United States Patent
Troost et al.

(10) Patent No.: US 10,226,492 B2
(45) Date of Patent: Mar. 12, 2019

(54) PROBIOTIC AND NEW BIOMARKER

(71) Applicant: DSM IP ASSETS B.V., Heerlen (NL)

(72) Inventors: Frederik Jan Troost, Maastricht (NL); Zlatan Mujagic, Stein (NL); Maria Margaretha Faas, Groningen (NL); Paulus De Vos, Slochteren (NL)

(73) Assignee: DSM IP ASSETS B.V., Heerlen (NL)

( * ) Notice: Subject to any disclaimer, the term of this patent is extended or adjusted under 35 U.S.C. 154(b) by 0 days.

(21) Appl. No.: 15/529,079

(22) PCT Filed: Nov. 25, 2015

(86) PCT No.: PCT/EP2015/077642
§ 371 (c)(1),
(2) Date: May 23, 2017

(87) PCT Pub. No.: WO2016/083450
PCT Pub. Date: Jun. 2, 2016

(65) Prior Publication Data
US 2017/0258858 A1     Sep. 14, 2017

(30) Foreign Application Priority Data

Nov. 25, 2014  (EP) .................................. 14194725
Nov. 25, 2014  (EP) .................................. 14194729

(51) Int. Cl.
| | | |
|---|---|---|
| *C12N 1/20* | (2006.01) | |
| *A61K 35/747* | (2015.01) | |
| *A23L 33/135* | (2016.01) | |
| *C12N 5/078* | (2010.01) | |
| *C12R 1/25* | (2006.01) | |
| *G01N 33/50* | (2006.01) | |

(52) U.S. Cl.
CPC .......... *A61K 35/747* (2013.01); *A23L 33/135* (2016.08); *C12N 1/20* (2013.01); *C12N 5/0634* (2013.01); *C12R 1/25* (2013.01); *G01N 33/5047* (2013.01); *A23V 2002/00* (2013.01); *A23Y 2220/67* (2013.01)

(58) Field of Classification Search
CPC ....... A23L 33/135; A61K 35/747; C12N 1/20; C12N 5/0634
See application file for complete search history.

(56) References Cited

U.S. PATENT DOCUMENTS

| | | |
|---|---|---|
| 2006/0257384 A1 | 11/2006 | Molin et al. |
| 2014/0335066 A1 | 11/2014 | Mikelsaar et al. |
| 2015/0240200 A1 | 8/2015 | Tsai et al. |

FOREIGN PATENT DOCUMENTS

| | | |
|---|---|---|
| CN | 102747012 A | 10/2012 |
| FR | 2848115 A1 | 6/2004 |
| WO | 2009/035330 A1 | 3/2009 |
| WO | 2011/092261 A1 | 8/2011 |
| WO | 2014/184644 A1 | 11/2014 |

OTHER PUBLICATIONS

Zhang, Zhuo-Yang et al., "Complete Genome Sequence of Lactobacillus plantarum JDM1", Journal of Bacteriology, American Society for Microbiology, Aug. 1, 2009, pp. 5020-5021, vol. 191, No. 15.
Kleerebezem, Michiel et al., "Complete genome sequence of Lactobacillus plantarum WCFS1", Proceedings of the National Academy of Sciences, National Academy of Sciences, Feb. 18, 2003, pp. 1990-1995, vol. 100, No. 4.
International Search Report of International Patent Application No. PCT/EP2015/07642 dated May 24, 2016.

*Primary Examiner* — Padmavathi Baskar
(74) *Attorney, Agent, or Firm* — McBee Moore Woodward & Vanik IP, LLC; Susan McBee; Chester Moore

(57) ABSTRACT

The present invention relates to a new probiotic with immune modulating properties and to a new biomarker.

Figure 1A:
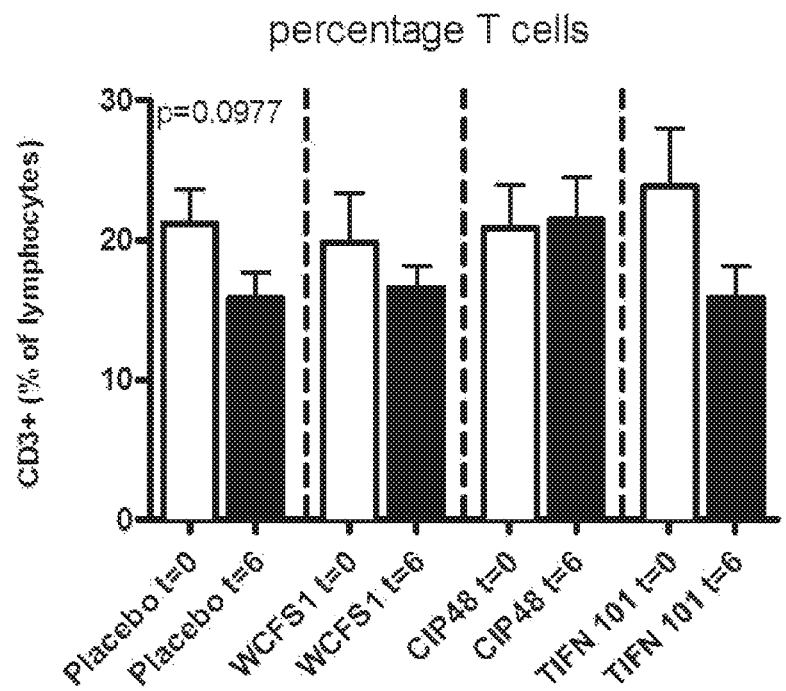
Figure 1B:
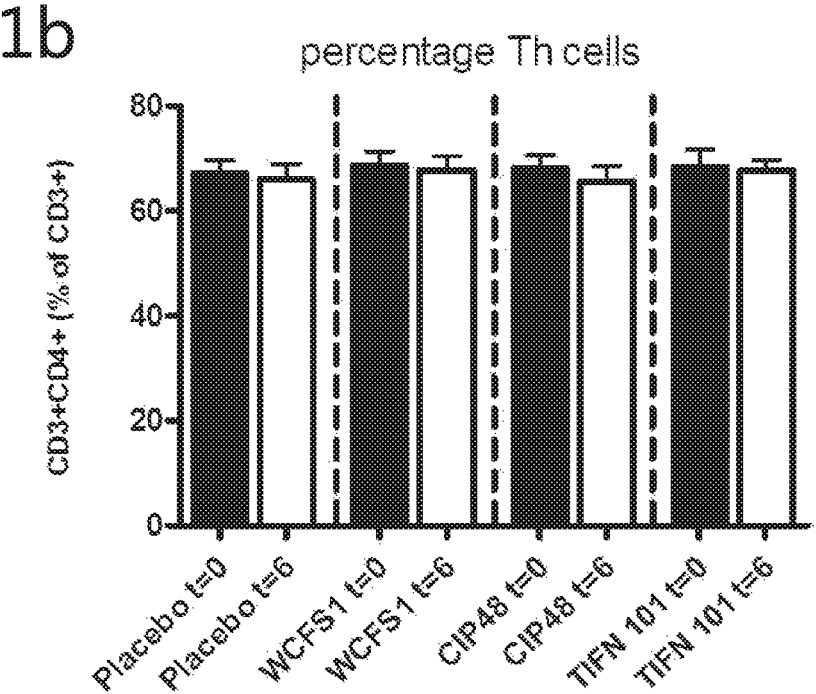
Figure 1C:
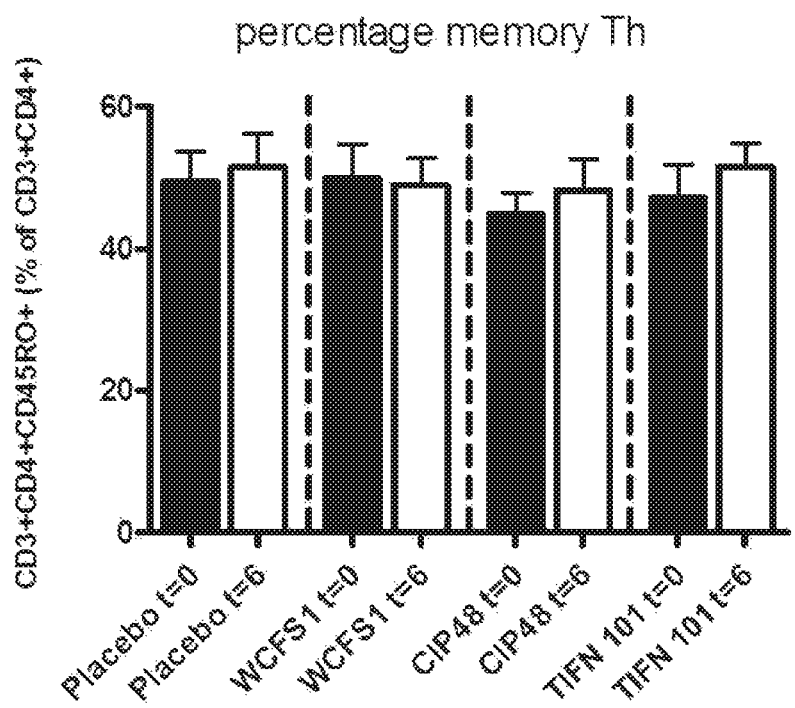
Figure 1D:
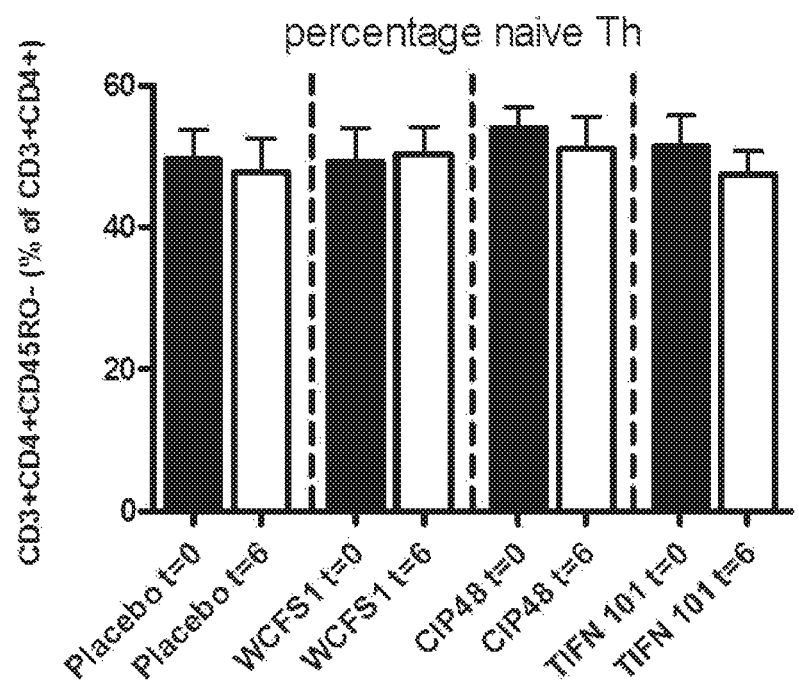
Figure 1E:
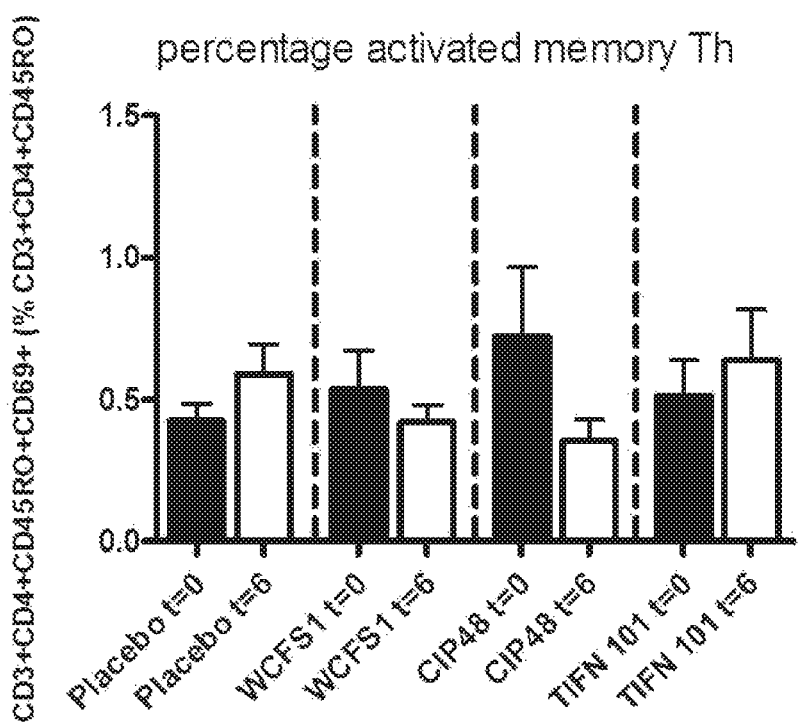
Figure 1F:
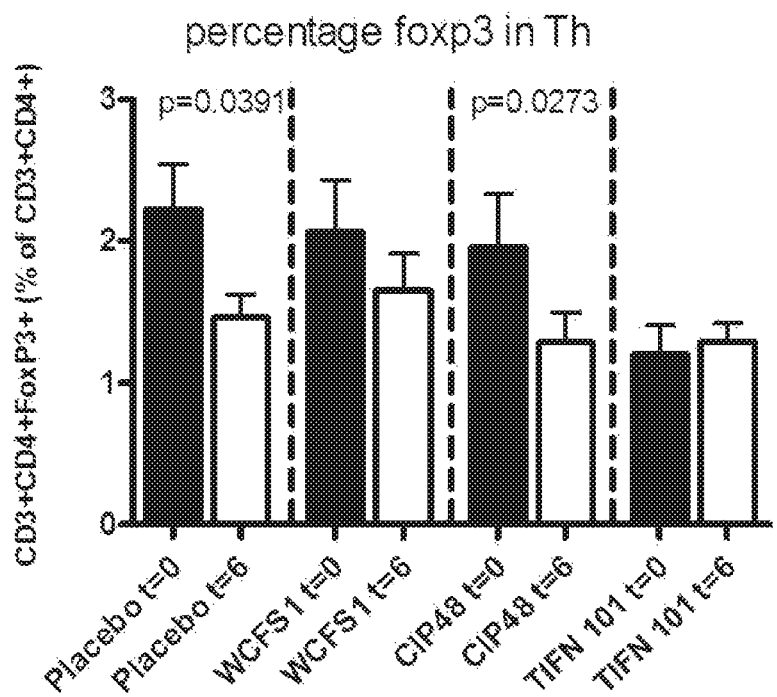
Figure 1G:
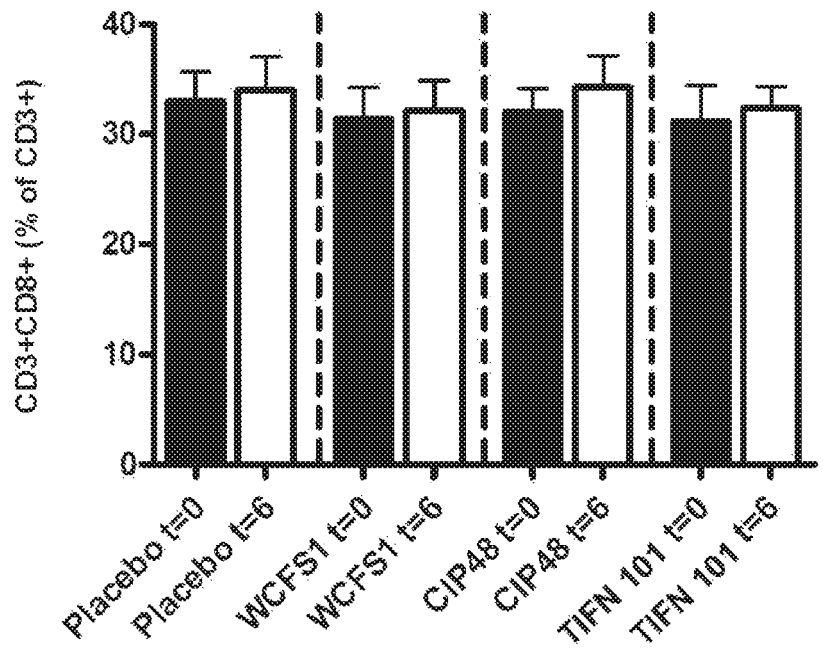
Figure 1H:
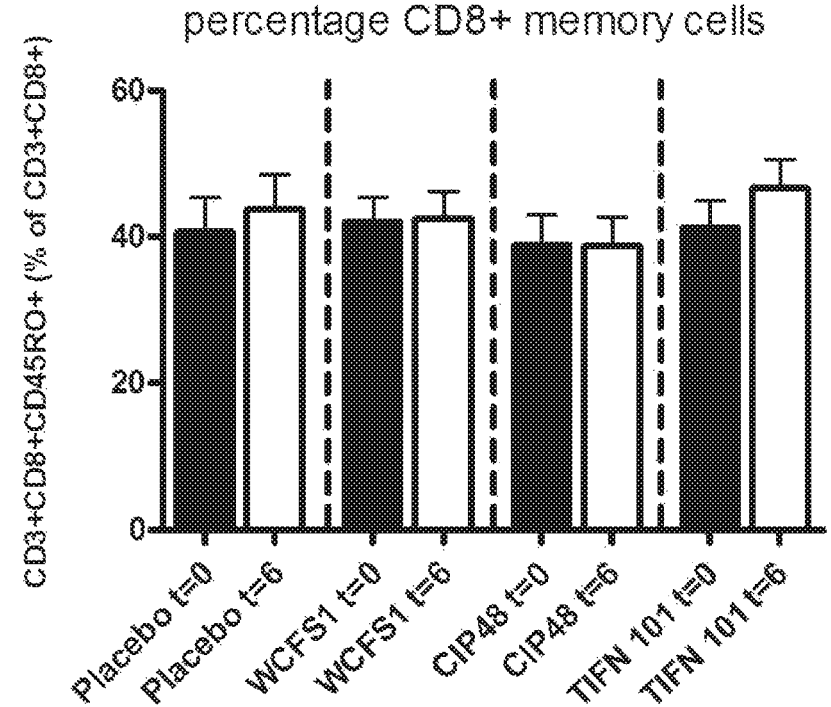
Figure 1I:
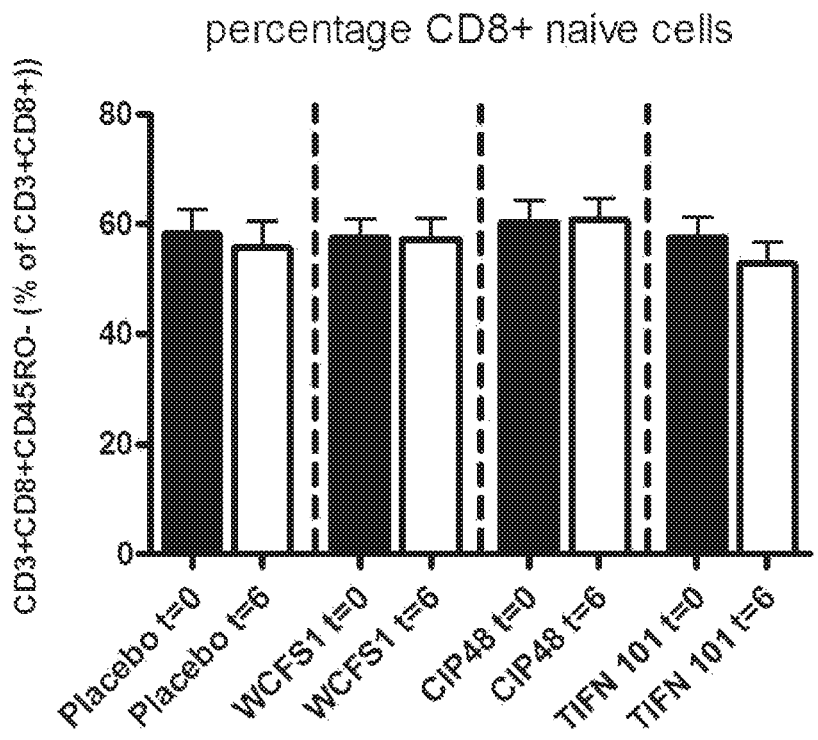
Figure 1J:
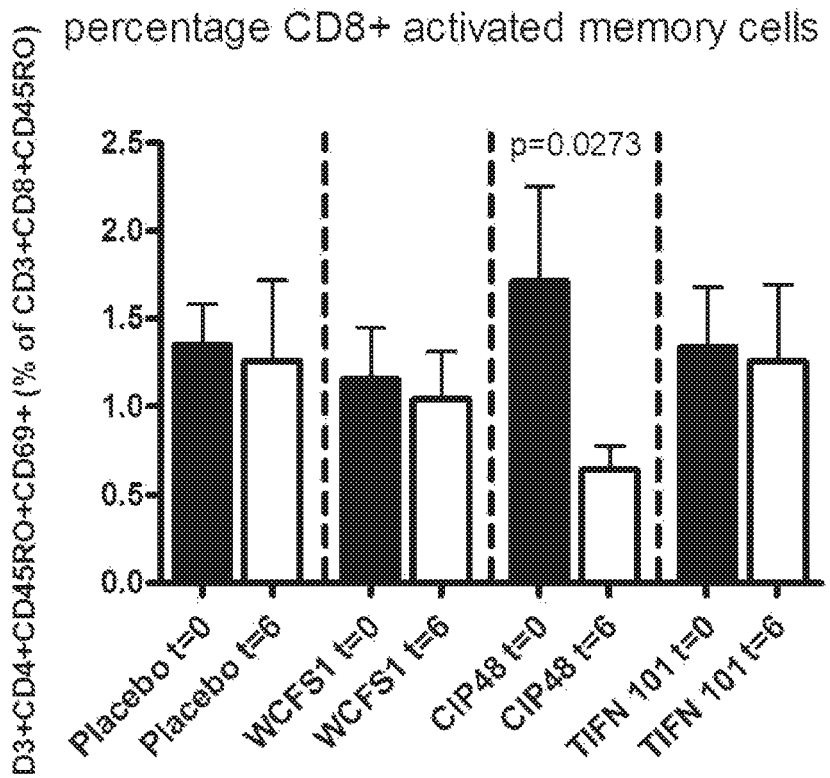

8 Claims, 12 Drawing Sheets
Specification includes a Sequence Listing.

PROBIOTIC AND NEW BIOMARKER

CROSS-REFERENCE TO RELATED APPLICATIONS

This application is a National Stage entry of International Application No. PCT/EP2015/077642, filed Nov. 25, 2015, which claims priority to European Patent Application No. 14194729.1, filed Nov. 25, 2014 and European Patent Application No. 14194725.9, filed Nov. 25, 2014.

REFERENCE TO SEQUENCE LISTING SUBMITTED AS A COMPLIANT ASCII TEXT FILE (.txt)

Pursuant to the EFS-Web legal framework and 37 CFR §§ 1.821-825 (see MPEP § 2442.03(a)), a Sequence Listing in the form of an ASCII-compliant text file (entitled "2919208-451000_Seq-Listing-as-filed_May-23-2017.txt" created on 12 May 2017, and 8,102,576 bytes in size) is submitted concurrently with the instant application, and the entire contents of the Sequence Listing are incorporated herein by reference.

FIELD OF THE INVENTION

The present invention relates to a new probiotic with immune modulating properties and to a new biomarker.

BACKGROUND OF THE INVENTION

During recent years it has become generally accepted that adequate function of the human immune system depends on the complex interaction of the microbiota with the human mucosa (Belkaid et al., 2014; Cao et al., 2014). In normal health, nonpathogenic bacteria activate the immune system to induce tolerance to microbiota essential for energy harvesting and immune development (de Kivit et al., 2014; Geuking et al., 2014; Walker et al., 2014). However, under specific conditions immune responses may occur against microbes that contribute to the development of diseases such as IBD (Meijerink et al., 2010). Human health may benefit from more insight in how microorganisms contribute to homeostasis of immune responses and how they prevent inflammation. The hope is it will lead to design of tailored interventions.

Commensal *Lactobacilli* species may play an active role in the maintenance of homeostasis of immune responses by guiding the polarization of T-cells toward regulatory T (Treg) cells and suppression of allergy associated Th2 responses (Smelt et al., 2013). This is considered to be accomplished by the interactions of bacterial cell wall components or secreted bacterial products that interact with immune or epithelial cells in the human mucosa (Walker et al., 2014). These interactions however seem to contribute to more than just tolerance to the beneficial microbes. In many studies *Lactobacilli* have been shown to have a positive impact on immune responses as shown in several vaccination studies (Meijerink et al., 2012; Wells et al., 2011). Also, *Lactobacilli* activate more general tolerogenic cellular pathways in humans as recently shown (van Baarlen et al., 2010; van Baarlen et al., 2009).

*Lactobacilli plantarum* is a well characterized food-derived bacterium (van Baarlen et al., 2009). In previous studies it has been shown that *Lactobacilli plantarum* strains have different effects on human dendritic cells and human peripheral blood mononuclear cells (Meijerink et al., 2010; Meijerink et al., 2012; Wells et al., 2011; van Baarlen et al., 2010; van Baarlen et al., 2009; Van Hemert et al., 2010). By applying comparative genome hybridization a number of bacteriocins and cell-wall components involved in glycosylation of cell wall teichoic acids have been identified that are associated with these differential effects (Meijerink et al., 2010; Meijerink et al., 2012; Wells et al., 2011; van Baarlen et al., 2010; van Baarlen et al., 2009; Van Hemert et al., 2010; Smet et al., 2013). It is assumed that this differential expression of *Lactobacilli plantarum* genes contributes to the observed differences in activation of Toll-like receptor (TLR)2-4, CD14 antigens, and nucleotide-binding oligomerization domain-containing 2 (NOD2) (Meijerink et al., 2010). As a consequence of differences in TLR-binding, *Lactobacillus plantarum* strains induce upon incubation with monocytes or dendritic cells different quantities of the proinflammatory cytokine IL12 and the regulatory cytokine IL10 (Meijerink et al., 2010; Meijerink et al., 2012; Wells et al., 2011; van Baarlen et al., 2010; van Baarlen et al., 2009; Van Hemert et al., 2010; Smet et al., 2013; Smelt et al., 2013). The gastrointestinal barrier may be disrupted on almost a daily basis by e.g. nonsteroidal anti-inflammatory drugs (NAISDs), sports or alcohol intake and as such cause (mild) inflammation of the intestine. A mild stressor cytokine that is very common in the Western society is the consumption of an NSAID such as indomethacin. Millions are using NSAIDs for the treatment of musculoskeletal pain. A side effect of these NSAIDs is the mild inflammation of the intestine by disruption of the gastrointestinal immune barrier (Schoultz et al., 2012). As NSAIDs are used by millions worldwide there is an urgent need to treat such (mild) inflammation of the intestine.

Another issue where food derived antigens may play a role is in maintaining vaccination efficacy. It is well known that immune memory to an antigen encountered in past (some decades ago) may wane over time. When the individual encounters the antigen or pathogen associated with the antigen again, such waned immune memory may result in an insufficient response to the antigen or pathogen associated with the antigen (Deasy et al., 2013; Kerneis et al., 2014; Poorolajal et al., 2010; Schure et al., 2012).

Accordingly, there is an urgent need to preserve, maintain and/or reactivate the immune memory. This could not only revive a waned immune response, it could also render the host immune system more susceptible to vaccination protocols, which may be specifically beneficial for immune compromised individuals such as elderly. In addition, to identify and to demonstrate effects of immune modulating products, adequate biomarkers and assays are lacking. Accordingly, there is an urgent need for such biomarker and/or assay.

SUMMARY

Surprisingly, it has now been demonstrated that a specific *Lactobacillus* has immune modulating properties. Such specific *Lactobacillus* preferably also has anti-inflammatory properties.

Accordingly, in a first aspect the present invention provides a probiotic formulation comprising at least one food-grade substance and at least one probiotic bacterial strain which has at least 50% sequence identity with the genome of *Lactobacilli plantarum* TIFN 101 (deposited under number CBS 138100 at the Centraalbureau voor Schimmelcultures, Uppsalalaan 8, 3584 CT The Netherlands). Said probiotic formulation is herein referred to as a probiotic formulation according to the present invention. Said probiotic bacterial strain is herein referred to as a probiotic bacterial strain according to the present invention and has immune modulating properties and preferably also has anti-inflammatory properties.

A preferred probiotic bacterial strain according to the present invention comprises at least one polynucleotide that has at least 50% sequence identity with a polynucleotide sequence selected from the group consisting of SEQ ID NO: 1-SEQ ID NO: 174.

DETAILED DESCRIPTION OF A PREFERRED EMBODIMENT

Preferably, a probiotic bacterial strain according to the present invention comprises at least two, more preferably three, four, five, six, seven, eight, nine, ten, twenty, thirty, forty, fifty, sixty, seventy, eighty, ninety or most preferably hundred polynucleotides that each have at least 50% sequence identity with a polynucleotide sequence selected from the group consisting of SEQ ID NO: 1-SEQ ID NO: 174.

A further preferred probiotic bacterial strain according to the present invention comprises at least one polynucleotide that has at least 50% sequence identity with a polynucleotide sequence selected from the group consisting of SEQ ID NO: 176-SEQ ID NO: 256.

Preferably, a probiotic bacterial strain according to the present invention comprises at least two, more preferably three, four, five, six, seven, eight, nine, ten, twenty, thirty, forty, fifty, sixty, seventy, eighty, ninety or most preferably hundred polynucleotides that each have at least 50% sequence identity with a polynucleotide sequence selected from the group consisting of SEQ ID NO: 176-SEQ ID NO: 256.

A further preferred probiotic bacterial strain according to the present invention comprises at least one polynucleotide that has at least 50% sequence identity with a polynucleotide encoding a polypeptide with a sequence selected from the group consisting of SEQ ID NO: 260-SEQ ID NO: 340. Preferably, a probiotic bacterial strain according to the present invention comprises at least two, more preferably three, four, five, six, seven, eight, nine, ten, twenty, thirty, forty, fifty, sixty, seventy, eighty, ninety or most preferably hundred polynucleotides that each have at least 50% sequence identity with a polynucleotide encoding a polypeptide with a sequence selected from the group consisting of SEQ ID NO: 260-SEQ ID NO: 340.

The immune modulating properties can be assessed in vivo and in vitro. For a preferred assessment in vitro, Peripheral Blood Mononuclear Cells (PBMC) are isolated from blood and stimulated with an antigen and the probiotic bacterial strain or a part or an extract thereof.

An immune modulating property of a probiotic bacterial strain according to the present invention preferably is the ability to preserve, maintain and/or reactivate an immune response raised by a previous immunization and is preferably defined as the ability to maintain or increase the amount of a sub-population of PBMC within a population of PBMC. Preferably said sub-population is an antigen specific CD45RO+ population, preferably selected from CD3+/CD4+/CD45RO+ cells (memory Thelper cells), CD3+/CD4+/CD45RO+/CD69+ cells (activated memory Thelper cells), CD3+/CD8+/CD45RO+ cells (cytotoxic T cells), CD3+/CD8+/CD45RO+/CD69+ cells (activated memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells). Further preferred sub-populations are CD3+/CD4+/Foxp3+ cells (Foxp3+ Thelper cells), and IFNγ and/or IL17 producing CD3+/CD4+/CD45RO+ cells (IFNγ and/or IL17 producing memory Thelper cells). Preferably, the sub-population of CD3+/CD4+/Foxp3+ cells (Foxp3+ Thelper cells) and/or CD3+/CD8+/CD45RO+/CD69+ cells (activated memory T cells) are maintained in a subject that is administered a probiotic formulation or a probiotic bacterial strain according to the present invention. Preferably, the sub-population of IFNγ and/or IL17 producing CD3+/CD4+/CD45RO+ cells (IFNγ and/or IL17 producing memory Thelper cells) is increased in a subject that is administered a probiotic formulation or a probiotic bacterial strain according to the present invention.

Preferably, the antigen is a recall antigen by purposive or non-purposive immunization, i.e. an antigen that the individual has encountered previously; more preferably, the recall antigen is selected from the group consisting of tetanus toxin, Hepatitis B antigen and Influenza. Preferably, an increase in the amount of the specific sub-population of PBMC is at least 10%, 20%, 30%, 40%, 50%, 60%, 70%, 80%, 90%, 100% (i.e. a 1-fold increase), a 2-fold increase, a 3-fold increase, a 4-fold increase, a 6-fold increase, a 10-fold increase, a 50-fold increase, a 100-fold increase, a 1000-fold increase, or at least a 10,000-fold increase. Such increase can be measured by any assay known by the person skilled in the art and is preferably measured with an assay as described herein.

A further preferred immune modulating property is enhanced cytokine production of memory Thelper cells, more preferably activated memory Thelper cells; preferably the percentage of IL-17-producing (activated) memory Th cells and/or the percentage of IFNγ-producing (activated) memory Th cells is/are increased compared to a control that has no probiotic according to the present invention administered. The increase in percentage is preferably at least 10%, 20%, 30%, 40%, 50%, 60%, 70%, 80%, 90%, 100% (i.e. a 1-fold increase), a 2-fold increase, a 3-fold increase, a 4-fold increase, a 6-fold increase, a 10-fold increase, a 50-fold increase.

A further preferred immune modulating property of a probiotic formulation or a probiotic bacterial strain according to the present invention is the induction of a change in IL10/IL12 ratio by dendritic cells when assayed according to Meijerink et al., 2010, preferably a change into a relatively high IL10/IL12 ratio. The increase in ratio is preferably at least 10%, 20%, 30%, 40%, 50%, 60%, 70%, 80%, 90%, 100% (i.e. a 1-fold increase), a 2-fold increase, a 3-fold increase, a 4-fold increase, a 6-fold increase, a 10-fold increase, a 50-fold increase.

A further preferred immune modulating property is the induction of a differential transcriptional response in duodenal mucosa. Preferably, a gene encoding a compound selected from the group consisting of immunoglobulin lambda variable 6-57, putative V-set and immunoglobulin domain-containing protein 6-like, immunoglobulin lambda variable 7-46, interferon regulatory factor 4, GDNF family, CD27, CD79a, and plasminogen activator is upregulated. The upregulation is preferably an increase of expression level of at least 10%, 20%, 30%, 40%, 50%, 60%, 70%, 80%, 90%, 100% (i.e. a 1-fold increase), a 2-fold increase, a 3-fold increase, a 4-fold increase, a 6-fold increase, a 10-fold increase, a 50-fold increase.

A further preferred immune modulating property is the upregulation of MHC-II α in the duodenal mucosa. The upregulation is preferably an increase of at least 10%, 20%, 30%, 40%, 50%, 60%, 70%, 80%, 90%, 100% (i.e. a 1-fold increase), a 2-fold increase, a 3-fold increase, a 4-fold increase, a 6-fold increase, a 10-fold increase, a 50-fold increase. The immune modulating properties according to the present invention can be combined properties of a probiotic bacterial strain according to the present invention.

A probiotic formulation according to the present invention may comprise at least one further bacterial strain, which is preferably a probiotic bacterial strain.

A probiotic formulation according to the present invention comprises at least a probiotic bacterial strain according to the present invention and at least one food-grade substance.

A food-grade substance is herein further referred to as a food-grade substance according to the present invention and is a substance suitable for consumption by a subject, preferably a human or an animal, more preferably a human. A food-grade substance may be of plant or animal origin, and may contain essential nutrients, such as carbohydrates, fats, proteins, vitamins, and/or minerals. A food-grade substance may be intended for ingestion by an organism and subsequently assimilation by the organism's cells to produce energy, maintain life, and/or stimulate growth. A food-grade substance according to the present invention includes but is not limited to a substance selected from the group consisting of a dairy-, grain-, vegetable-, fruit-, fish-, or meat-based product.

The term "based product" is herein defined that the food-grade substance is produced from a specific raw material such as dairy, grain, vegetable, fruit, fish, or meat. The food-grade substance may be based on a mixture of different raw materials e.g. a mixture of dairy and grain or a mixture of meat and fruit.

A probiotic bacterial strain may be any probiotic bacterial strain. Probiotics are live microorganisms which, when administered in adequate amounts, confer a health benefit on the host (FAO/WHO, *Evaluation of health and nutritional properties of powder milk with live lactic acid bacteria. Report of FAO/WHO expert consultation* 1-4 Oct. 2001). The most widely applied probiotics belong to the genera *Lactobacillus* and *Bifidobacterium* (Marco et al., 2006). Their beneficial effects are exerted via several mechanisms, including the modulation of the intestinal microbiota, the production of antibacterial substances, improvement of epithelial barrier function, and reduction of intestinal inflammation (Corr, et al., 2009; Saulnier et al., 2009; Saxelin et al., 2005). Probiotics are most commonly provided through ingestion of freshly fermented food products or dried bacterial preparations. The viability of probiotic strains is considered an important trait for probiotic functionality; reaching their side of action in the intestine alive is thus considered an important trait for probiotic strains (Ma et al., 2004; Gobbetti et al., 2010). The present invention provides for a probiotic bacterial strain. A preferred probiotic bacterial strain according to the present invention is a bacterial strain selected from the group consisting of the genera of *Lactobacillus, Lactococcus, Leuconostoc, Carnobacterium, Streptococcus, Bifidobacterium, Bacteroides, Eubacterium, Clostridium, Fusobacterium, Propionibacterium, Enterococcus, Staphylococcus, Peptostreptococcus,* and *Escherichia*, preferably consisting of *Lactobacillus* and *Bifidobacterium*. Preferred species of *Lactobacillus, Bifidobacterium, Streptococcus, Leuconostoc* and *Pediococcus*. are *Lactobacillus reuteri, L. fermentum, L. acidophilus, L. crispatus, L. gasseri, L. johnsonii, L. plantarum, L. paracasei, L. murinus, L. jensenii, L. salivarius, L. minutis, L. brevis, L. gallinarum, L. amylovorus, Streptococcus thermophilus, Leuconostoc mesenteroides, Pediococcus damnosus, P. acidilactici, P. parvulus, Bifidobacterium bifidum, B. longum, B. infantis, B. breve, B. adolescente, B. animalis, B. gallinarum, B. magnum,* and *B. thermophilum*. The *Lactobacillus* bacterium is preferably *Lactobacilli plantarum*, more preferably a *Lactobacilli plantarum* from the group consisting of *Lactobacilli plantarum* JDM1, ST-III, F9UP33, EITR17, D7V971 (ATCC14917) and C6VQ24, even more preferably *Lactobacilli plantarum* WCFS1 and most preferably *Lactobacilli plantarum* TIFN 101.

It is understood that replicates and/or derivatives of the deposited strains or any other strain according to the present invention are encompassed by the invention. The term "replicate" refers to the biological material that represents a substantially unmodified copy of the material, such as material produced by growth of micro-organisms, e.g. growth of bacteria in culture media. The term "derivative" refers to material created from the biological material and which is substantially modified to have new properties, for example caused by heritable changes in the genetic material. These changes can either occur spontaneously or be the result of applied chemical and/or physical agents (e.g. mutagenesis agents) and/or by recombinant DNA techniques as known in the art. When referring to a strain "derived" from another strain, it is understood that both "replicates" of that strain, as well as "derivatives" of the strain are encompassed, as long as the derived strain still retains the immunomodulating capabilities of the strain from which it was derived.

Preferably, in a probiotic formulation according to the present invention, the concentration of probiotic bacterial strains ranges from about 1 to about 99 weight percent, more preferably from about 5 to about 90 weight percent, more preferably from about 5 to about 80, more preferably from about 5 to about 70, more preferably from about 5 to about 60, more preferably from about 10, 20, 30, or 40 to about 50 weight percent with respect to the total weight of the formulation, and/or about 1 E+4, 1 E+5, or 1 E+6 to about 1 E+8, 1 E+9, 1 E+10, 1 E+11, or 1 E+12 colony forming units/ml of formulation, even more preferably about 1×10 E+6 to about 1×10 E+12 colony forming units/ml of formulation.

More preferably, in a probiotic formulation according to the present invention, the concentration of probiotic bacterial strains ranges from 1 to 99 weight percent, more preferably from 5 to 90 weight percent, more preferably from 5 to 80, more preferably from 5 to 70, more preferably from 5 to 60, more preferably from 10, 20, 30, or 40 to 50 weight percent with respect to the total weight of the formulation, and/or 1 E+4, 1 E+5, or 1 E+6 to 1 E+8, 1 E+9, 1 E+10, 1 E+11, or 1 E+12 colony forming units/ml of formulation, even more preferably 1×10 E+6 to 1×10 E+12 colony forming units/ml of formulation. A colony forming unit is a term known to the person skilled in the art and one unit typically refers to the amount of bacteria that forms one colony on a culture plate; it is a term to refer to viable bacteria.

Even more preferably, in a probiotic formulation according to the present invention, the concentration of probiotic bacterial strains ranges from about 10 to about 50 weight percent with respect to the total weight of the formulation and/or about 1 E+6 to about 1 E+12 colony forming units/ml of formulation.

The probiotic formulation or a probiotic bacterial strain according to the present invention may be in any form or state of constitution known to the person skilled in the art. The probiotic formulation or a probiotic bacterial strain according to the present invention may be part of a (compressed) tablet or pill or may be contained within another vehicle such as a container or a capsule, a gel, or a drop. A preferred vehicle is a container with a liquid volume between 0.5 and 50 ml suitable for comprising, preferably comprising a probiotic formulation or a probiotic bacterial strain according to the present invention.

The probiotic formulation or a probiotic bacterial strain according to the present invention may also conveniently be comprised in a food substance. Accordingly, in a second aspect, the present invention provides for a food product, a formulation for food enrichment, a food supplement, a nutraceutical formulation or a pharmaceutical formulation comprising a probiotic formulation or a probiotic bacterial strain according to the present invention. A food product according to the present invention is preferably a food-grade substance as described previously herein.

A food, food composition, nutraceutical formulation, formulation for food enrichment, food supplement and pharmaceutical formulation according to the present invention is herein understood to include liquids for human or animal consumption, i.e. a drink or beverage. The food, food composition, nutraceutical formulation, formulation for food enrichment, food supplement and pharmaceutical formulation may be a solid, semi-solid, semi-liquid and/or liquid food or food substance, and in particular may be a dairy product, such as a fermented dairy product, including but not limited to a yoghurt, a yoghurt-based drink, a yoghurt-like drink, a cheese or a buttermilk. Such foods may be prepared in a manner known per se, e.g. by adding a probiotic formulation or a probiotic bacterial strain according to the present invention to a suitable food or food-grade substance, in a suitable amount. In doing so, probiotic formulation or a probiotic bacterial strain according to the present invention may be used in a manner known per se for the preparation of such (fermented) food or food-grade substance, e.g. in a manner known per se for the preparation of fermented dairy products using a probiotic formulation or a probiotic bacterial strain according to the present invention. In such methods, a probiotic formulation or a probiotic bacterial strain according to the present invention may be used in addition to the micro-organism usually used, and/or may replace one or more or part of the micro-organism usually used. For example, in the preparation of fermented dairy products such as yoghurt or yoghurt-based drinks, a probiotic formulation or a probiotic bacterial strain according to the present invention may be added to or used as part of a starter culture or may be suitably added during such a fermentation.

A pharmaceutical formulation (or pharmaceutical composition) comprising a probiotic formulation or a probiotic bacterial strain according to the present invention may be for human or animal usage in human and veterinary medicine, particularly for human therapy, and comprises at least a probiotic formulation or a probiotic bacterial strain according to the present invention and a pharmaceutically accepted excipient. The pharmaceutically accepted excipient may be any such excipient known to the person skilled in the art such as a pharmaceutically or nutritionally acceptable carrier or diluent. Examples of such suitable excipient for a pharmaceutical formulation described herein may be found in the "Handbook of Pharmaceutical Excipients", 2nd Edition, (1994), Edited by A Wade and P J Weller and in "Remington's Pharmaceutical Sciences", Mack Publishing Co. (A. R. Gennaro edit. 1985). Examples of suitable carriers include lactose, starch, glucose, methyl cellulose, magnesium stearate, mannitol, sorbitol and the like. Examples of suitable diluents include saline, glycerol, water and mixtures thereof.

A food, food composition, nutraceutical formulation, formulation for food enrichment, food supplement and pharmaceutical formulation according to the present invention is preferably present in a container with a liquid volume between 0.5 and 1000 ml. Accordingly, the present invention provides for a container with a liquid volume between 0.5 and 1000 ml comprising a food, food composition, nutraceutical formulation, formulation for food enrichment, food supplement and pharmaceutical formulation according to the present invention.

The probiotic formulation according to the present invention and/or a probiotic bacterial strain which has at least 50% sequence identity with the genome of *Lactobacillus plantarum* TIFN 101, can conveniently be used as a medicament, preferably for the treatment or prevention of intestinal inflammation.

Accordingly, in a third aspect the present invention provides for a probiotic bacterial strain according to the present invention, and/or a probiotic formulation or a pharmaceutical formulation according to the present invention, preferably as defined in the first and/or second aspect of the present invention, for use as a medicament, preferably in the treatment or prevention of intestinal inflammation.

The present invention also provides for a method of treatment of intestinal inflammation or a method of prevention of intestinal inflammation comprising administration of a probiotic bacterial strain according to the present invention, and/or a probiotic formulation or a pharmaceutical formulation according to the present invention, preferably as defined in the first and/or second aspect of the present invention.

Intestinal inflammation within the scope of the present invention may be any intestinal inflammation known to the person skilled in the art, such as but not limited to inflammation caused by nonsteroidal anti-inflammatory drugs (NAISDs), sports, alcohol intake, irritable bowel syndrome, allergy, celiac disease, inflammatory bowel disease, Crohn's disease, gastrointestinal related autoimmune diseases such as Type I diabetes.

The probiotic formulation according to the present invention and/or a probiotic bacterial strain according to the present invention, can conveniently be used for modulation of the immune system, wherein modulation of the immune system is preferably as described previously herein. Accordingly, in a fourth aspect, the present invention provides for a probiotic bacterial strain according to the present invention, and/or a probiotic formulation according to the present invention or a pharmaceutical formulation according to the present invention for use as a medicament comprising administration of an effective amount of the probiotic bacterial strain according to the present invention and/or of the probiotic formulation or a pharmaceutical formulation according to the present invention for modulating the immune system, wherein modulation of the immune system is preferably as described previously herein.

The present invention also provides for a method of modulating the immune system of a subject suffering from intestinal inflammation, comprising administration to said subject an effective amount of a probiotic bacterial strain according to the present invention and/or an effective amount a probiotic formulation according to the present invention or a pharmaceutical composition according to the present invention.

Preferably, in this aspect of the present invention, an effective amount is about 1 E+4, 1 E+5, or 1 E+6 to about 1 E+8, 1 E+9, 1 E+10, 1 E+11, or 1 E+12 colony forming units/ml of formulation, more preferably about $1 \times 10$ E+6 to about $1 \times 10$ E+12 colony forming units/ml of formulation. More preferably, an effective amount is 1 E+4, 1 E+5, or 1

E+6 to 1 E+8, 1 E+9, 1 E+10, 1 E+11, or 1 E+12 colony forming units/ml of formulation, even more preferably 1×10 E+6 to 1×10 E+12 colony forming units/ml of formulation.

Preferably, modulation of the immune system according to this aspect of the invention comprises maintenance and/or reactivation of an immune response raised by a previous immunization and/or enhancing memory T-cells generated previously by immunization, as described previously herein.

To identify and to demonstrate the effects of immune modulating products such as described in the previous aspects of the present invention, adequate biomarkers and assays are presented herein.

Provided is a method for the detection of a response to an agent comprising:
  a. stimulating PBMC from a sample of a subject with at least one antigen,
  b. identifying a sub-population of PBMC,
  c. comparing the data from (b) to data of a, preferably otherwise identically assayed, reference sample, of preferably the same subject, which reference sample has not been stimulated with the at least one antigen of (a),
wherein a difference in data identified in (c) is a measure for a response to the agent. The method is herein further referred to as an assay or a method as presented herein. An assay as presented herein preferably involves flow cytometry and preferably is a fluorescence activated cell scanning or -sorting (FACS) assay. FACS (see e.g. The Molecular Probes Handbook. A Guide to Fluorescent Probes and Labeling Technologies (I. Johnson and M. Spence (eds.) 11th Edition, Life Technologies, 2010) is a method by which the individual cells of a sample are analyzed and sorted according to their optical properties (i.e. light absorbance, light scattering, fluorescence properties, etc.) as they pass in a narrow stream in single file through a laser beam. The Fluorescence Activated Cell Sorter was invented in the late 1960s by Bonner, Sweet, Hulett, Herzenberg, and others to perform flow cytometry and cell sorting of viable cells. Becton Dickinson Immunocytometry Systems introduced the commercial machines in the early 1970s. Fluorescence-activated cell sorting (FACS) is a specialized type of flow cytometry. It provides a method for sorting a heterogeneous mixture of biological cells into two or more containers, one cell at a time, based upon the specific light scattering and fluorescent characteristics of each cell. It is a useful scientific instrument, as it provides fast, objective and quantitative recording of fluorescent signals from individual cells as well as physical separation of cells of particular interest.

The cell suspension is entrained in the center of a narrow, rapidly flowing stream of liquid. The flow is arranged so that there is a large separation between cells relative to their diameter. A vibrating mechanism causes the stream of cells to break into individual droplets. The system is adjusted so that there is a low probability of more than one cell per droplet. Just before the stream breaks into droplets, the flow passes through a fluorescence measuring station where the fluorescent character of interest of each cell is measured. An electrical charging ring is placed just at the point where the stream breaks into droplets. A charge is placed on the ring based on the immediately prior fluorescence intensity measurement, and the opposite charge is trapped on the droplet as it breaks from the stream. The charged droplets then fall through an electrostatic deflection system that diverts droplets into containers based upon their charge. In some systems, the charge is applied directly to the stream, and the droplet breaking off retains charge of the same sign as the stream. The stream is then returned to neutral after the droplet breaks off.

A wide range of fluorophores can be used as labels in flow cytometry. Fluorophores, or simply "fluors," are typically attached to an antibody that recognizes a target feature on or in the cell; they may also be attached to a chemical entity with affinity for the cell membrane or another cellular structure. Each fluorophore has a characteristic peak excitation and emission wavelength, and the emission spectra often overlap. Consequently, the combination of labels which can be used depends on the wavelength of the lamp(s) or laser(s) used to excite the fluorochromes and on the detectors available. Fluorescence-activated cell sorting provides a rapid means of isolating large numbers of fluorescently tagged cells from a heterogeneous mixture of cells.

Positive detection of a response to an agent in a flow cytometry assay as depicted here above, preferably relies on the difference, preferably quantitative difference, of a specific sub-population of PBMC between a sample stimulated with an antigen compared to a reference sample not stimulated with said antigen, as depicted here above.

A person skilled in the art is well aware of stimulation assays and using FACS as a tool for read-out. Preferably, the assays described in the examples are used in a method as presented herein.

Preferably, the difference is an increase or maintenance in the amount of the specific sub-population of PBMC. In case the sub-population does not change in a non-stimulated reference sample, the difference is preferably an increase in the amount of the specific sub-population of PBMC in the stimulated sample. In case the sub-population does not change in the non-stimulated reference sample, the difference is preferably maintenance (no change) or an increase in the amount of the specific sub-population of PBMC in the stimulated sample.

Preferably, the sub-population is a population selected from the group consisting of CD3+/CD4+ (Thelper cells), CD3+/CD4+/CD45RO− (naïve Thelper cells), CD3+/CD4+/Foxp3+ cells (Foxp3+ Thelper cells), CD3+/CD4+/CD45RO+ (memory Thelper cells), CD3+/CD4+/CD45RO+/CD69+ (activated memory Thelper cells), CD3+/CD8+/CD45RO− (naïve CD8+ cells), CD3+/CD8+/CD45RO+ (CD8+ memory T cells), CD3+/CD8+/CD45RO+/CD69+ (activated CD8+ memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells).

More preferably the sub-population is an antigen specific CD45RO+ population, preferably selected from CD3+/CD4+/CD45RO+ cells (memory Thelper cells), CD3+/CD4+/CD45RO+/CD69+ cells (activated memory Thelper cells), CD3+/CD8+/CD45RO+ cells (CD8+ memory T cells), CD3+/CD8+/CD45RO+/CD69+ cells (activated memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells). Further preferred sub-populations are CD3+/CD4+/Foxp3+ cells (Foxp3+ Thelper cells), and IFNγ and/or IL17 producing CD3+/CD4+/CD45RO+ cells (IFNγ and/or IL17 producing memory Thelper cells).

Preferably, in an assay as presented herein, the response is an immune response, preferably modulation of an existing immune response, more preferably an increase of an existing immune response, such existing immune response preferably being as described previously herein.

Preferably, in a method as presented herein, the agent is a food product, preferably a probiotic, more preferably the agent or part thereof comprises a membrane of a probiotic.

Preferably, in a method as presented herein, the sample comprises a bodily fluid; preferably the sample is a blood sample.

A blood sample in the context of the present invention preferably is a sample of whole blood or of a sub-population of cells of whole blood. Sub-populations of cells of whole blood include but are not limited to PBMC or a sub-population thereof such as lymphocytes, monocytes, and macrophages. PBMC are a critical component of the immune system to fight infection and adapt to intruders.

Preferably, in a method as presented herein, the at least one antigen in (a) is selected from the group consisting of a general T cell stimulator such as a superantigen, a Protein Kinase A (PKA) stimulator such as a lectin, a recall antigen, i.e. an antigen that the individual has encountered previously, preferably selected from the group consisting of tetanus toxin, Hepatitis B antigen and Influenza, or the agent or a part thereof.

Preferably, in a method as presented herein, the at least one antigen of (a) comprises at least:
  a. a recall antigen such as tetanus toxin, a Hepatitis B antigen or an Influenza antigen, and
  b. the agent or a part thereof.

Preferably, in a method presented herein, the sub-population is a population selected from the group consisting of CD3+/CD4+ (Thelper cells), CD3+/CD4+/CD45RO− (naïve Thelper cells), CD3+/CD4+/Foxp3+ cells (Foxp3+ Thelper cells), CD3+/CD4+/CD45RO+ (memory Thelper cells), CD3+/CD4+/CD45RO+/CD69+ (activated memory Thelper cells), CD3+/CD8+/CD45RO− (naïve CD8+ cells), CD3+/CD8+/CD45RO+ (CD8+ memory T cells), CD3+/CD8+/CD45RO+/CD69+ (activated CD8+ memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells).

More preferably the sub-population is an antigen specific CD45RO+ population, preferably selected from CD3+/CD4+/CD45RO+ cells (memory Thelper cells), CD3+/CD4+/CD45RO+/CD69+ cells (activated memory Thelper cells), CD3+/CD8+/CD45RO+ cells (CD8+ memory T cells), CD3+/CD8+/CD45RO+/CD69+ cells (activated memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells). Further preferred sub-populations are CD3+/CD4+/Foxp3+ cells (Foxp3+ Thelper cells), and IFNγ and/or IL17 producing CD3+/CD4+/CD45RO+ cells (IFNγ and/or IL17 producing memory Thelper cells).

Preferably, in a method as presented herein, the identification of the sub-population of PBMC comprises flow cytometry analysis as depicted here above; preferably the identification of the sub-population of PBMC comprises quantification. Quantification in an assay as presented herein, preferably relates to determining the percentage of one or more sub-populations of PBMC, preferably of at least one sub-population selected form the group consisting of CD3+/CD4+ (Thelper cells), CD3+/CD4+/CD45RO− (naïve Thelper cells), CD3+/CD4+/Foxp3+ cells (Foxp3+ Thelper cells), CD3+/CD4+/CD45RO+ (memory Thelper cells), CD3+/CD4+/CD45RO+/CD69+ (activated memory Thelper cells), CD3+/CD8+/CD45RO− (naïve CD8+ cells), CD3+/CD8+/CD45RO+ (CD8+ memory T cells), CD3+/CD8+/CD45RO+/CD69+ (activated CD8+ memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells).

More preferably the sub-population is an antigen specific CD45RO+ population, preferably selected from CD3+/CD4+/CD45RO+ cells (memory Thelper cells), CD3+/CD4+/CD45RO+/CD69+ cells (activated memory Thelper cells), CD3+/CD8+/CD45RO+ cells (CD8+ memory T cells), CD3+/CD8+/CD45RO+/CD69+ cells (activated memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells). Further preferred sub-populations are CD3+/CD4+/Foxp3+ cells (Foxp3+ Thelper cells), and IFNγ and/or IL17 producing CD3+/CD4+/CD45RO+ cells (IFNγ and/or IL17 producing memory Thelper cells).

Further provided is the use of a sub-population of PBMC as a biomarker for efficacy testing of immune modulating agents. The term biomarker (or biological marker) refers to a distinct biochemical, genetic, or molecular characteristic or substance that is an indicator of a particular biological condition or process. Within the context of the present invention, a sub-population of PBMC as defined herein is used as biomarker.

Preferably, the immune modulating agent is a food product, preferably a probiotic such as described previously herein. Preferably, the sub-population of PBMC one such as previously described herein; preferably, the sub-population is a population selected from the group consisting of CD3+/CD4+ (Thelper cells), CD3+/CD4+/CD45RO− (naïve Thelper cells), CD3+/CD4+/Foxp3+ cells (Foxp3+ Thelper cells), CD3+/CD4+/CD45RO+ (memory Thelper cells), CD3+/CD4+/CD45RO+/CD69+ (activated memory Thelper cells), CD3+/CD8+/CD45RO− (naïve CD8+ cells), CD3+/CD8+/CD45RO+ (CD8+ memory T cells), CD3+/CD8+/CD45RO+/CD69+ (activated CD8+ memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells).

More preferably the sub-population is an antigen specific CD45RO+ population, preferably selected from CD3+/CD4+/CD45RO+ cells (memory Thelper cells), CD3+/CD4+/CD45RO+/CD69+ cells (activated memory Thelper cells), CD3+/CD8+/CD45RO+ cells (CD8+ memory T cells), CD3+/CD8+/CD45RO+/CD69+ cells (activated memory T cells), CD3+/CD4+/CD45RO+/CCR7+/CD62L+ cells (central memory Thelper cells), CD3+/CD4+/CD45RO+/CCR7−/CD62L− cells (effecter memory Thelper cells). Further preferred sub-populations are CD3+/CD4+/Foxp3+ cells (Foxp3+ Thelper cells), and IFNγ and/or IL17 producing CD3+/CD4+/CD45RO+ cells (IFNγ and/or IL17 producing memory Thelper cells).

Definitions

The genome of *Lactobacilli plantarum* TIFN 101 is the genome of the strain deposited under number CBS 138100 at the Centraalbureau voor Schimmelcultures, Uppsalalaan 8, 3584 CT The Netherlands. SEQ ID NO: 175 represents a scaffold of 174 contigs of TIFN 101 and is for the context of the present invention construed as the preferred genome sequence of TIFN 101.

"Sequence identity" or "identity" in the context of amino acid- or nucleic acid-sequence is herein defined as a relationship between two or more amino acid (peptide, polypeptide, or protein) sequences or two or more nucleic acid (nucleotide, polynucleotide) sequences, as determined by comparing the sequences. In the art, "identity" also means the degree of sequence relatedness between amino acid or nucleotide sequences, as the case may be, as determined by the match between strings of such sequences. In all embodiments of the present invention, at least 50% sequence identity is to be construed as preferably at least 50%, more preferably 55%, 60%, 65%, 70%, 75%, 80%, 81%, 82%, 83%, 84%, 85%, 86%, 87%, 88%, 89%, 90%, 91%, 92%, 93%, 94% 95%, 96%, 97%, 98%, 99% and most preferably at least 100% sequence identity with the genome of *Lactobacilli plantarum* TIFN 101, or with a polynucleotide sequence selected from the group consisting of SEQ ID NO: 1-SEQ ID NO: 174 or with a polynucleotide encoding a polypeptide with a sequence selected from the group consisting of SEQ ID NO: 245-SEQ ID NO: 327. Within the present invention, sequence identity with a particular sequence preferably means sequence identity over the entire length of said particular polypeptide or polynucleotide sequence. The sequence information as provided herein should not be so narrowly construed as to require inclusion of erroneously identified bases. The skilled person is capable of identifying such erroneously identified bases and knows how to correct for such errors.

"Similarity" between two amino acid sequences is determined by comparing the amino acid sequence and its conserved amino acid substitutes of one peptide or polypeptide to the sequence of a second peptide or polypeptide. In a preferred embodiment, identity or similarity is calculated over the whole SEQ ID NO as identified herein. "Identity" and "similarity" can be readily calculated by known methods, including but not limited to those described in Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part I, Griffin, A. M., and Griffin, H. G., eds., Humana Press, New Jersey, 1994; Sequence Analysis in Molecular Biology, von Heine, G., Academic Press, 1987; and Sequence Analysis Primer, Gribskov, M. and Devereux, J., eds., M Stockton Press, New York, 1991; and Carillo, H., and Lipman, D., SIAM J. Applied Math., 48:1073 (1988).

Preferred methods to determine identity are designed to give the largest match between the sequences tested. Methods to determine identity and similarity are codified in publicly available computer programs. Preferred computer program methods to determine identity and similarity between two sequences include e.g. the GCG program package (Devereux, J., et al., Nucleic Acids Research 12 (1): 387 (1984)), BestFit, BLASTP, BLASTN, and FASTA (Altschul, S. F. et al., J. Mol. Biol. 215:403-410 (1990). The BLAST X program is publicly available from NCBI and other sources (BLAST Manual, Altschul, S., et al., NCBI NLM NIH Bethesda, Md. 20894; Altschul, S., et al., J. Mol. Biol. 215:403-410 (1990). The well-known Smith Waterman algorithm may also be used to determine identity.

Preferred parameters for polypeptide sequence comparison include the following: Algorithm: Needleman and Wunsch, J. Mol. Biol. 48:443-453 (1970); Comparison matrix: BLOSSUM62 from Hentikoff and Hentikoff, Proc. Natl. Acad. Sci. USA. 89:10915-10919 (1992); Gap Penalty: 12; and Gap Length Penalty: 4. A program useful with these parameters is publicly available as the "Ogap" program from Genetics Computer Group, located in Madison, Wis. The aforementioned parameters are the default parameters for amino acid comparisons (along with no penalty for end gaps).

Preferred parameters for nucleic acid comparison include the following: Algorithm: Needleman and Wunsch, J. Mol. Biol. 48:443-453 (1970); Comparison matrix: matches=+10, mismatch=0; Gap Penalty: 50; Gap Length Penalty: 3. Available as the Gap program from Genetics Computer Group, located in Madison, Wis. Given above are the default parameters for nucleic acid comparisons.

Optionally, in determining the degree of amino acid similarity, the skilled person may also take into account so-called "conservative" amino acid substitutions, as will be clear to the skilled person. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulphur-containing side chains is cysteine and methionine. Preferred conservative amino acids substitution groups are: valine-leucine-isoleucine, phenylalanine-tyrosine, lysine-arginine, alanine-valine, and asparagine-glutamine. Substitutional variants of the amino acid sequence disclosed herein are those in which at least one residue in the disclosed sequences has been removed and a different residue inserted in its place. Preferably, the amino acid change is conservative. Preferred conservative substitutions for each of the naturally occurring amino acids are as follows: Ala to ser; Arg to lys; Asn to gln or his; Asp to glu; Cys to ser or ala; Gln to asn; Glu to asp; Gly to pro; His to asn or gln; Ile to leu or val; Leu to ile or val; Lys to arg; gln or glu; Met to leu or ile; Phe to met, leu or tyr; Ser to thr; Thr to ser; Trp to tyr; Tyr to trp or phe; and, Val to ile or leu.

A polynucleotide is represented by a nucleotide sequence. A polypeptide is represented by an amino acid sequence.

In this document and in its claims, the verb "to comprise" and its conjugations is used in its non-limiting sense to mean that items following the word are included, but items not specifically mentioned are not excluded. In addition, reference to an element by the indefinite article "a" or "an" does not exclude the possibility that more than one of the element is present, unless the context clearly requires that there be one and only one of the elements. The indefinite article "a" or "an" thus usually means "at least one".

The word "about" or "approximately" when used in association with a numerical value (e.g. about 10) preferably means that the value may be the given value (of 10) more or less 0.1% of the value.

All patent and literature references cited in the present specification are hereby incorporated by reference in their entirety.

FIGURE LEGENDS

FIG. 1. Effects of three *L. plantarum* strains on frequency of different CD4+ (a-f) and CD8+ (g-j) T-cell population in the systemic circulation (n=9). Statistical significance was calculated using the Students t-test.

FIG. 2. Effects of three *L. plantarum* strains on frequency of IL21 (a), IL17 (b), IL4 (c), and IFNγ-producing (d) superantigen (SEB) stimulated memory-Th cells (n=9). Statistical significance was calculated using the Students t-test.

FIG. 3. Effects of three *L. plantarum* strains on frequency of IL21 (a), IL17 (b), IL4 (c), and IFNγ-producing (d) *Staphylococcus aureus* enterotoxin B superantigen (SEB) stimulated memory-CD45RO+ Th cells (n=9). Statistical significance was calculated using the Students t-test.

FIG. 4. Effects of three *L. plantarum* strains on frequency of IL21 (a), IL17 (b), IL4 (c), and IFNγ-producing (d) tetanus toxoid (TT) stimulated memory-CD45RO+ Th cells (n=9). Statistical significance was calculated using the Students t-test.

FIG. 5. The Flowchart of microarray analysis (a) and the number of unique genes that are regulated in the intestinal biopsis of the human consumers of three different *L. plantarum* strains (*L. plantarum* WCFS1 (WCFS1), *L. plantarum* CIP104448 (CIP48), *L. plantarum* TIFN 101. Intensity >20 on at least 5 arrays, interquartile range >0.2, at least 7 probes per gene. (b) Venn diagram chart of the number of upregulated and (c) downregulated genes in the intestinal biopsies after consumption of *l. plantarum* and indomethacin.

EXAMPLES

The present invention is further described by the following examples which should not be construed as limiting the scope of the invention.

Unless stated otherwise, the practice of the invention will employ standard conventional methods of molecular biology, virology, microbiology or biochemistry.

Such techniques are described in Sambrook et al. (1989) *Molecular Cloning, A Laboratory Manual* ($2^{nd}$ edition), Cold Spring Harbor Laboratory, Cold Spring Harbor Laboratory Press; in Sambrook and Russell (2001) *Molecular Cloning: A Laboratory Manual*, Third Edition, Cold Spring Harbor Laboratory Press, NY; in Volumes 1 and 2 of Ausubel et al. (1994) *Current Protocols in Molecular Biology, Current Protocols*, USA; and in Volumes I and II of Brown (1998) *Molecular Biology LabFax*, Second Edition, Academic Press (UK); *Oligonucleotide Synthesis* (N. Gait editor); *Nucleic Acid Hybridization* (Hames and Higgins, eds.).

Example 1

Differential Human Mucosal Transcriptomic and Immune Responses to Three Probiotic Strains; Insight in How Probiotics Contribute to Immunity in Healthy Individuals Materials and Methods
Bacterial Strains and Growth Conditions

*Lactobacilli plantarum* WCFS1 (Kleerebezem et al., 2003), *Lactobacilli plantarum* CIP104448 (CIP48), and *Lactobacilli plantarum* TIFN 101 were cultured at 37° C. in Man, Rogosa and Sharpe (MRS) medium (Merck). To obtain stationary-phase cultures, bacteria were cultured overnight. Maltodextrin and glucose were added to a final concentration of 20% and 2% (wt/vol), respectively, to obtain bacterial preparations (WCFS1, $2.6 \times 10^9$ CFU; CIP48, $2.4 \times 10^9$ CFU; TIFN 101, $5.6 \times 10^9$ CFU); placebo controls only contained the two sugars. Bacteria and placebo materials were prepared such that they contained similar final sugar concentrations. Detailed protocols for culturing, harvesting, freeze-drying, storing, and viable count determining of *Lactobacillus* species can be found in Smelt et al. 2012.

Volunteers and Interventions

This study was approved by the University Hospital Maastricht Ethical Committee and was conducted in accordance with the principles of the Declaration of Helsinki. All subjects gave their written informed consent before their inclusion in the study. Ten healthy volunteers, 7 female and 3 male (26.3±10.1 years, BMI of 21.8±2.40 kg/m$^2$), without a history of gastrointestinal symptoms and free of any form of medication, were tested on four separate occasions (three bacterial interventions and one placebo control, randomly chosen) in a randomized placebo-controlled cross-over study. The volunteers consumed habitual diet during the study period and were asked to fill in a gastrointestinal symptoms diary. Three days before the intervention a blood sample was taken to obtain baseline values. The night before the start of the supplements intake period the volunteers ingested 75 mg of indomethacin. At the starting day the volunteers ingested another dosage of 50 mg indomethacin conform previously established protocol to establish mild gastrointestinal stress (Troost et al., 2003). Subsequently, the volunteers consumed the probiotic or placebo supplements for a period of 7 days during lunch and during dinner; *L. plantarum* WCFS1 ($2.6^{10}$ colony forming units (cfu) per shot), *L. plantarum* CIP104448 ($2.4^{10}$ cfu/shot), *L. plantarum* TIFN 101 ($5.9^{10}$ cfu/shot) or placebo. Neither the volunteers nor the researchers knew which subject received the *L. plantarum* strains or the placebo (double-blinded study); the vials containing bacteria or placebo control were non-transparent. On the $7^{th}$ day, tissue samples were obtained from the horizontal part of the duodenum by standard flexible gastroduodenoscopy at approximately 15 cm distal to the pylorus. The duodenal mucosa was chosen as this is the first intestinal segment coming in contact with the bacteria, minimizing the adaptive changes microbes might go through during passage of the intestinal tract. Also, the duodenum is readily accessible for mucosal tissue sampling. Finally, the duodenum contains the lowest endogenous microbiota colonization level, ensuring that the measured responses are as specific as can be achieved. The interventions were performed with an interval of 4 weeks to allow a wash-out period and to allow healing of the biopsy-sampling region.

Cell Staining

The various dilutions of the antibodies and other reagents used for cell staining are listed in Table 1.

Blood was collected in EDTA containing tubes and processed for FACS analysis. The following antibodies were used for staining of the T cell sub-populations: Pacific Blue-conjugated anti-CD3 (clone UCHT1; BD Pharmingen), PerCP conjugated anti-CD8 (clone SK1, Biolegend), APC-Cy7-conjugated anti-CD69 (clone FN50, BD Pharmingen), APC-conjugated anti-FoxP3 (clone 206D, eBioscience), biotin-conjugated anti-CD45RO (UCHL1, Biolegend) with Pacific orange conjugated streptavidin (Invitrogen). Isotype controls were purchased from the same company as the antibodies and used in the same dilution as the antibody.

For intracellular cytokine staining of T cells we used: PE-Cy7 conjugated anti-IL4 (MP4-25D2, Biolegend), Alexa488-conjugated anti-IL-17A (clone eBio64DEC17; eBioscience), PE-conjugated anti-IL-21 (clone eBio3A3-N2; eBioscience), Alexa700-conjugated anti-IFNγ (clone B27; BD Pharmingen), For staining of the NK cell populations we used: APC-conjugated anti-CD56 (clone MEM-188, Ebioscience), EFluor450-conjugated anti-CD16 (clone CB16, eBioscience), PE-conjugated anti-CD335 (clone 9E2, Biolegend), PE-Cy7-conjugated anti-CD161 (clone HP-3G10, eBioscience) T-cell polarization was studied after three types of stimulations of the T-cells. It was done by (i) aspecific stimulation with PMA/Ca$^{2+}$ or superantigen (SEB) to study whether the total responsiveness was influenced by probiotic treatment, by (ii) stimulation with cell extracts of the specific *L. plantarum* strains in order to investigate whether specific immune responses against the probiotic was stimulated, and (iii) by stimulating with an antigen to which all volunteers were vaccinated, tetanus toxoid (TT), to study possible stimulation of specific memory responses.

After blood sampling, 200 µl of blood was diluted with 200 µl of RPMI1640 supplemented with 10% fetal calf serum (FCS) and incubated with either PMA (Phorbol myristate acetage; 80 nM Sigma-Aldrich, Steinheim, Germany) and Ca2+ (4 µM) (4 hr), *Staphylococcus aureus* enterotoxin B SEB (5 µg/mL Sigma, Deisenhofen, Germany) (24 hr), TT (tetanus toxoid; 1.5 Lf/mL) (24 hr) or bacterial lysates (30 µg/mL) (24 hr). Stimulation with bacterial lysates was according to the administered strain and performed one week after treatment. After the treatment week with *L. plantarum* WCFS1, samples were stimulated with cell extracts of *L. plantarum* WCFS1; after the treatment week with *L. plantarum* CIP104448, samples were stimulated with cell extracts of *L. plantarum* CIP104448; after the treatment week with *L. plantarum* TIFN 101, samples were stimulated with cell extracts of *L. plantarum* TIFN 101. These cell extracts were made by repeated freeze-thawing of the probiotics.

After stimulation, red blood cells were lysed with ammonium chloride. After washing (PBS with 2% FCS), cells were incubated with different antibody cocktails.

Staining for T cells and T cell subsets: Cells were incubated with an antibody cocktail consisting of anti-CD3, anti-CD8 and anti-CD45RO for 30 minutes in the dark on ice.

After washing with washing buffer, cells were incubated with streptavidine Pacific Orange (1:100 Invitrogen) for 15 minutes on ice. After washing and spinning down, pelleted cells were resuspended in Fixation/Permeabilization solution (eBioscience, 0.1% saponin and 0.009% sodium azide) for 45 minutes on ice. After washing in Perm solution (eBioscience), cells were incubated in mouse serum for 15 minutes to prevent non-specific binding, followed by incubation with the cytokine antibody mix (anti-IL-4, anti-IFNγ, anti-IL-17 and anti-IL21) or an isotype cytokine mix for 30 minutes on ice. After washing with Permeabilization solution (3 times) cells were resuspended in wash-buffer and measured by flow cytometry within 24 hrs.

Staining for NK cells: Cells were incubated with an antibody cocktail consisting of anti-CD3, anti-CD16, anti-CD56, anti-CD335 and anti-CD161 (NK cell staining), or with isotype control cocktail for NK cells consisting of anti-CD3, anti-CD16, anti-CD56 and isotype controls for anti-CD335 and CD161 for 30 minutes in the dark on ice. After washing with washing buffer, cells were fixed in FACS lysing solution (BD Biosciences, phosphate buffered saline (PBS) containing 2% heat-inactivated fetal calf serum (FCS)) for 30 minutes on ice. After washing, cells were suspended in washing buffer and measured by flow cytometry on a Becton and Dickinson LSRII within 24 hrs; at least 500,000 events were recorded per sample.

TABLE 1

| # | Reactivity | Isotype | Label | Dilution | Company |
|---|---|---|---|---|---|
| 1A | CD3 | mIgG1 (UCTH1) | Pac Blue | 1:25 | BD 558117 |
| 2 | CD8 | mIgG1 (SK1) | PerCP | 1:25 | BD 345774 |
| 4 | IL17A | mIgG1 (eBio64DEC17) | Alexa488 | 1:25 | eBio 53-7179 |
| 5 | IL21 | mIgG1 (eBio3A3-N2) | PE | 1:25 | eBio 12-7219 |
| 6 | IFNg | mIgG1 (B27) | Alexa700 | 1:100 | BD 557995 |
| 7 | CD69 | mIgG1 (FN50) | APC-Cy7 | 1:25 | BD 557756 |
| 8 | FoxP3 | mIgG1 (206D) | APC | 1:25 | eBio 9017-4776-220 |
| 9 | CD45R0 | mIgG2a (UCHL1) | Biotin | 1:25 | BioLegend 304220 |
| 10 | Streptavidin | | Pac Orange | 1:100 | Invitrogen |
| 11 | CD3 | mIgG1 (UCHT1) | PerCP | 1:30 | BioLegend 300428 |
| 12 | CD16 | mIgG1 (CB16) | eFluor450 | 1:10 | eBio 48-0168-42 |
| 13 | CD56 | mIgG2a (MEM-188) | APC | 1:25 | eBio 17-0569-42 |
| 14 | CD335 | mIgG1 (9E2) | PE | 1:7.5 | BioLegend 331908 |
| 15 | CD161 | mIgG1 (HP-3G10) | PE-Cy7 | 1:20 | eBio 25-1619-42 |
| 17 | — | Mouse IgG1 | PE | 1:62.5 | BioLegend 400112 |
| 18 | — | Mouse IgG1 | PE-Cy7 | 1:20 | eBio 25-4714 |
| 20 | IL4 | rIgG1 (MP4-25D2) | PE-Cy7 | 1:25 | BioLegend 500824 |

RNA Isolation and Microarray

Total RNA was isolated from the duodenal biopsies by using Trizol reagent (1 ml) (Invitrogen, Breda, NL). Thereafter RNA was purified using the Qiagen RNeasy Micro kit (Qiagen, Venlo, NL). RNA was quantified on a NanoDrop ND-1000 spectrophotometer (Isogen Life Science, De Meer, The Netherlands) RNA quality was checked using an Agilent 2100 bioanalyzer (Agilent Technologies, Amsterdam, NL). RNA was judged suitable for array hybridization only if samples exhibited intact bands corresponding to 18S and 28S ribosomal subunits and displayed no chromosomal peaks or RNA degradation products.

Total RNA (100 ng) was used for whole transcript cDNA synthesis by using the Ambion WT expression kit (Life Technologies, Bleiswijk, The Netherlands) and subsequently labelled by using the Affymetrix GeneChip WT Terminal Labelling Kit (Affymetrix, Santa Clara Calif.). Samples were hybridized to human whole genome Affymetrix GeneChip Human Gene 1.1 ST arrays, washed, stained, and scanned on an Affymetrix GeneTitan instrument. Details on array handling can be found in the Affymetrix GeneTitan Instrument User Guide for Expression Array Plates (P/N 702933 Rev.2).

Microarray Data Analysis

Microarray analysis was performed by applying MAD-MAX for statistical analysis (Lin et al 2011, J Integr Bioinform, PMID 21778530). Quality control was performed. All arrays met the criteria. The probes on the Human Gene 1.1 ST arrays were redefined according to Dai et al (2005, Nucleic Acids Res PMID 16284200) based on the NCBI Entrez database (CDF version 15.1). In this way the Human Gene 1.1 ST array targets 19,682 unique genes. Normalized expression values were obtained from the raw intensity values by using the robust multiarray analysis preprocessing algorithm available in the library AffyPLM using default setting (Irizarry et al, Biostatistics, 2003, PMID 12925520). Microarray data were filtered, and probe sets with at least 5 probes and expression values higher than 20 on at least 5 arrays, and a interquartile range >0.2 (log 2 scale) across all samples were and selected for further statistical analysis. In addition, an Inter Quartile Range (IQR) cut-off of 0.2 was used to filter out genes that showed no variation between the conditions. Differentially expressed genes were identified by using linear models, applying moderated t-statistics that implemented empirical Bayes regularization of standard errors in the library limma (Smyth et al., 2004). To adjust for both the degree of independence of variances relative to the degree of identity and relation between variance and signal intensity, the moderated t-statistic was extended by a Bayesian hierarchical model to define an intensity-based moderated t-statistic (Sartor et al, 2006, BMC Bioinformatics PMID 17177995). Genes were defined as significantly changed when the P value was <0.05 for pairwise comparisons.

Pathway Analysis

Geneset enrichment analysis (GSEA; at world wide web: broad.mit.edu/gsea/) was performed using MADMAX and genesets with a false discovery rate (FDR) <0.2 were considered significantly enriched. GSEA takes into account the broader context in which gene products function, namely in physically interacting networks such as biochemical, metabolic, or signal transduction routes, and has the advantage that it is unbiased, because no gene selection step is used (Subramanian et al., 2005. Possible transcription factors playing a role in the activation and inhibition of genes were identified using Upstream Regulator Analysis in Ingenuity Pathway Analysis (IPA; Ingenuity Systems, Redwood City, Calif.).

Genome Sequencing and Annotation

The L. plantarum strain CIP104448 was obtained from the NIZO culture collection (Meijerink et al., 2010). For DNA preparation, 2 ml of overnight culture was pelleted, washed and resuspended in TES buffer (N-[tris(hydroxymethyl)methyl]-2-aminoethanesulfonicacid). Cells were lysed with lysozyme (360 mg/ml) and mutanolysin (140 U/ml) by incubation for 2 h at 37° C. Subsequently 300 µl water was added and 80 µl of 20% SDS solution. The DNA extraction was done using phenol/chloroform (3×). The DNA was precipitated with isopropanol and washed with 70% ethanol. Samples were treated with 100 µg/ml RNAse (Sigma) during 1 hour at 37° C. DNA paired-end libraries with barcoding were made and sequenced using Illumina technology (Baseclear Leiden, NL). The contig sequences were submitted to the RAST automatic annotation server, which provided ORF calling and automatic annotation. The annotated contigs of CIP48 and TIFN 101 were ordered by comparing them to the circular template genome of L. plantarum WCFS1, and comparing them to each other. Contigs/genes which did not match to the WCFS1 genome were annotated in more detail using BLASTP (http://blast.ncbi.nlm.nih.gov/) and InterProscan (http://www.ebi.ac.uk/interpro/). Ortholog groups (OGs) in the 3 genomes were determined using OrthoMCL (www.orthomcl.org/).

Statistics

Flow cytometry data results are expressed as the mean±standard error of the mean (SEM). Normal distribution of the data sets was confirmed by the Kolmogorov-Smirnov test. The two-sided Students t-test was used to determine changes in immune cell populations after probiotic treatment. Gene expression data are depicted as the medium (range). The two-sided Mann Whitney U-test was used to determine changes in expression profiles after probiotic treatment in vivo. P-values<0.05 (*) were considered statistically significant.

Results

Human Trial

None of the volunteers experienced any discomfort during or after the 7 days consumption period. Before the start of the trial (day 0), and at day 7 blood samples were taken to study the effect of probiotic consumption on T-cell polarization. Also at day 7 biopsies were taken by standard flexible gastroduodenoscopy, and total RNA was isolated and hybridized to whole-genome expression microarrays. Quality control of the hybridizations and primary data analysis were performed according to strict criteria to ensure that the array data were of the highest possible quality.

Differential Peripheral Responses Induced by L. plantarum

L. plantarum WCFS1, L. plantarum CIP104448, and L. plantarum TIFN 101 were selected from a series of 42 individual L. plantarum strains which were assayed for the levels of IL-10 and IL12 they induced from dendritic cells (Meijerink et al., 2010). L. plantarum WCFS1 is characterized by a relative low IL10/IL12 ratio and classified as proinflammatory, L. plantarum CIP104448, does not change the IL10/IL12 ratio when compared to medium control and is therefore classified as neutral and L. plantarum TIFN 101 induces a relative high IL10/IL12 ratio and is therefore classified as anti-inflammatory (Meijerink et al., 2010).

Cell Frequencies After 6 Days of Treatment with L. plantarum

We did not observe differences in the frequencies of the total percentage of CD3+ cells, the CD3+/CD4+ cells (naïve or memory), or the activated memory CD3−/CD4+ cells after treatment with either L. plantarum strain. However, the percentage of CD4+/Foxp3 positive cells was significantly decreased following placebo and CIP 48 treatment, but not after WCFS1 and TIFN 101 treatment (FIG. 1a-f). Moreover, although we did not find an effect of treatment on CD3+/CD8+ naïve and memory cells, activated memory cells were statistically significantly decreased by CIP48 treatment only (P<0.01) (FIG. 1g-j).

Treatment did not affect total NK cell numbers or NKT numbers. There was also no change in the percentages of the NK cell subtypes (i.e. CD56hi and CD56dim), while the expression of CD161 (KLRB1), mediating cytotoxicity (Jacobs et al., 2001; Tarazona et al., 2002), was also not affected by the L. plantarum treatments.

T-cell polarization was studied after three types of stimulations of the T-cells. It was done by (i) non-specific stimulation with PMA/$Ca^{2+}$ or superantigen (SEB) to study whether the total responsiveness was influenced by L. plantarum treatment, by (ii) stimulation with cell extracts of the specific L. plantarum strains in order to investigate whether specific immune responses against the L. plantarum was stimulated, and (iii) by stimulation with a previously administered vaccine antigen (TT) to study possible stimulation of specific memory responses.

After non-specific stimulation with PMA/Ca-ionophore or SEB, we studied the percentage of IFNγ, IL-4, Il-17 or IL-21 positive Th cells and memory Th cells. Treatment with placebo or the administered L. plantarum strains did not influence cytokine production of the total population of Th cells or of the Th memory cells after non-specific stimulation with PMA/Ca-ionophore (results not shown). Although after SEB stimulation no differences were found in cytokine production of the total Th cell population after the three L. plantarum treatments (results not shown), we did observe differences in cytokine production of the Th memory cells after L. plantarum treatment. After stimulation with SEB (FIG. 2a-d), we observed a decreased percentage of IL-17 producing activated memory Th cells following treatment with CIP48 and an increased percentage of IL-17 producing activated memory Th cells after treatment with TIFN 101

Figure 2A:
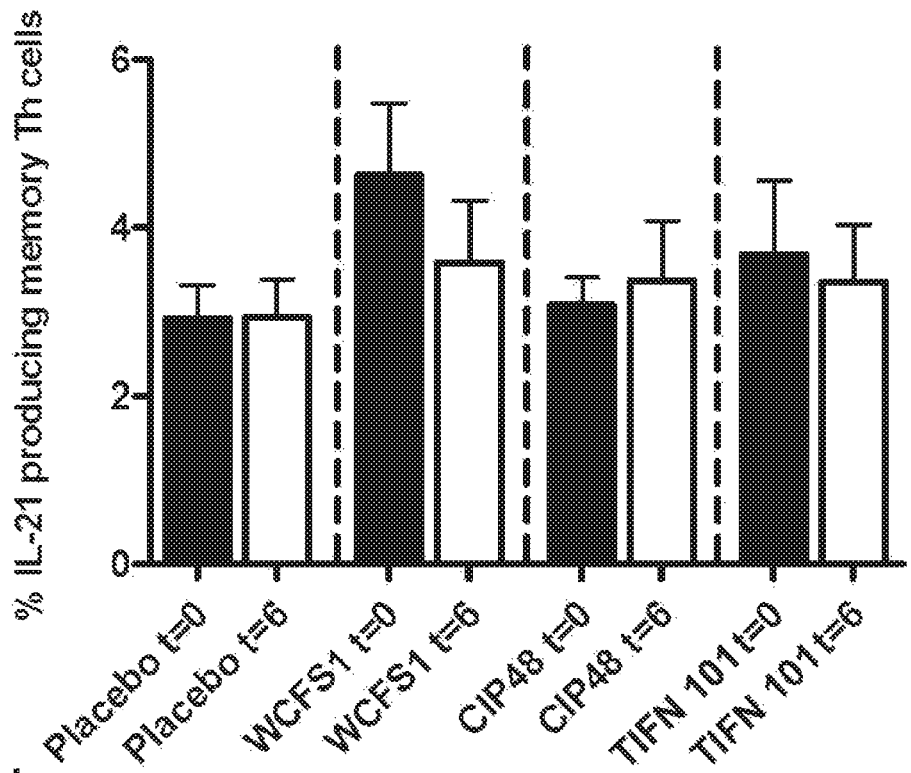
Figure 2B:
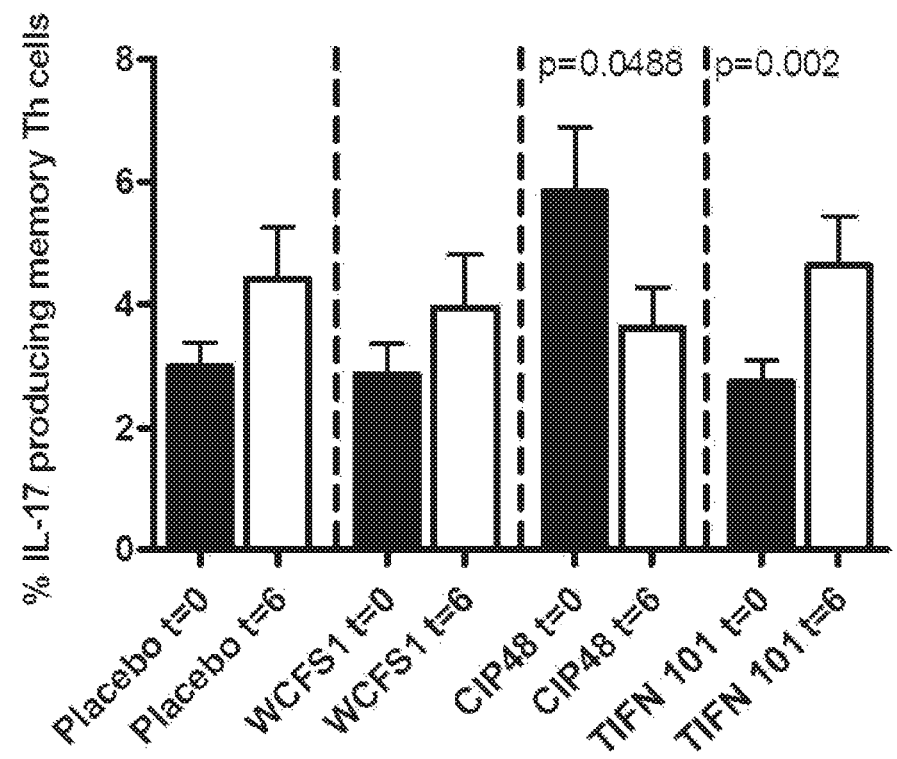
Figure 2C:
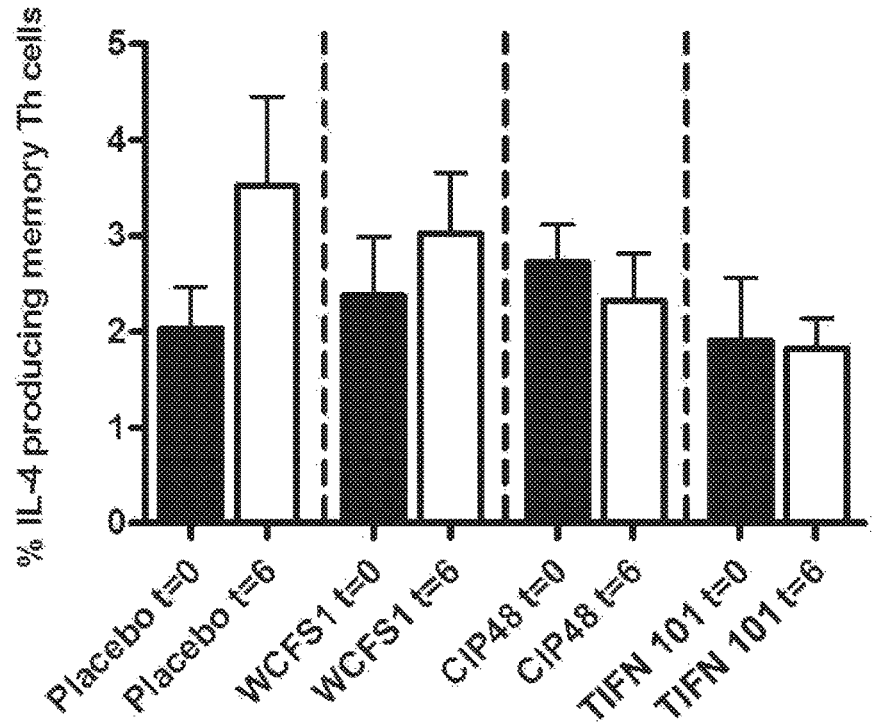
Figure 2D:
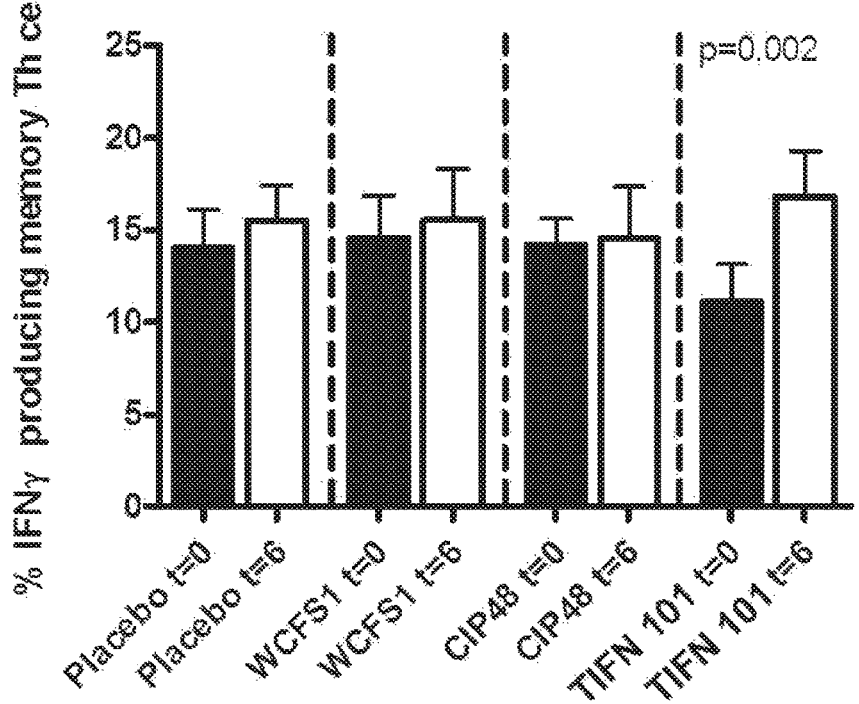
Figure 3A:
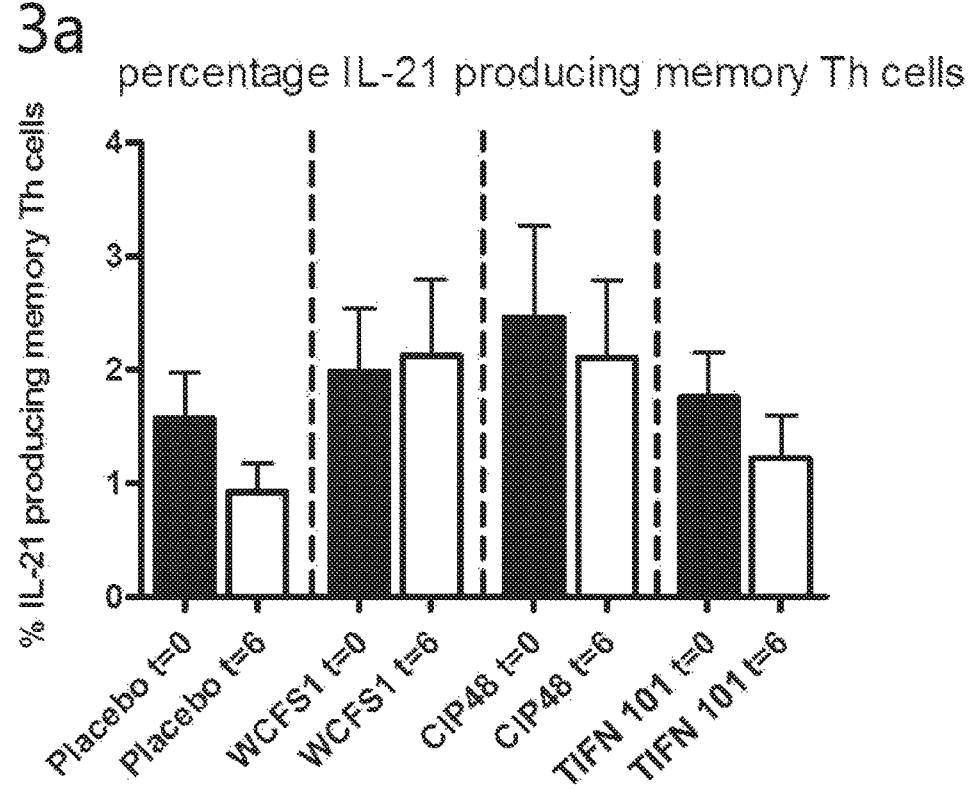
Figure 3B:
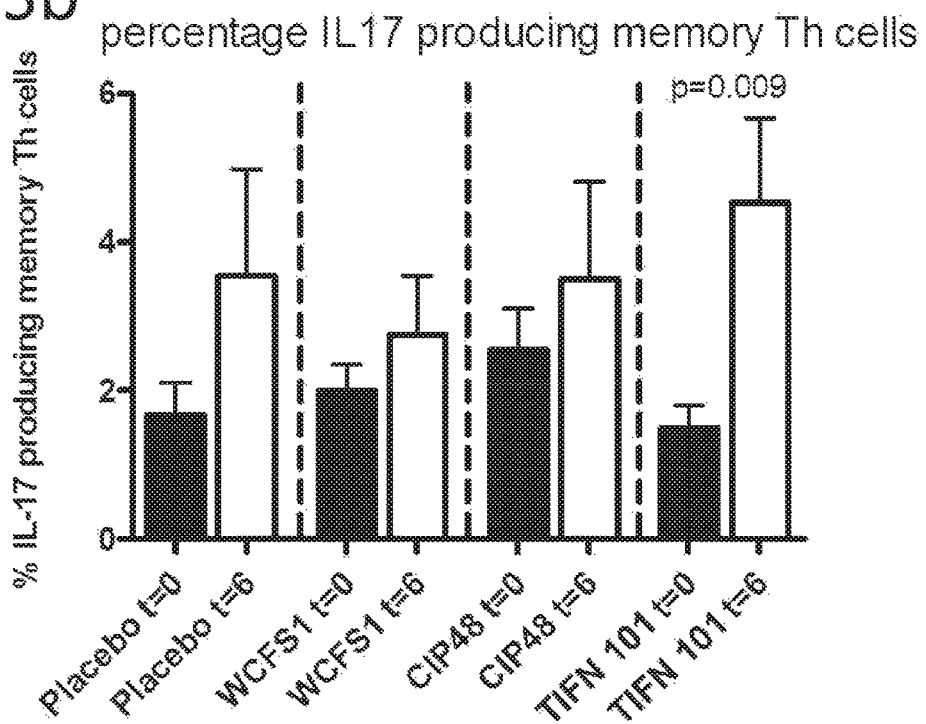
Figure 3C:
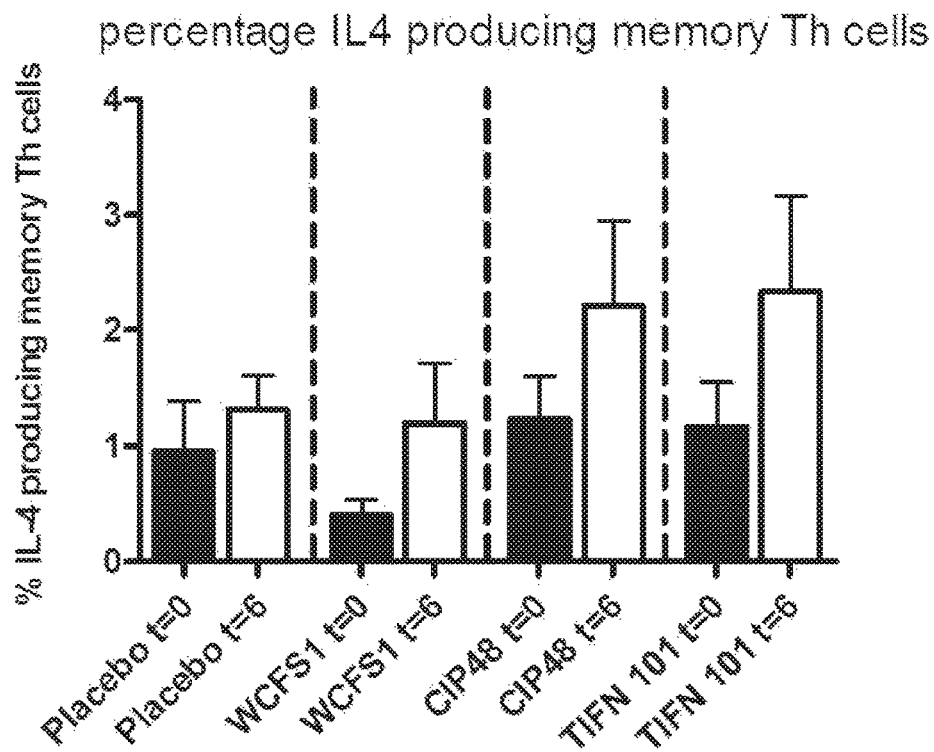
Figure 3D:
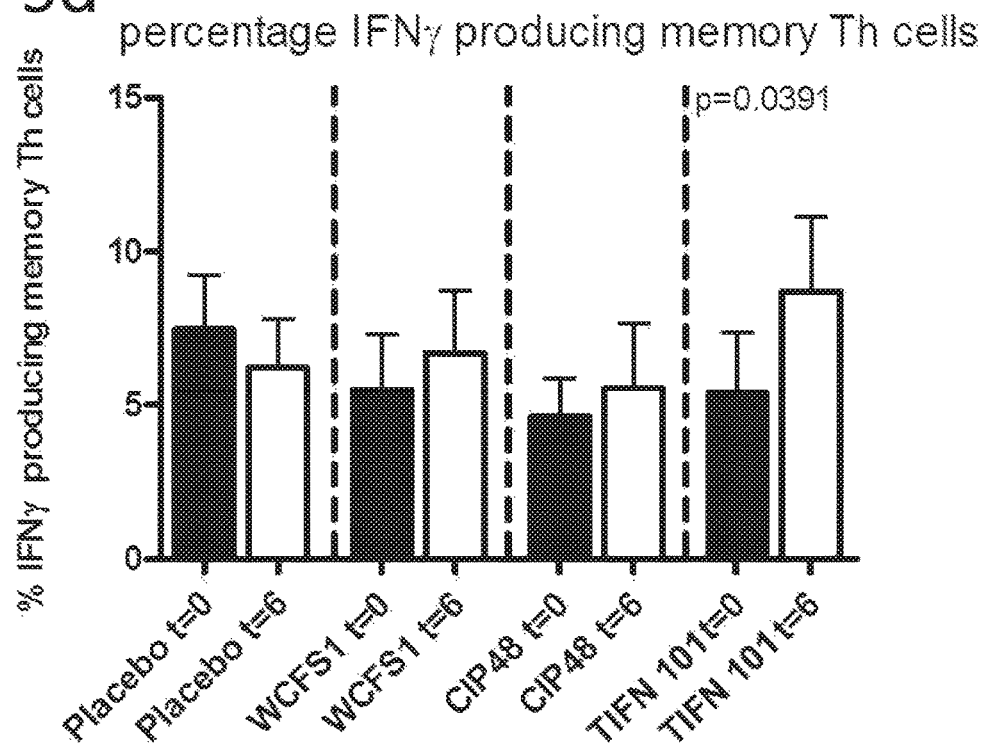

(FIG. 2b). Moreover the percentage of IFNγ producing activated memory Th cells was also increased after TIFN 101 treatment (FIG. 2d).

Treatment with L. plantarum strains also affected the cytokine production following a more specific stimulation by TT (FIG. 3a-d). We studied cytokine production of memory Th cells in order to study the effect of L. plantarum treatment on memory T cells. After TIFN 101 treatment, the percentage IL-17 and the percentage IFNγ producing activated memory Th cells were significantly increased (FIGS. 3b and 3d, respectively), while no effects of the other L. plantarum on cytokine production of memory Th after TT stimulation were observed.

Figure 4A:
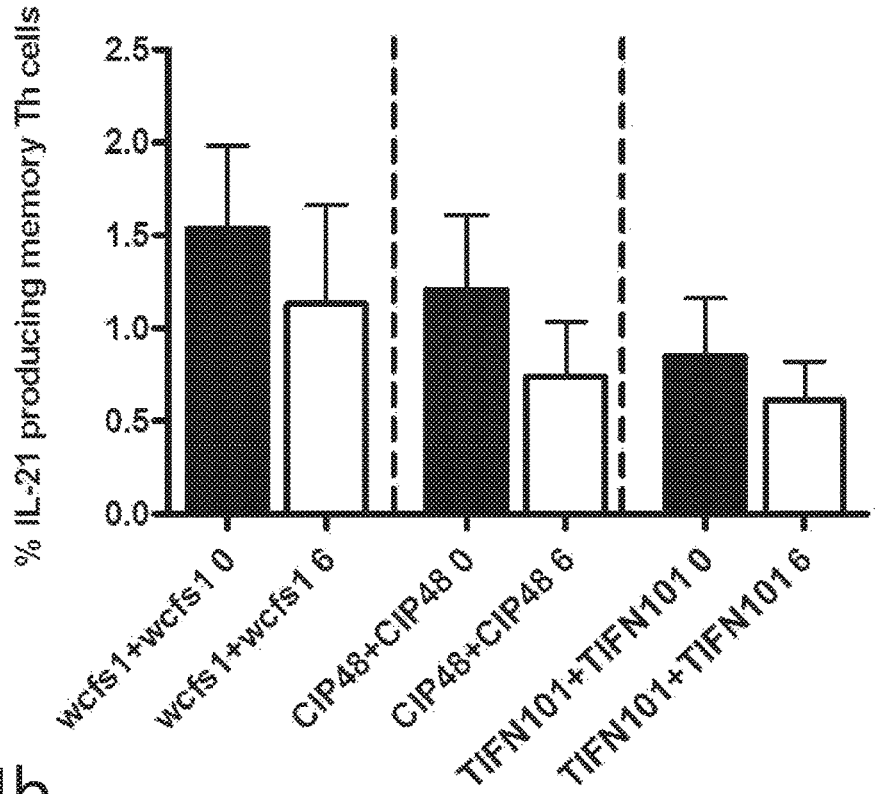
Figure 4B:
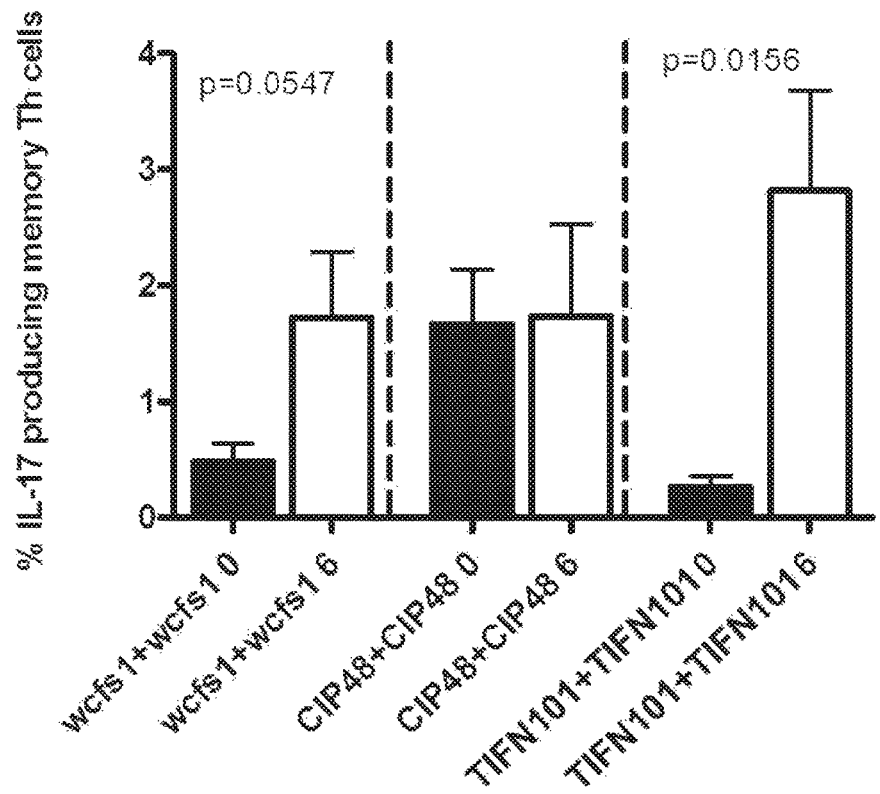
Figure 4C:
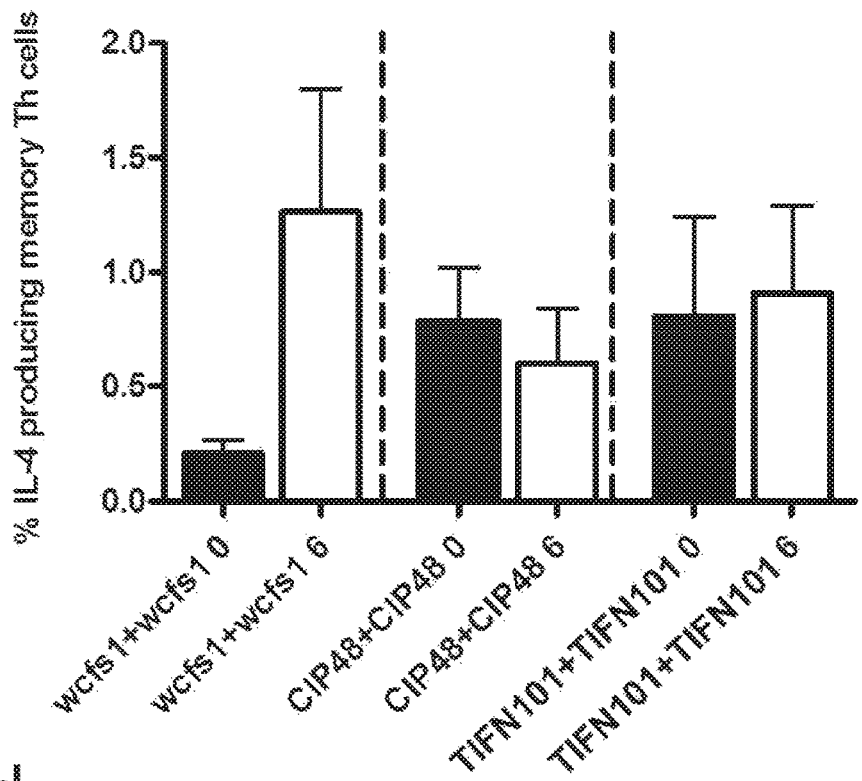
Figure 4D:
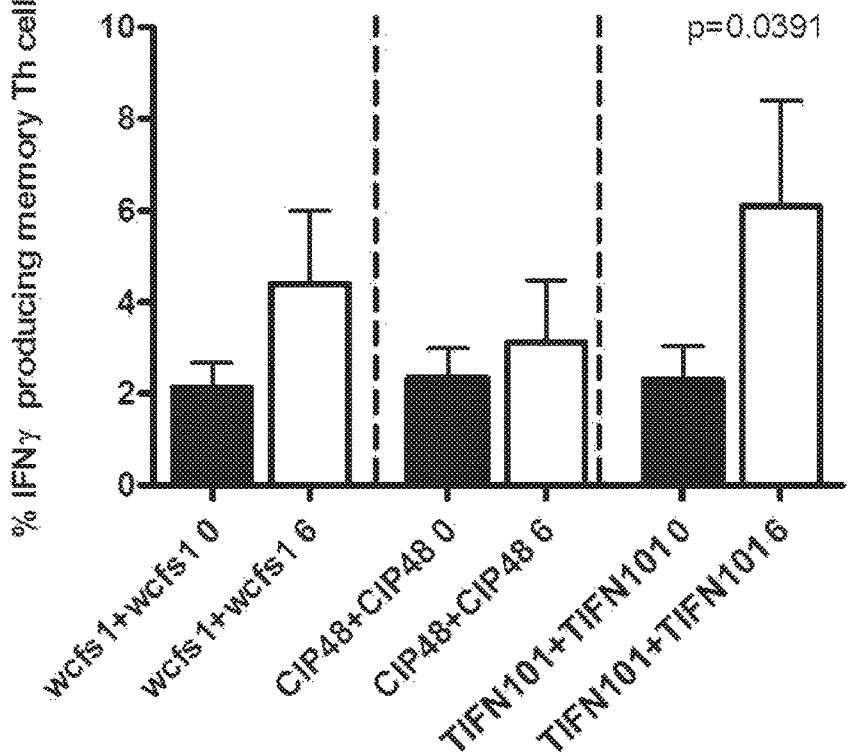

Finally, we stimulated blood samples of the individuals with cell extracts of the L. plantarum strain that they had consumed in the study (FIG. 4a-d). We observed that subjects who were treated with WCFS1, showed an increased IL-17 response after stimulation with WCFS1 cell extracts (FIG. 4b). Other cytokines were not affected by this treatment. There were no differences in cytokine production in subjects when treated with CIP48, when their blood was stimulated with CIP48 cell extract. When subjects were treated with TIFN 101, their activated memory cells showed an increased IL-17 and IFNγ production following stimulation with TIFN 101 cell extract (FIGS. 4b and d, respectively).

Figure 5A:
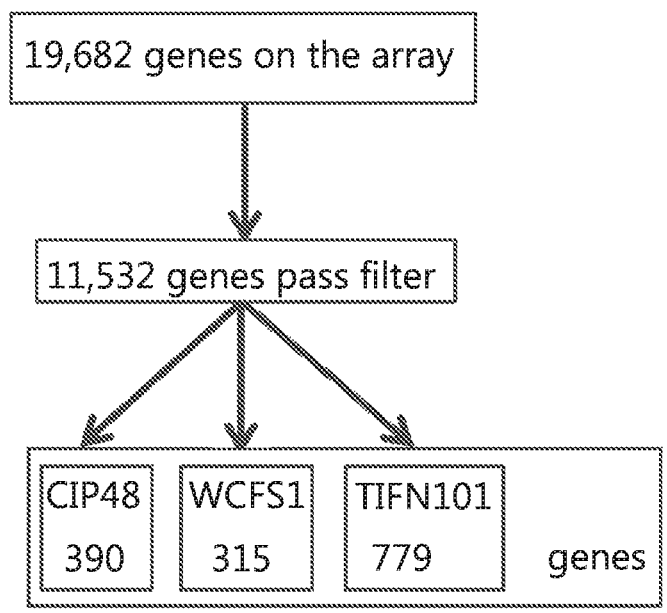
Figure 5B:
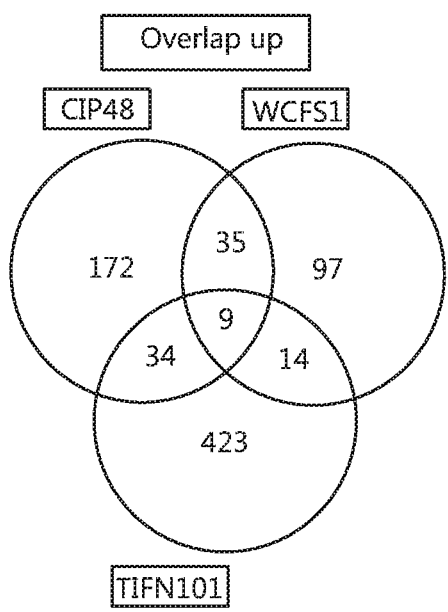
Figure 5C:
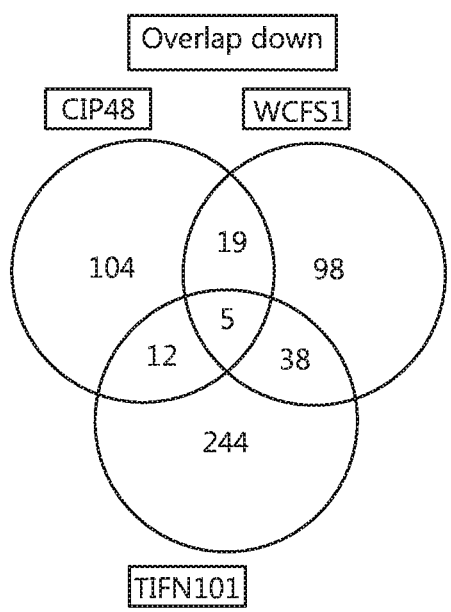

Differential Transcriptional Response in Duodenal Mucosa Upon Exposure to the Three L. plantarum Strains Although, we compared strains and not different species we found very different numbers of genes that were up- or downregulated in the stressed intestine of the subjects exposed to the three L. plantarum strains. After treatment with the three strains, 315 genes were differentially regulated with L. plantarum WCFS1, 390 with CIP48 and as many as 779 with TIFN 101 (FIG. 5a). Of these genes WCFS1 shared only 35 upregulated genes with CIP48 and 9 with TIFN 101 (FIG. 5b). An additional 19 genes were downregulated when CIP48 was compared with WCFS1 and another 5 with TIFN 101 (FIG. 5c). Shared genes were mainly involved in general cellular functions and metabolism. As expected, in an indomethacin-stressed intestine also in placebo treated controls, expression of many genes associated with cellular repair were upregulated.

To gain more insight into the changes induced by the L. plantarum treatment, genes were subsequently ranked according to mean fold-change in expression. Listed are the 10 highest induced and 10 lowest induced genes in Tables 2-3. WCFS1 and CIP48 shared the downregulation of 6 small nucleolar RNAs (snoRNAs), i.e. snoRNA, (H)C/D (ACA) box 6, 14b, 53, 57, 60, 388.

TIFN 101 produced a completely different profile (Table 4). Of the most highly induced genes in TIFN 101, (the most immunological active L. plantarum) 8 of the 10 are related to immunity, these are immunoglobulin lambda variable 6-57, putative V-set and immunoglobulin domain-containing protein 6-like, immunoglobulin lambda variable 7-46, interferon regulatory factor 4, GDNF family, CD27, CD79a, and plasminogen activator.

Based on the immune data we expected to find differential changes by specific transcription factors. To identify these transcription factors and to identify pathways regulated by the different strains, we performed Ingenuity Pathway Analysis (IPA). IPA uses information from literature combined with gene expression changes to predict a role of transcription factors in the dataset. TIFN 101 induced more changed than CIP48 and WCSF1 in the NSAID-stressed intestine. The most significant set of target genes in the TIFN 101 group were immunology related genes. TIFN 101 upregulated MHC-II α while with CIP48 and WCFS1 we found a downregulation of MHC-II β. This might explain the enhanced responses to antigens such as TT in the TIFN 101 treated group. Another pathway that might contribute to the enhanced responses in TIFN 101 is the upregulation of genes involved in leucocyte extravasation. An interesting observation is that TIFN 101 enhances RAPL which is a GTPase involved in regulating integrin affinity and enhancing the adhesion of leucocytes. Concomitantly an upregulation of essential adhesion molecules such as ICAM-1 and Cadherin 5 (CDH-5) was upregulated illustrating the upregulation of immune cell migration pathways by TIFN 101. Also with CIP48 and WCFS1 some regulation of leukocyte extravasation was observed but this was much less pronounced than for the TIFN 101 group.

Differential Gene Expression Profiles Between the Three L. plantarum Strains

Due to the differential effects of the three L. plantarum strains, L. plantarum CIP104448, and L. plantarum TIFN 101 were sequenced, annotated and compared with the genome (chromosome and plasmids) of L. plantarum WCFS1 (Siezen et al., 2012). A total of 3010 ortholog groups (OGs) were assigned to the chromosome based on this ordering of contigs to the template WCFS1 genome. The three genomes shared 2455 of the 3010 chromosomal OGs (=81.5%), which is defined as the core genome for this study. Unique genes in TIFN 101 are listed in Table 5. When the contigs and OGs/genes are included that do not match to the WCFS1 chromosome much higher numbers of unique genes are found for the CIP48 and TIFN 101 genomes. Many of the unique genes in TIFN 101 are on plasmids (see Table 5). The analysis e.g. revealed that L. plantarum CIP104448 lacks the complete plantaricin biosynthesis gene cluster (and a large set of genes adjacent to this cluster (i.e. OGs 334-348), and the entire gene cluster for EPS biosynthesis. L. plantarum TIFN 101 is missing some genes associated with plantaricin biosynthesis as well as genes for exopolysaccharide biosynthesis, many sugar utilization cassettes, and two large LPXTG-anchored mucus-binding proteins.

TABLE 2

The ten most up-and down-regulated genes in NSAID-stressed human intestine after consumption of L. plantarum WCFS1 (WCSF1).

| | Gene name | IBMT p value | Mean fold versus control |
|---|---|---|---|
| Top 10: Upregulated genes placebo versus WCFS1 | | | |
| kinesin family member 20B | KIF20B | 0.01 | 1.34 |
| microRNA 186 | MIR186 | 0.03 | 1.31 |
| guanylate cyclase activator 2A (guanylin) | GUCA2A | 0.04 | 1.31 |
| integrin, alpha 4 (antigen CD49D, alpha 4 subunit of VLA-4 receptor) | ITGA4 | 0.01 | 1.31 |
| centromere protein E, 312 kDa | CENPE | 0.05 | 1.30 |
| putative homeodomain transcription factor 1 | PHTF1 | 0.00 | 1.30 |
| spindle and kinetochore associated complex subunit 2 | SKA2 | 0.01 | 1.29 |
| killer cell lectin-like receptor subfamily D, member 1 | KLRD1 | 0.00 | 1.29 |

TABLE 2-continued

The ten most up-and down-regulated genes in NSAID-stressed human intestine after consumption of *L. plantarum* WCFS1 (WCSF1).

| Gene name | Gene name | IBMT p value | Mean fold versus control |
|---|---|---|---|
| gamma-aminobutyric acid (GABA) A receptor, alpha 2 | GABRA2 | 0.02 | 1.27 |
| retinitis pigmentosa GTPase regulator | RPGR | 0.01 | 1.27 |
| Top 10: Downregulated genes placebo versus WCFS1 | | | |
| small nucleolar RNA, H/ACA box 16A | SNORA16A | 0.02 | −1.35 |
| small nucleolar RNA, C/D box 53 | SNORD53 | 0.04 | −1.36 |
| contactin 3 (plasmacytoma associated) | CNTN3 | 0.00 | −1.38 |
| small nucleolar RNA, C/D box 6 | SNORD6 | 0.04 | −1.39 |
| small nucleolar RNA, H/ACA box 57 | SNORA57 | 0.00 | −1.44 |
| small nucleolar RNA, H/ACA box 60 | SNORA60 | 0.00 | −1.44 |
| small nucleolar RNA, H/ACA box 14A | SNORA14A | 0.03 | −1.49 |
| small nucleolar RNA, H/ACA box 38B (retrotransposed) | SNORA38B | 0.01 | −1.58 |
| small nucleolar RNA, H/ACA box 14B | SNORA14B | 0.01 | −1.58 |
| small Cajal body-specific RNA 4 | SNORA16A | 0.01 | −1.72 |

TABLE 3

The ten most up-and down-regulated genes in NSAID-stressed human intestine after consumption of *L. plantarum* CIP104448 (CIP48).

| Gene name | Gene name | IBMT p value | Mean fold versus control |
|---|---|---|---|
| Top 10: Upregulated genes placebo versus CIP48 | | | |
| coiled-coil domain containing 59 | CCDC59 | 0.01 | 1.33 |
| aldehyde dehydrogenase 1 family, member L2 | ALDH1L2 | 0.03 | 1.32 |
| KIAA0125 | KIAA0125 | 0.00 | 1.31 |
| phospholipase C, beta 4 | PLCB4 | 0.01 | 1.31 |
| coiled-coil domain containing 102B | CCDC102B | 0.04 | 1.29 |
| RAS guanyl releasing protein 3 (calcium and DAG-regulated) | RASGRP3 | 0.03 | 1.28 |
| peptidase domain containing associated with muscle regeneration 1 | PAMR1 | 0.00 | 1.28 |
| DEP domain containing 1 | DEPDC1 | 0.01 | 1.28 |
| phospholipase A2, group IIA (platelets, synovial fluid) | PLA2G2A | 0.02 | 1.28 |
| heparan sulfate (glucosamine) 3-O-sulfotransferase 3B1 | HS3ST3B1 | 0.04 | 1.28 |
| Top 10: Downregulated genes placebo versus CIP48 | | | |
| potassium channel, subfamily K, member 15 | KCNK15 | 0.05 | −1.33 |
| transient receptor potential cation channel, subfamily V, member 6 | TRPV6 | 0.01 | −1.33 |
| long intergenic non-protein coding RNA 282 | LINC00282 | 0.03 | −1.35 |
| ephrin-A1 | EFNA1 | 0.02 | −1.38 |
| matrix metallopeptidase 10 (stromelysin 2) | MMP10 | 0.05 | −1.41 |

TABLE 3-continued

The ten most up-and down-regulated genes in NSAID-stressed human intestine after consumption of *L. plantarum* CIP104448 (CIP48).

| Gene name | Gene name | IBMT p value | Mean fold versus control |
|---|---|---|---|
| angiopoietin-like 4 | ANGPTL4 | 0.03 | −1.47 |
| heme oxygenase (decycling) 1 | HMOX1 | 0.00 | −1.50 |
| nuclear factor, interleukin 3 regulated | NFIL3 | 0.01 | −1.52 |
| major facilitator superfamily domain containing 2A | MFSD2A | 0.02 | −1.59 |
| glucose-6-phosphatase, catalytic subunit | G6PC | 0.02 | −1.65 |

TABLE 4

The ten most up-and down-regulated genes in NSAID-stressed human intestine after consumption of *L. plantarum* TIFN 101

| Gene name | Gene name | IBMT p value | Mean fold versus control |
|---|---|---|---|
| Top 10 Upregulated genes placebo versus TIFN 101 | | | |
| immunoglobulin lambda variable 6-57 | IGLV6-57 | 0.01 | 1.63 |
| putative V-set and immunoglobulin domain-containing protein 6-like | LOC642131 | 0.00 | 1.55 |
| immunoglobulin lambda variable 7-46 (gene/pseudogene) | IGLV7-46 | 0.04 | 1.48 |
| heparan sulfate (glucosamine) 3-O-sulfotransferase 3B1 | HS3ST3B1 | 0.00 | 1.41 |
| interferon regulatory factor 4 | IRF4 | 0.00 | 1.40 |
| GDNF family receptor alpha 2 | GFRA2 | 0.00 | 1.40 |
| CD27 molecule | CD27 | 0.01 | 1.40 |
| CD79a molecule, immunoglobulin-associated alpha | CD79A | 0.03 | 1.38 |
| plasminogen activator, tissue | PLAT | 0.00 | 1.37 |
| Den-like domain family, member 3 | DERL3 | 0.00 | 1.37 |
| Top 10: Downregulated genes placebo versus TIFN 101 | | | |
| small nucleolar RNA, H/ACA box 38B (retrotransposed) | SNORA38B | 0.04 | −1.40 |
| small nucleolar RNA, H/ACA box 21 | SNORA21 | 0.03 | −1.40 |
| small nucleolar RNA, H/ACA box 60 | SNORA60 | 0.01 | −1.41 |
| small nucleolar RNA, C/D box 53 | SNORD53 | 0.01 | −1.43 |
| ephrin-A1 | EFNA1 | 0.00 | −1.45 |
| small nucleolar RNA, C/D box 6 | SNORD6 | 0.02 | −1.46 |
| small nucleolar RNA, H/ACA box 57 | SNORA57 | 0.00 | −1.47 |
| small nucleolar RNA, H/ACA box 14B | SNORA14B | 0.00 | −1.73 |
| family with sequence similarity 5, member C | FAM5C | 0.03 | −1.97 |
| small Cajal body-specific RNA 4 | SCARNA4 | 0.00 | −2.00 |

TABLE 5

Summary of main unique contigs/gene clusters/genes in L. plantarum TIFN 101; the sequence identity numbers are depicted in column 3, the first SEQ ID NO depicts the polynucleotide sequence, the second SEQ ID NO depicts the encoded polypeptide [polynucleotide polypeptide].

| OGs | Contains functions | SEQ ID NO: |
|---|---|---|
| chromosome | | |
| 185 | MFS family transporter | 176; 260 |
| 186 | fumarate reductase/succinate dehydrogenase flavoprotein | 177; 261 |
| 187 | Transcriptional regulator, AraC family | 178; 262 |
| 382 | toxin-antitoxin system, antitoxin component MazE, AbrB family | 179; 263 |
| 383 | toxin-antitoxin system, toxin component MazF, PemK family | 180; 264 |
| 409 | Hypothetical protein | 181; 265 |
| 410 | Conserved ankyrin repeat protein, putative | 182; 266 |
| 411 | integral membrane protein | 183; 267 |
| 461 | nitrate/sulfonate/bicarbonate ABC transporter, substrate-binding protein | 184; 268 |
| 462 | nitrate/sulfonate/bicarbonate ABC transporter, permease protein | 185; 269 |
| 463 | nitrate/sulfonate/bicarbonate ABC transporter, ATP-binding protein | 186; 270 |
| 1197 | ADP-ribosylglycohydrolase | 187; 271 |
| 1986 | abortive infection bacteriophage resistance protein | 188; 272 |
| 2366 | cell wall hydrolase, glycosyl hydrolase family 25 | 189; 273 |
| 2549 | membrane proteinase PrsW, regulator of anti-sigma factor | 190; 274 |
| 2583 | hypothetical membrane protein, YfhO family | 191; 275 |
| 2610 | Fructokinase (EC 2.7.1.4) | 192; 276 |
| 2611 | glycosyl hydrolase, family 38 | 193; 277 |
| 2612 | PTS system, IIC component | 194; 278 |
| 2613 | PTS system, fructose-specific IIBC component (EC 2.7.1.69) | 195; 279 |
| 2614 | (EC 2.7.1.69)/PTS system, fructose-specific IIC component (EC 2.7.1.69) | 196; 280 |
| 2615 | Transcription antiterminator, BglG family | 197; 281 |
| on putative plasmids | | |
| 3299 | hydrolase, HD superfamily, C-terminus | 198; 282 |
| 3300 | Ribonucleotide reduction protein NrdI | 199; 283 |
| 3301 | Ribonucleotide reductase of class Ib (aerobic), alpha subunit (EC 1.17.4.1) | 200; 284 |
| 3302 | Ribonucleotide reductase of class Ib (aerobic), beta subunit (EC 1.17.4.1) | 201; 285 |
| 3303 | Ribonucleotide reductase of class Ib (aerobic), beta subunit (EC 1.17.4.1) | 202; 286 |
| 3304 | transposase, fragment | 203; 287 |
| 3305 | Site-specific recombinase, DNA invertase Pin related protein | 204; 288 |
| 3306 | membrane protein with DUF161 and DUF2179 domains, YitT family | 205; 289 |
| 3307 | Na(+)/H(+) antiporter | 206; 290 |
| 3308 | Voltage-gated chloride channel family protein | 207; 291 |
| 3323 | Glucose uptake protein | 208; 292 |
| 3324 | Mannose-6-phosphate isomerase | 209; 293 |
| 3325 | hypothetical protein, C-terminus | 210; 294 |
| 3326 | hypothetical protein | 211; 295 |
| 3327 | Glutamine synthetase type I (EC 6.3.1.2) | 212; 296 |
| 3328 | transposase | 213; 297 |
| 3329 | toxin-antitoxin system, toxin component, PemK/MazF family | 214; 298 |
| 3330 | toxin-antitoxin system, antitoxin component, PemI/MazE family | 215; 299 |
| 3331 | integrase/recombinase | 216; 300 |
| 3332 | hypothetical protein, C-terminus | 217; 301 |
| 3333 | hypothetical protein | 218; 302 |
| 3334 | Cold shock protein CspA | 219; 303 |
| 3335 | toxin-antitoxin system, RelE/StbE family; replication protein RepA | 220; 304 |
| 3336 | hypothetical protein | 221; 305 |
| 3337 | Transcriptional regulator, PBSX/Xre family | 222; 306 |

TABLE 5-continued

Summary of main unique contigs/gene clusters/genes in *L. plantarum* TIFN 101; the sequence identity numbers are depicted in column 3, the first SEQ ID NO depicts the polynucleotide sequence, the second SEQ ID NO depicts the encoded polypeptide [polynucleotide polypeptide].

| OGs | Contains functions | SEQ ID NO: |
|---|---|---|
| 3338 | hypothetical protein | 223; 307 |
| 3339 | integrase/recombinase | 224; 308 |
| 3340 | toxin-antitoxin system, antitoxin component, Phd_YefM family | 225; 309 |
| 3341 | toxin-antitoxin system, toxin component, RelE/StbE family | 226; 310 |
| 3342 | hypothetical protein | 227; 311 |
| 3343 | hypothetical protein | 228; 312 |
| 3344 | ISEf1, transposase | 229; 313 |
| 3345 | hypothetical membrane protein | 230; 314 |
| 3346 | hypothetical protein, N-terminus | 231; 315 |
| 3347 | replication protein RepA | 232; 316 |
| 3348 | hypothetical protein | 233; 317 |
| 3349 | Transposase IS66 | 234; 318 |
| 3350 | Transposase IS66, N-terminus | 235; 319 |
| 3351 | Transposase IS66, C-terminus | 236; 320 |
| 3352 | Pyridine nucleotide-disulfide oxidoreductase | 237; 321 |
| 3353 | LtrC-like protein | 238; 322 |
| 3354 | Major facilitator: Oxalate: Formate Antiporter | 239; 323 |
| 3355 | transposase IS3/IS911 family protein | 240; 324 |
| 3356 | Excinuclease ABC subunit A paralog | 241; 325 |
| 3357 | site-specific recombinase | 242; 326 |
| 3358 | Iron-sulfur cluster assembly protein SufB, permease, C-terminus | 243; 327 |
| 3359 | membrane protein, MarC family | 244; 328 |
| 3360 | peptidase E | 245; 329 |
| 3361 | hypothetical protein | 246; 330 |
| 3362 | FIG00742910: hypothetical protein | 247; 331 |
| 3363 | alkaline shock protein, Asp23 family | 248; 332 |
| 3364 | hypothetical membrane protein | 249; 333 |
| 3365 | hypothetical protein | 250; 334 |
| 3366-3371 | FIG00753329: hypothetical protein, N-terminus | 251; 335 |
| 3367 | FIG00742586: hypothetical protein | 252; 336 |
| 3368 | replication initiator protein, C-terminus | 253; 337 |
| 3369 | replication initiator protein, N-terminus | 254; 338 |
| 3370 | hypothetical protein | 255; 339 |
| 3371 | plasmid partitioning ATPase ParA | 256; 340 |

Discussion

This study was undertaken to investigate whether *L. plantarum* strains selected in vitro for their differential immune stimulating capacity have different impact on local and systemic immunity in healthy individuals undergoing a mild, commonly encountered stressor of intestinal immunity. All three strains had an effect on immunity but that this effect was highly strain dependent and may not be beneficial in certain contexts. On the basis of results obtained by dendritic cell stimulation with *L. plantarum* strains in vitro the immune properties, of strain. WCFS1 was considered to be proinflammatory, *L. plantarum* CIP104448 as neutral and *L. plantarum* TIFN 101 as regulatory. However, the immune responses to these strains in vivo was very different to that predicted in vitro.

Consumption of NSAID induced reduction in CD4+/ Foxp3 regulatory cells but was prevented by WCFS1 and TIFN 101 administration which should be considered to be a beneficial regulatory effect. CIP48 did not prevent NSAID induced reduction of CD4+Foxp3 T cells and had more negative effects. CIP48 reduced the number of memory cells suggesting a proinflammatory, worsening effect of consumption of this bacterium.

T-cell polarization was studied after different stimuli to gain insight into the mechanisms by which bacteria might influence immunity. A hypothesis we had was that bacterial wall components might induce immune responses (Smelt et al., 2012) and enhance systemic immunity as bystander effect. However, this hypothesis had to be rejected as the sole responsible mechanism as only WCFS1 showed a trend of elevation of IL17 production after challenging whole blood of the WCSF1 consumers with the bacterial strain. The most pronounced stimulator of immunity, i.e. TIFN 101, showed no response to the bacterial extract but enhanced the responses against specific pathogenic antigens such as SEB and that against TT.

The analysis of the mucosal transcriptome suggested that the enhanced memory response is related to TIFN 101 enhanced upregulation of processes associated with T- and B-cell function and antigen presentation. TIFN 101 in contrast to the other bacteria had a pronounced effect on immunological related pathways in the mucosa of the consumers. In particular TIFN 101 enhanced pathways and genes related to antigen presentation. TIFN 101 had a pronounced effect on CD27 upregulation which is required for generation and long-term maintenance of T cell immunity (Huang et al., 2013). Also TIFN 101 enhanced the expression of MHC-II α in mucosa and of key regulatory molecules such as RAPL. RAPL enhances integrin affinity and the adhesion of T-cells (Raab et al., 2010; Zhang and Wang, 2012). These observations in the mucosa may explain the enhanced memory T-cell responses observed in the TIFN 101 consumers. Also B-cell immunity in the mucosa was enhanced as illustrated by upregulation of immunoglobulin regulatory genes and by CD79a. CD79A is also known as B-cell antigen receptor complex-associated protein alpha chain forming together with CD79b protein the B-cell antigen receptor (Herren and Burrows, 2002). CIP48 and WCFS1 did not have these effects or downregulated processes such as antigen presentation in the mucosa.

The observation that bacteria can downregulate snoRNAs in the intestine has to our best knowledge not been reported before. SnoRNA are metabolically stable noncoding RNAs that associate with a set of proteins to form small nucleolar RNPs (snoRNPs). The majority of snoRNA function as guide RNAs in the post-transcriptional synthesis of 2'-O-methylated nucleotides and pseudouridines in rRNAs, small nuclear RNAs (snRNAs) and other cellular RNAs, including mRNAs (Bratkovic and Rogelj, 2011; Esteller, 2011; Williams and Farzaneh, 2012). The relative reduction in snoRNA 53, 57, 60 by CIP48 and WCFS1 suggest a downregulation of methylation of ribosomal RNA (Kiss-Laszlo et al., 1996) and downregulation of 14b diminished pseudouridinilation of RNA (Kiss et al., 2004). Usually this suggest a destabilization of cellular processes (Su et al., 2014), again suggesting that CIP48 and WCFS1 are not beneficial for a mildly stressed intestinal environment.

We applied genome sequencing of *L. plantarum* CIP104448 and *L. plantarum* TIFN 101 to identify possible gene clusters that might be responsible for the differential biological effects of the three *L. plantarum* strains. Several hundred novel *L. plantarum* genes were found in strain CIP48 (340 new OGs) and TIFN 101 (177 OGs) compared to strain WCFS1. Only a small number of these (47 OGs) are shared by both CIP48 and TIFN 101. The majority of these novel genes appear to be on plasmids. *L. plantarum* TIFN 101 partly lacks the plantaricin biosynthesis clusters. These genes have in previous studies been linked to strain differences in cytokine production (Meijerink et al., 2010; Wells et al., 2011) but were shown here not to be associated with immune effects in vivo. Also *L. plantarum* CIP104448 and *L. plantarum* TIFN 101 lack very large regions of the sugar metabolism. These adaptations have been attributed to adaptations to environmental factors which are interesting targets to identify genes associated with probiotic effects (Molenaar et al., 2005). Not only presence but also absence of genes may enhance immune effects of bacteria (Smelt et al., 2013b). This comparative genomics study in which effects of *L. plantarum* supplementation on the mucosal transcriptome were combined with systemic immune activation parameters provides many leads for follow-up experimental work to identify genes that are responsible for or involved in the observed differences in immune effects in the human subject.

REFERENCE LIST

Belkaid Y, Hand T W. Role of the microbiota in immunity and inflammation. Cell 2014; 157:121-41. doi: 10.1016/j.cell.2014.03.011.

Cao S, Feehley T J, Nagler C R. The role of commensal bacteria in the regulation of sensitization to food allergens. FEBS Lett 2014; 1:00312-3.

de Kivit S, Tobin M C, Forsyth C B, Keshavarzian A, Landay A L. Regulation of Intestinal Immune Responses through TLR Activation: Implications for Pro- and Prebiotics. Front Immunol 2014; 5:60. eCollection 2014.

Geuking M B, Koller Y, Rupp S, McCoy K D. The interplay between the gut microbiota and the immune system. Gut Microbes 2014; 5:3.

Walker M M, Talley N J. Review article: bacteria and pathogenesis of disease in the upper gastrointestinal tract—beyond the era of *Helicobacter pylori*. Aliment Pharmacol Ther 2014; 39:767-79. doi: 10.1111/apt.12666. Epub 2014 Feb. 24.

Meijerink M, van H S, Taverne N, Wels M, de V P, Bron P A, et al. Identification of genetic loci in *Lactobacilli plantarum* that modulate the immune response of dendritic cells using comparative genome hybridization. PLoSOne 2010; 5:e10632.

Meijerink M, Wells J M, Taverne N, de Zeeuw Brouwer M L, Hilhorst B, Venema K, et al Immunomodulatory effects of potential probiotics in a mouse peanut sensitization model. FEMS Immunol Med Microbiol 2012; 65:488-96.

Wells J M, Rossi O, Meijerink M, van B P. Epithelial crosstalk at the microbiota-mucosal interface. Proc Natl Acad Sci USA 2011; 108 Suppl 1:4607-14.

van Baarlen P, Troost F, van der Meer C, Hooiveld G, Boekschoten M, Brummer R J, et al. Human mucosal in vivo transcriptome responses to three *lactobacilli* indicate how probiotics may modulate human cellular pathways. Proc Natl Acad Sci USA 2011; 108:4562-9. doi: 10.1073/pnas.1000079107. Epub 2010 Sep. 7.

van Baarlen P, Troost F J, van Hemert S, van der Meer C, de Vos W M, de Groot P J, et al. Differential NF-kappaB pathways induction by *Lactobacilli plantarum* in the duodenum of healthy humans correlating with immune tolerance. Proc Natl Acad Sci USA 2009; 106:2371-6. doi: 10.1073/pnas.0809919106. Epub 2009 Feb. 3.

van Hemert S, Meijerink M, Molenaar D, Bron P A, de Vos P, Kleerebezem M, Wells J M, Marco M L Identification of *Lactobacilli plantarum* genes modulating the cytokine response of human peripheral blood mononuclear cells BMC microbiology 2010, 10 (1) 293

Smelt M J, de Haan B J, Bron P A, van Swam I, Meijerink M, Wells J M, et al. The Impact of *Lactobacilli plantarum* WCFS1 Teichoic Acid D-Alanylation on the Generation of Effector and Regulatory T-cells in Healthy Mice. PLoS One 2013; 8:e63099.

Smelt M J, de Haan B J, Bron P A, van Swam I, Meijerink M, Wells J M, et al. *L. plantarum, L. salivarius*, and *L. lactis* attenuate Th2 responses and increase Treg frequencies in healthy mice in a strain dependent manner PLoS One 2012; 7:e47244.

Schoultz I, McKay C M, Graepel R, Phan V C, Wang A, Soderholm J, et al. Indomethacin-induced translocation of bacteria across enteric epithelia is reactive oxygen species-dependent and reduced by vitamin C. Am J Physiol Gastrointest Liver Physiol 2012; 303:G536-45. doi: 10.1152/ajpgi.00125.2012. Epub 2012 Jun. 14.

Deasy A, Read R C. Challenges for development of meningococcal vaccines in infants and children. Expert Rev Vaccines 2011; 10:335-43. doi: 10.1586/erv.11.3. (16)

Edwards K M, Berbers G A. Immune responses to pertussis vaccines and disease. J Infect Dis 2014; 209:S10-5. doi: 1093/infdis/jit560. Epub 2013 Oct. 31.

Kerneis S, Launay O, Turbelin C, Batteux F, Hanslik T, Boelle P Y. Long-term immune responses to vaccination in HIV-infected patients: a systematic review and meta-analysis. Clin Infect Dis 2014; 58:1130-9. doi: 10.093/cid/cit937. Epub 2014 Jan. 10.

Poorolajal J, Mahmoodi M, Haghdoost A, Majdzadeh R, Nasseri-Moghaddam S, Ghalichi L, et al. Booster dose vaccination for preventing hepatitis B. Cochrane Database Syst Rev 2010: CD008256. doi: 10.1002/14651858.CD008256.pub2.

Schure R M, Hendrikx L H, de Rond L G, Ozturk K, Sanders E A, Berbers G A, et al. T-cell responses before and after the fifth consecutive acellular pertussis vaccination in 4-year-old Dutch children. Clin Vaccine Immunol 2012; 19:1879-86. doi: 10.128/CVI.00277-12. Epub 2012 Sep. 26.

Marco, M. L., S. Pavan, and M. Kleerebezem, *Towards understanding molecular modes of probiotic action.* Curr Opin Biotechnol, 2006. 17(2): p. 204-10.

Corr, S. C., C. Hill, and C. G. Gahan, *Understanding the mechanisms by which probiotics inhibit gastrointestinal pathogens.* Adv Food Nutr Res, 2009. 56: p. 1-15.

Saulnier, D. M. A., et al., *Mechanisms of probiosis and probiosis: considerations for enhanced functional foods.* Current Opinion in Biotechnology, 2009. 20(2): p. 135-141.

Saxelin, M., et al., *Probiotic and other functional microbes: from markets to mechanisms.* Curr Opin Biotechnol, 2005. 16(2): p. 204-11.

Ma, D., P. Forsythe, and J. Bienenstock, *Live Lactobacillus reuteri is essential for the inhibitory effect on tumor necrosis factor alpha-induced interleukin-8 expression.* Infect Immun, 2004. 72(9): p. 5308-14.

Gobbetti, M., R. D. Cagno, and M. De Angelis, *Functional microorganisms for functional food quality.* Crit Rev Food Sci Nutr, 2010. 50(8): p. 716-27.

Smyth et al. 2004, Stat Appl Genet Mol Biol

Subramanian et al 2005, Proc Natl Acad Sci USA PMID 16199517

Tarazona, R., J. G. Casado, O. Delarosa, J. Torre-Cisneros, J. L. Villanueva, B. Sanchez, M. D. Galiani, R. Gonzalez, R. Solana, and J. Pena. 2002. Selective depletion of CD56(dim) NK cell subsets and maintenance of CD56 (bright) NK cells in treatment-naive HIV-1-seropositive individuals. *J Clin Immunol* 22:176-183.

Jacobs, R., G. Hintzen, A. Kemper, K. Beul, S. Kempf, G. Behrens, K. W. Sykora, and R. E. Schmidt. 2001. CD56bright cells differ in their KIR repertoire and cytotoxic features from CD56dim NK cells. *Eur J Immunol* 31:3121-3127.

Siezen, R. J., C. Francke, B. Renckens, J. Boekhorst, M. Wels, M. Kleerebezem, and S. A. van Hijum. 2012. Complete resequencing and reannotation of the *Lactobacillus plantarum* WCFS1 genome. *J Bacteriol* 194:195-196.

Huang, J., C. Jochems, A. M. Anderson, T. Talaie, A. Jales, R. A. Madan, J. W. Hodge, K. Y. Tsang, D. J. Liewehr, S. M. Steinberg, J. L. Gulley, and J. Schlom. 2013. Soluble CD27-pool in humans may contribute to T cell activation and tumor immunity. *J Immunol* 190:6250-6258

Raab, M., H. Wang, Y. Lu, X. Smith, Z. Wu, K. Strebhardt, J. E. Ladbury, and C. E. Rudd. 2010. T cell receptor "inside-out" pathway via signaling module SKAP1-RapL regulates T cell motility and interactions in lymph nodes. *Immunity* 32:541-556.

Zhang, Y., and H. Wang. 2012. Integrin signalling and function in immune cells. *Immunology* 135:268-275.

Herren, B., and P. D. Burrows. 2002. B cell-restricted human mb-1 gene: expression, function, and lineage infidelity. *Immunologic research* 26:35-43.

Bratkovic, T., and B. Rogelj. 2011. Biology and applications of small nucleolar RNAs. *Cellular and molecular life sciences: CMLS* 68:3843-3851.

Esteller, M. 2011. Non-coding RNAs in human disease. *Nature reviews. Genetics* 12:861-874.

Williams, G. T., and F. Farzaneh. 2012. Are snoRNAs and snoRNA host genes new players in cancer? *Nature reviews. Cancer* 12:84-88.

Kiss-Laszlo, Z., Y. Henry, J. P. Bachellerie, M. Caizergues-Ferrer, and T. Kiss. 1996. Site-specific ribose methylation of preribosomal RNA: a novel function for small nucleolar RNAs. *Cell* 85:1077-1088.

Kiss, A. M., B. E. Jady, E. Bertrand, and T. Kiss. 2004. Human box H/ACA pseudouridylation guide RNA machinery. *Molecular and cellular biology* 24:5797-5807.

Su, H., T. Xu, S. Ganapathy, M. Shadfan, M. Long, T. H. Huang, I. Thompson, and Z. M. Yuan. 2014. Elevated snoRNA biogenesis is essential in breast cancer. *Oncogene* 33:1348-1358.

Molenaar, D., F. Bringel, F. H. Schuren, W. M. de Vos, R. J. Siezen, and M. Kleerebezem. 2005. Exploring *Lactobacilli plantarum* genome diversity by using microarrays. *J Bacteriol* 187:6119-6127.

Troost, F. J., W. H. Saris, and R. J. Brummer 2003. Recombinant human lactoferrin ingestion attenuates indomethacin-induced enteropathy in vivo in healthy volunteers. Eur J Clin Nutr 57:1579-1585.

SEQUENCE LISTING (340 sequences)

SEQ ID NO: 1 - DNA, 114720 bp, Lactobacillus plantarum
ttaaatttgcaatctacctttgactgaaattagaatgcaatggatttagagttatacagtgggttttcagaaattatgaaggcccatttttgtgagcttaaatgaattgttgtggttaataataagtccgtcacttaatcttaaataaaccggttttgaagattcggttggaattctgaatggttcgtaacacaaggttatttccgcattttctttgtaccggttcgtaataatgggtggtactagcacgggggttaagttcggataatttgttaatggttggtaccgaaatcgttgctttgtttgaattgcgaggaagatattggtactatcaatttgaactattgagctgtgtgaccactgacagttgcctaggtcaatggttggatgattgagataaataattacagtaatagtcgtaagcttgcctttgaggattgtgggtgtcaggcattaatgattataaaattagtcgtggatagttgtgggggcagatattctgcgttattaatgataccggaatgtttttcgttaagtgtctaatttgggccacaatcgaatggcgctaatgataccgaaagttgcaattataattgttatttcgtaaaactatttgagtcatattgggggaattagcatgcaaaatccacggttaaccattattgtgccttgctacaatgaagaagcggtgttacctaagtctgcacacatcttggatggtatcttgacggatctgatccaacacaaacaggtcaatgcggcaagtaagttattatttgttgacgatggtagtcaagataagacttggaaactgattaagtcgttggaaaaacagtactcaaccgtgacgggtcttaagtttagtcgtaattttggtcatcaaaacgcgttgatggctgggatgcaggtcgccagtccgactgctgaaatagtcattacgattgatgctgatttgcaagatgacccacaggtgatcccagaaatggtggcacgctatcgtgctggtagtgatattgtattaggtgtccgcaatgatcgaagtagtgattcacttttcaaacgatggaccgcggacggcttttatcggctaatgaagcgtattggtgtgcaattagtacctaatcatgccgatttccgtttgctaagtcaacgggcagttcaggcactgttaacctatgaggaaaccaatttattcttgcgtggaatcgtaccacgactaggttttccaacaactaaactttattatcatcgccaaccacgttttgcgggtgtttcaaagtatccattacgtaagatggtggcttttgcttttgatgggatcacgtcattttcaatcgcaccgattaaagtaattttattgttcggtatggtgattagtggcggtagtttgatgatgatgctatatgcgttaatacaaggattactagggaccgcaacgagtggctggtcctcactcatgacaagtctatggtttttaggtgggatgcaattgattggtattagtattgttggcgagtatgtaggaaaaatttttgcggaagtcaagcaccggccccgctatattattgaaacggatgattatacggcaactcaacagccagctattgtgaattcgcaacgggtgcacggatgaaggccgtggttaagagcgtcaattggctggcggccgcggtattggtcgtcgcagttggcatggcgtggttgcaaccgattcacttcttcggcaacccggactgggcgtcaccggtcgtttaattagccatggttctgggattattggtcatgacgatggctggccggcaggtgctcaaacagttatcatctcgtcagtatcgttggctgttgattgggctggtcggcttaatcgccatcgtgcaaatattgattgccactagttttgttgacgtggcgcgggccgacccgtttttcgttcggcagcaggcactgttattagcgcagggcagccatcattggcaacattattttatgatttatcccaataatgtgaattttacgttattagttgcgaatctgctcaagccattattgaaactgacgcagacgccctgggtattattaaatgtcatccgatttatctggatcgataccggactaatcagtgggttatatttactaaaccgttggcgttactggcaaccgggggcggtctcatttagtttgttgtggctcgtcagtgttcccgtggccgcatttggactatttgcatatacggacgccctcgttttgccactacttccagacagcttggccttgctcacactcggactaagcttaaccggctggcgtcgttggggcgttttgattggtgatgggttattggtggccgtgggcgtggtgatgaagactaatctcattgtgctctggctcactctcgtattgatggggatcatcttgtggtggcaacgacaattcagtggtcggcaaatgttaggctggctcgttagtttagtgatgacactcggggtgatgtttgcggtgatgcgaactgcccaacagcaagcgggttatacgcgccaagctgatgccgccttaccggcaaccagctggattgcgatgagcttgaacccccaaagctcgggtgagtaccgacatggcgattttgcgcgcgttaatcagatgccaactgcggcggccaagcgccaacagacccagcaaataattcagcagcggttacatcagatgggcgttacggggaccctcgtacatttactcaaaaagatgcgggtcttctgggcgactggcgattttgatagctttaagttgaccacccagtggattcgtgcgccccgctggtatttgaatcatcaacgccagcttcaattttggctggttctaatgacgcaaacgatttacctgacgatgctggtgcaagcaatcgtgactttgatgaagcggcgcgagtgggccgtgacgttcgtcgccctggcaattctcggtttaacggcttttcatgtcggactttgggaagtagaagggcgctatgcgttgccgctattaccgggattgatgctcctcagtattgtgggtggtcgtgagttgccggtgtggcaccttaaccgagtaatgcggcgccaactgacgtggttggtcgtcgtattggcggcaatcagtgtggttagtttgtggcagacgagtcaggcgacgcggattactgatgtggtacgtggcaatcagggaaatgggcgttatgttgtgtccacggttcaaaaaattggaccgggtcacgctgttacaacgccgttagccgttagtggtaaaagtaatgttttacggttgaagccagttgcgacgcatgggcgcgtaacaattaccttgactaagggggcgcatgttgtcaaacggtggcggggctcggccaatgagctgaccactttgaattatccgttgacagcggcgggcaacctgcgattagcgattaaaaacattggtcagacgtccgtccggtatggtgtgatggcgaccaactacagcccgttaacaggccgggtgacggctaagcggcacgcgtacttacaagtcgtgataaaacagcagtttattaagccgcacgcgttaacaacgggtgccgccagtctagcagttgtcggctgtgtggcgctggcgaccattttggcgttaggtcggttacggccagaaactgaataataaaacttgaagcgaaagtcttaataactggtgttgccagtgttgggacttttatttgtggttaaacgaaatataatagccgttaatttgggtgacttatcaaggtgaggtgaattcaaatggttcaaattattgcgcatactttagtgactgccgggcacgacgttttaattttaaaacgcaatcagtttgagcgtgggcggccgaatgttgatgccagctattgggatctgcccggtgggagtgcattagctaatgaatgaccgcaagtagcggccaaacgcgagtgttgggaagagacaggcttgaaagttcaaactgagcgcgttatttgggaagatgccacctttgacaaggctaaaaatcaggtgtacacgcgtttagtgtatagcacacaggcattcgttactagaccggcaatcaacttagaacttactgaacatatggcctttctttggatgaaacctgaattaattttgactaatataagaattgtgtcctatctaaaaccgatattaacgcgactggtttagcagttacggcgaccattaaaacaacaatcggactgcctagcagaatagcttggcagtccgattgttttgattgacacgattctaatggtggcgatatcgttgacgccaaagaatgaagctaagtccacttatgattgaaatcagtagtccgcccagcaatcccgggacgtggtaagttagctgaatctgattcttaccgggctgaatcggtagggctaacatcccaccaatgaccgttttaggagtaactttgacgccgttgaccgtggcgcgccaccccttgtcggctggaatagcaacgtagagccacttttgcttggagcgattggtgacttgaccactgaccacggtatgaatgcccgagacgtggtaagtcggtgtaaagcgcgtggatagcagttgctgtttgacttggttgaaccgggcttgatccaggctggcgatgtggacatgggtgccaagcgttggttgggtacgtttgaccgttaacgtgacgacagcgcctttgtcaaaataacctagcgatcggagcactaactcaccgttggcattgaacttagtcgggactaagtgaccgttgacccgcatcgtggtgtattttgtttgacgagtcgtgtcgttataatacagcgtcccggtgcgtgtcatccttaatttaaccgtatgcaaatacggatagcgtttggcctgtgaatcttggatgacgtgatctgagagcgtcgtggcgttgccaaaataggcgcgtttcgatggccgcaaactttgtaagaggcgttcttgattgataatggcactattctgacgaagctttaactgtctaaatgctgttggcacggcaaaccctaacccgttttgactacggagccgcgttgtcgcttgacccacggcgtttaattgcacagcgtattttacatctaagagtaaatcagtgaccggatttaggccttctgaactgacacgccgggcgtttttagaaaatagcccaagtgacttcaacatgagacgtgtttggttcgcaaaagttgaactgtagtaggtaatatcgtgaaagttaaataacatcgggtcgttgtaattacgatacttgctatcataattgtaggcctgattgattagcgtattttgattttcaacgcggtataattgaccatcaggatcgttgacggcttgcatttggcggtattcggttcgataggcagttacaaatttagcctgattccctagtggtgacttcgccatcatgagggtactgttagtccctaattctaaggcgacgatacctgccaagctgagcggttgccaccgcttcgccgttgcgaataaggcaattgcggttaagatgacagcgactaagctgagcgccagcgttgaagttgttaaggggtgcttagcagttcgttgggcaaaccagcctaatatcagcgcactgaccatgagtgtcggtaacaaccattgccagcgcaaggcgatccgccgggggcctgctaaccaggcttcaaaagcgatcatgatcaagacaaagctaaagaaaaaagcattgcggtatggaaagccagcgggcgtttgaaacatgtgccaaatcgtatctaaggtacgaatgtccatactcaagaagagtgcaagtaatagtccgaagctatgccatttgtgagctttagtcaagttgggctgcacccagaaacttagggccagcaagacgaccagactactgctgaagacggttggtgcgtgtacgagccgagtcgtaaaattggcggcacctaagccaaattgactcaaaacagctaaaccgaattgtgggaccggtaagtagctcgataatttgaccgcagatttagccgtggtcagcatgcctaaaccagtggggatcaggacaaacatcgtgcttaacccactgagtagcatggtgaccacgacgtgccgaattaacgaaaattgatgacgaacagtttgccaaagactgtcctgagggcgtttgcgttcaaatagttgataaataaaatagtaaatcacaaataggcaagtcatatagcctaagtagtaattggtgacgatactgacccataaccagccgaaaaagcgcccgggatgactagttgcaattaagtggtcgagtccttgaatgaccagtggtaaccaaattaatgcatccaaccacatgatcgtaaaatagttgagggcaacgaagccagagaggctgaaagcaacaccaaaaatggcagtcgaccaccgctttgtttgaaaatgcgtttgtaaaaaagccgtcatagtgaccgcaatcaagctgatttttaacatgatgagtagactaagtccggttggcaaattggccgccggaaacaacaacatcaaaatgttaaatgggcttaatagatagtaagcaatcgtgggtagtgcgttaccgcctaatgactgtgaaaatgaatataattgaaaactatgcgttaaaatggcatgccgatacgcggtgaaaaatgataagtattggccacccatatcactaattaataagttatggttaccgaagggcgtgatcccccaaattgcgaagacaatccccatgatatcaagggacagtaatccagctgtcactgccacttgccagcgccttgtttgataattaggccacattttattcaactccgatattatgaatgatttcattgtaccgtactgaaacttgaaaactagttaagaaaagcgaacaattttctgaaaaaagttaagaattagtgttagtcattatcatttttataaagtttgctagcagtttaacacagcagttcacgaggttaaactaaaaggggtgattgacaattgattaagaaagtgtttttataaaaggtgaaaactgaatacgatttcttcggggcagggtgcaattcccgaccgacggtaacaacgtaagttgaagtccgtgacccgcgtgagcggtggacccagtgcaagtctgggaccgacagtatagtctggatgggagaagaaaattattgcttgaattttactaggcagtagtggctattggcgacctttaagtaggtttatttagctggatcctactggtgaaatctatttggcgaacacttcacacccgattatcgatgatttgataattgggtgtttttttatcttgttggaggtgaaccaatgttaactgattttatgcaaatggctatcgatcaagccaaattggcgggggtggcgacgtaccaaaatccccaggtcggtgcggtattagtcaaagacggccacgtgttagctcaaggttatcatcattattttggcggtgaccatgctgaggtggatgtgctgcggcaggtcacaccagaacaggcgcgtggggccacgttatttgtcacactggaaccttgttcacactatgggaagacgccgccgtgtagtgcgcgaatcgtcgcggctggaattcggcaagtcgtgattggtcaattagatccccatccaatcgtgggtggtaagggacgtcagtatcttttgaaccacggagttgatgtggtgacgggctgtttaacggacaaagttcgcgcgttgaacccccactacaatcatttttatgtgcagcagcgaccatggatcaccctaaaaacggcgataacgcttgatggcaaaattaatactgaaacgccgactcggacgctggtttccaatcatgctagttatatcgatagtcagtgcttacggtcacagtttcaagcaattctgattggtgaacggacgctaacgattgatgatccacaattaaccgtccgactgacggcaatggtgcagccaccggttcgattggtggtgttgaatacgagtaccgtggcgttaaaccaccggcttgttcaggacggtcaggcaccaacctggttactttgtcgtcaggctgcggctagtgacgaccaacttcgaaacagtcccaatgtacacgtcctgattggcaactggacacccgctgcaatcagtcaactatgtgtcgaacaaggctggcagtcactcttagttgaaggtggggctcatctgcaagctgaatttgttgcggctgaattgattgacgaatgggtcagctacatcgcaccaatgatgattggtgggacgggtttgccagccgttaccggggccgctgcgatgacaccgttgacatttgaacaaccaacggtaacttgtttagggacgaatatccggctacgggccgttcgaaaggaagttaagtaaatgttttctggaattattcaaaccaagggccgcgtcagccaagtgcaccaacaagggttgtaaatgacccttacgattaccgcaccgtcgctgatgacaccgagtcttaagattggtgacagtatagcggtgaacggcatttgtttaacggtaacgacccgacaagcggatgctttcagtgtagtggtgatgcctgaaacggtgcgtcgaacgaacttaaagatccttgtggtcggttcattggtgaacctagaacgtgcgttacaagtgaacgcgcacttagatgggcacattgttcaggggcacatcgattactgtggtcaagtgatgcagcgacaatctgatgcgcacgcgttgcgtctgttgatcagtttaccgtcagaatatcgcgcactagtagtcactaaaggttcggtggcagttgatggggttagtttgacggtcgtagcggtcacggagacaacgtttgaagtcgatttaattccgcattcacaagcggtgacgaccttgtctaagttacaagttggaacgctggtgaatgtagaaacggatattctgggcaagtacttggcccggcaattagcattagaggggagtcattaagatggatacaatgaaaaaggtagcagcggccttggccgcattaaaacggggcgaattgattattgttgcggatgatgagacgcgtgaagcggaaggagacatggttggcctagccgctaaagcaaccactgcgacagtgaatcggatgattacatcagcgcggggactactctgtgttccgatggcgccaagtatcgccacgcgactacatttgacaccgatgactagtgaacacgatgcgtttggaacggcatttacagtctcaacggatcaccatacgacgtccacgggaatctcggcagctgatcgggcgaccacgattcaagcgttagccaatcccaatagtcaggccgctgatttctatcatcccgggcacgtttttccattgattgcgcggactggtggattgttagcgcggcgtggtcatactgaagcggccgtcacgttagcacaattagcaggtgtgacccccgcggcctatatttgtgaagttatcaagaaaaatggcttaatggcgcggcgccgtgatctcaaagctttggcagagggcttacaattaccgctaatcaccattgaagatattaccacctacgtgattcaaacgggtgccgcccagctaacaacgaccccgagtgtcaacttaccgaccaaggatggtcagttcacgatgactggtttcgaagcccccggtcatacggcgttgccagtggcactgcaagctggtgatatcagtggcgatgaaccagtgttagtgcggttacactctgaatgctttacgggcgatgttttaggatcgcggcggtgtgactgtggtgatcaattacacgccgcactccaaaagatcagtcaagctcagcgcggtgttttcgtctatttacggcaagagggtcgcggcattggcttggctaacaaactagcagcttacgcactccaagaacacggggttgatacgtatgatgcgaacgtgcagttgggctttcaaccggatgagcgccggtatgatattgcggcattaattctacgccaaatggggattacacgggttcgtttgctgactaataatcttgacaaggttgagcagttacgtgcagcggggattgatgttgttgaacgggtccccttagaaataccagccaatcagtacgatcaagcttacttaaaaacaaaacgtgatcgatttcatcatcaactcacactaacggagggacacgaatgacaacttttaacggcaaaattaatggcaacgggcttaagattgggattgtcgtggcgcgtttcaatgcgtttgtaacgcagcagcttttaactggggcacaagaaagtttggtacagcatggggtcaatgaaaccgatattgacgtggcctgggtaccgggagcttttgagattccactgacggttcaaaaaatgattacaaccaagcgctatgatggcgtgattgcacttggggcagtcattcggggtgcaaccgcgcactttgactatgtttgtcgtggcgtgacgacggggattgcgaccgtcagtttggcaaccgatacgcccataatgttcggcgttttaaccacggataccattgaacaagctatggatcgcgctggctttaagagtggcaataagggtgctgactgtgcggtcagtttgttagaaacgttggacgtgcagcgggcaatattaaaagctgacttggcctaaatgacgtaaattaagggtatgcataatatttcaaataccatcaatttgtaacttgggccattgttgatgccactgcttctgtgccattcgctgctgatagattgccatgtgcttggcatcctggcgatagtaggggattggggaacagcgaaagtttatcaaatcgtctacaccgtatggggcgattagcttgatttgattttcgtctaaaaaggcgccaatacaagttggaacttcgacaaagtgaccaattgcatcggtaacggaagtgaattcgggatccttatcaaaattataatgtgccatatagacctcattttttatttgccattggtattgtggggctttatcagtaagttgctgatagatttttaaatcatcgctggctggtcgctcagggtcaaaaaagacgacgtcaatatcactgttgaacatcactggctgcccgctgagtacttgccaaacagtattacggatgctaccagccgccaatgcgccttgttttaaatgacagtcttgaattaattgaagaatcgtcattaaagcaggagttgttttaataatatgaataactcgttgttcgttggtcattgaaaacacctcaatttaatgttggttaaaaatagtctaacatagtaatgatatcgtgcaattcaaataaaggatttgcttttgctgatttcataaaaaattaaggccgcttaccactactaactgatagtggtaagcggtcttagtttttggttgtgagtttaagtaataattgcctagtcttccgtaacctcaatcttaccaactgcaattggtagggttacgtgagcatcatacatgcccacttcaccagcgactgatgcaggtagggctaagtcttgtgggacgccgtgaatataaatgacccgcttgtctagttctaagtcatcggtaccgaagacttctttgaacttagcctgtaggtcgcctaagggcacatcgatttcataagcgaagtggccctgcacgtcggcaactgggtaattatcatttggtacgtccatatgatggggcgcattatcaaatgggaccatcgtcgtcccagaaacaggttcagtttcaggcaagtctacaaagccgtcgtgattgacatcttgggccatagtagcaatctgtgccgctttgccatttggaaagccgtggaaatgttcccagtgttgcgtgttggccggggtatcgaacatttcaatggtgacgtgtaattggttaccagtttcagtgaaagtcgctgtgccgtgtggggcagtaccgattccttcggcgttcagcgggacgatgttagcaacgtattttttagtcatgaataattcctccagttcttcattatatggtcagtatatgctagtctaatcatataaaaattgacatagatcaagaaaaggagaaattatgcattcaaaaatggattgtgtgagtcgttcaccattattttcaccgctagcgccagcggtgaaagccaaattaatcacggtgacccatcaccggaaattttatcaaaaagggcagttgattcgtcagccactcgaccatcaggaaggcatgctcattttagatgagggaacggctaaaatttatgccttagctgctaatggtaaggagaaaattattgagttgttgcgtagtggtgatgtcgtcggacaacactggctatttgcaccgcatgagaatcagggatttattcaagccacgagtgatgcgtgggtctgttccattcaatatgatgattttcagcgattattaggtgaatcagccagtttatcattagcaatgatcaataattttgggaaccaattgattgaagctgagaagaatcaattgcgacgagatttgctggatgctaaagcgcgtttgatggcgtatttgcgcgattgtgccgttgaatccggacaaatcgaatttgaattgccgttgaagaagaaggaattggcgaatattttggggattactcccgaaaccctgagtcgtcagtttaaacaattggcggctgaagggcagattatcgtcaataagcgccagattacaatttgttagacgggtaaaggggggcgtcgcctggttttggctagttaagggtgacgctggttcaatattaaaaataaagtctgatttccaacgcagtatgggctaggaaatcagactttatttgacttgtgaggaagaggttctttaatgatgaaaatgccggttagcaacgccacttgctcgcaatgccggcaaaacgacttgatcaatgagattggtgagttgctgatcagtgttcatcggttggttgatgatgtcgcagtaccgtaattgttgaaacaatactaattgtgcggcttggttaggccaaatctgaagttcaccgtggttttgtgcattcgtcagaagtggctcgatcaaggtcaagttggcatgatcaatttgagtcactaactgcgtgagatcgcgctggttctgcgcgttcaaggctgtggcaaacaatagccgaaaatagcggaagggccccgtactagtttgttggataaagcgttgcgctaacagaatgagatcggtacgaagactgccagtatctaatggcgtggtcgtaagtgcaatgggagtcttttgtatttgatgaataatagtatgaaagatgaggtcaaaggtcgaatcccagtagcgataaagaacactgcggctggtagcggccgcagtggctactcgtgaaaaagtgacctggtcgaggccgtattgactaagcagggtataggtggtgtcataaatcgcgttttccagtcggttgccacgtcgacgttgattgagttgggtcacaaaaagatctcctaattggttttagaaacagtttactgctttttgtgccttaataatagtgatttccgtagccaaacgattgttgtagttaaagacaacgtgtatcttaaatagcgttgttaacaataatttaagtaatcagaggcggaaaatatggcaaaaattattattgtcggggctgcacatggcggccgcgaaacggtcaatggcttattagcagctaatacggataatgagattcattggtacgagcacgggcaattcgcgacggctttggattgggctccggcggatgctgaaaaagagcggttggccttgtcccagcaggtgactctattcgaccaaacgacggtcacaagaattaccccagcgacccacacgattactgctcgtaatcaacgggggcaattacagactgatcattacgatcgattggtattgagcgttggatcgttaccaatccagttaccgattcccggagccgaattatctggtgttcgatcgattcaaaaccgtgccagcatcaatgagttaaaattggccgctaagtcagcagccattaaaaacgtggtcgtgattggaggcggctatattgggatgaattttgcagccttatttaaacaaaccggcaagcaagtaactgttattgatgtgaacgctcggccattcagtcacaatcttgattcagaatttacgcaaattttagctgcagcgagtgttgagaatgggctgcaattaaagatggaagagcgggtgacggccgtattaggttcaacacacgtgacagcggtacaaacgaatcgtggtcagtatgctgccgacttagtccttgtcgcagtcggcaatcgaccgaatactgcatggctacggggaactttggcgctagattctgagggattaattgagacggatgattattttcaaacaagtgttccagatatttacgcgattggcgatgcgactaaagttcggtttacgcccacgggtactaaagagcggatcactttaggcagcgcggccagtcatgccggtcggttattagcgcataacttgttaacggatcagcgaattgtgtttcccggcgttcaggcaacgtccgcgcttaatgcggcgggatattactttgttgctacgggcctaaacacgcaactagctgtccgtatgcaacaaccggtgttagcaacttacatcgcggttccccgattggtggcatccgcaccagctcgattgaatgcgaccgttcattttaagttgttttatgataaaactcatcggatactaggtgcacaaataatgtctacagcagaattaacggcggtcatcaataccgtttcgctcgcaatccagatgggagcaacgctcgagcaattagcctatggtgactttttctttcaaccgggattaagccagccggtggatgtactcagtacggctagtttacaggcgttacaaactttagccactaactaggttgattattgccaagcccattatacggacttggcaattttaagttgatgtgttgcttaagctcagtatatgacatggaaaactagtggttactgatgattagctcattaggaactcacaggaaaaaaccgtcgcgtcatcaataatgatgggcaatccagcgacggtcaaatttaagtgatgaaatcgacaattattgtggtggtctaatggtgctttgaagtcgcgcttccaattgctagagttggggccagtacttaaggtgtacggccgaggagcctcagtttggcacatttaattgttagttcgtcacgttagccgttagcgtccaagttacggttgtgttataggtttggcccgcttgggcggtgttgccaggaacggtcaattgaacttgggtgggttgccagacgttggttgaaaggtctttccccacgttggccgttgctggggctgcaaagacgggttgttcggcggttgtgagatcgaccgcgtagcttttgagctggcccgtagcgcgttcattataggtctgcccggcaggaatgtgtaacttcgcgccggtgagttgggcgccactagtactagtaaaaggactgttctggcgggcggtgacggtccaaccgtgagttgctaaccgattatccgaaacttggagccactgtttcgcgacaccgttgattgtctgggcggcgtaagttttaggctgcatacttgttgtgacactgccaaagttaaattggctgggcgcgtagtctaaacgaagttcgcccgtattaccggtcccagtgttttcgctcccactggtattggtcgtaccagggtgctcgggctcagttggtgctgtcgggccgattgccggtgcgacggtgtattgggtagcggcggcaaacgtggcatcatgataagttgtactggtgaccggattttcgttccccgcactatctttcacaaaaatctgaatgacgtcgttagcttttaatttagtggctggcatcgcaagggaccaactcccatcactggcagcggttgctgtgatggcattgccgttgctatcagctgcggaggtcccgttaaccgtgtaacgaagtgtgttaccagccgtcgtcgtggaaccgctggcaatcgttttttggtcggcaacgatttttccatctttaacggttaccggcgtcggtggcgtcttatcttggacggttatggtgacaggatctgaagtataggtggtcgttgcttgagctgtcatagtcgtgccggccgttggaaaatgatctaaggtgaaattaacgtaaccgctgctgtcagtcgtaccactttgcgttgcgccttgatcatctgttaacttgacggttgccgtgcccgttccagcgtaaatcggcgtttgtgtgccattcgattctgtataaccggtgataacgcgaacgcggaccttcttgtcggcattggtgacgagctgggcgttcaagtcactcgtatacggtgagctgaattgcacagtcggtaatgagagggtgttcgcaattcggcgcgcagccgagaaggtgagtagtcccggtaagacgctaccgctgttggtaatcaggaccccgttctgttcgatggcggtgatcccttgataggtcacactggcgctcaacaggttcaataaggacaatgaccacatactcaggttactgttcgtgattttgaaacttttaatggtcgtctcgacgattgaccccgtttgaacgagaagcgcaaagtccgtatttttaatgtcgtaggccttaggggaatctagcaagacgctcaaaccggacatgtagccaccaaaaataggggctgagccactactagtgatatacaactcgccacccgtcacggtaaacgtactgttgttgccaagcggaatcaacggggtaacgtagtagagcgcattactactagttgtggctaagttctcaaacgtgaccttactgccagcgttggcggtaaacgtgtttgctgtttctgcccgatagacgttaccgtacatcttggcggttaggatagcgttggtacccaccgtgacggcatcatactggtcatagaaaataccccgagtcgcgtctgatgcgctacctagcaagttaacattagcagcgctaccaatagtgactttacggtctccagtcccaactgtactagttgccgtgaagttgaagaaagctttgttggcggcactgttattcgccttgcgaccgatgtaggtactgctggcggcaaaggtcattccaccagtaatcatgttttcagcgacggttgttgcggtgactgcgccactgacattgacttgattaccaggagcgttgacgaggcggtaaacgtcgctggtagtgattaaatcggtcactgtaattgtccaacgagctccaccagcattagccccaccatcggtcccactttgaatgattccggcggcgccaccactacttgttccactcgcaattgcgccacgaatactactgaagttttttactgtcattgtctgggccgtggttgtggaacccaatgtgaagttaccgatgccgagatcaaggctgtgattttgcccgtcgatggtcaggctggtggtacgagtgcctaattctgtagcacttgttgacgtgtgggtaatgttggcccccaatttaatcgtcgtgacggcggtattggtatacgctgattttaaatcatcgtaagttgagacggtcgtgctaccatctggattgaccacgattgcggcggtcgtgatatcattagcggctttggtggcagtcgctttagtcgctttcggtgtccgttctacttccgaatcagcctgcgctgtgcgactagtagcagtgtcgttgtcagcagtcgggtccgatgtcgcggtggtgctagacgactgttcggacgatttgcttgtggcattgtagtcatcacgtttcgtggtagccgcttgtgttgctgttgctgacgaatcgtcagtggtcgggtcttgactggccgaagaggtgctttcggcatcattgctgacctcacgtgctgattcagtgccggcttcttcaggaggtgagtcgactgcggagcccgcggccacggtgaaagttattggttcagcggtcatggtgtgggtcgtcggtttttcactactggcgacagctgaagcggtagtggtcgctaatgctggcccagtaatcagtgcttccgcggtcactttgtaggttttcgcttcactggcactcaataccaaatcgaacgtggtactggctgtcggatcagatggcgtcaaagttagtttccggttgtcagcatcaaaatccagctcagcgaggctcgctctgttggcttgccgggttttagtttggtcaacggtgagggcctcaggaatagcgaccatgacttggtgttcctgggaaccttgtacggccaactgaagtgtaaaaggttgcccaatcactaattccgtgggtggttcctcgaatttgattggtgtggccgtggtggtcgctgtcgcataaatggcaccgccgttgacaacgagtagactcattaagagaacgagtaacccgagccaagccgttattaatcttcgtggtcgttgcaaattgctcactcccttcggcgttgcatgagccacacgagccaaccggctaagacagctgtcaacagacctaaccagactaacagttggcgggcttcattcgtttgtggtagcactgattgatctggacgtattgccgcggatgatggtgtctgagtcgaagcctgttgattagcagtggcgatgatgttgggcaccgctagatattgatagggacgggggtgctggaagtttgtcaggtccgtcccggcttgccagtcggtcaatgtcacactagtgtcagttggggtagccgctagggcatcgggactccgacagccaccagcgagggctagtccaaggcttaatgatagtaaaactagccgcctgaatttagccataacgataacctccttgtttgagtaccaagttagaagataatctaaaattaactgcttatttaggttctgcgattgtgtcgtttcataattagataaacgattccggcggataagccagcaattacaatgacgattaggacgtaccaccagatactgatgggggcggccgggtcattcttggctttttgattattttgacgtgcttgttcagtcgtaatcttaaagtcccgggaccaatgccaagtttttttggcccatttggagtcgttagtcgttgcggtgacggataaggtataatcacccgcccgcatgacttgatcgtctaaaaaagtggggtaagtgaagttcgaattgggggccatgatcaagttgtcgctactgttctgatagagtaccttggaactgccttttctcgtgaccttagtggtcagttttaattgcgagaccactgctggttctgggttccgaatggtcgcgagcacgactttgcgatagttgcgtaatccgggagtgaccgtccccaaagtcaacttaggctgtgcaatttctttggccgtcagtttaaccgctaacgcataactatatttttggttaatattgacgctcttggatgcttttttcgcgccttgccccattttttcgaagtaccatgagcctaagattacaccggtatcgaatcctttgggaatgttgattgtggcgctgacgacccggttacttttggcggggaccgtgactttatcggaaccggctgccaaagtcgcaatttgatcaaaacgatattttaagctggcatcgtatcgtttggctgtttgggtgtaagcgatttggcctgaatcattcgtaaatgtcgtgagtagctgggtcttgaccgtaattgattggtcagtcgggttatagacccgcgcctgaattttacgagtggtgcccgccttggccttaaggtcgaaaaacggactgctagcatcgacttcttggccgggactgattttgttaacactatattgaacttcggcattggtagcggtggcctggacgcttggtgaggtccaactcatgaaaaccaagccaccaattacgccgaataagcacatcaattttttcatgattacctcctagttagtggtagcggcgactaacgtccaaactaagttgttcgtgtagttaccgacttgggctgtcagcttggggattgaaagggtcacggcacccgcgttccaagtgtttgtggaagtggctttaccaacacccgcccggttgggggcactgaaaacgacttggtcagcggtggtgacgcttacactgggggcaacaactaaattggaatcggctactgaggcgggctcgtttagcgaattacgcgcagttccttggggtaggtgaatcaccgcaccagtcagcacgtgattattactagcgttagttaacgtccggtcttgcttaacgttgacttgccagccgttggcagtggtgcgtttgtccgagacttgtagatattgattgtagttgccaattgcagtgtaagttttggctgcgttggacgtagtgacggtaccaaagtcgatagtttttggggctacatcgagggtcaatgttccggtattgttagttgccggattattcggatcggtggttgtcaacgggacgttgggactagtgggatcaactggggccgtggcactagtatcatcttgaaaagtcacggtaccattagtcgttgccccgagagccgtcaaactggttgccattaaccctaaaatcgctaaccccgtactaagacaaaagcggttaaacatggcaatccctccttatggttagctaggggtagcagcggtcaaggtccatgtcaaagtgttgctgtaggctcctggtttggccgtgtttttgggaatcgtcaaagtgacatcacttggatcccaaactttaaccgaagtgcctttaccagcgccggtagtggccgttgtattaaaaacggtcacggcaccactcgtattggtaacatcggcagctgtagtcgttaggttggtatcgaccgccgtagggtcagttgccagactattacgtgcaatcccagctggtacgtggatggtggtaccggtcaaaacatgcggtgaacttccactagtttcggttaaatcttgatcttgctcgacggttacggtccaaccctgttcatcggtcccacggttatcggtgacctgtaaatattgttgcccattagtggtcgtcgtggccttataagtgtgttcggcggcataagtttgaacggagccgaagtcgaaagttcgaggagccacgtctaatgttagagcaccagtattaccagtagctggattgtctggatcttctggaacttgtggattggccgggttagtgggatctactgggatagttggtccagtattttctgtcaattccaaattagtagttgtgttcgcagttgaatcggcggttgccatgacggcgggcattcctagtaagcttaacaacatggtcgcggtaagcactgtttttttcatgatggatcgctcctttttggttgtccgtgcctgcggtgatcaacaaatgtttggtaacgataatcaactcctggccagaagattgtcttgcgtttatcgttgctatagggctagcataatctattaggttgcggctatttttatgcatatattttgatgaatattgattagtattagcttatcaatcaggccacgatgatgtaggacagtgttgatgtgccagcactaggtgtaatggcgtataattaagtcatatgaataaataaagaatcggttaactaacgggaggagtgatgggcgtgcgccgagcggaaattatcaatggcttacgatggtcagtagtagcggacgcattagggttgcccgcggaaaatcgtcaacggggaacttatccgttaattacggaaatggtcgcaagtgacttttggaaacagccagcagggagctggtctgatgacacatcgatgagtttaggattgattgagaatttggttagcggtggtgattatgatgatctcatgtcccgatttgagaactatatgcgctttggaacgaacacgccgcgtggtgaactgtttgacattggtcggacttgtgctcatgcaattcggaattatgccatcaatcagtttccggcccgccaatgcggtgatccttcggtgcatgcgaatggcaacggcgcgctgatgtacttagcgccgttagcggtggctctgcagaatgacacaagcgtcgcacatcgactgacgataactagaaattacacgatgttgacacatggtcatgctcgttcagttgtggcgagtctaatttatttggaagtgttgcatgcgcttcatcagggacaagcgttgcctgctgcactggtatcggtgcatgaattgctaatcagtacaatcaaggatatgacacttttaggtgaactgagcacatatggcgcgttattttcaccagacttcgcccaaacaaaagccggagtcattcggactagcggttacgttgtggataccctgttggccgcatgctggttagctttaaactaccagacgccacgggaagcggtgttagcggctgttaactttggcggcgatacggatacgattgccacgattaccgcggccttaactgctgcttggcatcctgatattacagtggatacgaagtggtggcaacaaaccttaaatcataaactgctcaatgcccattttgaggtatttactgctaaatttgcgagcagctagctgacggttagtctttcggcgtgaattgtttggatgtgattaagtagcttgggaggcgttcccgggatatatttatcggtggcctggtgcaaagcgctcacgaataacgttagtcgttttcaaaaaacaagcgtttaaaatcatgattccacacaaaaagccaccctgacatgttaaacgtcagggtggcttaattaatttaattagttagagcttgatgaagatgaggttgaaaggtatgacgataagatatccttcaaatcgttatccttgattgaaacgttcccacccttaagcactttagaaacaacgttttgtaagacagtggagtcgctcatatcattgtcccaaatttgtttcttcaaatcagcggtgtgatcagacatcttacccttaccagggttcttgatcatccggatgatttcataaccgttgctggtcttaacagcggaagtcgtgtattcaccgttctttagcttgaaagcagccgttaagaatttagatgagtagctcgtgttagtgttatcaaaggctgataacttaccaccatcattcttagtcgttgtatcagttgaatacttcttggctaacttcgtaaagttggcttggctagaatccttcttcaaagcgtctaagactttgtcagcagttgctgatttggcaactaggatatgttgaaccgtgactttaggttcgtaagacttccattgcttcttcaaagctttatcagtaatcttgaccttgtctttaacggcttccttcaataataagttagaacgtaattgttccttgaaggtcttggtcgtcaaaccattttgcgataagacggttgagaaagaactaccatattgtgacttgtaagtattatattgcttcgtcacttgcttagtcgaaacttttgagccataatccttttcgagcaccttattcaggatcatttgttgcaagacttgcttacctgaagaggttcccttcatactactgtaatattggctttcggtaatcttaccaccggaagttgatgcaacggtcttgctaccacaaccagctaaggtgaaggttagtaagacaccagcaagggcaatgagccatttcttcattcctaaaacacatcctattcttgaaatcgttctgcgttagcagacttcaacgactactataccatatctattaaagcttctgcatgcatatggaaatctttacaaaattttcagagatttcacagcctcttcataaattctacctaatgcgtcagtgaatttaaacgaaatcagcttgttaagatagcaaacaaaaaaatcgtgggcctaatgcgacctcacgattacttgctcagtcggttgtcttggttaaatggtctaaggtgtcttgtaagtgatccgcacgttttttcatgatggctacgtggggttcaatcttaaattgaaatttatccaattcagtctgaatgtcatcaaaaacttccgcagcgtgggccatttgaacactgagattgctctgggcatcgctaaactcttcacgtgcgtcttgtaagttatcagcagcatctaaaacgtcttgcacgtaacttttgatgtctgtgtagagtgctttaggtgttttctgattgatcaacatgtaggtcgcagcactgagacccagaccgatcaggctgttacgaataaactttgccatgggagacctcctaattagctaattcagttttaatggcgttctgtaagcgagtgtagtcggtttcgtcatattttttggcgttgtccttaaagatcatccgaaaatcatctttatcgctgtagcgggggatgaggtgaaaatgggagtggaagacggactgataagcgaccgcaccattattgttaacgatattcatgccaatgatattctcgtcagttgctttgatagcgcgggcgatttcaggaatccgcgcaaacacgatgctggcaagatcacgatcgtaaccgaaaatatcggcaacgtgcgtcttcggtacgactaaggtgtgaccaggagtaccttgcgagatgtcaagaaaggctttgaccatgtcgtcttcataaacggtatagctcggaatatcgcccttaattattttacaaaagatacaatcgtcatcgagttttggttcaaaagctgtcatgtgataaccttctttatttattagttgggttcattatacactatcgatgttgcggcaatcaaaactaggtagcttgattgacgacaaattactgaagtttcggtaaagtcggggatcaatgagccaaccaaatagagggtgtcgtgatggctatgctataatgggagcacttataccaacacagaaagaggttaacgttatgacattagcggtacaacacttagttggtgggtattcgcaaattcccgtcttaaaagatattagttttcaagttgagcccggtgaattagtgggcttgatcggacttaacggggccggtaagtcaacgaccattaatcatattatcggtttgttgacgcccatgaaaggatcaattgcgctcaatggcgtgacattagcacaagatcctcaaagctataaaagccaaattgcgtacattccagaaacacctatcttatatgaagagttaacattaaaagaacatctagaaatgacgatgctggcgtatggtttagaccaagaacaggcttggcaacgggctcatgacttattgaaaactttccgattggctaacaagttggattggttccccgcgaacttctcaaagggaatgaaacagaaagtcatgattgtttgtgcgttcatcactaacgctaagttgttcattattgatgagcctttcttaggactggatcctttggcggtgcacgacttgttggcattgattgcgacagtcaaagcacagggagccgctgtccttatgtcgacgcacgttttggacacggctgaaaaagcttgtgataagtttgtattattgcatgctggtgaagtacagacacaggggacttttgctgaaatcaaagcgaattatccggatgcgggtgagtcgttaaacgatatttatctttcattgaccggggtgacccgtgatgaatgagttatttcaaacgcggttgcagcggcatctgcgtcggatgctgcgctacctaagattggtgttcaatgatcactttgtcattgcattgatgttttttgtcggcggactcgggctggcttattccaattggctcaagacgcttggccctcagcagacgtggatcgtctgggtgctcggtctcttattatgggcggggctaagtgtcagtcatatcgcaacgttattagaaccggccgataccgttttcctgttaccacgtgaacgggatgtgcatgcgtacttcgtgaaagcgtggcgctacagttggtggttggcgcaagcagtccaagtgatttttgttggcttgaccgtgccgttgctcatgatcgttgatcagatgacgggctggtcgttgctggcgttactcatcacccagttggcgttaaaggatgcccagttaacgctgagcgtgacgcatctctatcaagtgaagccaagcatgaagcggtggttgcgccccctgaactgggccggcgcgttcgtcacgttggcagtgggactactagtgacgccgtggttgagtgccgtaatggctatcgcgattgcggtgggacaacgttatttgcaccaacgaatttggtcgaccacggtgattgcttggcgtgacgacatcaaagccgaagccaaccgtatgttagggatttatcgattctttaatttatttacggatgtaccaatggtgcaaggcagtgtcaaacgtcgtcggtacctggattggttactacggtggttacctaaggaccagcagcatgcgtttggctacctatatacacgtggcatgttgcgcggcacggaatttagcgggttagtggttcgtttgacagttattggtgcggtgctactgtactttagtgggcacggttggttagcgatggcgttggacgccttatttatttacttgattgggtttcaattgttgccgttttacaagcaatacgataatatagtttttacgcacatttatccgctggcaactaaacagcgggtgaaaaactttcagcggttattgcgaaacgtgttaagtttgacgggattaatctttttagttgcgttctggttaagcaacgcaccgttagctcaagttgggattttgctcatcattaacgtgattgaaatctatctcttagttacttggtatttaaaattaagattagcttaaaaccttgatttatcaagggttaaaaaggacttgacggattcaactttcgtctataaaatgtgattgttaagtcaaataataatgagtcattaaataaattttgagaggagtggggctgatggatttcgaacttgatgatggctgggacgtttacccgatctatgggaatacgaataaagctttcatgggcaaaaaaaatcaccaacgattgttcttaaagcgaaacgcctcgccgttcctagcggcgctgtcgatggaagaaattaccccgcgattaatctggacgaagcgtatctcgagcggggatacgctgacagcccaagagtggttgaatggtcaaactttaacgaagcaacaaatgcggctgcctgaagtggcgcatttattggcacgtgtgcacaattccgagttgcttcaccggatgttaagaaaagtcggtggtcagagtgtccgcccacaagactttattcagcaatacttacaagatttaccagatgatttacggcaccatccgttaatggcccgggttctggatgaattaagaggaaccgcacccactttaccggccactgattatcgcgtttgtcacggtgatcttaaccacaagaactggttactatctgatcgccaacaactgtacttggttgactgggattccgcaagatttgcggatccggcgtcagatattagtatgctactatgcgaatatgtcccgttaagtgattggcaacagtggcttagtgaatacggtgagactatgacgaccgccttacggacgcgagtggtctggtatgctaagattaatttactattgaatatcaaagataattattatcggaatcagtaccatcagatgaaccatgaaattatctttttagaagaattatcgcagtacgaagtgtaacgacgagcaacaaaatcgccgcgagtcccagatggaattcgcggcgattttgttgagtaagcaaatgaagaaggagtcaatcaagatgcgtgtcagaaataaaccgtgggcgccaaagttaattgccgcccatcccgaacttattaccgaagatccaactcagttaaaaggccgctggcaaagccgttttgccaaaccccagccactccagattgaagtggggagtgggaagggccagttcatcattgaaatggctaagcgtcatcctgagataaattacgttgccattgaaattcagacctcggtgattgcgattattttgaaaaagctagtcgaggccccgctgcctaacctgcaattggcacatgcggacggtcaagcggtgactgcctttttcgaaccccatgaagttgatcgcttatatctgaacttctctgatccgtggccgaagtcgcgtcatgaaaagcggcgtttgacctacaagtcgtttttgagcagttaccgggaagtcttaaaacccaacggtcagattgaatttaagactgataaccgggggctattcgaattttcattaacgagcatgaataactttgggatgcaatttgaacaagtttggttagacttgcatgcggttgccacacctgaggataacgtcgagactgaatatgaacagaagttcagtgcggcgggcccaatttataagattattgcaactttcccagcaaaatagactgaatgagaacagcgaaacgcgtcggcgatcgctgttttttaattgagtgtaattgtcggaaacatcaaaaatgagcttccagaattttaattccagaagctcatttttgatttttgatgcggatagtcaattgtgagttattaaagccggtaaatgtctaaaatactaccagtatttgcatcggccaaaaactcgtactgtaccagctgaccatcttcatagcgggtaatgccgccatagtagacatccgtgcgcaatgcgaacttttgtaatggggattttttcatttcaatccacgagccttcaatcggtgcttccttcaaaaacgcgcgcttgacttggctaagaatttggttaggggtggggcggcgcaaccgcttgaacaggccgccaacggaaaagcccccggcgataccagccatcccaaccgctaacaagccgccatattgtaattgtttattcatgatgttgcgtctcctttcagctaacttgactaggaaatgttttatttaaatttagtataccaatgattgacgagaatacaaagaaaagtcataattaatcagtatgatttaagtaaaatacgctataataatatattgaacgctaaaatgagagtaaaggggtttcacatgttaattacaagttataatccatccgaattaggtgacacgttaatcaccattttacgaccagatgcggccacccaaacgattgaaacacatgccaatgtgacgcgtattagcgatgctgacagtggggaaaccttgggctataatttctttgacgtttccaagacgttaggcgacttagatgccaatggtcaagttcacttaacggccgaacaagttgagcaattaaataatttattaaaaaccaatgattttgaacctgaattagttttagacactgaccctaagtttgtggtcggctatgtggaatcagccgaagcacatccaaagtctgatcatttacagattaccaagacgaatgttggtttggaacaaccacttcaaatcgtgagtggttcacctaatatgcaggcgaatattttagttgttgttgccaaggtcggtgcaatgatgcccagtggcttaattatttggccgggcgaattacggggcgttgagagtgatggcatgattgtttcaggccgggaattacgattaccgaacgcgccacaacggccaggagctttgattttgcccgccgattatcagccagtgggtgcggcattcgattttaaacgcgctcagacgttatttaccgcttaatttgcagatattaaaaactaggatgattgaaaatgaaccattatgatggcccggcatttttccggaaatatcgatttaacaaaccacaagtgaataattcagcggccagtcaatcaactcctgtagcggcatcggctagtccacaatcgactgctggtgcacctagtgcgacgccaaagcgggcagccagtcaaactagcgccaagcaggtgacgagtcaggcaactacttcgagtagcagtgctgcaactagtgcgaccctctttaacggtggcacccatgggacttttcacccatcccgggtaccagcccagcttagtgcggcgctgacaaatggcggtatcattcaggatcacgataaccgtaattatttagaaattgaagcgagcttgcataagcggcccgagaccttcttattgtttgcggatgcagcagctaatgatttaccggctgttgatttgcaacaaccgctttctgatagtgggacggacacgagtcaagttgaacacccgagtgattcggcagttcttagtcaagcggaacggaagatggcttcaagtgttgacccgacaacggtaactagtcaggcagcatcgagcggggctgctcaaacggtcgtggctaacacgtcacagaccggcagtgattccacggtgtccgcagcttcggcgacggttgtgcgaccaacggaagtgtttgaacctactactcctgaattagctgtgtcggctgcggcaattaatacgcctaaaaccgatgattcagtggtagtgacggctcccacggaagtatttgagcccactgacccaagtttagcagcgtcggcagccgccataaatgcgcctagcgcggtaagttcggcagtatcggcaggccccacggaagtatttgagcccactgacccaagcttagcagcgtcggcggccgccgtaaatgcgcctagcgcggcaagttcggcagtatcggcagggccgacagaagtgtttgaaccaactgatcccgcgcttgctgaatctgctgcaactgttaatgcggctgctgatcatgataaaatagaatctgctgcgactagtgcgacacccaagtcagcacatgggctaggactatccttaggggatattatgaccgctgagcacgatgcccaggcggacttagcgttatttaaggatcagccaacaacggcggcttctgcagcaccacagtcaagtactgcgcagactcgttcacacgttaacgaagaaccttatcaaccggttggcatgcggccaactagcacaagtcctgctgtgacgtcggcaacggccacgccagtcagcgttgtggcatccacggtacctttacaggaaagtgggggagcggctagtgtgactatggcaccgtcacaggcggctacttctgcagttacaactagtcccgctttgtcagagacatctgcagtggcttcacaacctgagttagttcatagtggcggttcagcggcccccgtccttgaggataaagaattagcggcttatcatttgccaccgctgaatctgttgaaagcaccgatcgtggctaatgaatctgagatggatgattggatcgagcagaaggccagtgcgttagatgaatctctggacgcatttggtgtcaatgccaacgttgtcgattggacgattgggccaaccgtgactcagttccaagtaaaacctgctcgtggcgtcaaggtcagcaagattaccaacttaaatgatgatttgaaattggccttggctgcaaaagatattcgaattgaagcgccgatccctggccgtaatacgattgggattgaaattccaaatgcgaaatcgcggccggtgatgctgtctgaagttttagattctgacaaattccgcgacagtaagtcaccattgacggtcgcactcggtgtcgatttattcgggcaaccacaagtcactgacctgcggaagatgccgcacggtttgattgcgggggctacgggttctggaaaatcagtcttcatcaatagtatcctggtttcgattctgtacaaagcgaacccacaacaagttaaattgttgttaattgatccgaaggccgtagaactagcaccatacaacgagattccacatttattagcacccgtgatttcagaacccaaagccgcttcggcagcgctgaaatgggtcgttgatgaaatggacaaccggtatgataaacttgccgctggtggtgcccggaacattgagcaattcaacaaactggccgacgaacatgacgagccggctctaaaaatgccgtatatcgtgattgtaatcgacgaattagctgatttgatgatggttgcttctagtgaggttcaggattacattgccagaatcacccagaaagcccgtgcggcagggattcatttactagttgcgacccagcggccaagtgttgatgtggtcactggtttgatcaagaataatatcccaacgcgggtggccttcatggttgccagccagatcgattcgcggacgattctggacgcgagtggggcggaacgcctgttgggacgcggtgatatgttgtatcttggcaacggtcaacccgcaccgattcggttgcaggggacgttcgtggacagtgagattgacagtatcactcagtttgtccgtgatcaggcagcaccgcactatgaatttcagccagacagcctaatgaagcacgaggaagcagcacgcaatgaagatgacttgatgcctgaagcattggcttacattgccgatgaagataccatgtcaacatcgaagttgcaacgaaacttctcgattggctataatcgggcggccaatattattgatgatttggaaagtcgcggctacgtttcagcagctaagggttccaaaccacgagatgtttatttcacggcagcagatttaactaaattacaagccaattcataattaaaaataaagcgattcacctcatgattgatgaattgtgaatatgggagattattagcataatggataaagcaacggtttattattttgttgggatcaagggctctgggatgagctcactagccttgattttacatgacaagggttaccaagttgaaggctcagatattgaacaatatacgtttacgcaaaaaggtctagctgcagctggcattaagatgctaccgttttccgaagataacattcgcgaaggcctcacagtgattgcggggaactcatttactgatgaccatcctgaaatcaaaaaggcgcgtgaaatggggttgcccgtttatcgttatcatgaatttcttggaaaattaatggaaggcttcacgagtattggtgtggccgggactcacgggaagacgtcgacaactggtttgttgtcccacgttttgagtcatattgctcccaccagttacttgattggtgatgggaccggtaaaggcacccctgacgcgcgtttcttcgtttttgaagcggatgaatatcggcggcacttcgttgcttaccatcccgattatgccatcatgacgaacgttgactttgaccatcctgattactacaaggatttagctgacgttcaatccgctttccaacaatttggcaatcaagtgaagaagggcatctttgcttggggtgacgatgaaagtttacgacacctcgatgttgataccccaatttactattacgggacgaatgaccgtgacgactttcaagcggttaatatcaaacgaacgactaaggggtcttcatttgaagtgaagtatcacgatgaatcgttaggggaatttgaaatcccattgtttggtgaacacaatgtcttaaacagcacggctgtcattgcggtttcttactttgaaaaggtgaacttggacgaaattcggcgggaactcctcgactttagtggggttaaacgacgtttctcagaacatcaagttggcgatatggtcatgatcgacgactacgcacatcatccatcagaaattaaagcaacattggatgctgcacgccaaaagtatccggataaggaaatcttggccgtattccaaccacatacgttctcacggacgaaagcattgatggatggctttgcagccagcttaagcaaggcagatcacgtctttttgaccaatatcttcagttctgcccgtgaaaaatctggtgatgtttcctccaaagacttagctgctaagttacccaatggtggtgaaattatcacgaccgatgacatgtctgctttaacggcttaccacaatgccgtcgctgtctttatgggtgctggtgacattcaaaagtacgaaaaaatttatgaagaccaaatgaaataatttttaaaaaagcggccccagcagggccgcttttttagtctgtctttaaattgatttagcgtaaaccggcgttagcatccaagatgaaaccctatgagagatgttagattattgctagacaacagttgtgcgacctattttgaccttacaagttttaatggaacttatgcagtcgataaataaagcaccaatgaggataattcactagaatctccgtcattggtgttttattagtgtgtatgatttctaaggattaaccacgtggttagtgaggcaggtgcagtagtcttagttttgttgcttctgggctttgtttaacattttcttagcttcacaatcatagtcgcaggccgcacatttgccctttttagcacgtttgaccacgcgataaatctgatagccagcagccccaataattagtgcgataattaagaaattaacgaataatgccatgtgaatcaaactcctttcagataaataattgaccaacttggtaaatgacgaaggccaaggtgtaagcaatgaccaaactcgagcagacggcgtaaacagctcacttggtcgatccagtctcggacttgatggtcccaatcgtggcgaagcacgggacatatagcaagatgaagacgagcatcgcgtatgcggataacggtgtgaaaaagcgccccatcatggcaatcaagccggcctgatttgcgctgtggaacattaccatcatactagagctgatgacttctttggctagaatcccagtaaagagggctgagataacttgccaagcagtcacaccgagtggcgcgaacagcggtaatagtgttttgccaagtgtcgcggcaaagctgttgtcgatgtcgctgactaagccgctagtaccgaatgaggaaagtaaccaaatcaagaccgtaccggcaaaaatgatagtacctgcctttttgatgaaccctttacccttatcccaggtgccacgccaaataatgtcagcccggggaatatgatactgtggtaactcaacgatgaagacggaactatcatcgacgttgaaaatcagttgataaaatttagccataccgagggcgaccgcaatgccaagaaagtaaatcgacaagacaattagggcctgatttttcgggaaaaaagcggccacaaataggctgtagattggcagacgggcggagcaactcataaatggggaaatcagcgttgtaattaagcgttctttaggttgttcaattgtccgggcggccataataccagtgacgttgcatccaaatccaataattagggggataaatgccttcccgttgagtccaatcatctgcatcaagcggtccgtaactagtgctgctcgtgccatgtaacctgaatcttccaagattgaaatacaggcaaacaagacaaaaatttggggaataaagacgagcacgccaccgacccctgcaattaggccgttaacaatcagtgagcgcaagaccgggatggctccagccatggtcaaccagtgactcacggtggtggatagtggtccggagacgaagctatctaacaaatctgacaggggcgtgccgacccaatcaaaggataatttgaacatcaagtagaagattcccacgaagacgggtagccctaagaacggattggtgacccacttgtcgattttagcagtcatctcgacgtggctggtgcttgccaagttttgactagcgctggctaaggtttgctcaataaagtctagtcgggtttggaagatctgctcgtcgaatttttgagcgtcgtaataagcggcttgactagtgagtggtgtcaatcccatgtgtttcgcgtaggctcgaattggcttattttgattaataaattgaatcgtcagccaccgtgcgaagtctgctgtcaaatcaaattttttgatgagctgttggctagcctgacgaatggcttgctcaatcatgaaaggatagttgagtttgagcggtgtcgcggccggatggggacctgccaataagtcttcgcgtagctgatgcagcccttctttattgcgggcgttagtcgctttgatctgacagccaagttgttcagctagcgtgtcaaaatcataataatggcccgtccgtttgaggtcatcaatcatgttgagtgcgataatcaccggtgcgccaaattccaacacttcgatcgacagtagtaagttacgcttgagctgactcgcgttggtcacgttcagaattagatcagggtggttatgtagcagatagttggtgacgactgcttcatctttggtgattggattaagtgaatagactccgggtaaatcgaccatttcaacttcagagtgccgaatccggcccatcttcttctcaacggtcacgccggtccagttaccgacgtacgcgtatttatccgtcagttcattgaatagcgtggtcttaccagtattgggatttccgagcaatgcaaccgtcgtcatcttaatggcctccaatcaacgtttgaaatacggtgtaccgaatcccaatccgttgttgatcaatctgaacaattactggtccgtgaaacggatagtagcggacaacggccagcggactgccgacatgtagccctaagctgtgcaatcgttgaacggtctgattatccaaacctgtgaattgttgaatatgtagttgtgatgtattagtaacggattgacttagcataaggctcagtcctttctgaatattccaatagtgaataattcatcaaaaatattatacctacatcatagcatgaaagggcttttattaatatggggaaaagccttattttcttttgaaatgaaaacggttatactctaagtatagaatacaaaaaggccgatgttacgctatttttgttgaagccgttgactaatcattatatacggaaggaataacggcttgggtaataaattcaattgttggaggatgatttaaatggcaaccttggaagttaaagatttacacgttgaagtgacggatgatgagcaaaaaaagtctcgtgagattttaaaaggcgtcaatttatctatgaaaactggtgaaattcatgccattatgggaccaaatgggactggtaagtccactttatcacaaactattatgggccaaccggcttatcacgttactcagggtgatatcttgttgaacggcgaaagtatcgtaaacatgccagttgatgaacgtgcacgtaagggactcttcctcggcatgcagtatccagctgaaattcaaggggtcaccaacgctgaatttttacgggcagcaatgaacgcacgtcgaccagctgatgatcaaatctcagtgatggcctttcttaaagaactcgacaagaacttggcactacttaatatgagcgaatccatgacggaacgttacctaaacgaaggtttctccggtggtgaaaagaagcgtaacgaaattttgcaattattgatgatcaagccatcattcgccttattggacgaaattgattccgggcttgatatcgatgcgttacaagtggtttctaagggtgttaattcgatgcggggcgataatttcggctcattgattatcacgcattatcaacggctgttaaactacattgtgcccgatgtcgttcacgtgatgatgggtggtcgaatcgtgaagactggtaacgccgacttagcaaagacccttgaaaaagaaggttatgctggtttacgtgacgatttgaacattgatgtcaaacttgttgacgacgaagattagggggtggcagtaatggaagcaactgctgattatgaaactatcaaaacaacgctagctgcggctgctaacgaacatggtgaaccgcactggctcgttgaacgccgtttagcggctttagatgcgatgcaaggcctagcggttcccaaagctgatcgctttagtattcgcgactggccactgacgcccaccgaccaaccactaaagttcagtcgttcggatcgaactttagcaactgatgtaacggctgaagctggtcatatccaaatcgtacaagttgggcagacaacggtgaccgtcaatttgcctgatgaactagatgatcagggtgtcattttgaccgatatgttcacggcttttcgcgaacatccacagctaactgaaaaacattttatgggcaaagtcgtcaaaactgacgaggaccggttgaccagctaccataccgcgtttttgaacgccggggtcttcctatatgttcctaaaggggttactgtcaaagaaccaattgagatcaccacgattcaggatagtacccgagtgcaaccgttaattagtcacgtcttgattgtggctgaacaagacagtcatttcgcagtaactcagcacctgacaacgaagggtgacgtcgataatatcgccaactgtgttgtagaaattttggcacgggctgacagtgaagtgcatttttcagcgttcgatgaactcggggccaacacgactgcttatttgaatcggcgggccgcgatcagtcggggagccaaagtcgattgggctatcgggatgatgaataacggtaacactttcggggactttgactcggaactgatcggtgagggcgccaaatccgatgccaaggtcatcacagtgacgaccaaggcccaggatgtctgtgttaatacgcgggtcactaaccgtggtaagaagactgacggcaatatcgtacaacgtggggtcattatggaaaagtctaacctgatttttaacggaatcggtcacattattcacggggcctccggtgcacatgctgaacaggaaaatcgggttttgatgatgtctgatgatgcccatggtgacgcgaacccgattctattgatcgatgaaaatgacgtgttagctggacatgcagcaagtgttggtcaaattgatcaaaatcaaatgtactatttgatgagtcgcgggattgataaaccacaggcccaacggttggttattcggggcttcttaagtaccgtgattggtgcgatcccatcgaagactgtccggactcgcttaacgaacacgattgaaaggaagcttgaagatggcatccaattttgagacgttacggtcagattttcccattctaaaccaacaagtgaatgatgaacgacttgtctacctggataatgcggcgactgcgcagcgccccaaccaagtcgtggatgcgctcgttcacttttatcaacacgataatgccaatgttcatcgcggtgtgcacaccttagcagagcgggccactagtcaatacgaagctgcgcgcgccaaggtgcaacggttcatcaatgctgcaaaaacggatgaaatcgtcttcaccaaagggacgacggatagtctcaatctgattgccagtacttatggcgaagccaatattcaagcgggtgatgagatcgtcatttccattatggagcatcatagtaatttaattccgtggcaacagttagcattgcgtaagcacgccaccttgaaatatattgagttaacggcgactggtgaattggacatggccgatgctgccaacaagattacggatcgaacaaaaattgtttcagtgacccatgctagtaatgtattgggaacggtcaatccaatcaaggcgttagcacgattggcgcatcaacacggtgccgtgatgattgcggatggggcgcaagcagcccctcatatgccggtcgatgtccaggcactcgatgttgatttttacgcattttcagggcataaaatgctaggaccaaccggtattggcgttctatatggtcgtgagaatttattagctacgatgccaccgtatcaatttggtggtgagatgattggctttgttcaccgtgatgacagtacctgggcggaactaccgtggaagtttgaagcgggcactcagaacattgccggtgcgatcggcttgggcgcggcggttgattatttgacgcaactcggtatggatcaagttcagcaacacgaacagcaattagtcaattacttattgcctaagttgattgcaatgcctggtgtcacggtctacggtccccaagatccccaacatcatacgggcgtcatcgcctttaatatcgacggtttgcacccgcacgacgcggctaccgcgttggatatggaaggtgtcgccgttcgcgcgggtcatcactgtgcacaacccctgatggcagcgctcggcttagtagtaactgcacgggctagtttttacatttacaatacacaagcggacgctgatcaattattaacgtcactccaagcaacaaaggagtttttcgaacatgggactgtctaaattaagtggcttatatcgcgaagtgattttagatcatggtgatcatccgcatcataaaaatgcgttgccaaacgcaacacatgccattacgttgaaaaatccaacttgtggcgacgtcatcaatttggctattcaattggatgcgcatgatcaaatcgaagatattggatttacgggtgagggctgtaccatcagtcaagcatcggccagtatgatgacggatgcggtgatgggtaagtcgaaagaacaggcattggcaatggctaagacattttcggatatggcgattggcaagcaacacccgcaggccgatatggatgccttagaagacgccgcaattttatcgaatattatgcaatttccggcacgaatcaaatgtgccacgctagcttggtgggctttgcaacgggcattgcttgctgaaaatggcaatgaggaggaatcagaagtatgagtgaagtacctgacgtggtcaaaaatgaccgtgattatgaatatggatttcatgacgatgtcaaaccagcatattcaactgggcgaggattaacggaagccacggtgcgcgaaatttccgcggcaaaacatgagccacaatggatgttggattatcggttaaatgcctatcatgagtatttaaagatgccgatgcctaagtttggcccggatctcacgaaactcgacttgaaggacatgctgtattatcagaagatgaccgataaaaagttccgtgactggaaagaagtcccagctgacttgaagcggacgttcgaccggttaggtgtgcctgaagctgaacggaaatacttagccggttcatcggcgcagtatgaatctgaagtcgtttatcacaatatgcgtaaagattttgaaaagttaggtattatttttaccgataccgatacggcgcttcacgattatccagaactgttcaagaagtggtttgggaaactcgtcaaaccaaccgataacaagtttgcggctttaaacgcggcggtctggtcaggtgggtccttcatttacgtgcctaagggtgtccagacgaagacgccaattcagtcatatttccggttaaatgctgaaaactcgggtcagtttgagcggactttgattatcgtggaagatggtgccagtgtcgactatgtcgaagggtgtacggcccctaattattcttcagatagtttgcacgcggccgttgttgaagtcaatgttgagcccaacgcttactgccgttatacaacgattcaaaactggtctgacaatgtttatagcctggaaactaagcgagctgcagcggccgaaaatgccacgatggaatgggtcgatgggaatttaggttcgaaggttacgatgaagtacccaagcgtttatttgaatggggaaggtgcccgcgggaccatgttatcgatcgcggttgccagcaatggcatccaccaagattctggtgctcggatgattcataatgctaagaatacctccagttcgattgtttcgaagtccatcgctaagactggtggtgcgactgattaccgtggaaccgtgcgttttgccaagcattcagacggttccaaagcgcatgttgagtgtgatacgattatcatggatgaccagtcgtcttccaacacgattccgtataatgaaatcgacagtgctaacgtcgcgatggaacacgaagctaaggtgtccaaaatctcagaagaacagctctactacttgatgagccgaggaatttcagaagctaaggcaaccgaaatgattatcatgggattcgtagaaccatttacgaagcaattaccgatggaatatgctgttgaattaaaccggttaatcagctttgagatggaaggttcaatcgggtagtaagggggattggttaagctgatgttaaaataaaacttgagtggcatgcgagattgcgattcgagttttttggttaaatgattgttgatgaatgttagccattataatcgtgccagctaggatggttgataattgtagtaatttaaaattgtatctcggttagtgtttttatcatgctgattcgccttttcgttaatattggcgacgtactttattataaattaggattattaacgtatattctaacaatggtataattaaaaacagttttaaacagacaggagtgtggcagaatggcagacgaacttggcgaggataaggccctctcacccgttgaagacgcggtcatgaagtcgttagagcaggtgattgatccagaactgggcgttgacatggttaaccttggtttgatctatggtgttgacgtagacgataatggtagctgcacggtaacgatgacgctgacgacgatggggtgcccattaggaaatttattggcaagtcaaattaatcaagcaattatgagtgtggatggtgttaagaattgtgaacttgacttggtctgggaacctgcttggggaattgataaaatgagtcgttttgctaaggttgcccttggcattcatggctaacgggtgagacaaggtggtgtgcgatggatattgaaaagtttattgcccggcgaaaagctttaaaaatttcacaagtcaaattatcaaacggaatttgtacgcaggcgactttaagtaagtttgaacggcgtgggcgagtaccagcattagcaattttaaatcagctctgcgctcgtctgggattgacagttgatgatctaagtgaaaaccaggctaattcagtgacccaaattcgacagcaacttgatgagattgagcgacgactgatgatggaagattatcaatcagtcctgcaatcattggtagacctgaaagttgagcaaattgatgcggtaccttcacggatgcaatattactatttatgtggcatgctaagttcgttgattaatggaacagccagtgatatttgtttttccttctcgcaaatcgttgatgatttggatagggctcaccaaacaattttcacaccgctagcttatgtcggtctgggtgtcatgtatggccggttagctgagcctgagaaagctcaattttatttcaggagagtacgatactatgtcgagcacgctggctcatcaggatatgcaaatgattacttacggctgttaaccctaatcttttatacggcagagtattacgcaattagtggtgatttcgtcacaagtaatcgtctaatagatgatggggtagcgctttgctcagatgaacatgtcacgtattacttaccaagattgaaatacttagcgaccgagaatgctgttaagcaacaactttcggataaattgattaagcggttaatgagtgaaacagaagcttttgcacggattaatcataatcaagttgttgaggttaaggtagctgcattgcgacaacgatatttgcagggtattgctgcttcagaaaacaattaacaagacaatggctagatttagtgttttattgtagtttccaacatgctaaaactaatcaatgctttgtacattaaataataagaagtcccacactagcaagtcaatactagtgtgggacttcttatttagaaagttatgtatgacgccgcccgcccctaaaaaatcttccccggatgtcccgcaaaaagtcctaccgattgaagttctattataaacgcttatggtgtcccattccggaaaatcctaatgtagcggtaatccattaaagacaatgattgaatggaattcacttagacataagaaattcttattaaattcacaggcacaaactattttaccttctttgactaatttgatagacttaagttaagaaagttgaggtgactgattgagatggctagtcataggcaaatgattgacaaactagtgtggtgttgttactagcgcagtctgcgttagtaacgatgcacaaactcaatttttaatcttaactcggaaaaagtaacgagtagtcaatttttaggtgaaagagggattttatgaacaattttcaaaatgacccacaaccacggaccatcaacacacaagttggcctccgtagtttcctaactaaaatgtatgggtttatgacaatcgccgtgttagtttcggcctttaccgtttacttagcgatgaccacgttccaagcacaaattaatgccgccttttcacaacacccattcatcttcttgatgatcttcattgtcagcatgtttgtgatgattggtgggattcaagtcaacgcgacacgcaatccagcgatgagcttcaccttactgatgctctttgccatcatctttggggttgaaatgtcagtgaccttgtccttatacacgggtgccgttatcaccggtgcgttcgttgcagctggagctgtatttgcgaccatggcggtgattgggacgacgactaagcgtgatatttcacgtattgggacgcacttgattgcagctttaatcgggttgtttgtcgcttcactggtcaatatgttcttacaaagtgccatgattagttacatcttttcatacattggtgtattgatcttcgccggcttatccatgtgggacgctaaccggatgcgcaacatgtatttacaatatggtgaccaggtttcatcgactggtttggccgttactggggccttacaattatacttggacttcgttaacttgttcctctacttcgtccaaatcttcggtggctcaagccgcgactaatcattaagataattattaaggattatgaccaagatgtcataatccttttaatttaccgaaaatgagttatttcacgggttttcggtggaccgaactcccgttttacttaattgtttggtacaattataagggtaaataattagtcgttcagcctgtactgacaggcgctgcgaatcagaccgccaatcgagtggtattaatggtctgagtgacggattttcataaaaatgatgatttaaattaagagatggggagcaaactaatggcaaaaaaattattactgattgatggtaacagtgtggcatttcgggcgttctttgcgttgcatagtcaactggaacggttcgtaaatccagacggcctgcataccaacgccatttatggcttcaatacaatgcttgaccacatgatcaaggcagtcgaacccacggatatgttagtggcttttgatgcgggtaagaccacgtttcgaacagccatgtacgataattacaagggtggccgggctaagacgcctagtgagttttctgaacaaatgccgtatatcaaacagctattagacgcgtatggtatcaaacattatgaattaaaagactacgaagccgatgacattattggcacactggccggtcaagcggatcaaaccggctacaccacgacggtcgtcactggtgaccgtgatttgacgcagttgacgaccgagcataccacggtggccgtgaccgttaaaggtgtttctgaagtggaacactatacgccggcgcacgttgaagaaaagctgggcatcacaccggcacaaattattgacatgaaggggttgacaggtgatacctcggataactatccgggtgtcaccaaggttggtgagaagaccgcccttaaattactcaaacagtatggtacgatggaaggcatttatgaaaacatcgatgccatgaagcagagcaagatgaaggaacatctgattgaggatcgcgaacaagcggcgcaggctaaggtgctagcaacaatcaagcgggatgcgccgattgatgttcaattggctgatttatcctatgatggcccggatcttgaccagctggccgcgttttatcagaagatggactttcaatcatttttgaagaaattacacctacagtcggacgaaccagcaacgcccattgattataccgtcttgacgaaagctaacctgacggaattgcaacaatttaccgatcacgtggacttttatttggagatgccaacgccgaactaccacacgtcggcctttgctggctttgccatcggagcggatgatcactggtacatcagtcgggatgtggaattattaatgcaaccgactgtggctgatctcttgagtagcacaacgattaccaaggacgtttttgatatgaaacgcacgacggtcgggcttaatcgtttgggtattcagctaggtaaagtcgattttgatctcttactcgtttcatacttattagatacaaatgataacagtaacgacttgggaagtttagctgagcaacacgggtacactgacttgccgagtgacgagaccgtttatggtaagggcgttaagcgtgccattcctgaagatgatgatgtctactttagtcatctcgcccggaaattggccgcgatcgctagtttgaagccacagttattaaaggaattggcagccaatgagcaggatcaactttacgatgatattgaaaaaccgatggccaatgtcttagctcagatggaaatcgccggcattacggtcgacagcagtcgacttaaagccatgggcagtcagtttacagaacggttgagtgaaattgaacagacgatttatcaagaagccggtgaagagttcaatattaattcacctaagcaactaggtcacatcttgtttgaagaaatgaaattacccgtaatcaagaagaccaagacagggtattctaccgccgtagacgttctagaaaagttagcaccggaagcaccaatcgtcgctaatattttacaatatcgtcagatttcgaagattcaatcgacctacgttgtcggtttgttagatgccattcattctgctgatcaaaaagtgcatacgcgctacttgcaaacgttgacccaaaccggccggttgtcgtccgttgatccaaacttacaaaacattccggtgcgcttggaagaaggacgtaagattcgacaagcctttgttcctagtcatgaaggttggcagattttctcgtctgattattcgcaaatcgaattacgggttctcgcgcatattactgatgatgaaaatatgcaggccgcttttaaagcgggtgatgatattcatgccgcaacggccatgcgaatctttcatttgaactcagctgaagaggtgacgccaaatattcgacggcaagccaaggcggttaactttggaatcgtctatggaattagtgattacggcttgtcacaaaatatcggcattacgcgtaaacaggctcgcagctttattgacgcttacttcaaagaatatccgggtgtcaaaaagtatatggatgaaattgtccaaacggcgaaaaaacaaggttatgtggaaaccatttcacatcgacgccggtacttgccagatattaattccaagagcttcaaccaacgctcattcgctgaacggacagccatgaatacccccatccaagggagtgcggctgatattatcaagattgcgatgattaagatgcaagataagttacaggctgcgggtttgaaagcaaccatgctgttacaagttcatgatgaattgatttttgaagcgccaaaagaagaaattccagttttagaaaaattagtgccaagcgtgatggattccgccgtacagttagccgtaccgttaaaggttgagagccactacggtgatacttggtacgatgcaaaatagggggaaccaccatgcctgaattacctgaagttgaaactgttcgtcgcggcttaaatcgtctggttagcggggcaacgattgctagtatcgaggttttttggccgaaaattattaataatgatgtcgatagtttcaaacagcgtttagccaaccaaacgatccagaccattgatcggcgggggaagtatttattgtttcgctttagcaatggtctgacgatggtgtcgcatttgcggatggaaggcaagtataatgttgtaccgcgtggtgaagatcaaggtaaacacacgcacgtgatcttccatctgaccgatgatcgtgatttgttgtacaacgatacgcgtaagttcgggcgaatgacgctcgtgccgaccggtgaagaaaacacggtggcgggattgcggacaattggcccggaacccgttgctgaacagttaacactggcttatatgacggccacttttggcaagtcgaaaaagatgatcaaaccactattgttggatcaaagtaagattgcgggcattgggaacatttatgcggacgaaacgctatggatgagtaagattcatccaatgcggcctgctaattcactaactactgatgagattgcaacattgcgccaaaacattattgatgaaatggcgatggcaattaaaggtcacggcaccactgttcattcattttcaacggcatttggtgaggccggtcagtttcaaaatcacttacacgtctatggtcgtgaaggggaaccttgcgaacggtgtggcacgattattgagaaaatcaaagtggcacagcgagggacccatttttgtccgttagaacaacggttgtaggtgatcaagatgacaaagctgattggattgactggtggcattgccactggtaagtcgactgtttctaagctgctggcaactaagttaccaatcgttgatgcggataaaatcgcgtggcaggttgaagggccaggccaaccgacgacccaaaagattgtggcgcactttggtcagcaagcagtgctggcagacgggcggctgaatcggccatggcttggccagttggtttttaacgatgctcaagctttacaagccttaaccgcaattacacggttaccgattcagtacgcgatgttcgaagcgattgtcgcggcaaaccagcaacagcccgacgcaattattttagatgtgccgttgttatttgaaagtggctggcaacatgtttgtgatcaagtgttggttgtgacggcaccaccagccgtagtattgcagcggttaatggcacgtaaccacttatcgcaacaggcggctcaggcacgaattgacagccaaatgccacttgcacagaaggtcgcaagggctgacgttgtcattgataacggggccaacattgataaaactaaagcagccgtgttaaaatggctgaaaactattactaaataaagaaaaactgattgttagttgttacaaggggtgagaagtctatgcaatgtccacattgtcatcataatggctcccgcgtggttgacagtcgaccaactgatgatggtcgcgtgattcgacggcgccgggaatgcgaaaactgtgggttccggttcacaacatttgaacgggtcgaagccacgccattattagtcattaagaaaaatggtgcccgcgaagaattcaatcgtgaaaaagtcttgcgcggaattattcgctcggccgagaaacgacccgttagcatggaaaccatgacgggcgtcgttgatgatgttgaaaataaggtccggtcactgggcgaaaatgaaatttcaagccaagttatcggcgagtatgtcatggagcaattggcagatattgacgaaatttcgtacattcgttttgccagtgtttaccggcaattcaaggatatgcacgtcttcttgaatgaactccaagatatgatggagcgtgataaggtcaaactggcaaaaccgtcagcgaagacgacccacgcacctaaacgaaaaaaagattagtgaaaaagaatggtgaacaacatgccaaatgatgaacccttaacacccaaaactgggttagtggtcccgcaagcaccagcgctcagtgcggcgcaacaagctgtattggcggaattatacttgccactgatggggccattggcatatagcttgtacgcggcgttacgtagcttacagagtagcgagaatgagctgagcaatcgacgcagtcacgcggaactgcttggcatcctaaatgtggacttgccgacggtgttagcggctcggcgtaaacttgaagcaactggcttgttgcgcagctattatcaacaagatgaattgggtgccatgtacatttatcaattacaagcaccattactggcgttacaattctttgcggatgatctattgagtgtcctattgttagatacggtcggtgagttacgttatcaacaacttgctggcgattttgcagcacagccgattgacttgacggctgccaaagacgtgacggcaaatatcttagatgtgtttcacgttgatagtcaaaaagttacgacgccacctctttcagtgcaaaaggtgcgcgcccaattggcggccaatgaaccggccgaggatcactcgcccgtgctcagtgacgatgactttgactggcaactgttggggcaaattttgaagcagaactatgttgatctcaaacaggttgcgagttcacggcaactgatcattacggaaagtcgggtctacggcatcagtgagattgagatggctaagttaatcagtgaagtggctagtttaacaacgggtcagtttgatgaaaatcaattgaaattattgattgcgcggcgctatgaacggcccgcagtttcgagtcagcaggtcgctacggaagcaacggttgcaacgacgaccactaaggataacaaggcttcagcacagctctcaacggctgagcagcaactcgtgacgtatgctaagcagacagcgccgtatgactttttatcagctttgaagcaggagaaacatggttttgtgacgagcggtgagaaccggctagttcatgatttaattggtcggggggtattacccaatgccgtcatcaacatggtgatctactacttattgcaaaatcgggagttagctgcccttaatcgtaatttgctagaaacagtcgccaatgattggcaacaacacggcattacgacgccggaagcggctttgatgtatttgaagcaacgtaaacagccgaaatcaacaccaacacggcgcaagaacaatcgaccgacgcgtaaggagattatgccaaagtgggcccaacaacagcaacagactgagagtggtaagcaaccagctcagaccggtaaacaaattactgctgcccaacgcaaacagcttgctgatcgactagcaaagcttgagacaaattcggaaaaggaggactaaaacatggagaatatctcagaaacactccggacgttaatgaatcggaaaaacttgaatcatcggtatgaggcgttaatgacaactgtgtaccaagatccagatgttcgccagtttttagctgctcatcaaaacgaattatcttcggatgcgctagaacgttcagcggctaaattatatgaattttgtgaagagaaacgtaaaattgcgcggcacgagccaactcaagcacctgggtatcagccgacattagtgatgagtaatcacttgattgacattgcttatcagccaacaccacaaatgcaagaacagcaagctgctcacgcattgcaacagcgggttcgatcaatcagcatgccgaaaaatattcagacggcggacttaaagacgtatgatcaagatggtgaccgggcgacagcattaatggcagcacttgattttattgatgcctatacacaagcgcccaagcgttttcaccggggcttatatctctacggctcatttggtgtcggtaaaacttatttactcggtgggatggcgaacgcgttggctgctaagggtttcaatacgaccttgattcattttccgagttttgcggtcgagatgaagcgctcaattagtaacaatacgtcggcggataaggtcgatgcgattaaacgggcaccgattctcatgattgatgatatcggtgcggatgcttcgtcgacttggattcgggacgatgtgctcggggttattctggagtatcgaatgcaggaggaactgccaacttgtttttcgtctaatttttcgatgcaagaattgcaagatggttatttgacgctctcacaaaagggtgatgaagaaccagtcaaagcgcagcgaatcatgcaacgggtacgttaccttgcgagtgagattgagatggtcggtcgtaatcgacgactcaatcccgatgcttaaaatcaagagttgacttttagtttaaaagtggtttaatgaaaacagatgcaaaagacacgctttgtttaccatggattgcagagaccaagaccttgttctggaagtcttggaccgggtttacgaagataccacttttgtgaacatgctcaattgagccggaacgcttccgttattagcgctaatgagtcagtgtctttgatgacactgaaaaatcgggtggaaccacgtcaatgacgtccctaatgctagttcagtctggcattagggacttttttgtcgtcccggcgcggtgttttggtgagtgggtaaattttaaggagagtgtcaagtatatggcaagtattaatgttaagttcccagatggtgctgaaaagcaatttgatgccggcgtaacgacggaagcaattgcaaagtcaattagtccttcattggctaaacggtcggttgctggtaagttcaacgatcagatcgtagactatcgccaaccactgacaaccgatggtagtatcgaaattatcgctgctgatagtgaagacggcctcaatgttttacggcaaacggctgcccaagtattagctaacgcggttaaacaattattccctaacattcattttgggagtggtgaagggaatgccaacggtttcttctttgataccgacaatcctgacgaagacggtaaacaagtcagtgaagatgatttggaagccatcagtgataagatggctgcaattatcaaacaagatttaccaatcgaacgcgaagtcttatcaaaggctgacgctttagctttagttggtgacaacccttaccaacaagacttagttaacgaacgtgccgctgccaacaatgatcaagtcgttgtttacaagcaaggggacttcgttgatttatctgacggtgcccaattagcttcaacggggaaagtcaaggtcttcaagttattatccgttgccggtgcatactggcaaggtaagtccagcaatccaatgttacaacgaatctacgggacggccttcttaaagcaaaaagacttagatgctgacctcaagcggcgtcaagaagcccgcgaacgtgatcaccgggtcattggtaacgaattagacttattcttcgttgatcctaaggtcgggaatggcttgccttactggatgccaaatggtgcaacgattcgtcgccaaatcgaacgttacattatcgacaaggaagttgcaaatggctaccaacatgtatacacgccagttttagctaacttggacgtttacaagcaatctggtcactgggaccactaccgtgaggacatgttcccaccaatggacatgggtgacggcgaacaattggaattacggccgatgaactgcccatcacatatccagatttacaaccatcacattcgctcataccgtgaattaccattgcggatcgctgaactcggcatgatgcaccgttacgaaaagtctggcgccttaactggattatcacgggttcgtgaaatgactttgaacgatggtcataccttcgttgcgttggatcaaattgaagaagaattcaaaaaaatcttgagtttgatggttgaagtatacgaagactttgacatttctgattaccggttccgtttgagctaccgtgatcctgaaaacaaggaaaagtacttcgatgatgacgctatgtgggaacgcagtcaaaagatgttgaagtccgctatggatgatatgggcttggattacttcgaagctgaaggtgaagctgctttctatggtcctaagttggatgttcaaactaagacggcccttggtggtgaagaaaccttatcaactatccaattggacttcttgttaccagaacgctttgacttgaagtacgttggtactgatggtgaagaacatcgtccagttatgattcaccgtggtcttgtttcaacgatggaacggttcgtcgcttacttaactgaaatttacaagggtgctttcccaacctggttagcacctaagcaagtaacaatcatcccagttaacaatggtgcgcacggtgcctacgctgaaaccgttcgtcgtcgtttggcagctgaaggtgttcgggtaagtatcgatgaccgtaacgaaaagatgggttacaagattcgcgaatcacaaacgaagaaggttccatacttgttagttgtcggtgaccaagaagttgctaacgggagtgtttcagttcggaagtacggtgaagaacggactgaatccgaagccgttgacatgttcattggtgccatcacgcaagaaatcaagcattacagtcgtggtgcaagcaaataattaacagccaatggcatcaatattgattgatgggttgacaagggccgtggttcttgttaatatattggagttgagaaaaaaagcagaagcacccgcttctcgccttggtgaccagagtcatcgggcagatgaacgatgaattgattcccattaacggggttgagcgggcgtactatgcgcccgctctttttgtgaatttctctaaaatatttcggaggtgaattaccatagctaaagattcaatggttaatgacggcatccgtgctcgcgaagtacgtttgatcgccagcgatggtgaacaattaggtgtcaagtcacgacaagaagcaatgcagattgctgaagacgctagtttagatctagtattggttgcgccgaaagcgaaaccacccgtggccagaattatggattatgggaagtaccgtttcgagcaacaaaagaaggatcgggaagcccgtaagaagcaaaaagtggtcagcatcaaagaggtccgcttgagcccagctatcgacaccaatgactttaacacgaagctgaaacatgctgaaaagttcttgtcaaaaggtgacaaggttcgcgtctccatccggtttaagggccgcgctattacccataaggatattggtcgccaagtcttaaatcgaatgattgaagctactaaggaattttctacggtcgaagcctatcctaagatggatggtcggagtatgttcctagtactagcaccaaaaacagataagtaatttctaggaggattattgattatgccaaaacaaaagacaaaccgcgctgctgcaaagcgtttcaaggtaactgctaagggtaagattaagagcgccaacgcttttactagtcatcgtttccatggtaagactaagaaacaacgtcgccaattacgtggtacggctattatcgaaaagccaatggtcaagacataccacaagttattacaaaaataattcacaacgttttagttaaatctaggaggaaataacatggctcgagtaaaaggtggaactgtaacacgtaaacgtcgcaaacggattttaaaattagctaaaggttaccgtggtgctaagcacatccaatttaaggttgctaaggaccaagtaatgaagtcatacctatacgccttccgcgatcgtcgccggcgtaagagtgacttccgtcgtctttggattgcccggatcaacgcggcagcccggatcaacgacatcagctacagtcaattaatgcacggtttaaagttagctaacgttgacgttaaccgtaagatgttagctgatttagctgttaacgatgctgatgctttcaaggcattggttgacactgctaaaaaggcacttgcttaatttaaaacttaattagggcttgctctaatgtttgaacgaccgtcatcctgtatgggtggcggtcgttttgttttgacgcttgattaaggggcacgattcctggacaagatggttcggtgtgttgacgtccttactgaatcttgagattgatttgacacattattgtgatatagtaatgatgtaagcgcttacttatgtgttgattaattatttagctgggagctttggagaaggggtgtcaccatggcaacagttttacctaaagcagttaaggtctggatgggcgccaacatcttgcagattgagtttgataatggggagtttcgatacatgcgtacacatttcattgatgactatgtttctgcgtggtcacccaaaaagggtaagggaaagcggcgcaatttgtggttaatgccatcttgggaatggttgggtgccaatgctcggattgaatcggatggcactgtcgtgttgttcgaaaaggatgtttatacggcccaagaactttggcataatagtgtgacgcgaattgacttggtctctggcgtgcactgattcataaaagatgatgccaaataaaaatggacttggtcatttgactgagtccattttttgatgccgcttggagtatacgtggataacggcctaagtgagccatttagtgcgcgactctgatttatgaaaatcgagtgtgatttctgattggttaagccagtctgccattgtctattcgtgataatcttcgttataaataaagcgatgcagttttaggtattgtgcaccgagtttgcgttcattttcattatctttagggtaataataacgacgaccagccaatcctttaggcatgtagttttgttgggcaatctgatgtggcatttggaatggattatcgatcagaccaccacctgtaatttcctcggagtgtttgtagtgcatatcgcgcaatccacggggcatggggtgctgacttggattttgtgtgtcctggtctagtttttcccaagattggtcaaacgaaccagacttgggtgaaatgcacatcagcatggtggcaaacattagtggatattttgctttgggcatgccaatcttttcggcttgattggcagcgaccacaatttgtgtgacctgttccgggttagctaagccgatataagtgtatggaatttcacgtagccggcggaccactgagggtaagtcatcattttttaacaaaatggttaagtagtagagcgccgcgtcagtatctgagccagccatcgaatccgaataagccgacagatagtcataatgcttagttgccttccggtcgtagctaaaatgctgttgctgggcaaagtgttgtaccgcagcaacagtgatttgcttctggtcaatagcgtggagcgtttccaagatatttaacgcaattcgcagatccccttcggccgaaatagcgatcaggttgagggctttagcatctacctgatcgtcggttaggttgtaaatgtcggttaccgcacggcgtaaagcaatctcgatatctgtatcgctcagtggttgaaactcaaaaatttgacagcgcgaacgaatggccggaacgattgacataatcggattttcggtcgttgagccaattagcatcacgtgcccattctctaagtagggcaacaaaaaatcctgcaatgttttagtcattcggtgaatttcgtcaattaatagaacaaacgattgctctgggtattgtgcgatggctttcgtcagctgtgccttattttcggtcgaagcattaaaagccacgaatggataatcgtcttgactcgcaataatctgcgccaaactagttttgccagttcccggcggcccccacagaatgaggggaatattaacatgttgatcaataatctggcgtaatggctggcctgccttcaacagatcctgttgcccgaccatctgttccagtgattgcgggcgcatttgatcagccagtggtgttttaaatgccaatttcaaagtcctttctgattaagtgttttagtcaaattgatgctatcatcatagcactaatattttggaaactgaaaaagaaagtttggcaggttagcggggaacgatgctgaaatgagtgagtctgataccataggtttgacgttggctcgagtgatgggttgaaggtgtattgatttaagttttcatgcttgttgatgaatgagaaaggcgatattgtttcgtagatggtattgagtcagcttggggagattaatagcttggaattaccccccgtgtatacggaaaacagattaaacgaatcccggggagtgcaacatcagttgtaagcactaaaagacagaaaaggacagcgtatttggcgagttaaagttgatcattatcgcgcgagccgtaatacccgtcaactcatttccatccttcaataactaccttgccaatcatatgatgttgctcgataagttgatgggcctgccgcaagttaagcgcgttgattggccgtagtgtctgcgatagcgtgctttgaagcaagccacggtcaagtaaatccgcaatggtttctaagatatcgtgctgactaatcatgtcggccgtgtggtagtaggattttgagtacatccattcccaagcaaatgtcccgcgtttcttggttagttttttaaggtcgattggacgccgattttcggtaattgatgcgatgtggccaccgggtttaatgagcgtacatatctcattccagtgactgtcaagatcgcttaatccgaggatgtaatcgacatctttaatacctaaagcatgtacttcactaaccaaatcatgatgatgatcgacgactaaatcggcgccgtgttgctgcgtccaagcgatactttcaggtcgtgaagcactactaataactgtgagccccgctaattttgctaactgagtagcaattgaaccgacaccaccagcgccattgatgagaatggtttgattgcatttttcggaattaggtttagctgggtcaaaaggaatgtgaagttgttcaaataatgcctcgtatgcggtcagcgaagtaagtggcatggccgcacgggcagcggttgttaatgtcgcgggggcgtgaccgacaaggcgttcatcaaccaggtgataagcactgtcgcagccgggacgtctaaatgagccagcataaaagacgtagtcgccgggttgaaacagggtgacagcttctccaacagcggtcacaataccagtggcgtcccaaccgaggatcttgggtcgcatgaggtgctcatgccccgttttacgaacgctaacgtcaacaggattgacagcgacggcttgaacttgaacaagtaagtcatgaccttgagcgctaggttttgcaatcgtcacgtctcgtagactagcaggatcttcaataggtaagtggtcggtaaaaccaattgcatgcattattaatcaaacccctttcatgacattactataggttaccagtgaggaataaacaagacgtgaattatttgccacatagggacatatttgtcacgcctattagttgtgctacaatcaagacacttaattaaggtaggggaagttagatgcagcgacaagtatacgattgtacgccgggttgtccggttgaaagtaccttgcaagttattgccggcaagtggaagagcgtgattttgtatcatttatttacggcaggaacatgccggttcagcattttgcaaaaacgactgccgggttgttcgcggcggatgctagctcgccagttacaagaattggttcaagacggggtgattgcaaaacgagtttatccggtcgtgccaccgaaaacggaatattggatcacgccatttggtcagaccttgaaaccggtgattatggctatggagacgtggggccgacagtataattcagtgaatggaaaacctcgtcaataggaatgtgagaacgggcatagtgtgagtttcaaggaattgttgtcggttttgttaggggcgattgtgcttggtgccttgctcgcattaatagtgactgtttaactaggctagtaaagaattgatgtgattctttactagcctagttgttttctaatctaataaaacgggagtctgacgtaaaaagtacaccgatagatcactgtttggcagcatttcttgaataatcatgggtttgcagtaagcaatgataccgtattaagtctgagataggttgtggattagttgcttgttaggaggtgcatgttagataattattaacaacttaatgaagtgcagcatggccgtgaatctcgttcgctaaatgggggtgccattatgaaaaattgctttggaatcattggtgggatgggaacaatggcgacggaggactttgtgcataccgtgaaccggctgaccgttacccatcgtgaccaggattatttaaactacgtcattttaaatgatgctgagataccagatcgcaccgcatatattttggatcataactgtgccaacccgttaccatcattggaagcggatgtgcagctacttaatcaattaggggtcatgtttattgtgatgacgtgtaacacagcacattacttcattcccgcattgacggcgctttctaacgtgccaattttgaatatgccggccttagcggtaacagcagcctgtcgatcacagcaaccgcgaccgttacgaatcggtattttagcgacaacggggacactagagtcgcaactttatcaacaacttattcggtctaatggacatattcctgtgatacccaataagcagcagcaagcttaagtgatgaccttaatttatgacgacatcaagcaacgtgattttgtagatcgggtcaaatttcatggcttaattgatcaattattgaatgctgctgattgtgacgccgtcattctcggctgcaccgaattgtcggtggctcaggatgctgcgccatatgattctgaacgaattattgacgcacagtatgaactagctcgagcaaccgtccaacgcgcacaggcaactaagccagcgttgatacttcgtcggcggccatcgattaggcggtaggaggggtgcaggtaactggataaaaatgatttttgatctatttagtacgtgtgattgtagctgttataacaccactttcgtatacatgaagaatagtaaaattgtaagcgctcaaatcgttgctaactagcctattctcgcacatgcaaggttgggtccgtctccacacagtcccgcacaacaaaaaagcgagccttcaattgaaggctcgctttgtgttctcgattattcagtgtggtgcttccgaactgggctgacccaggtgccgctgccgtaacccaggatggttttaacggctggaatcagcgtagtgaccagagcgagggcgttaacctgccagtaaatcagcatgtagagtggcatgaaaatcagatatttaaacttgcggccacggtcgtcaacgatcaatgcggacaatagctgcaagacgccggcgaacatttcgaaggtcacgaagatgaaggccatgcagaacatatgatagacgcgctcgtaattgccagtaaagaagaaggtgacgagcgagatcaggaagatcagtgttgagacaaagaagaatagggaccagatgatgctcagcgtttgatcagtaataaaagcccattgcttcaaatacttaccgggatgactgacaacccgtttaaagttggtcaacagcacttcggtaccacctttggcccaacgtttgcgttgatgataaagggcgtctagattctcggggacgttcatatagaatagaatgtctggcgagaaaacggtcgtccaaccattcaactggtgatcccaagcaatactgatatcttcggtcgcgcgatcttgccggaataagccgacgtcaatcagagcgtcacgacggtacattgtattggcaccactataggcatacatgttacctaaagcactgacttggctccgcttgataacaccaacgatacttgaaaattctacggtttgcgacttagcgatgatcgtgcttcggttctgaacgtccatgttggccgtgaccgctgccgtattggcgtgttcttcgcccatgaagtaactcatatatttccacagtgcatcgggttctggaatggaatcagcgtcattacttaaaatgaattcaccacgggcaaagccgacaccgacgttgaacgcgtgggccttaccctgatttttcttgattgttaccacgcgtaggttgtcgtacacgctctggagacgttctaaaatagctggggtctcatcagtcgaaccatcgtctgtgaccagcacttcatatttttcataatttaaattgttcattaaatagttgattgtgtgttcaatcatgacttcttcgttatgcgctggaatcatgatcgtgataaagggttgttcttcaggcgttagcggttgaaattcaatatcgtctttgtggcgatggcggtaaatcagctggtagcagagtacaccgataaaccaggcaaatgcaccgagaattgggtaggagactaatagtaatagaacaaagttccagatactttcaaagggcttaagtgtttgcattatttccattggctagtcctcatacaatctgtggatttcgttaacatcgagattttgttcggggtcaaccgtgtagtgcttgacgtgttgccggaaagtggcctgcccgaatcgttgggtataaaagttatttagttgccgcttccgaatatctaactggtcttcgttgtattgccgttctttactgatatgctgcttgacccggtgattattgtgaatcgtggagacaatgaccacaatggcgattaagataaacgcaataataaagaaccggtcaaaaaagtagaacagcgtcttaccttcttcgtatttccaggcgtgaatgaactggggattattcgcaagtaacgttgacgagatagtccagtagacaggtacggcaacgcagatccaagtaataattgcgactagggtttgccaaagtttcgtccaccagtgccccttggaaaaatatttatcggtaacgtattgtttcataacatcttttttctccataaacgaacctccgagatgacatattgtttagtgatcgtgcggatcatatagtttatatcattactgatattgtcagtttatcgacatagaacaacaccagggcgcctaacattaactgcgatgaacagttttagaacaatctgaacatttaaccatgtcaataagcttacatgaggattgcattgatgtgcaatcaatatacatatcagtatcatgatataagtaaaagccacgtatctttaattaatatacacttaatgggatactttgttaatctaatttgacaaaacggtcagtgcgacaattgaatgtcaacttgtggtttagccattgcaaataaactggcgagaaaagggcaaccggcaaaacatcgctgaatttactggcgacttttagtgctattttcaatgtcttactcgggccccaacctatcaaataaatgcggatgcgatcaacttagtcaaatttgatccaggtggtgtcatcaagttacgacaacttggaaggattttcgttgcttattttcaaaaaacaaattattatataatgatgactaaaatttagcacaattgcctagtgaaatccggctccagacctgatttagtccggtatttcaccaatagtatgataaaatgggctagtggggttatgccaataaccaaaaaatccagcgagaagcgaaggggataacgatgattaagcaatttaaaccaacttggatgataccagcaatctacaatgtgacaccggcgcagttacgagcgcagggcattaaggcggtatttaccgaccttgataacacgttgatcgcatgggacaatccggatggcaccccggaactgaaaaagtggctgcacgcgttacaagacgcgggcattccgttagtggtggtgtcgaacaattccgaagcgcgaattgctaaggcgctgcaaagcctggaactgccatttgtttcgcggtcactgaaaccactaccgctggggatcagtaaggcgcgtcatgacctgggcttacacaaaaatgaagtggtcatggttggcgatcagtatatcaccgacatgtgggcggcccatcttgcgggcgtgcccagtatcttagtccagccaatcgtgaagacggacgcgtggaatacccggataaaccgtttctttgaacgatttatcaaattacgattagcacatgtttatccagaaatgcattttcaggaggaccttaataagtgagtgaaacatcagaagaaactttatactgtattgggtgtggtgcggcgattcaaacgaccgatcctaaggcggccggctacacaccgaacagtgcgttacaaaaatcattagctagtgacgcacaggatttatactgtcaacgttgttttcggcttcggcactataacgaaatcgtgccggttggcttaacggatgatgattttcgtcatttgttagccacgattcgagatgcgaacgcactggttgtgtacgttgtcgacatttttgatttgaatggaagcatcattcctggtctccagcgctttgttggggataatcccgttttgttagtcggtaataaggaagacgtgttgccacgtcagttacgccggacgaaattgcgggaatggatgaatcaacaagttcgtgcacagggaatcaaaccggtcgacgttgcgttaacgagtgccaagaaggggcattccattgatgagctcttggcgatgattgaaaaatatcgtcgtggccgcgatgtttatgtcgtaggggtcacgaacgttggtaagtcaacgttgatcaatcggattattgccaacaatactggtttgaaggacttgatcacgacatcccggttcccagggaccacgttagacaagattgaaattccgttggatgatggtcatatgatggttgatacacccggaattattcatcccgaacagatggcccacgtgttatcaggcgatgacctgaagttagtctcaccacaacgcgagattcgcccaaagggtttccaattaggcaacggtcaaactttgttcttaggtggggtggcacggttagatattgttgatacgttaaaagcaactgggacggtctacgttgataataacttgaccttgcaccgaacccggaccgagaatgcggacaacttttataccaagcatgtgggtgaactgattacccccccaactggcgatgctgtcgctgactttccaccactagttcgccacgaattcaaagtgacggaaatcagtgatattgtctttgaaggcctcggatgggtcacggtggctgcggatacgcgtgtagcggcctgggcaccaaagggtgttgcagtcttgacgcgcccagctatgatcaacaagcgttgatgagttgtggtcggagtagaatctgattcgcgattatcaaacagaaaattataggagtaaatcaaacttaatggaaaacttacgtggaaaacaaaaacactatttacgtggtgaagcccaccacatgcggccactatttgctgtcgggaaaaacggcttgactgacgaatggttgacccaactaacgggtgcgctggataagcgagaattaattaaagtcaacattttacaaaatgctgatgtgacaacggctgaagttaaagctgcaattgaacagaaaaccgcgattacggtcgttcaaacaattggccgggtgttagtcttatacttgccagctagtcatgaagaagaccagcactattcattggaagttgctaagttataggaggaatgacgggtgcagacggttaatcaaacagcgacaaaagttctgacggaaacggtgacggcaattccgcatcgccgtgttggtattttaggtggcacgtttaacccaccgcatttgggacatttgatcatggcccagcaagttggtgatcaactgggtttggatgaagttcgctttatgccggacgctcaaccaccgcatgtcgacgaaaagaagacgattgcggtggaagatcgtgcgaatatggtccaagaagccattgttgataatccactatttcggttggagacggcggaaatcgagcggggtggcaaaagctatacttacgaaacgatgaagtttttgaaagctaagcatccggacacgcagtactatttcatcattggcggcgacatggtcgattatttgcatacttggtatcacattgacgagctagttaaattagtcacctttgttggtatcaaacgaaccgggtacccaacgacgagtcaatatccggttatttgggtcgacgcaccgttgatcgatattagttccactcagattcgtcaaaaaatcagccatgggcattcggtccgttatctggttccagaagccgtggccgcttatattaaggagcatcatttgtatgagcaaaacgattgagtatactgaagcgattgttccatatcgtcacgaggagctaatggcaaaggttgccgcccagttgactgacaaacgctatcaacactgcttacgggtcgaggagactgcgcggcagttagctgctgacaacggtgttgatgtcgagttagctggaattgcggggttattacacgactacgccaagcaacgcgatgatcaaacatttattcagctcattaagacgcatggcatggaccccaacctggtttcgtatgggaacggggtctggcatggctatgttggcgctgaactgatcaaagatgagttgcacatctacaatgagccaattttgaatgcggtgcggttacacacggtcggtgcgccttatatgactaaactggaccaaatcatctttatggccgattttattgaaccagcccgggacttccccggtgttgaagcggctcgtgaagcgacggccaagtcgttggctgacggtgttcgtttccagattcaacatacactagattatctgattcagaagggtgcgccagtctacccacaaacgttagcaacctataacgcgtgggtcggcggtgtggcccctcaatttgccaattaaatttaagggagagttttatggatagcaaggaacttttacaattaactgttgaggccgctgacgataagcgtgccgacgatatcgtggccttagacgtcgcggaagtcagtttgatggcggactattttgtcatcttatccgcggattccaagcgccaagttcaagcgattgctgataatatcgtggactttgtgcgcaaggccggttcggacgttaagagcgtcgaaggtcggactgcgggcgaatgggtcttgatcgatgccggtgacgtcatcgtgcacgtcttccaaaaggatgcgcgggcacactataatttggaaaaattatggtctgatgcgcccatcgtcgacgttgcacaatgggtaaatgcatgatttatcagacgtttgccgaactttatgacgaactttttgatccagccatgtaccagcaatggctggattttgtccgtcgtgaatatcctaaccaagatggtcagttgctcgaattagcttgtgggacgggacgcttaggggtgttgttagcccaagccggctatcaggtcaccggtttagatttgtcggagaacatgttagcactggcacagcgccatgcggacgaggcagccgtgaccttaccgctattacaaggggatatgctcgatttatctgaaattgggacctttgatgcggttacctgttttgctgattcgttctgctatttgcccgatattacgacagtccaacgtgcatttgaacaagtggctcaacatttgacagcggccggcgaatttttattcgacgtcattacaccttatcagacggatgaggtctatcctggttatatgtacaattatcgcgatgaggatcgggcttttatgtggacaagctatgccggtgaacagccgcacagtgctgagcacgatttaacgttctttatttataatgatgataagcaggccttcgacgaggtcagtgaattacatcaagaacaaacttatgtgttggctgattatcaacaagctctgcaggcagccggttttaatcatgtcacggtcagcgccgattttggccgccaacaaccggatgatcagaccacgcggtggttcttcaagtgtcgtaagtagtaggaggaacaagaatgcaagcagtcgggttaataactgaatacaatccgttgcataatgggcatcgctaccatttgcggcaagcacaacagttgaccaatgccgactgtgttattgttgtgatgagtggtgattggctgcaacgcggtgaaccggccattttagacaagtggacacgtgcgaagctggctttggaaaatggggcggatctagtaattgaactgcccgtgttttttgcaacccaacctgcccatttatttgcacggggtggtattgaactactcagtgcactggactgtacgagtgttgtttttggtgcggaacatcctgagctggactttcaacggttggccacggcaattgcggcgcggcagggcagctttacccactataatgcgacttttgccactcagtttaacgcggccttgcaagctgccacgggcgtgacgttgacggcagccaatgatatgctgagcttctgttattacgctgccaatcagaccctggcacatccgatgcagttactgccgatcaagcgtcgccaagcggatcacgcgacgacgacaattgcggccgatagtcgctacgccagtgggacagcggtgcgccaagcggcacttgcacaggattgggaggcgctgaaaccagttgtcccggccgacacgttcacggcgctgactacgcaacgactgcagcgctggagcgacttttggccgtttttacagtatcaattgctgaccgttgacgttgcccgtagtggacagtatgatcagatggcggaaggcttggaataccggatgcaggcgatggcccaacacgccacgacttttgatgactttattcatcaggtcaagtcaaaacgctatacgtatacacgattgcagcgggtggcgacagccgcactactacaacttactcaggcagaagtccagaaagcacaggcacataattatctgcgcgtcttaggcttcacacctaaggggcaggcttatttgcatcaagtgaagaaacagctcccgttgccgctgtatacgaaaatcaatcaagacttacgccagcatgctctgaatctcgattatcgggcggggcgcgtctatcaattaattaatgggcaatcgcaagatttatatcgacaaccatggcggttaccggtaacaattggttgaccgcggcgggctttcttgatatggttaggtctaatgacgggcattttggactgtcaaggaaaaaacattgacaaaggatttttacacaggtataatttatcacgttgcattaggaggtttttaaatgaaatggtcactttcacagcttaaaacataccgtgaaacgccacttcagtttgatgaagcattggatttaaaacactccttgatgagccgttatccagaaattatcgatgttaagtcagttcacgcaactgggttagcgagttatgataaggataatgtgttaatcacggcgaagattgacgcaatgttaacattgccgtctagtcgctcgctgacgccagtggatgtcccattggcttttcaaatgacggaatattatgttcctcagggaaccgatctgagtcgttttgatgaagaaactgatacggtaattattttacctgaagatgatattttagattttgatgtcgctgtggaggataatattttaattcacatccccatgcagattctttctgaagctgaacaagacggcgccccaatgccaactggtaagggctgggaagttctctccgaggacgaccaagcgttgcaagctgcagaacttaaaactgttgatccgcgtttagctaagttaaaaaacctgttccctgatcaggaagacaaggattaagttagctaggcgtatcaaaacacacattatgtgaattcacttgaaggaggtgtaggttgatggctgtaccagcaagaagaacatctaagatgcgtaaacgcaaccgtcgtggtcatattaaattggctacaccaaatttggcaccatgcccaaattgtggcgaattacgtgtatcacaccgtgtttgcccaagttgtggatactacaacggcaagcaagtcgtaaaagtaaacaactaattgttagttggtgaaaagttgcattgcggccatggcgcatgaaactttttgttaccataatacgatcaaaaagcccgcttaggtgggctttttttgttgtcttcaattaagtttgagttgggaccagcacttcttgaaataaggcttgactgaactgccagcgcggtcaagcgagtggctttgcatattgattgcgatgaggcgtctcccttccgtatactaagactatcaaatatgagtacggcttcataataagtgttactgacgcagcgacaagggggttatggagatgatgagcaaaaaatatgggatcgggttagcactactcaccgtggttctgctagctggatgtggcacccaacagtcgacgcaaaataaggcgacaagccaatcgactagcagtcaaagtagttcgaccaaaagtgtgacagccaaaacgaaagtgtcattagccgcagccatcaaaaagtttcagcaacaatatccggacgccagtgtgacgagtattgagttagaagaccaactcggtcgaccggtttacacgctggaaggcgttggcggcacccaggaacatgaattacaactcaatgggcgaaccgggaaggtcatcagtaagcagtctgagatgctggatcaagatgatcaagctgacgctgagggtgaccggctgaatcttaacaaggtaatcagtcctagtaaagcggtggcgattgccatccatgaccgtaacggtggctatgctagcgagctcaagctcgataaggacaatggcaccacttactgggaggtccaggtacatcaaggaaagcagcaagtcgatattaagattgatgcctatgaaggtcatattttggaaactgagcacgacgattagtaccacgtggttgctggtgaaaaggggcggtatgtagcctcattttgtcagcaactagtcttgaaatggtcagccggctaaacgtatcgcctattttgtaaatcactgatttgatcaatagctagtcgtaatcatcacgtccgtttccatcacaccgaattcttgccacatgatttgattgatggtttcaatcagacgtgtgatttcaatcgccgtcatccgaggtggcacaacgatcgtggctcgcagcatgatgagattaccatcataatgagccttgagaaaaatgactttgcggacactagttaaatcagcaattcgccgttgatagcgatcttcaaggtaagggtcgaaatagtcaactaggttcagactactttctcgaaaaattttggtgccagtattgaggatgtatagccctaagccgatactaatcaggttatcgaaccactgaaggtggagcttgaccgtgacaaggatcgtaagaacggtagtcagactggtcaacgcgtccgtgaaggtatcacggctcgctgcggtcagggcagcattgttaagtttgcgactccaataatgattgaaggcccataagaccagtagcaccacgaaggaaaacccggcggccaagccggcgatactgctgaggtttttgaagggggtacgggtggcgaatgtcattacgcctttgataataatgtcgattccaatggcagccatgatggtgccggctagtaaattaaaaatcgtctcaaaacgaaagcgggattgctggattcggggtcctaattgctgctgctccgcgggtgcgatgggtgcgccaaataaatcgtcatcgtgcgtgcgactggcgatgaatagaccagtcatgagtagcccggtcgaaaaaattccagataaattattaaaggcatccgcacgtagggcctgtgagtggccccagcgtgcccctagaagctcgataataaataagcccaaataaacggtcacgttgccccagagatggtgacgggccgttttaagcgaaatgacaacgggctgttcaatttgatgccaatctggcagtcgttggatcgacatgattaggggcctccttacgcatcttgaattggactgctggtcaggattagtggtgctagggtgtctctctggtaaaagtggccaccagcgggcatgtacgaataaaaaaagtgcggaacgtcagaataacaatgaggacactagcctaaacaccacgaaccgatctatgaaggttatccgtttattttactgtaagcctagcacggtgtttttaactttgtcagttggtgctgtttgaaaggtaagtaacctttttggatggtcctatgaaaattaatttctttccaagataaattatatgaaattaattttaaaatttgcggtcatttactttattaacagcgtgttttttggtacgatagttgcgtattaaaaattgggaggcaataaactaatgagtaatgaaaaaccacaaattggtgtcattgggatggccgtcatgggtaagaacctggcgttgaacatcgaaagccgcggctacaaggttgcgatttttaatcggactggtgccaaaactgaaaaggtcgttaaggaccatgctgacaagcaattagtaccaagttataagatcgaagacttcgtggcttcacttgaaacgccacggcggattatcatgatggttaaggctggtaagccaaccgatgccgttatcgatgaattattaccactattagataaaggcgacgtcttgattgatggtgggaacaccaactttaatgacacgatggcgcgtaacgcccgcttagataaatccggaatcaactttattggtatgggtgtttccggtggtgaattaggtgccttacaaggcccttcattgatgcctggtggtcaaaaggaagcttatgatttagttgccccaatcttggaaaagatttctgctaaagcgcctcaagacggtgcaccatgtgtgacttacatcggcccgaacggtgctggtcactacgttaagatggtccacaacgggattgaatacggtgatgaagagttaatcgatgaatcatacaatatcatgcgcaacgtcgcgggcttgtccgttgatgaaatgtccgatatttttacggactggaacaaaggcgaattgagcagttacttgatcgaaatcaccgctgacattttgtcacgtaaggatgatttaggtgcggataagactaagccaatcgttgacatgatcttagaccgtgggaacaacaaaggaactggtaagtggagttccgaagatgccttgaacgttcaagtgccacaatccgttattacggaagcggtctatgcgcgttacatctcaatgatgaagaacgaacgggttgccgcttctaagaaattagctggcccaaccgctgacgttgacttgccagccaaggaagaattggttgagaagattcgtcaagccctctacttcagcaagattatgagttatgcgcaaggcttcgaacaacttcgtttcgcttctgaacattatggttgggacttgaagttcggtgaacttgcccaaatctggcgtgctggttgtatcatccgggcccaattcttacaaaacatcacggatgcttttgataagaagcctgatttaaataacttattgatggacgactactttgccgacatcgccgccaagtatcaacaatcaacacgtgaagtgcttagcttagcgatccaagctggtgtaccggtaccatcatttagtgcggcattgtcatactacgactcataccgggccgaagtgctacctgctaacttgttgcaagcgcaacgggactactttggtgcgcatacgtatgaacggactgaccgtgaagggttataccattacagttggtacgaagaacaataaaatcattttgaatgaactaaactgtggctaatgacgttacgcgtgattaggcgcagtttttttgtgctgtgggtggctgtgcggtaatgatcgttggtttgagtggattagaacgtacgtttgcgttaaaattgagagtaatgaataaacgcgaaagtgggggtcgccatgcgacaagaatcattatttaacccggataaatctagtagtagtccgttggcttaccgggtccggccagtgacgctggcggatttcaagggccaagagcatctacttggcccgggtaaactattacgacaattaatcgcagaagatcagttaccatccctgattttttggggaccaccgggagtcggcaagaccacgctagccgaaattattgcgcaacagacccagtcgcactttattacgtttagcgcggtgacgagtggcattaaagaaattcggcaaatcatggatgaagcggaggctaatcgagattttggtgaaaagaccattgtttttattgatgaaattcaccggtttaataaagcccaacaagatgcctttttgccatatgttgagcgcggcagtatcacgttaattggtgcgacgacggaaaatccctcatttgaaattaacgcggccctattatcacggtgcaaagtattggtcttaaaggcattgacgcctgacgcattagaagctgtcttacagggcgctttgcagaatccgaaggggtttccggatcttgagattacgatgcagcctgatacactacggttgatcgcagaatttgctaatggtgatgctcgtatggcgctcaatacgttagaaatggctgttttgaacggtgaccgcgatggcaagcacgttacgattactacggccgggttatcgcaactgatcaatactaagtcgttgcgctacgataagcatggcgaggagcattataatattatctccgcgttacataaatcaatgcgtaatagtgatgttgacgcggcgatttactggttgatgcggatgctagccggcggtgaagatccgctgtatatcgctcggcgtttgattcggtttgcgagtgaggacattgggctagctgaccggcaggcattgccactgacggtagcagtctttcaggcgtgccagttgatcggtatgcctgagtgtgacgtgaatttgacggaagcagtgacttatttagccttagcaccgaagtccaatgcattatacgcggctaaatcggcagcgcaagcagatatcaaagcgacgggtaatttaccggtccccttacagattcgcaacgcaccgacaaaattaatgaaagatttaggttatggttctgattacaaatatgcccatgatacagcggccaaattaaccacgatgacgacgatgccacctgagttaaaacagcaccggtactatgagccgactagccagggacaggagaaagcctggcaacagcgcctagctgctattcgccagtggcaccagcaacatccgcaaaccgaaccgtcagatgatgagacataaagattgcaatttaatgagaattcactaaaattagatttgggtgaggagcagaccctggttggggtgtaggaaattcagcgttttcatgttagaataacatgttgtactagcttaatgcaggttagtggtgataaatcactgattcgtacggtttttagataagttgaatattaggagtgactaaaagtaaatgagtcgaatattaattattgaggatgaaaaaaacctcgcacgcttcgttgaattagaattaaaacacgaaggctatgatattcaagtcgaatataacggccgtaaagggttagacgcagcgttagctgaagattttgatgccatcctattagacctgatgttaccggaactgaacggtttggaagtctgccggcgggttcgtgaagtcaagaatacgccgattattatgatgacggcccgtgactccgtgattgatcgagtttccggcctggatcatggggcagatgattacattgttaagccatttgctatcgaagaattacttgcccgcttacgagcactattgcggcgaatcgatttggaaagtgaacaacaaagcactaaacaaacgaccgtcacttataaagacttgacgattgaaaaggaaaacttagtcgttaaacgcggcgacgaagtcatcaacttgacgaagcgtgaatatgaactgttattaactttaatggaaaatattaacgttgtcctcgctcgtgatgtcttactaaacaaagtatggggttacgaatcagaagttgaaacgaatgtcgtcgacgtttatatccgttacttacggaacaagattgaccgaccaggagaaaagagttacatccaaactgttcgtgggactggatacgtgattcgttcttaatgactgacgctgatacgaatcaagtgacgcctaaaccacggcgccgttggtcattaaaatggaaatgggcgctcgggaccgcaattgggtccgcgctcatttttatttgtttttcattattggtctataagagtttcacgaacctcttattgcgccaagaacaacggaacgtggctagtgctgttacaacggtgcaacaatcgttacgaacggagtcgaagggactgaccattaaatcggtggccgctaaattgcaacccgaagcgagcgttgaaccggcaactaccatgagtgaacgtaagcatggtgtgctgcaaagtaaaatcttttcagattctgatttaacagccttatcccgtacaaacttagctgtgacggtttatgatccacacgggaacacactctatctatcccgcaaggatgcacatgagttctctaagaataagacgcgtcaggtggtggtgattggccgaggaagtgatgctgaattagttgggcgggcgcccatttatgcggctagcaatcaccgtttgattggttacacccaggtcaccgataatttggcggaataccattcaacgactcagaatttgatctggatctttattgtgatgacaatgatcactatttttggtgccacgctactgggctatttcttagctgcgtttctattacggccaatgcgtaaaatcaaacagacgattaatgcggtcaatgatgatccgcaaactgactcgcgagtgcccgatcttaaacgcaatgatgaattgtcggatttagcagtcgtattcaatgatatgcttgatcagatgcaacgctatattaatcaacagcagcaatttgttgaagacgtttcccatgaattacggaccccggtggcaattatccagggccatatggagttgctgaatcgatggggcaaggatgatccgcaagtgttgtcggaatcattggcggctagtttgtcagaaaccaagcgaatgcagagcttagttcaagaaatgttggacttatcgcgtgctgaacaattggaaatcaattttagccatgagacgtcggacgttcagaagttagtgacgcaagcatttaacgattttacgatgattcaccccgactttcattttacgtttgatgatgatgttaaaaagccggtgtatgctcagatttaccgtaatcaccttgagcaaattctgattattttattggataatgcggtcaagtactcgacacgacgtaaagaaatccatttatcattatccacggattatcgctacattgaagtcgccgtccaagactttggcgagggtatttctaaggacaatctcgatcgagttttcaaccgtttttatcgggttgataaggcgcgtagccgtgataagggtggtaacgggttaggattatccattgcgcaacggttagttgaaggttaccatggtcatattagtgttgaatctgtggtgggccagggctcgatctttcggttccagttaccgattctacgggacgcgaagctcttagctaaggccgaggctgaaacgaatgatgttgaaaagattgccaagtcggaactgccagccggaatccgaccagctactcgtgatgaagatgaagcgcccttggatgatcatgagcacgaccactaggtaatcgaatcattgatgaatttaaaacgcacattcaagttaatttaacttgaatgtgcgttttcagtatggataattgcgctgtaatgaattttaaagccgcggcctatgggatcatatcgtgattttgagggaggcctggatcaatattgagcatcgactgacagttcgatagggcgcagtaagatgctgattaaacgacgaataggttgtacaccagcaggctgggtttaatcctgattcagattgatccgactcgaaatatatttaagctgaccgatatttgttggtatgttcatcatgaaaccattttcacaagtaaccttttttggtatagtggaagagtagttaatttaatcagggggcgaagttgttgacgaacgaaccaacttatcggccaatgacgttcaaaatttttttggaattcattcggctaaatgccaaggcagctagtgtggtgccgtattttattggtattttattttcaatctattattttcatgcgtttaattggatcaattcgttaatttacttagttgcacaagtagcgattgcattgtttgtgacggggtttaataacgtgcaggattactacttggctaaggatttacattatcgggatacttataacattgttggccgtgagcacctatcaccacgacgatcattgaatttgatgctagcgatgttagcaactgcaattattttaggattagtgctagtcgtcagaacaaacctattgttactgttcatgggcgctgcagcgattggtgtggctatcttctatacctatggcccggtaccgttttcgcgcttcccgttgggtgaattactgtcgggatgtgtcgaaggatttggcgttttctttctgagtgtttatatgaacgtcgcgacccccgtactggcgggctttaagtttgcttggccgcagtttgcgattgtggggaatttagagaacatattggtcatgattttggtggggctaccagggattttcttggttgcgaatatcatgttagctgataatatttcagatttacaacaggatattcgcaatgaacgttatacggttccgtactatattggtcatcgttggtcactacgggtctacgatacgctggcgctgttaggttatttgccagtgctgatgagtgttgttttacaaatactaccgatttatcagctggcagtgttgctcgttttaccaaaaattttgaagaatattcgggcctttaacgcggtgcaggtgaaagaaaccacctttaatacggcaccacaaaatttgatgatgtttcaaggcatgcaattacttggactgatcctgggtattttcttttaatccggtctgattaattgggatggttcacagaaacggcggccgtcatccagcataattgctgaatgacggccgccattttttgtgtcgctgttttttggaccttgttagtcatgtactgcggttgttttcggcggctatttactgatcaaccgcacggtactgtggccatcccccatctttttgatgagaacttgttggccaatcgttcgtttcattgattcaatgtgactgataacaccgaccattcggttttcaccaattgtttcgagtgcctgcatcgctttttccaaagtttcatcatccagggagccgaagccttcgtcgacaaacagtgcgtcgatttggacgccattagccgaagattgaacgacctcactgagcgagagtgcaatcgacagagcagcaatgaaggtttcaccaccggacaacgtgttggatgaacgcgagttgccggtttcattatcgtaaacattgatatcgaggccgtggtcactgcggttatcactcgcttcggcagctagttcaaatgtgtagcggttattggaaagcaggttgataaagtgatcattggcgtagtttaagacgcgttgcaagtagttttggacaacgtaggtctctaacttgagcttgtgatcgttgccatctttaccagtcatgatattatacaggcttgtaatttcggcgaaccgctttgcaaatgtgccttgctggtgcatgatttgttggactttttcgagacaactttgcgcgtcggttaaggcttgttccgccacggtttgggattgcagtgctcgatccttatgagcttgcaggtcggccagctgagcttggatacccgtaatattcggtcgttcaacgttcgttaaggcggtttgcagttgcttgatttcggttgtcagacgctccttgtcttgccgataggtggcaatttggacttgcagggcggtcagtcgaccattggcgagttcttctaaccaattttcaagtacagtttggtcatgagtcggtgcttctggagcagctaaggcctgtgcgattgtttgctcaagctgcgtgcgcgtggcctgtgttgtcttcaaccggtcgtttaaatcatcgagcttagtttgatgttttgataaagtaagttgactggtttgaacggtggcttgggcggcctctaggcgttgttggtaggtcgcgacgatctgattgagatgcgctttttcggccagcaggtcagcgcttgtgacttgtaagtccgtaccaatggctgcctgagctaccgtcaaatcggctgttttattgcgcaataaggcccgttgttcgcctaactgtaactccgtttgttgggcctgtttttgttgtgcttccagttcagcagtatatttctcaatagcttgaaccactcgttgggctgcctcaagcttcttcgtaattgtggcgagttgctcagcgaaaaaagccctgactgcggtcaaatcgtagggtgacttgagtgctagtccgttggtttcaatcaactgttggtaagttgaagttagttgcgtttgggcagtggttacttgctgcgtagcctggtcaacttctttttcagcctgttcgatacgttgttgagttgcttccacttgcttgttggctgccgccagcgcgttttgagcgtcgtcaacggcttgcatggattgtcgtaagtcagcttcatttgcaacgatggttgtgaccggcatctgtgaatgatcggttgatccacagaccacgcagggctggccgtcaacgagttcttgttgtaattgggcaatcattaagctttggcgttgaccacgttgttgttcaaattggacttgcgcattgtgctgattctgttcatcgcgggcaagctgcgcccgtaaatcagtcagttgcttggtgacgcgctgctgttcttgttgcgcacctcgccattgactatcaagtggtgtcagggtgtcgacgaactgttctcgttgtttaatcagcaaatctttagtggcgtgtaagtcatcaatagatggcaagttcgcttgttgggtggtgattttggctgttaatgtctttattacggtttggtgctgttcaaaagtcgccttcagatcagcgacactcggcttgagctttgcgagctgtgcgatgagactttcaacgcgttgcgcttgtggaatcaacgtggccaattgttccaagcgctgctggtgctgatggttagcttcactttggtcatgtaattgttgaactgcagcttgcgcttggcgatagtcgtcctgcgcttgttgcacgttatccatagctgcttgctggtcaagcgtcaattgcttttggtcacgtgtttgttgagtgagggattgcatggtggcttgtaggggctgggcccaagttaacgcgtgcaactgttgcttggctatggtaattgccggtgtttgttcttcaactttagtttgataatcagcttgcgcctgtgtgagccggtcaaattgttgttggcgatcgcgtgcttgctggtaggtcgtttcggccgctttaacagaccgattgattttactagtcgtttgctgtgcttggtcaaaaacactttgacgcgtcgtaacaaatgctcgtagtagtggaattttttgattgtccggaactgcttgaagttgagcctgttcctcatcattccaagttgctgaggctagtgcgacccgcaaatcggcgacaaactgatcaccagtcttgctggcggtttgatactccgctttaagttccgcagtaaagtctgaataaagttgcgttccaaaaatctttttaagaattttttccttgtcagtcgtttttgactttaagaattccgaaaagtcattttgggggagtagaatgatttttttaaattgatcggcagtcaaattcaagatggtcgtgatctcgggaccaacgtcggccggtttggttgcaatgctctcaatctccacgccaccaacgtgatcaacgacagctaatttggccgtactattctttttcgtcagtccagatccttttttcttagctaagtattgttcaggggagcgcgcaatcttatagagttgattgccttgctcaaagtagaaggtgacgcttgtcggttggtcagcgggggcgaactgactgcgcatctctttggctgcccgaccatccgtcccatcattcgtcgtactgccaaagagggcaaaagtcatggcatcgaaaatagttgatttaccggccccagtatcaccactaatcagaaaaatcggggtactttctagcttgctaaaatcaataattgaatgttcgtgggggccaaaatagttcatggctaaataaacgggtttcacggctaatcctcttttcttaagttgacgaaaatctggtcaacgagttgttgttgtgtcgttgagagctggttaccagtaatcgcgtggaaaaattgcccaacaattgcatcaggactcagttcgttcatgttttttgggccactaatggcggtggcttggtggttcgattcgtagtccagttcgacaatggtgccgtagatttgttcgagttgcgcccggacgttcagatgcttactacggtcgaattcctggacggtgatcgcaaaccaagcctgctttaacggctgttgctgataaaagttgggatcaagtaacgtttcccaaggcgcacgcaacgtaaccaagtcagtttgcggctgaattggcttgaattcatgggtgatcgcagtgggtgtgattgtcacaatttcaacacctttgccatggaacttagggttggcttccttgacgttaaatttgacggggctaccggcataacgaattcgatctttgtcgggtgaggctaaccgagtgtgaatgtggcccagcatcacgtagtcgaagtctgcgaataaatcggtggtcagcgtcgccaaaccgcccactttggaagttgtttcacttgttaattccaagtcgtcatctgctttgggtgtaacggtaaaatgagtaatcaacaagtgccgtttttcaggatcaaaggtggcaatgaggtcactaaccacgcgttgcatcgcatcgtgaatggtgtgaatcgccttgacttgtttttcgggcaaaccttgttgctgatagtagacccgcgcgtcaatggggtcaaaaaacggtaacataaagatttgtgccgttggggtctcgatgggcgtgaaggcctcggctagtaacgtattgatatgaaaattattataggctagccattcacgaccgtagttgagacgtttggcgccatcatggttgccagcaatggcatagattggtaggtgatgctcgatattaatagcctgcagcatgtggtcaagtgaagtgaccgcatcggtactcggaacggcccggtcgtagatgtccccagcaatcacgataccatcaactttttcagccaatgcaatcgttagaatttgcttgaacgctgcttcctgttcatctaacaaagaataaccgttaagcgtccggccgatgtgccaatccgctgtatgtagtaacttcatgggagttcctccttgagtttgaattgttaatttccattatcgcatatttacataaaatttcaggtctcgaagtgtcgtctgcccaaagtagattaattttgacgaaatacgtttgatttagtttggaatgttggcggacaaacttggaagtgggcaagttccaccccttattatgcaattcagctataattgcgcttaactagttgagcaattattgattgcaacatacgggtgagtaatttgctggtcatctttgctttcagcgattgcgtgttttagtcacgcataacgtaggactcggtattggaataattatggcgctgcaaccttatctggctagcagtttagaatgggggcttactcatgattccagaaaaatggcaacagacgcttggggttaaattgcttatcatggtaaatttaatcaatttggtcatcttagtagtgattaaactggccagtggtgggcccatgtggcaaattcgtaatgcaccgttggccgtggttggtgggttatttttaattgggattagtttaattttgatctgtaaacagaattccaactggcgcaagggaacgtatctcggtgctgatattaacttgaccgttttattttatttgttacttattgatttcaaccggatttccacgattggctttgcgctgatcgcgataatcatctcgattgtcgcattaccgatggcatatacttctcgtaatcgcttggttggaatccggattccgtgtacctatttgtcagaagaaaactggcatcggactaatgtgctagcaggcagattatttggaatctcaggaccgctgttagtagcgatgggaaagatgtcaacagactcatttctcaatgtctttgttacgattatcgtgttggtcgtgattttgaccgtgggttattcctaccggttaagtaagaaattaatctgatcgggcctggcagcgttaattggcatcccgtggtaatgtttgcgaaatcagttaaggggacggctgtatgccggttaagtgaaacgtaaaaagcaccgccatgagaattttcatgacggtgctttagtgttgattaagcttcagttattatttatgatgtcgttgttgtttaccggcattccgaccacgccccgcattattttgcggacgaggatgactaggcttggattcagttgcactaaccggctttggttgcgtcggtgttggtgttttgatggggtgctttttgagttctgcttcaacttcgcgccgaatacgtggccggaagaagttgatgatcagtgtttgcaagcaggcaaataaaccaccgacgaagaagtaaagtcctaaacctgcgggagcggacatggaaacaaataaaatcatgaccggactcataatgagcatgagacgcatcgtcttcttctgttcttcaggtaaaccaatcatggataggtaaccctgtgccaagtaggataaaaaggctaaaatggctagaatcagactggatttcccaagggagatccccataaaggtcgccttagataattcaggcgaatagcgaatagcgtagtacaaggcggagaaaattggcagttgaatcagtagtggtaaacagccaataccaccagtcatgctaataccgttgtcacggtaaagttgcatgagctcattactgattgcggctttttcttcctgagtcgtcgctgctttttgccgtgcctggattttttccatctgtggccgaaccgcggacattttttcttgttggtaggttgatttacgttgttgattaatcatcattggcagtaaaacgagtcgcacaatgaccgtcaagccgatgattgcccaaccgtagttgttaccgaatagttgtgacaaccattccatcacgttttgccctggctttgcaaggtactcgtaaacaaacccgtatggtttaccagctttggtcgtttgcacacaaccgcttagaaacagtgctaacgtccctaaggtgatggtgagcgtaaggcctttttttgatttcactagttaataatcccctttgttaaagtcatataatgatgatgatactaaagatgtcgggggaattcaattggttatccgaaaatcgtgatagttttgtggttcaacttcatgcacttcgaggtgcttgaccttgccaaaatcggttggcgactgccgaacaacgtcgataaagacttgcactcgttgatcttcaccctcggcttcaataaagactgagccgtccatcaggttacgaacgattccgttcacgccgcatttgtcagcggcaactttagtggcccaacggaagcccaccccctggacccggccgattgcttttaatgttactgcacgcattgtgtcacttccttacttaacttgttcagctagtctaacctgtgactagcatcttgattgtactgattgctgattgtattgtgttagcataattagtacaatctgtattacttatataatagcatggaaatgttcaacgggcgatatgctatacttgggataaaacggacactttcgaatgatacagggtgccccgaattgacaagaccggctgatgtttcaaccgattaattaaaggaagttgacgatggaaaaaattaattcattacaaaatgcgcacgtcaaggcgtggaaaaagctccaaacaaagaagggacgcaaacaacagggacaatacttgctagatggttggcatttagtcaacgaagcagttaaagcacacgtcgcgattcagaccttgctcattactgccaagcaactggcgaccgaaccggacttgactcattttccagcggtcattgaaatctctgatgaagtcgccaaacatatcagtgcgacggtgacgccgcagggggtgtttgcgctggcgaccctgcctgctgcaattgaagatctatcacaattagatttaacgcggccttggttactgctcgataatgttcaagatcccggaaatattggaaccatggtacggactgcggatgctgcgggttttgccggcgtcgctttcggtaccgggacggtggacatccatcaacccaaagttgaacgagctatgcaggggagtcagtttcatttacaactgattagtactgatctcgacaagttggttgaccaattgcaggcgcagggttcaccagtctacggttcagagttaaatccacaggcagcccggtatttagatattgacgcgccggctagttttggcttgatcatgggaaacgaaggtaatggaatgagtcgggaattattggcacggacagaccaaaacttatacattcccatcaaggggcaagcagaatcgttaaatgtagccgtggctgctggcgttttaatgttcggtttatatcgctaacttacaattagtaagaaaatgctaaaatccaggtaaaatactttcaaaatgactgactttttagtagaatagccgtagatattagcaaagggagctttagatgaaaactaataatgcgtggcaacaagattctgaatacgtggcgatcgtcgaagatttattagcacagccggccgttcagcggcttgctgagtttacacagcaccaccattcaaatcgattggatcattcgattgcagtttcatatgatagttatgttttagcgaagaaatggcatctaaatacgacggcagtggcgcgtggtggattattgcatgatttgttttattatgactggcgtgaaaccaagtttgatctcggctcgcacgcatttattcatccgcgggtagcgttacgtaacgctgaaaagttaacgaaattaacgccgatggaaaaagatatcattttgaagcatatgtttggtgcaactttagctgtgcctaaatatcgtgaaagtttgctcgtctctttagttgatgattatgaagcagaacatgaattttttggaccattacgtatgaaagtggccaaacaactagatcggttccgaggcaaggtctccgccggttaattcaataattgggggtcattgcatgtcagaaatgctagctgacacggtaacagaatccaacgtggatttcgaactgtgtccaaaatttgaaaagacgttctcaattctagggaaaaagtggaacggtttaattatcgatgttttactggaagacggtccccaacgctttaagaatctggcacgccggattcctaagtgcagtgatcgggtgctggtcgttcgtctcaaggaattggaagaaaacggcattgtgagtcgggtaacccattgtgactctgccctgattgagtatcgcttgactacgaaggggcaagatttacgacaggtcatggatacggtccataactggtctgataagtggttcagcctggccgaatcctaatacggggttgacgtgcagggcactttgccataaactgacaatgtagataaaagccttgacgagaaatagtagttagttacggcgtcgtagggacgggtgtcaccgattgaaagcaccctggcgaccaagattgacgaattcactctctgagctgaaattgggcgtttgtgtaaacaaataattttccggtatcccgaccgttatgacgggtagtgagtgtgcatagtgactactatgcaaacaagggtggtaccgcgatgacctcgtcccttttcagggatggggtctttttttgtccgcaacgcaactaaaaattggaggcagcatatgagtttacaagatcgattaaccgaattacgcgatcaaggcttggccgatattaaatccgccgatgttttgaaaaaggttaaccaagtcaaagttgatttgcttggtaaaaagggtccgattacagaagtattgcgcggaatgcgcgacttaagcccggaagaacggccaaaggtgggcgcttatgccaacgaagttcgtgaccggattcaggctgcgattgatgaacgccgtgaagaactggaacaagcagccgttaatgagcaattggctgccgaaaaactggacgtgacgttaccgggtcgggaagttccacaaggtcagcctcacgtgattacccagattattactgaattggaagatctatttatgggaatgggctatcaaattgttgatggtgatgaagttgaagaggattactacaactttgaacggttgaacttaccgaaggaccatcccgcccgtgacatgcaagacacgttctatattaccaaagacgtgctactacgcacgcagacgtctgctgatcagccgcggtcacttgaaaatcacgatttttctaaaggaccgctgaaggtcttgtcacctggccgcgtttatcggcgtgatacggatgatgcaacccattcccatcaatttcatcaaattgaagggttagtcgtggacaagcatattacgatggctgatttgaagggcaccttaattctggttgccaagactttgtttggcgatcaattcgatgttcggctacggccaagcttctttccattcacggaaccatccgtagaagctgatgtaacttgctttaattgcaatggcaagggctgtgcaatctgtaagcaaacgggttggatcgaagtactgggtgccggcatggttcacccccacgtgttagaaatgtctggcattgatccagaagaatatggtggttttgcctttgggttaggaccagaccgctttgcaatgttgaaatacggtgttgacgatatccgcaacttctacttgaatgacgtgcggttcttgtcacagttctataagaaaggttaggcgtccacatgagaatttctacgacatggttacgcgattatttgaagctggacattccggccgatgaattagcagaaaagattgaacggacggccgttgaagttgacggtgttattcgtcccagtgaaggattgaaaaaagttgtagtggggcacgtcttaacgtgtgagccacatccagattctgatcatctccacgtttgtcaagtggacgtaggcgaatcagaacccttgcaaatcgtttgtggggcacctaacgttgcggctggcgaaaaggtgatcgtggcgttacccaattcatggattggtggtcacactaagatcaagaagagtaagatgcggggagttccatcaaatgggatgctgtgcgccttagacgaacttggttttgatgaaaagttagttcccaaagaagttgcggatggtatttttattctgcctgacgatgccacgccaggtgatccggtcttttcatacctagggatggatgatgaaattattgacatgtccgttacccctaaccgtggtgacatgcttagtatgaatggtacggcgcatgaacttgctgccatttacgaccagcaaccaacgatgccgaaagttgatttgcatgaggatgctacgacggtggctgcggatgatctacatgtggctgtcgctgccgacgaacatgatgtcccaatgtacaaaatgcgtctaattaaaaacgttacgattaaaccaagtccgttatggctccaaattcgaatttggaatgctggtatgcggccaatcaataacgtcgttgacgcaacgaactacattttgatgcaatatggacaaccgctacatgcttttgactttgatcaattgaatgacggtcaaattaacgtccggttggcgaaagctggcgagcatttaacgacgttagatggtgaagatcgcgaattactagcgagtgatctgttgatttgtagtggcgatcaaccaatttgtttggctgggacgatgggtggcctagcgaccgaagtcactgatcagactacgaccattgcgttggaaggtgcggtttttgatgcagttaagattcgtaaaactgcccataatcatgacttacacagcgaagcttcaatgcgctacgaacggggcattgaccacggcatgactgcaacggccttagacgctgccgcagccatgattgcagaacttggtgatggtcaagttgctagtggtatggtcatcggtcgtgatgaggatgtgcaaccaacgacagtaaccattgacttagcacggatcaaccacgtcttaggaactgagttgtcattggacacggtcagtgatatttttaaacgattggactttccaacggtcgttgctaatgaaacgttcacggttacggtgccatcacggcgttgggatatccatattccggctgaccttatcgaagaaatcgcccggctatacggttatgataacttaccagcgaccctaccaacgggccaaccaacaatcggtaagcttaatgagacccaacaggtgattcgtgactcacgtaagttaatggaaagtgctggcctcacgcaagccatcagttactcattgaccacggagactaagtcgaaggcctttgcgcttcatgctagtgacgtcactaaattagactttccaatgagttcagaacggaccacgctacgcttgagtctagtttctggtttgctggatgatttagcttataacaatgctcgtaaggaacacaatgtggcattgtatgaagaaggacgggtcttttacagtcaacctgaacaagtccggccgaaggaaattgaacacattgccggagctattacgggttccatggttcccaagagctggggcgttgccgaacaacccgttgatttcttccagattaagggtatcgtggctggttatctgaagagtctggcgttgcaagatgccgttagttacgttgccacggccgaacatccagagatgcatcctggtcggacagctgatatttacgttggtgaccagttagtcggtttcgtcggtgaagttcatccaacgactgccaaagcctacaagattcgggaaacttatgtctttgaactggatttaacggcgttgattgccttaccaaaagcgcgtcaacagtatcaaccgatttccaagttcccaagtatcacccgggacgtggcgatgttgattgatgacgatgtgaccaacgcaaccgtggttgccttgatcaacaagaagggcggcgcgcatttacggcacgttcaactctttgatgtttataatgggagtcacgtgccagcgggtaaaaagtcgctagcttatacgttaacgtatcaagaccaaaacgcaacgttagtcgatgatgatgttacgacagcatttgaaaaagtactgacagccttaacggatgaattaggtgctgaaattcgttagtttgttgatagtcttgttaaacgccgaatgatttgaagtcattcggcgtttaatgtgtgtccaagatcctaaaaaaccataaaactaatggcgaactagtgcaaactgggcaacagttttgtataattgataagattaatcaataaatggaggggcgagtcttgaataacaaccaggataaccaagatcagaaggatcaaaacgattcacaagatcgtggggtaaatgaacctaatcgttcagaacaaaaacagcggaaatcattttcgaaacacgttattggtggcgttgttggtattttagtcgtacttttaattattgtgggggtattgggttatcgatattttgataatgcgacgcaaccatatgacagtagcgacaatcgcgtcgttcaagttgatatcccgtacggtgctaatggtaagaaaattgccgatattttacagcgcgaaaaggtgatcaagagtggttttgtctttgaatactggacgaaagcacacaacttatcaaactttcacgcgggctactatcagttgaagccttcgatgtcacttgctcaaattgcgaaggccttgaataaaggtggttcatcggaaccggttcagagttctagtggtaaagtcctaatcgttgaaggtagtcagattaagacgattgcgaagacggttcaaaaacaaactgatttcacgtcggcagaatttctagccttaatgaaggatcaaacattcatcaaatcattggccaagaagtatccacaattgttgaattcagcgatgagtgctaagcaagttcgctatcgtttagaaggctatttgttcccggcaacttatgttgttggtaagaaaacaactttgaaacaattagtaacgcagatggtttcgaagactaatgatgagcttgaaccatactacgcgcaaattaagaagtcgaagatgtccgtgcaagaagtaatgaccttagcgtccttagttgaacgtgaaggcagtacgacgaaagatcggcggttgattgctggcgtcttcttgaatcggttagatgctaagtggcgcttggattctgatatttcagtgttctatgcgatcaattctaacaagtcaacgttaacgaataaagatttgcagactgattcaccgtataacttacggttgaacttaggctacggccccggaccgttcaacagtcctagtttaacatcgatcaaggcagtcttagatcctgcacaacggagcaagggttacatgtatttcgtagcagatttgaagactggtgatgtctattatgcaaaggatgctgcgggtcacgcggcaaacatcaagaaggtttcgaagcacaacgaagccgctgaaaaataagaatgaggcgtaacttaaatgactgaaaataaacatcgccgaccagtagtcatcggggtaactggtggttccggtagtggtaaaactacggtcagcaatgcaatttacaaccaattatctggtcaatcattgttgatcttacaacaggattcctattacaatgatcaaagtgaaatgacaatggctgagcgccatgccgttaattacgaccacccactggctttcgatacagatttgatgattaagcaaatcaagcagttgctggcctatcaaccaattgaaaagccggtctatgattacgagcagtatacgcgtagcgacaagaccattcatcaagaaccgcgtgatgtgatcattgtcgaaggggtattgatcctagatgatcagcgtttacgcgacctgatggatattaaggtgttcgtcgataccgacgatgatattcgaatcattcggcgcattcagcgtgatatcaaagagcggggccggacactagactctgtgattggtcaatatttggcgacggtcaaaccaatgtatcatcagtttgtggaaccaacgaaacgttatgccgatctaattgtgccagaaggtggcgaaaatgaagttgccattgatttattgacaactaaagttcgttcaattttataaaaaataacgtcttaaccagcgctattttagatttaagagtttacttttaaaatctgaaatggtaggctggtttttgataactatattgcgtatttgaggagtgaaacacattggctgaagataagacatatccaatgacagaagaaggcaaggtcaagctggaaaaagagcttgaagaccttcgaattaatcaacgtccagaaattattaatcgtattaagatcgcacgtagctacggtgatttatcagaaaactctgagtatgaatcagcaaagaatgaacaaagcttgctagaaaaccggattaagacggttgaacacatgcttcaatatgctgaaatcatcgatagtgacaagattgacgaaacggaagtctccgttggtaaaatcgtgacgttcaaagaattacctgatgaagaaccagaaagctacaccattgttggtgctgccgaagctgatccaatggttggcaagatttctaatgattccccgatcgccaagggcttgattgggcatcacgttgatgaagaagttgccatcaacattccagccggtaccatgacggttaaaattttgaaggttgaaaacgcgtaattttatgcttaagactgttttgaggtagaggataccttgaaacagtcttttttggtggtttagaagcgcgattactgattaccagccactatttaacgaacgttactgaacaagcacgtttgcgtatgagttcggaattcaagcaaaacacccgcttatctgcacaaagcaggtaaacgggtgagtaaatcggacacgttacaattttgttgagcatttactatgatgaaaacatgccagttggttgggttactgctcatcagcacttgcacgtcctattccgacctccggggctgaggattagcctagctagggcgttaagcggtgaatttccgcttggcgtcatagcgtagctaaccggaagtctcagcctgacccgaacacgtttcaccaatatggcgttaaagcgtggaagaccagtatttaagacgtggtttgtggcttaaatctttgtccaccacgtttcagcaattggcagagatgcctggaagtcggtgtaggacgcgctcaaccaagcaagtctatacgaactcgacttttcccagtgggtccatagctggccctttttgaacttaaaaactggcatgttttaatcatgattcatgacagattgatcaggatatggccgacagtaaagtaggattagatatagataattcgtaattcaccaagcgagacgctgccggttagtatgacacccgggccagcagtggtcggtgtacctgtcgatgagatgtggcccattgagttgctgagattttcctgtagctgccaagtttgagggaggtataactcaaggctacctaatgaaacgtcgacattgatggttgctcggccttctttgatgtcagcgtcatcgaagtagattttggcaccagccattgatacgttcagatccgcagaacgaaaattttcgctgtgaacgtagcggatactgttgcctagtgagagatctaaattaacatggtcatcgttgattgtgctcgttgattcatggacgtcatcgtggttatgatgattgtaatgagcatgatcatggttgtgatagcgataatgatattgataacggggatgaatcaaaagacccaaaccaatgctgagtaatacggcagcccctaaaattgtccatggtacgagcttagtgattccaagtggttgcgcatagatcatggttaagaatgcgatagcgaagacgacgcccggcatattcaagtaacgaaggctactaattaaagccgcaactagaatcaatgttaacaagagactccagatgctgacgtggagcgtgaagagaccgagttgactaacgataagaacaacggcgctggcaattaagaagacgggccaaaaccaatttttatgcatttataacagtcctttctgttcaagacttattttgagttggcgatagtagcgtcttgaagcgtacagttgtttaggtgagtggtgaaacgcaatcaagttcccggtcaatgtcttggtcaaggaatagacttgtttggtattgacaatggcagatttggagacgcgaagaaagtaagcaggtaagcctgtgcccacagcggtcagcgacttgggaacacgataaacattatccagcgtatgggcggcgacctggtgaccagttgcttcgatgaataggatcgaagtaagcggtaactgtacgagttgaccacgttgtgaaacggttaacgtagcggcctcaattgaaagatttttgagagcagcagtgagggcggccgtttcggggtagtcgactggaacatgcagtgtgacggttggaattgaggtgtcgggctccgtttcaatgttcacttgcatgggtttcacctccttaagtagtttaagtacaccacaaaacaatgacgctgtaaataaagactcccttagcggtcatttcaggaacgcaactggtcattggcttgctcatcgactgtcaatgttgcgttttatgggcaaaaagggcacaattactgtaaacgatttcaatgatgaggtgttagtaatgaaaataacaattacagatttggccagtaagtggtttcatgatgacatgggtgtaaccactggtaatggggtgcgcttttacggcaaaacttatggcaagacagcagttcacagtggcttctcaatcgggatcatgcgtgatgacgaaccccatcaaccgattgccatggttgaaaaggatggtgtcaattactatgtcaacgaccgtgatgaatggttctttaagggctatgatctcacagttgattatgatgaacaaaatgacggcccgaagtatgactacacgcccaataacgagtagttctggtgagtgcttgccaatagcgattaatatttggacaaaaaatcagcgttgcctgaattaacaattcaggtaacgctgatttttgctgaccacatctttgactgtgaactgggctaggcgtggtggcgtcgacgccggacgataaaccaaccagccgttgcgagtgcactaatcccagtaatcagactaccagtgattaagaatggcggtcgatacgtcaaggtgaccgtatgcttgcccttacttaatgggacagcaacaaaggtattaatcactttcttagttgcgacggattttccatcaacagtggcatgccaacccttggagtaaggaatggtcgtcatcaaaacttggtgacgatgcttgatgttgattgtaccagtaatcttacgacttgagtgggccgtgatgttccaaggggattgctggagtttctgcgccgacttcttgaattgggtattatccaacttgtagagggtgaagttttgtaaccagagagaagtcttcttcatctgaatcccgaatgtcacggtcttgcccttgctattcgatgcaacgttaacagcgatcgtgtgccggtaagttgggtactgcttgagttccttaccgttaatgtagtaactcgcattcgaagtagttaggttttgcccgagcgtgatgtagtaggaatcattggttgtcggcgtgaacttaaagtaaaccgattccgttttcgctaaattttgtttgttcaagacggcgccagttaacgtcgtgaccttcttaacgttttggaagaccacttcgttaaagttttcggcactgatcaagccgctggttgaacgatttgccaaggtttggtaaatcaactcttgccgggcaatcggatcgccagttgttttggagactttcaagctagtaatcttgtcagacgctgcgaaaccaagacccagggcgtatggatttttgtaggtcgtgactttgttagtgctgagctttgccgatttttggtaattcgtcagatctttcttggtactggtgaccggaatgtagctacgatagttcgcgttatcagtctgggatgtcggtactgttttatccataaagtactgcatgtccagtaacgaatcggtaatcatggtcccgttggtgtaggcgaccacaccgtccccatccggctgaccaattgaaccgaaaaagttagggataatactttcgaaggtcgaactgaaatgatcagcaccgttataggccgcctgcatcggatcgtctttagttcgtgtaaacgtcttaccaattcgataaaaacgattgttgctagctttaattttgttgacggcattgtcaaggacttgcgtgtatttaccaaactcactttgtgacacgtaggaaatattatttaatgaagcgaccacgttgatcgacatatcagtcgcaactaaaattaacgcgacgatttgataaatgagacgtcgttccttaggcaacgttaagaaaatcaatgtaattgctgccaagccaattgtaattaagagattagcttgggtgacgtaggtgactttcttaatgttcaagtaaatggttgtaaacaaaccgaccagcaatgcgagcatcgttagcgcttgccacagtttgatcgttattttgtctgtcagtgcttgggcaccaatccagacgacccagaaacaaaagacaaaggagaagcggtaagggtaccaaactggaaattggcccgcatgccacaataaatcaagtggttcgtaacaaaatgataagataagcgtcgcggttacaatcaaggcgctcaacttcacggaccatttgaactggcgccgtaagaagaagagcacaaaggcgagaactgctaaccatgccacgtaaaagttcggttgaccggatggcatctgatcgaagttgaaagtaccggtgacgaacttagctaacatcttccagggcgcgtattcaagtttccaatgaaccttggtcacattatattgagccttactttgaatgagcgcccagaaagttggtaatagcaaccatgcggagaatgcgacacctagcagaccaccccaagcaaatttgagggcgtgagttgctaaggtcttcacgttttgccaatacttagttgcaccatacaaccagtataaacaactgaataaaatgaccatgtagcccatataatagttgtcaattagcatgacggccagccagccagcgaagtaacggactttaccagttgtaaacaagcgttccagtcccaaaatgaccaatggtaaaatggcgaccgtgtctaaccagatcatgttgagctgattggcgaccatccagcccatcagtgcatatgcggtactaaaagttggcaccaaccaacccttttgcgtctgcgttttagttagtagccaggcgaaggatagccctgcgaaaccatactttagtacagtgacgataaaaatgccggtagtgattgattgaccagggaatagtaagtagattaaattaaagggactcattaagtaataagcccagaccccaaccatctcgccaccaatcgttttggagaaggaatagaagaaagcactcggatcgtgcagtagggtatgccggaaataggaaaacaagtcaacgtattgttggcctaaatcgaccgttaacagactgcttgatccaaagggagccatgtgccgataaataaaataaccggtcatgatcagtaaaggtaaccaaaagctgatccataatggccatgtgcgcttgtcaaaaaaacgacggagtttcaaaaattgccacctcaatctctaataattcacagccaaacagaaaaataatcaaaaaaacattaaaatccgtaataacggctgaaatttttatgtctatcgtttagaataacataagtatggtatttatctaggattgctagtatcatctggtaaatttttgcgaaatgtttaccaaattaagaatgggagcgcctgagaattgaaattgtttaagaaaattacgataaatcgtgatcccaacaagtcgcatattccatttcggctgaacttcttgtttttcatcgtcttcttgttatttgctgcgttgattgcgcagttagcttacttacaagttgactacggacagaagttccgaagtacagtgaattcagccaataatacgacggcaacgggaaacgttcaacggggatcgatttatgattcaaccggtcgggtcttagtgggaaacaaatcccaccaagcgattcaatacacgaaggggctgtcagttgcgtcgactaagatgtacgaagtggcgaataagttaggtgagtacttaaccattccaacggatacattaacggatcggaacttggctgattattacttagcgggggcggctaatttaaagtcggttgctaagaaggttaaaacgtctagcgacgatgatgttttgtacgcacgggaagtcgcctatgcggaaaaacatatcattaataatttaacgtctacgcaaaagaatgcggcggcgatttattataagatgagttcggcgtactcgctgtcaacggtcaatatcaaatcgactggtgtgacgagtacggagcttgctgaaatcggtgagcaccaatccgaaatgccaggagttaaggtcggaacgagttggactcggagttatcctaatgggactgacttgagtagtgtgctcgggacagttacgaccgaaaagcaagggttaccgagtgatagcattaaaaccttgctggcagaaggctattctcgtgatgattcggttggtcaaagccaattggaaaagcagtacgaaaatgtccttcgtggaaccaagtcacagactgaggtcaagacgcaggatggggtcattcaaaaggagattaagaagtacggtggccagaagggggacaacgttcagctgacgattaattcgaagttccagaaaaaggttcaaagtatcattatgtctgaagccaaaacggtggggagtagtaatgcctactcgccaggagcctatgctgttgtaatgaaccctagcactggtgccatttatgcgttagcaggtgccagccggaatctatccactggtaaagtgactgaaaatgcgttgggaaccatcaaccaatccttcgttatggggtcggtcgttaagggtgccacggtcatgggtgccttgcaagatggtgtgattacacccacgaatagtactttgaccgatacgccaatcaagttagccggaacggccaccaagtcgtcatggtttaacaagaatggtggaactagtctgagtcttaacgcttcgactgccatggaagtttcttctaactcctatatgatgcaattagccatgaaggaaggtaacttcagctatgcgtctgggaaagccttgacgatgtctaattcggtcttctctaaacttcgtggttattttaacgagtttggcttaggtgttaagaccgggatcgacttgccgggtgaagcctcaggttaccaaggttcttcggcacagaaggatattggtaaagcgttagacttgtcctacgggaactacgatgcttacacgactattcagctggcgcaatacattgcgacaatggcaaatggtgggcaacgcattgcaccacacatcgtttccgctattactgggactaaatctaacgggtcccaaggggctgttaagactaatgttaagccacgtgtcctgaataccattgacgtcccatcctcatactttgatgtcgtacaccaagggtattgggatgtggtccatgggagtatgacgcagcggacggggagtgcactagctagtttatcaccagcggttgcagctaagtctgggactgccgagacattccacggaacgacatctactgaaaccttaagtttggtgacttatgcgccttataagaaccctaaagtagtgatagcggttgcctttccaggaattactgctactagtggtgattataatatggtcgttgctaagcaaatttatgcagcgttctggaagtattataacaagtaaaaaatcagcttttttcgtaccagtatcttaattgatactggtatttttcaatcattaatggtatagtagttcaagttaagggttccggccctgtaatatgcgaatgagtttggagggtcaacaacatgcgggtacacattacacttgaatgtacagaatgccatgaacgcaactacttatcttcaaagaaccgccggaacaatccggaccgggttgaatttaagaagtattgtccacgggaacacaaagtgacattacatcgtgaaacaaaataacaacggggactcctgttgttttttctgtaacattgtcatcagacaatgggtttctcatttgttggcaactgccaaattgatttttcaatttgacatgttaatgaatgagatttttttataccaattttattttcgggggtgccgtacgtggagaaaaaagcatttcgtaagcaacagcttgggcgattaagccaaatgacgccggctgaccggcaacggcaaaaccaggcgttacagacccaattatttgcaagcccaacatggcaaactgcccaggtcattgccatgacaattagtagtgacatcgaagtagcgacgcgcccacttattgaacaagcttgggcggagggcaaaatggtggttattccaaaaacgctgccgcatcgtcaaatggctttttatccttaccaagcgactgatcgacttgagcgaacgacttttggaattccagagcccgtcacgggtgaaccagtcgccaagcaacagatcgatctgatcttagttcctggtcttgggtacagccgtgaccggcacgcccggattggatttggtggtggctactacgatcgttacctcgctgattatccgggtaagaagttgacactggcttatgacgagatggcttttgaacacgctgaatggccggttgatcaatatgacgtcttgttagacgaactcttggtagcaggggatgaacaacatgatgagaattaaacgctggtggcaaactgaaccggctatcacgcaggtgctacttggaattactgtggcagtcttcttagtcgagtggctgatgggcgacggcgccatgctgatttttaattcactaggtgctaagaacaatcaagcaattgcggccggccagtggtggcgattggtgacgccgatgtttttacatatgggacttacccatattgcactgaatggtgtcgttatttattttatgggcatgcaaattgaagcaatgtatggtcattggcggatgatggcaatttatattttgggtggcattagtggtaatattatgagtttcgcgttatccaataatcagtcagtaggggccagtacggcgtgtttcgcactctttggtgcctttttgacgattggggaatcgttctgggaaaatccagtgattcgccagctcacgaaccaatttttactactaaccgttttgaatttagtattcgatatgttctcgaatggcattgatatctggggacatgtcgggggtctagttggtggctttttgttaggctatctgctgggtgtaccacgaattggcaagattgcgccgctgaaacgaattgtggcaacggttattctagtcattggctggttagctttactaaaaatgggttttacaaatgctaatttaactgtataattaatcgaggatatgcacatgaaaacactttacgacgtccaacaattacttaaaaaatttggcgtgtacgtgtacgtaggcaagcgaatttgggacattgagttaatggccattgagatcgatcatctctatcaagctggtgtcattgacccgaagatgtatgcccgcgtcaagctcgtattgagccatgagcaccggatagaagcagaacgcgcccgtgaaggcgcggcgcatgactaatggagggatttagcaacatggagcgtaagttaatcggagtcgaccttggtgggacgacaactaagtttgccattttaacagaaaatggtgatattcaacaaaagtggagtattgaaaccacgattttagatgaaggggcccacattgtgcctaacatcatcgattccatcaaccaccacattgagttatataagatggaccgttctcaatttatcggaattggaatggggactcccgggaccgttgatttggataatggtacggttatcggtgcctacaacttaaactggaagaccttacaaccagttaaggctcaaatcgaaaagggaactggcatcaaatttacgctggataacgacgctaacgttgctgcacttggcgaacgttggaagggcgctggcaaaaacggtagtgacgttgtctttgtaacgcttggaactggtgttggtggtgggatcatcgccgatggccgtttactccatggtattgccggtggtgccggtgaaattggtcacgtaacggttgaaccaaacggctacatgtgtacttgtggtaagaaaggttgtttggaacaatacgcttctgcaactggtgtcgttcacgttgctcgcgatatggcagaagaattctctggtgcttctaagttgaaacaattattagacaacggtgaagaaattagttcaaagatcactttcgatttagctaaagaaggcgatgtcttggctaaacgcgttgttgatcgggtttcttattacttaggcttggcattagctaatgtcgggaacacgatgaacccatcttcaatcattatcggtggtggggtttcagctgctggtgatttcttattagatcaagtcatcagttactttaaccaattcacattcccaacgattcgcgacacgactgctttgaagttagcggtcttaggtaacgacgctggtgttatcggagcaggttcattggcccaacggtttatttaagttaaaatcaatcgtcaagaagcttggaagtaatgtccgagcttcttttttatactaagctccaaaaactgtgctgattaggttgtggttaaaaactgagcgccaattgccgatgctgatttgggctcatgtcctcagactatgcgcgattttagtttcatgtcggtatgttgttgtaacggcgtatgaactgttacacgatttggcacaagggatacgaatcgactagcgtgaattgaattagatgacagaattgattggagaagcaggatggtaaagttattattgtcttcacgggcgtttagcactgtggccgtaacggacgcctttttcactttagtggcgccggtggctaagaacagtgcgagaattgtgattattgtcaattcggtcagcacgggtaaaaatcacccccaaatggtggcactacaacaaacggttcagcagcttggatatgcgcacgtgcagctcctagatgtattgacggatgatttggccgcattgaatacggcaacggtcattattttgaatggtggctacgagtttttactgttgaagaatctgcgtgaaacgcacgtgctggaacgactgaggactctcgcgctggcgggcaagccaatctacggtattagcgccggggctatcttgttaggcccggatttagacctgtacgcctatttatacccggaggacaacaccgagcaactggcaagcacaacagccatcaatgcgacgacgatccgtatttatccgcattatgatgttcattgtgaagtaaagccgcaattgccgcagttgatcactgactgggaacataagacgggcgttacggtcaaacggttgactaacaatcagggattactggtgcatggtagtcagattcagatgatcgattcagattcataaatgtgataccgcgatgcttggttttgaattaacagcgtggttaaatgcgggtctcaggcccccgaccgttttaatggatttctttaaaccgtgggtgagtacggccataaagcaatcagtgggacttcaggattagtcagcagtttaatcgcggcttttcctgcttacccctagtaaaagtaagcggttttgtgtaaaatagataagtagaaattaggagggataacgtggttttaggtgcattgagcggcatggcgtatgttaacatcgtgttagttatcataatcgcggcctactttatttatgagttgtatagttacattcgacggcgtcaagtgtccacgatgttggacgaagaagcgtttcaggcgggaatgcgtaaagcacaagtgattgatttgcgtgaaaagaaagagtttgacgctggtcatattctgggggctcggaatattccgttcaacagtttgaaagttcggatgaacgaacttcgcaaggatatgccaatctacgtttacgatcaaacccatacgttaagtacacgggccgtcgtcacattagctaagaatggttattcacagctatacattttaaaacccggttacgcacgttgggaaggtaagacgaaaaaagcgaagtattaaaaaatggcggctagaacaacaacttgttcggccaccattttttatttaattaaccgttgtgagctgagcgactcttgcgcatcgcctttttccggttttcttcgaatttgttttcttggtcttcgattggatcaacaacttgcttcttaaatgataagacggagccaattacggcaccagcagttgcgacgaccccaaacaagaagccacgggtaaatgatttcattagtaaaacctcctagcaattgttagttttattatgcttgttttatgcggagatagcaatcaattcaatctgatttttaaaaaagtggggtgaaacgcaatgcttactcaaattattgctcatcgtggtagcaaggggaccaggccggaaaatacgttaccagcgtttattgcggctatcgaggatggtgcggatggcattgagactgacgtacacttgtcgcgagacgggcaactgattattatgcatgatgagctcgtcgaccgcacgactaacggaacgggtcggattgtggatcacacgttggccgagttaaagcaattggacgctggtgttaagtatgcatcagcctatgcgggaacgcgtattccgactttagatgaagtggttcaattattgattcaatacaactttactggtatttttaatctagaaatcaaaactaataagattcattatgaggggatcgaagacttggtagcggattattttaaccatcatcaagttccgtttacgctaatttattcgagcttctacggaaagtcgatcgaacggttgcatattttacagcccgaggtcgaatcggatagcctgttcaagactaaggttcaaactgcgaagcggcttcatgcgcaacacattgttctcggttatcatccggatattcgttgggtgcgagttcactggctcttattgccaaaagtgcagttgcggccatggacggtcaacacggaacgcgatatgcggttctgttatcgtcatcggtttgcgggactgattaccgactaccctggattagcacgaagaattcgtaagcaggtacaaggaggttaaacgagtgacaacagtaactaaacataaagtattactaatcgcgggaccaacagcagtcggtaagacggcattatcgctagcgctggctaaacagctgaatggtgaaatcatttcaggagactcaatgcaggtctatcgtcacttggatattggtacggctaaaataatgccggaagagcaggcgggcattccccaccatctaatcgatatcaaaaatattgatcagcgttttacagtcgctgaatttgtcagtcggacgacggcgttgatcatcgatattagtgctcggggtaaactgcctattattgtgggtggaactggcttttacttgcagtccttgttggcgggctatcagtttggaccagcggataatgaacctgatatggtgtatcgtcaagcttggtttgatcgtgccgctgtcgaaggttcggatgtggcgtggatggcgttgaaacagcgtgatccgcaggcagccaccgcaattgcgcccgctaacttggtacgggtcgtacgggcgttggagtacgtgcatacaactggtcagcttttttctgagcaggcggatacgcacggtgacacactggatgcttataccttatgtctgaccgcggagcgagcgctgctgtatactcggatcaatcaacgtgtcgatcaaatggtagcggccggattggaacaagaggcgcggtggctatttgaccaaggtggcgccatgttaccggctggtaaggggatcgggtatcacgaatggttcccttactttaatggggagcagacgcgtgacgaatcaattgctaagatcaaacaggactcacgtcgttatgcgaagcgtcagttgacttggttccgtaacaagatgtcggtcgactggatcaatctattggaacaccctgaattacgggtctcgattgaccaacggctagctagttggttaagctaaattataaattggtatacctatgataaaacgtgtgatattttctaacatgaatgattgacattcgatgataacattgctaatattaagtctgtattaaagaggagggtcgttatgaaggaaaaggaactccgtcgctcgttggccgtcttgccaattggtacggttatgaagctgaccaatttgtctgcgcgacaaattcgctactatgaagagcaagaattgattacgccggaacgaaatgccggtaatcggcgaatgttttcgttgaatgatgttgatcgtttgcttgaaatcaaggattacttagcagatggcatcaatatggctggaatcaaagaaatatatgcgctccaaaaacagcgagctgagcagaagcaagctgacttggctaagctgctaactgatcgcgatgtgcgccgaatccttcatgatgaattcctgaatctcggaggcttgcagtccgacaagggccccaattatccggcacactaagatgtttgcattcgttagtcaatcaatttaaggagcgattttcatggcaaaacagtcctactcaaaagacgatatccgccgcatcgtcaaagaagaaaacgttaattttttacggttaatgtttactgatctattcggcacaattaagaacgttgaagttccagtttcacaactcgacaaactcttggataacaagttgatgtttgacggttcatccatcgatgggtttgttcggatcgaagaaagtgacatgtacctgtatcctgacttatcaacttggttgatcatgccttggaacacggaacatggtaaaattgcacggattatctgtgaagtttacacgtctgaccgtaagccgttcgaaggggatccacggaacaacttaattcgtgtcttgaacgatatgcgcgaagcaggttatacgtcatttaactgtgggactgagcctgaattcttcttattcaagatgaatgaaaagggtgaaccaacgaccgaattgaatgataagggaagttacttcgacttatcaccaatggacttgggtgaaaattgccgccgggacattgcacttgaacttgaacgacttggttttaacgttgaagccagccatcatgaagttgcacctggtcaacatgaaattgactttaagtacgcggatgctttatctgcagccgatcatatccaaacgttcaaattggtcgttaagaccatcgcacggaaatacaatttgtgggcaacctttatgcctaagccgttaaacggtgtcaatggttctgggatgcatgtgaacatgtccttgttccatgatcaaggcaatgccttttatgatgctaatgataagaatggcttagaattatcatcagacgcttattacttcttaggtggtttgatgaagcatgcccggtcatacactgctgtcactaacccgacagtcaactcatacaaacgcttggttcctggatatgaagcgcccgtttacgtggcctggtcagcatctaaccggtcaccaatgattcggattccaagtgcacggggcttgtcaacgcgccttgaattacggagtgtggacgcttcaactaacccatatttggcctttgcagcggttcttgaagctggcttggacggaatcaagaacggtattgaaccaccaaagagtgttgatcgtaatatctatgttatggatgaagatgaacgggctgcagctggtatcgctgacttaccatcaacgttacacaatgcgctgaaagagttccagacagatccgacgatgaagaaggcgttagggccacatatttatcagagtttcttggaagctaaacggcttgaatgggcttcataccgtcaacaagttagtgaatgggaacgtgatcagtacatggaattgtactaaaccattaattgagataaaaatacgacggttagggcaccttaaatggcgaactagccgtttttgttataaaattggtaaattagtggtgttaacctttattaatgcactaattttcggtaacattaggaacagcaatgcaattcagcaagttttcaattattattgattgcaaggagattattatggaaaaacaaaatcagcctgatcttgaaaaacaagatcaacctacgcgcgcgcttacgaagcgacttcaacaaaagttagactatgtaactacgatgcgccaagcaattacggctggtgacgaccggttgatctacgaattgatcgatggtgaccactatcaccaagccttacttaacgaggaaccggatccaacccgtaacgcccaagtggatttaattacggatgtctatccggcaatcagtcactacttgagtaccaagttaattgattatttggctcatgagtacccattcttttattatgaagaaacccaactcggcgaatttcagatttactttggtaactggtgggatcggcgccggtttggtaaattgaacgttttgaaagtcgcctttgaatttagttcggaagaatacaataaattacaaaagacgtttgaactggctcccgcgcacaaacgtttcaatacagatcgtattcagcagatctcagctggtagcgatcagctacagaaactgattgacgcgcaatcagaccgtgatgcgcaaaaagaagaattgcggcagcaactaaaggaaaatgggcaacgtaactcactatttgattctggtcggatcaaagaagaacggcagcaaattattgaccagttaactaagttggccgatgaagacgaacaagctaataatgcccatgcaaccatgaaggataacgaagctaagattttaacgctttctaaggaagatacgattttagcttatgagaaacaagcgattgaaaacgcctttaagagttttgagaattttaatgagcgtaaccgtagtctttatgttgactacttgaccacgctgattgggaaggcgcaggtagcggctgatggcgaataatacggacaagcagatggacacggcaacactgagcactcacggtaagctgagtacgttcaatgagggcttaaaaaaaggactcgctaatggtgaaaaatttacggccttgatggaccaactgattgatacaactgacggggagacactgttagcagcggcacaacagctagcagactttaaactggatacggcttacgtgacgtttccccatcaatatcagaatgccgattattatttgatcttcatgagtcggttattgggcatgcatggtgatgaacaagcggtgctgaattctcaacggcatactgaagcgctgtatcacgtttacggggcgctaacggatgattacaccttcttgtatcaagtggtgaacaacggcaacggtggtgcatattatcgtgaacaaacaactggcgaaaacttgttttatattcatttagaacggcgcttgttacggtttaatagttcggcgtttacgaatttatttattaataaattattgttgaaggggactggggttgaccaaattaatacggttctcgcaacgctaattaaatttggacattgcttacaagatgattttggctttaacgtcgactttaatattttggacgttgctaacgcggctaaatatgaacttcggtcggctaatttagatcgggcaatcgttgacaaattgtttgtcagtgcggctaagaatgagcacatgttgcgtaattcacagcaaggacatggtgcccaaattgaactgcgggctggtttgacagttgatatctttgatgcagctgaagctggcggtagtcaacaatgggtcctgactgttcatgatcctgatcaagcagtttcgtggtttgacgtgttgttacactttgggttcatgcgtgattggtacttagaaaatatcgattcgctagaaataaaagcggatccattagtatttgcttaagtaacgggggtattagatgttagaactaacaacgttattacaacagtcgattcgtttagaccgcgatattacggcccgtcaacagattcattggcggccacaagaacggttgcaaaatgcgatggtctcactggacgtcgaattggcagaaatggctaatacgtcggaatggttcaaagtttggaagattcatcgtggcaaagcggatcctgataagacacaccgcgcaacgctgctgaacgaatacgtagatgcgatggacttcttcttccttgtctcagcgattcaacagtggacgcatttgattccagtaacgcctgagcaattgactacgattgcggctaagccggcgactgatttgaataaacagtacttggcgatcaagcacctcctctatgatgcttactttaaccatcgtcaggagagctaccagcacgcttggcacgttttcttgaagattgggctagttgattttggttttactcaggacgagatacagacggcgtttacggccaaaaatcatgtcaatgagcaacgacaagcaaataactattaaaaaaataacctaattgcgcgatttgatcacgtaactaggttattttttaagcctctgtcattaattgcgcgtcgttatcggcgtcttgtgcaactaagtcattaacttggtcgatcaatgtttgtcgttgatcaagatcatcgtcgcattcaaagaaggccccgagttcctcagctaaagtatctttgcccgcatccatataccgaaagtcattgctggtgatcgtatagtgctggtgatctggcatccggacgatgacacaaccagtggctgactttcccttggtggctttgtccgtaaactcgaccgcgagtacgtagggcccgtcagttgaacgatctttgatggcatgcgcgatatttccggcaattgcttcaagtttcaatatgtttcacctcaaaacatattatacgcactattaggatgggatgcgagaattgatttagtccatcagctgctcggccagccgcttctgttcagcgtagaaagcgttaaaggcgtggtgggcgttgatgactaggtggtaatggtgctgtgcgactaataagttatgatgaaattcaaaggtgtcacgcccttgctgaataaacgttaagtaatcgttcagataaatgttactggttaagccatggcgtaaaagcattgttgattcccccagacagtattagatacgttgattgtactacaccaaggttgtggtggattggacggtgtcttgattgtaaattggtattataaacgacgactgttacaattttgatattttcagtttgtcttccaccaaattaattggatagaatgcaatttttaggtaatagggtgatattgtccaatgcggcaaatgctctttcactcatacaagctgtgaacctaatacttttgtttttttatgtggatgctcagtttaggtagttgttgacctttttaatatctatgccgtcaattggctgatttaataagcacgaatacgatttggctgccgaaatttattagaaaccaaaaatagagaagtttgctaaacgttggtttaacaagcttctctattttaaaatggcaggtccgaatcgatggtatgtcacgagtgagacttgaactcacaaccctccgcttagaaggcggatgctctatccagttgagctaccgtgacaacaacaagactaattatagttaagaagctggagagtgtcaatttttatttaatttttcaccgatgtgcagcagttaaaaaaaggcgtgagtaagcagaatgatgtaaaaatgtaatatttgtaatgaaaaagcactaaattacagtaagcacattttgctgagataattggtcattatggtgaaagtcaaaaatgaagttagcctggtgaacgaggaaattgttttcatgaataccaattaatgcttgaagaacgacacaatataaacgctgtaatagcggtaactaagtccggtcatcattaatttaatttttgcaagacggggttgttaaatggcgacggcgaagaaccaatatctcctaaaatacttaagaaaagataaagaaattaacaaaactgactaaaatagtttgtttcgcttgaaatgttactgtaacaaaacgataataatcatgtaacaaggaaggagaattcttatgggttcagtatttgcaatcgtcgggatcatcgccatcgctggtggcattcaatattattcaaactttgttgccaaagaaaatgcaagcagtaagcatttcactgcttcccgtaatgaccgttagtcaacgggagttcttatcttgcacattggcattatacaatcaagtaattaaaaaagaactgctcat

SEQ ID NO: 2 - DNA, 112698 bp, Lactobacillus plantarum
atgagcagttcttttttaattacttgatttttggtgttttttcgatggtgtcagtcttgccggcagcccaacgttggatagcagcaacttctttttcgcgacgaatgcgcttttgcttcccagcaactggccgacgtgatgcccatgtgttatatggttttgcaacaacagtcataagagtatgtccctcctttgattagtccaataacgactatattaaacaagaatagtgtacattgcaaccgaattaacaggaaaagccagacttttcccaaaaattgcattattagtataacggttatttcggtcggttgtcaagataaaatcctttacagcgtttctaaagatcaatttagctttgaattgatgctaaggcatgtaaggactaaccagctagtatgatagtggcaggtaggtgagccccatatcaatcatgtgtcagtcgaatgaatgggccagatagatcactgagaaccatcttagacgtaatctaactatttgtccggctgattatcatctgttagacgctcttagtaattaatgttatattaattatgaaatgaaagtagggagcagatatgagtcatgaagttgatccgcgtgtcgataaaactcggcggcgcttgcgacaagcattaattacactattacagacagaaacagtcgataacatttccgtgcaaaaactgactagtacggcagcagttacccgcggaacattttatctccactataaagacaagccagcatttgttgatcaggccctagatgacttggtaagtgaattgtttgaaacggccatcgtgacggtttcagtgggtgatattatgaccaatccggctgacccgttacagcgggtgcatgttttttccttatcaaaggcactcggttacatcagtcagcacgcggaagcctttgagacgctattgttagatcagcgccagttagcggtcaatcaacggatcaatcagcagatgacgacgtggatgacgaaatttcaccgtgattttcaggatcaatttgctgatttggaagtaccggtcagcattcaaatcgcgtattacgtttctgcgacagtcggcctgattactgattggttagctaatgatatgatctacacgccacattacttaaccaagtgtattaaaaaaatgcaccatttgatgacggtagggagcattagtttcacggacttttttgtgaagtgaaatcaatccttgactattatgaaaaaatttgataatattttcctgttgtatttgtggacttctacagctacaaccgcacggattgagtcttaagttcagcaatggcacttacattcggcgagtctaagtgatttataatttaaggaggtgcacaaacgtgtacgcaattattgtaactggtggtaaacaatataaagttgaagcaggccaagcaatttacgttgaaaaacttgacgctgctgctggcgacaaggttacttttgatcaagtagtctttgttggtggtgacacaactaaggttggaacgccgactgttgatggtgcgacggttgaaggtactgttgaaaagcaaggccgtgaccgtaaagtggttactttcaagtacaaggccaagaagggccaacatactaagaagggtcatcgccaaccatacactaaggtaacgatcgacacaattaatgcataattaagaaagtaggcattctttatgattcaggcaaccatttctcgtaatgcgaccggtcaagtgaccgcttttaagttgacgggacatgctgattcaggtgcttatggacaagacatcgtttgtgcagcggtttcggtgttagcaattagtacaatcaatgggattgaacaagttgcccgcttgcaacccgtagtacaaagtgatgaaaccaatggtgggctattaattgcagatttcactaagctggacttggcgaacacacaattacaaaccttacttgaaagtttcacacttggtttgaacgatgtggccacgaattacggagattacatccgagttcgtgaacaaacacgataaccacattcggaggtggactttactatgttaatgaacttgcaattcttctctcaccataaaggtggcggttcaactgccaacggtcgggattcagctggtcggcgtttaggcgctaagcgggctgacggccaaactgttaagaatggtaacattctttatcgtcaacgcggaacccatatttacccaggtgtaaacgttggccgtggtggcgacgatacattatttgcaatggctgacggtgtcgttcgttttgaacgcaaaggtcgcgacaagcgccaagtatctgtttacccagcaaaataatttttgaagagcctctgcagggaggctctttttttgtgaagcaatctagggatacctgcgactattattggttcacgggccgcttagccgtaaacgtaattgattgacgaatggccttcaataaatcattaccttcagtttttggaaagtttggtataatgaagcgtgaggtaatgatgggagtgacgaaataatgagtcgagttgaacggttacaaaataagtttgatcagttaaaaattgatgcgtttttagtttcagatggagctaatcttcaatatttaacaggaatggctgatatggccggcgatggttatctgctagtactggcacaggaagcctatctgattacggatgcccgttatcagacagcttttgccggtcactatgatgaccagcacctagtcattacacgtgattatctgggggccgtttgtgatattattgccaaaaccggtactggggtcatgggcttcgaggccgagattccatatacagcctacagttacttagatgagaacttggtcagtgatttggttgcgttaccggacgtggtcgatgagttgcgcatcaccaagagtgttgatgagattgaccggctacgagcgagtgcacgtttggcggatgctggtttcgaatacgtaacgagtatcgtgcgaccaggcatgcgtgaaatcgacgttagcaacctgttagacgcgtttatgcggacgcacggtgcaagtgggccgtcgttcacgacaatcgtacttggtggtgcacgagcggctttgccacatgggacggcttctaaagcactcttgacggccgggcaacttgttactcttgattttggttactttttggacgggtacacgtcagatatgacacggacgtttgctttaggtactccggatgataagttggttacggcctaccaggcggtgcaggccgctcaacaggctgtgatcgatcaggtccaagcaggagcagccactgctcaactggatgcagttggccgcgatttgctgacaaaagcgggctatggtgacgccttcaatcatggtatgggtcacggcattggtcttgccattcatgaaggcccgttgatctcaaaaaacacgactggcaccttagttgcaaacagtgtgattactgttgaacccggggtatatttcccagatttaggcggaatgcggatcgaagatgatgtcttagtgactgctgagggccatgaacgactgacgactgcaactcgtgatttactgattttatagttaagacagttgccacagcggctcggtcttgttatagttataaagatatatttgaggaggatttttaaaaatgatttcaactgcagattttaaaaatggtttgacgattgaagtagacaatgcaatttggcgcatcgtggaattccagcacgttaagcctggtaagggtggcgcgtttgttcgttcaaagcttaagaacttacggacaggagccgttcaagacaagactttccgtgccggtgcgcggatggaacaagcgccaattgaaaagagtacgatgcaatacctttatgccgatggtgacagctatgtcttcatgaatacggaaacttatgaacaaattgaaattcctggcgaccacattcaagacgaattgaagttcttgaaggaaaacatggaagttcaagtaacgctttataagggtgaagtgttgggaatcgatttgccaaacacggttactttggaagttgctgaaactgaaccagggattaagggtgataccgcttccggtggctccaagccagctacgttggaaactggtgcaattattcaggtaccattcttcgttaaggccggtgacaagctgatcgttaacaccgttgactccacgtacgtttcacgggcttaatttttagaaaaactaataccggcaaacatggaattggaggaatgtcaaaatggctgacagtagcaatattacgttacaaagcaaagaacccagcttaggacaaattcaaattgcaccagaagtgcttgaaataatcgttggtatcgcggtaagtcaaattgatggcgttaaccggatgcaagggacgatttcttccagtgtaaatgagttgttcggtcgcaagaagaatcttggtaagggtgtcaagttaacaatcgtcgatgatcagattagtgttgatgtgttcgcatacttggactatggtgtttcggtaccaaaagtcgctttagcgattcaagataaggtcaagcaacaaatcttatttatgaccgacctcgccttaagtgaagtcaatgtccacatcactggtatcgtgactgagaagactgaaagtgccattgatccaaacaacttgtttggtgatgaagatacccagaccgatgaaaatgaagatggtgaagaatcgtgagtttaacgcgtcatgaaatccgggaaaaagcatttcaagctttattcgcgttgaatgctaacccagacgctgatgaaaatcagttgttccaacagttactcaaccctgaagaagcggatgcagttgaaattcccgcatatttaagtacgttagtaactggtgttcgtgaacatcaagttgaattagacgctcaaattcagccttatttaagtcagaagtggtcgttggaccgactggctaagaccgatttgattatcttacgcatcgcgttctttgaattgcaatttgttgacgacgttccaactaaggtcgcggttaatgaagcaattgaattgacaaaggcgttcagtgatgaccgctctcggaaattcgttagcggggtgcttggtaaagtggttaaaaaccaagccaattagtctaaaaccgaacaatcttatgttctaccgtaaaagtctggcgatttgccagactttttttaataacttattagtaaaccggtcataaatcattgtggtgaatatgctaaaataagaccagacagagaaagaggagtgtggcacttgtgacgaagattattgatggtaaggcagtagctaagaaagttaacgcgcagacggcaacggcagtagcggaattggctgctcagggaattcaaccagggattgctgtaattattgttggggacgatgcagccagtcaaatctatgttcgaaataagaatcgtaaagccactaagttggggatgcactccgtggtgcggcagttgccagcgactactagtcaggacgaactgttagccattattgcggcatacaatgcggatgacagcattcatggcatcttggtgcagtcgccactaccagcccaaattaatgaaccattgatcacgatggccattgatcctaaaaaggacgtcgatggttttcacccgacgaacgttggtaagttgatcaccaattttccaggtaattatcctgtagcaaatacgcctcgcggtattatgacgatgttggctgactatggggttgatccggctggtaaaatggcggttgttattggtcggagtaccattgttggtaagccgatggccgctttgttaacaaatgctaacgcaactgtaacgattgcacatagtaaaacagctgacctaaaggcggtcgcccggacggcggatatcttggtggttgcaacggggattgcacacctgatcactggtgctgatatcaaaccaggcgcgacggtcattgatgttggcatggatcgtgatgaaaatggtaaactagtgggtgacgtcgattttgattctgctcaaggcatcgcagggttgattacgcccgttcctggtggtgtgggtccaatgacgattgccaccttgatgcagacaacggtggaacttgcaaagtggagtgatgtaagtgagtgaaagtcaacaatatttgacagtgacagctttaactcagtatttaaaacgtaaattcgaggttgatccgtatttaggtaaagtgtacctaacgggggaagtttctaattatcgtccccggcctaatacgcatcaatatttcagtttgaaagatgaccatgccaagatttcagccattatgttcaagtcggcgtttgccaaggtcaaatttcagcctgaagaaggtatgaaggttctggtcgtgggccggattggtctgtatgagcccagtggtagttaccagatttatgtggaacgcatggaaccagacggcgtgggtgcgttgtatcaagcctacgaacaacttaaaaagaaattagcggctgagggcttgtttagtgcacccaaaaagccgcttccgcgctttccaaagcgaattgcagtggtcactagtcgtagtggcgcagtgattcgcgatattatcacgactactcggcgccgttttccgattgcgcagatcgttttgtttccatctcaagttcaaggtgatgcggctgcggccgaaattagtcggcagatcgaacgtgccaatgcgcaaggtgattttgatacattaattattgggcgtggtggtggttcaatcgaagatctgtggccattcaacgaagaagtggttgcgcgtgcaatcgcacagagtcaactgccagttatttcatccgtggggcatgaaacggatacgacaattgctgacttggtcgcagatgtgcgggcggccaccccaactgcggctgccgaattagcggtaccagtatataacgatgttttattacaattaaagcaagaccagacccgcgtgttcaatgcatttcagaatttcgttcaacgcgctcgacaacgacttaataaattacaaacgtcgtacgtgtttactcagccgaaccgcttgtacgaagggtatttgcagaagttagacttcttaaatgagcgacttaaacaggctggtcaaaataactttaatctggcaagccagcactaccagcgtgtttttcaacaattacgacagcaaacgccgattcaccaagttcgccaggcacaaacgcaactgcttaacttgcagcaacggctgaatcggggtacccagttagtcgtgcggcaaaaacggcaacaactgacgcagaccgtccaatcgttggatctacttagtccgcttaaaatcatgacgcgtggttacgcctttgtgacggcggatgaacaggtggttcacggggtcaaacaattgcagccagaacaaacggttgcaattcacatggctgatggtgaggctcaggcacagattacgaagattgatggaggaaaataatggctgaacaaccaacttttgaacagaatttatcacaattagagacgatcgttaatcaattagaacaaggcgatgtccctttagaacaagccttggatcaatttcaaaagggcgtggcacttagcaagcagttgcaagcaacccttgaaggtgctgaaaagacgctcactaagatgatgaatgaaaatggcgacgaagttccatttgagcaagctgacgccaatgaataagcaattattaactgaatttgaatccaagtggcgtcctcagattaatcagtatttagatgagcagcttcaagcgtgttctgaccaatcaaccctgactgacgccatgcgttattcggtactagcaggtggcaaacggttacggccgttattgacgttagccattttagatacttttgatatcacaacgacggctgcaaacttgcgggcaagtgtggccgttgagttgatgcatacttattcgctaattcacgatgatttaccggcgatggataatgatcagctacgacgtggcgaaccgactaaccatgttaagtttggggaagacgttgccattcttgcaggggatgctttacaaccgttgactttcgaatggattgcggatagtgggttaccggcatcgatcgtcgctaatcaaaccttagcattagcgcaggccaccggacctcgcgggatggtggctggtcaagttgctgatgtccttggagcgggacaacatctggctttgccagccttacaacagctgcatcgcgagaagacgggggcgttaattcactacgctgtccaggcagggttgattcaagctcaagtgcaaccaaccgtgcaggaattgctattacaatatgctgatgcctatggattggcgtttcaaatttacgatgatattttagacgtgacgagtacgcctgctcagttaggaaaagctacgcataaggatgccgatgagcataagaatacgtatccaggtttgctggggcttgcaggcgcacgaacagcgttagaacaagcggtaacagctgctcaaacggcgttagtaaaagctagtactgctagtcaacgaggcatgggcttgcttgcagcttttctaacgtattttacagattaaggacttaaatttagatggaaaaagaacgagttgacgtattattagtacaacaaggattatttgatacccgcgaaaaggctaagcgtgccgtaatggccggtgaaatcttaggtgtcaacgaagaacgcttagataagccgggcatgaagatcccagtggcaactgaattacatttgaaaggcaaaccgatgccctacgtttcacgtggcggtctcaaacttgaaaaagcactcaaaagttttgaaattgacgtgaccgacaaaacggtcctagatattggctcgtcgactggtggttttaccgacgtggttttacaaaatggggcaaaaatgagttacgccttggatgtcggtagtaatcagttggtctggaagttacgccaagatccgcgcgtggttgtgatggaacatactaactttcggtatagtaaactggcagatttcacgcaggggcaacctaacttcgcgtccatcgacgtttcatttatttcactacacttaattttgcccccattacacgcgattattgaaaacggtggttcagtcgttgctctaatcaagccacaatttgaggctggccgtgagaatgtcggcaaacacggaattgtccgtgatcctgctgttcatcaggcggtgttgacagatatcgtggaatttgcgcaagcgaatggttataacgttctagggcttgattattcaccaatcaagggtggtgaaggtaatattgagtttctaattcatttacaagctaccgatgaaacaccacggattgcgccgactgtgtcgattgaaaaaactcaggcggccgcttatgaacaattaaatcaagcttaaaattgaaatccggactttcatatttatgcattttggcttatgatgtgtttaaataagtatgaatagctaccgggggtgatcgggtgaagaagcaagagcgccaacgctacattaaacgattattgagttcgaacgaaattgaacgtcaagaagactttgtcaagctgttacgtgctgaagatattgacgtgacacaggcaaccatttcgcgcgatattaaagatatgcagctggtcaaggttccctcggtaacgggcggttaccactatagtatgccagttcagaaacaaatggatacggagaaaaagctcaagcggacactgaaagatgcttatgtctcgtatgcgactcaggataaatttgtcctcatcaaggtgttgccgggtaacggaccagcactagcaacgttgattgaagcaatgcattatgacgaaatttttggaacgctaggcgatgatgctcatgttctgattatttgcaagtcgttagcgatgactttagagctacaacaaaaaattcaacgcttactgagtgatcactaattagtaagctatcttcgacctgctcacatgtgtgtcaggtcgctttttttcaaaattaactaacggatgctggtaaccaattgcttttaaggagggcttgcagtgttacaagaattatcaattacgaactttgcaattatcgaacacttagacattgcttttgaagccggcatgacggttttaactggtgagaccggtgctggtaagtcaattattattgatgcagtcggtttattagcgggtggccgcggctcggcagagtttattcggaccggtgctgataaagccgttttgcaaggcatgtttattttgccggctgacggcgtgacggcccaattgttggacgaagcggggatcgaacatgcggataataccgtcattctacagcgcgagattactaaaagtggccgtaatacatgtcgcatcaatggtatgctggtcaatacgacgactttgaaacagattggtgaaacaattgttgatattcatggtcagaatgaacatcaagagttgatgcaacctgaaaaacacctgggattgctggacgagtttgccaccgctaaaattcgtaaattgaagcagcgttaccagcaacagtatgatcgttatcagcagttaaaccgtgaactgcggcaaaagaatgcgaatgaaaaagagtgggctcaacgcttagatatgctgaactttcaagtggacgaaatcgcagcagcacaagtcaaagtgggtgaagaggccagtttgactgcggaacgtgaccgcttggataattaccaaatgatcaatcaagcgcttcaacagagttacacattgttagctgcaggtgaggagacgactggtgcggttgatatggtcggtacggcgatgaatgcactagaaccgattgctaatttggaccccgcctttaatgagattaccgtgaatgtcaagaatgccttttatgggctgcaggacgcggccggtcagatttctaatcagctcgatttgcaagaattcgacgagggtcgcttggatgaaatcgaacagcggctggacgttttggcccagttaaaacgtaagtatggggactctgaacaacaaatcttagattattaccaaaaaatcgcggctgagttagccaagatgactgactctgaagaaaatagtgaagatctggcccagcgggtcgccgatctgaaacaacaactacttacgacaggcgaagcgttgtccgataaacggcgggctgcggcgaaagtgttacaacgacagatccatcaagaactcaaagatttgtatatggataaggcaatctttgaagtacgattcaaaccgactaagggtcagatctatcggagtggtctggacagtgttgaattttatattcagactaatcctggtgagcgcatgcgcccattggctaaaattgcgtctggtggggaactctcacggatgatgctggctttgaaaaccattttttctgaatcacagggaattaccagtatcatttttgacgaagttgatacgggcgttagcggtcgggttgctcaagcgattgctgagaaaatcaacggcattgcacacttttcacaagtgctctgtattacccatttgccacaggttgcggcgatgagtgatcaccactacttcattgccaagaagattactggtaaacgcacgaaaacgagtgtgactaagctggataatgcggcccgggttcaagaactggcacgcatgttggcgggaactaaagtcactaagttatcgcttgagcatgcggaagagttattgcgactggccgatgaggaaaaagacgattaggcttaattgatcggtaccacaagggacggacaactatggtcggtctttttttgatggtgttaattagtgacgatagtgtcgagtgaggtttcggtattattgccaaggcgacgataattctttacaatataaaacgcaaatagacgaaatatgggtcaacggacacgttttaatgaactgtcgggctggttggtagtgggtggctaatctgaagctccgactaccaaaatataccgttaaaacgataaaatgttcagtttacatgtcatgacgtttgcattttgctttcgttataagttatgcttaattacagtacagtttattcggcaacgaaataaactgagtaaatgattggagtgatgaggttgtttctgacaatggaacatttgaataaaacgtatcctggtggcaaagtagccgttgaagattttaatttggaaatcgaaaaaggtgaatttgtttgtttcatcgggacgtctggttcaggtaaaacgaccacgatgcggatgattaatcggatgttaagtcagacttccggtaccattaaacttaatggtaaggatattagccagattgacccggttaaattacggcgacaaatcggttatgtgattcaaaatattgggctaatgccccatatgacgattcgagacaatatcactttggtaccacgattgctaaagtggccccaagataaaatgaatgaacgtgctaagaagatgatcaaactggtggaattgccagaagattacttggatcggtacccgtcggagctttccggtgggcaacaacaacggatcggggttgttcgggcgttagcagcagaccaagatttagtattgatggatgaaccatttggggcgttagacccgattacccgtgaatctttgcaagatctcgttaaggatttgcaggaacgcttaggtaagacgttcgtctttgtaacccatgatatggatgaggcgttaaaattagcgacccgaatcgtaatcatggatggtggcgacattatgcaagtggatacgccagacggtatcttacgtcatccagctaatgaattcgttgagaacttaattggtaaggatcgtttgattcaagcacggccaagtattaccactgttgggcaagtgatgttgaaagacccaattgccaccacaccaggaaagtcattgacggtcgcattacgacaaatgcatgataaacgcgttgactcgttgttagtcaccgatgaagccggcatcttgaagggtgtgatcggcattgaagacgttgattacaactttaactcggctactagtgtgggcgacattatgaagactgatttgttctatgttcagtcaaattcattgattcgggatacggtcgaacgtattttgaaacgcggcttgaagaacattccagtcgtagatgaacaacatcgcctggtcggaattgtaacgcgggccaccctggtcgatattgtttatgatgctctctggggtgatgaagacgaagatgaagctgaaaataatattcatcatggggaggacgatgcgcccgctgaaggcggtgaacaggcatgataactttcctacaaaactacggcatgcagctgctggttaagacgtggcaacacttgtatatttcagcgttttcattgttcttaggcattatcgtagcggttccgattggaattctgcttacgcgggtgaagccgattgcgaatgtggtcatgtcaatcgctagtatgttacaaacgatcccagcgatggcgttgttggcattgatgatcccgtttttcgggattggtgcaattccagctatcattgcgctgttcatctattctttattaccgattctccgcaatacctatcttggactggaagacgttgatccggccttgatcgatgcggctaagggaatgggaatgaccggttggcagtcaattgttaaagttgagttaccgatggcagccccagttattatggctggtattcgattatccgcaacgtacgttattgcctgggccgcgttagcatcatacattggtgccggtggccttggggactttatctttaatgggttaaacctctatcgaactgacttgattttaggcggttcgattccagtgattatcttagccctcatcgttgattggctgttgggtaaactagaagcagcggttaccccaagaaccacacaagcgtaagggggattaaagatgaagaaaattaaaaagtggttgttaggtgttttcgcaacggtcgccagtgcgttattattggccggctgtggctttccgggtttgtcaggaacttcatccgatacgatccggattgcgtcacaaaacacgactgaacaacagatcatggcgtacatgattcaagatatgattaagcattattctaatttgaatacgacgatcattaacaatttaggttctgggacggttagtttcaatgctttgaagaatgatcaggctgatatttcagcgattcgttacactgggacggacttaacgacgattctgggtgaaaagatggatcggagtaatatcaagtcgattgaccaaaaagttcgctcacagttcaacagcaagtatcaaatgacctatttcccaagttatgggttcgcagatacctatgcttttatggtgacgaaagcgacggccaaaaaataccatctaaatacggttagtgatatgaaaaaagtagcctcgaagctgacggtcggtttggatcaaatctggactgaacgaaaaggtgacggctatcctgcctttaagaagttgtatggctttcaatttgggaagacttatccaatgcaaattggtttagtttatgatgccttggaatcaggtaaaatggatgccatcctcggatactcgactgatggtcggattggtagttatgatctgaagattttaaaggatgataagaatttcttcccaccatacaatgcgagtgcggttgcaacgaacaagatcttgaaagctcatccgaagttgaagccaatcttgaatcgattaaacggtaaaatcagcttaaagacgatgcaaaacttgaactatcaagttgataataacttagtggaaccggaagttgtggctaaacagttccttgaaaaacataattactttgaagggagtgacaaataatggctcagatgaacttactgcaacagttgatatattattaccaacaaaacggtgtgtacgtgttaagccagttctcacgtcacttcttgatttcaatttatggcgtgctgtttgcggcaattgttgggattccaattggcattttcattgcccatcatagtcggttgagtgcgacagtgatcgcgattgccaatgtgattcaaacgattccgtcactagcgatgttatcaatcatcatgattggtttgggcttaggtgtgaacacggtaatcgtcacggtctttttatacgcattgctaccgattatcaagaatacctatactggaatgcaaaatgtgagtgctagtattttggattccggtaaggggatggggatgacacgttggcaattgttacgaatggtggagttgccactgtcactttccgtcattatggctggacttcggaacgcattagtgttggctatcgggattacggccattgggactttcgttggtgccggcggtttaggggatatcattattcgaggaaccaatgctacgaatggtggtgccattatcttggccggggcgttaccaacagccttaatggcaatcattgctgatacggtcttggcttggattgaaaagcgtgctgatccaactcaaaaataacgtcagtgagcgacaagtaaaagaagcaatataaaaattaagttactaaaaaagattgatttacaggtactccgtactcactcattcagggaagtcagtggagctgtaacatcaatctttttgatttgcatcaaaaacaccatgagaatacgcaaggttgtattgaacatgatttcatcttttgatgcaagtattaatgattaaactaaacgcgtttgatataacggatggcgtccgggtcgaccaagtgggtcaggtgtaactgccgattaactagaaccaactgaccactagcgagggtttttaacactccgtgaatattatatggtcgggactcagtgagctgaggctgcatctggagcatgatttgatagtgttccgtgtgcgcttgagctaagaacaaatcccgctggaaagccggcatcattggcagtaacggcgcaacgacggtcggggcagcagtaaagtcatccataaattggcgataggaagcgtgtaagttcttggaaattagtttcaaattagattgttgattttgcatattagccacctcgaacatttgtttgtgtttccattatacgaacaggcgttctaaaaagcaagcctaaaatttgagaaaattcacgaataaaaatgaaaaaaagctgtgtaaccttgataatacttgcaatatagggttaaaaagtgcaaaataaactttaaaacatattttaattaaggggaatttgtgatcatggcgaaacaaggcatgttaatcgtcttatcaggtccttcgggtgtcggtaaaggtaccgtccgcaaggaaatctttgactcagatgataacgattttcaatattcagtctcgatgacgacgcggcaaatgcgtccgggcgaagtagatggcaaggactactattttgtgtccaaagaagagttcgaggatgaaattaagagcggcggtatgcttgaatatgccaagtatgttgacaattactatgggacgcccttaaaatatattaagcagtcgttggcggctggcaaagacgttttcttagaaattgaagttaacggggccatgcaagtccgcgaaaaaatgcctgatggcgtcttcattttcttgacgccgccggatttgatggaattgaagcaccgcatcattggtcgtgggactgatgatatgagtgtgatcaacaagcggatggcaaaagcggttgatgaaatcaagatgatgcgtaattatgattatgcggttatcaatgatgaagtcccgctagctgctgaacgaatcaaggctattattcgtagtgaacggtttagtgttaaacgggtcatgcccgagtatgaagaaatgttaggagatgcggaatcatgatcttatatccatcagttgatgacttattgaagcaagttaattcgcgttactcattgattatgttagctagcaagcgggcccatgaattggacgctggtgcagcaccaatgcttagcgaatacaaatcggttaaaacgattggtcgggccatggaagaaattgcggccggtgacttaatgatcgatccagatgaaactgacaaagattagtaacaaaacggtgtgctgagccagctggggcttggcactttttttatgaagaatgacgcggacgttcagcttcacgttactgtcgattcttgatacaattgttttattaaagtgtaaaaatctcgctggcacggttgcgagatttttcaaaggacgtgaagaagtgagtatatggacaaaacgccatgtaacggtagtcgttagtggtgggattgcgagttataaagcgttagtattgattcgtagtttgatgaaacagggcgccgtcgtgcgagttgcgatgacaacccatgcggcaaagtttatcacgccattgacctttcaaactttaacgcagcagccagtggtcattgatgaattcacaacgactgacccgcatcacgtcgtccacgtcgcgttagctgactggactgaagtgatgattctcgttccggctaccgccaacttgattgctaaggtggctaatggtctagccgatgatgccgcaacgacgacaattttagcgacgaccgcacccaagtttgtggtgccagcaatgaattcacatatgtacgctaatccagcaactcagcgcaatttgaagcaactgacgacggatgggttacacgtcttaactcctgctacgggtatgttggcggaaggctacagtggtcaaggacgcttgccggaaccagcggtgattttggcctggttgacagatcaactgattcagttgacacctgatttgccattagcaggacggcgagttgtcgtcactgccggcggaacccgagaagccttagatccggtacgatttatcacgaatcgttcatcggggaagatgggctacgcagttgctcaagtcgcacgggagttaggtgcaactgtgacactgatcagcgccacgactcatttagcagcgcctagtggtgttaaggtcgtgacggttgattcggctcaatccttattgacggcagtcagtgatatttttgatgatacggatatcttggtcatggcggcggccgtatctgattatcggccggctgaattagctgatcagaagattaaaaagccagctgaccatgctgacttaacgttacgattgacagaaacaccggatattttaaaaacgttagcggcccggaagcaccaacagtatgtgattggttttgcagctgaaacgcaatcattgctggctaatgccaatcgtaagttaactagtaaaaaattagatttaattgttgctaacgatgtttccaaaccgggagttgggttcaatggtgatactaatcaggtcacactgttgcggcctgagcaacaaccagttacgacggaattgacaacgaaaactgcaattgccaaacagatcttgatgacggcaattgcggatggtgcaggaacacaggcatgattaagtagagaggaagagttgtgtggcacaaattgcccaagtattagtcgatgtgcccactatgcagacaaatcgaccttatagttatcgaattccaaccgcctggcaatcacaagtgcaacccggcatgcgcgtcgtggtgccattcggccgtggtaaacggcgggtgcaggggtttgtgttagctcttgatgacgttactaactttgatggtgagctgaaaccaatcgacgcggtcgttgacctagcaccggttctgaatactgaagccttagcactgaccaagtggttggctgccagcacgttttcatttcagattacctgtgcacagaccctgctgccggcggtcatgcgtgcaaagtatgaaaaacagttgcgaacaacagcaacaacgcccgcgacgattcgaacgacgctgtttggggaccaatcgatggtgccgtttgatgacgtcgccacgacgccggcaatcgtcagccagttattacggctgcaggcggctgggcaagtcgatgtgtactaccaagttaaaaatcaagcacggcgtaaaacgcaaacggcggtgaaagcggccttaactaacgaagcgctacaggctgcagtggaccaggtacgcgccggggctacacaacaattggcggtgctccaggggttgctcactttaaatggtgaacagctctcgcaaaaggcgttttgtactcgttttgatgtcacggacggtgccattcgtacagcagtacagaaaggctggcttaaaaaagtggccgtcgaggtttatcgtgatccctacgcaactagtgatattaagactaccaaggcgttacaattgaatgatgaacagcaagtggccgtcgatcagattacgcaagccgttgaccaagccgcaaccaccacgttcttgttagagggtgtgacggggagcggtaagactgaggtgtacttgcaatcgatggcggccgcattggcacaaggaaaaacggcgttgatgttagtgccggagatttcactgacaccccaaatggttcaacgcgtgaagggtcgctttggtaaagctgttgccgttttgcacagtggattgtccagtggtgagaagtatgatgagtggcggcgaatccaacgaggtgaggctcaggtggtggttggcgcacgctcagcggtgtttgccccgctaaaaaatcttggcttaatcgtgatggatgaagaacatgagagcacgtataagcaggatgatgccccgcgttatcatgctcggcaagtggctttatggcgtagtcgttaccataactgtccagtcgtactgggttcggcgaccccatcgttagaaacgcgcgcccgcgcagaaaagggcgtttatcagcgcttactgcttgcggatcgggtcaatcgacggccccttcctaaggtttcaattattgatatgaaaaaggaaatgcaacaacacgctgaaagcaatttctcagcgccactgttagttgccttgcaggatcggcttgaacgtcatgagcagagtgttctaatgctcaatcggcggggctattcatcgtttgtgttgtgccgagattgtggttttgtcttgaagtgtcctaattgtgatatttcactcacgctacacatggatacgcacacgatgaagtgccattactgcggtcacgaagaagccattccgcggaattgtccgaactgtcatagtcgtcagatccgttattatgggacgggaactgaaaaagtcgaagaagaattgcaagacttgcttccggacgctaacattattcggatggacaatgatacgacccgtaaaaagggcgcccatgccaagcttttagcacagtttgggagtggtgaagctgatattttgattggtacccagatgattgcgaagggactggattttcctaacgtgaccttggtcggtgtcttgaatgctgatacggccctaggattgccagattttcgcgccagtgaacggaccttccaactattaacccaggtgagtggtcgagctggacgggcggaaaagagtggtcacgtgtatatccagacatttaatccggatcattatgcgattcggtttgcacaacaccacgattacgaaggctttttcaagtatgagatgcagatgcggcaccggggtggctatccgccgtactactttacggttcaaattacagcgagtgacttagatgaaggggtagcggccaagcgcatgtatcagttattgcaatggttacgcccgcggttggcaccgtcaacgattctattaggtccaacgcccaggccaatcgcacgagtcaatcgccgttattattatcaaatcgtgattaaatataaacaagaacccaatttagctcagacgctgacaacgctactgcatgagacgcaggcgcaacaacgacaagggctacagattggcattgacgtagaacccttacatttcatgtaatgggattaggaggaagtttgacaatgacatcaatcgtttttatgggaacgcctgcgtttgcggcaccgattctcaaaagtttaattaaagaacaataccaggtactaggcgttgtgacccagccagaccgaaaagttggtcgcaaacacgtcttaacagcttcgccagtcaaagaagtcgcggttgcccatgatattcccgtcttccaaccggaaaagattagtggtagtcctgaaatgcaacagattattgacttgcagcccgatttaattgtgacggccgcctttggacagtttttaccaacaaaattgttgaaagctgccaaaattggtgccgttaatgtccatggctcgttgttgcctaagtatcgtggtggtgcgcctgttcaatattcaattatcaacggtgagtctgaaactggaattactatcatttacatggttaaaaagatggatgcgggcgatatgctggcgcagcgtgcgattccaattgaaaaaaacgatgacaccgggacgatgtttgataagttgagcttagttggtcgcgacttgttactggaaacattgcccaagttgattgctggcgaaattacggcggtgccacaggatgaatcccaagtgacctttgcaccgaacattcagccagaacaagaggtcttagacttctttacaaaaacggccgttgaaattgataatcaagttcggggtatgcggccagcaccaatcgcctatgcggtcttggatgggaagcgcacgaagttctgggatgtgaccccgttagctgacgaagtggtcacgcaagctcctggacaagtggttcgcaagacgaaacatgagcttgtgattgcagctgctaaccacacagcgattgcaatcaatctgttgcagccagctggtaaaccgaagatgacaattacagactatttaaatggggcggcagataagttcgctaccggagagcaggttattaataaatgagtacagttggtaataccccccgctggttagcggtcgccgccttagcgaagattaagaacggtgcatattcaaatttgcaattaaaccagttaatcaatgatcatcagatggatcggcgtgacattaatctgctgacaaatatggtttacggtgtcattcaacatcggttgactctcgaatactggttgaccccgtttgttcgacatccgcaccagattgacccctgggtacgggaactcttattgagcgcattgtatcaatggcagtatctggataagattccacaacgggccgttttcaacgaaacgattgaaattgctaaggtcaaaggtcaccctggcattcggcggtttgtaaccggcgtcttacatcaaatggatcgctcaggattaccgagttttgatgcgattaaggatcctgatgaacggttgagtgtgacttatagcatgccaatatggttgattcaagaattgcggcgtcaattaggtgctgaaaagatggagcgaatcttatcatcattgaaccaaccagctaagcaagccttacgtgtcaacccggccctgtcgacggttgaagatgtgacaacggtgctgattaatgatggtttgacaattacgccgagtgaaatctcaccgttagggctgattgcaacggatggtcaggctattaatactgaagcgatgcggtatggcatgtttacagttcaagatgaaagtgcacaattagttgtgccagcactcaatctgcagccgagtgatcgagtcttggatgcttgtgcggcccccgggggcaagacgacccagattgcggctagtttagatgctgagcagggtggcacagtcgttgcccttgatattcatgctaataaagtgaaactgatcggccaaaatgcggcgcgcatgcacgttgctgatcgcgttgaagccaccgaactcgatgctcgtaaagttgagacgcagtttaatgctgaaagttttgatcgaattttagtcgatgctccgtgttcgggactgggattgatgcgccggaagcctgagattcgctatgagaaacagttgcaggatagtttgaacttgcaacgaattcaactggcaattttgacagcagtcgccccaaccttgaaaaaaggtggtatcatgacgtatagtacgtgcacgattttgcaacaggaaaatcaggatgtgattaccaaattcttagcggatcacccagattttgagttgcaaacaacgccaactgaacgagacttgaaaactgatcgaacggaaaagactttgtcgatttatcccgatgattatttatccgacggctttttcattgcttgtttgcgaaaaaaataatggtggagtggtaaacaatggattttgcataccggtcggatattggccaacaacgtgaagaaaatgaggactatgtcggcttttttcaaaataaagcgggcatcaattttgcaattgttgcggacggtattggtggccaccaggggggcgatgtcgcttccgagatggcagtctcgcacatgggttttcggtttgaaaatacaacattcaaggaacccaatgatgccgtcaagtggctagcaagtgaagttcaagatgaaaatcagcatattattgaaaaggcccgtgaattttcagatctaaacggcatgggtacgacaatggtcgccgctttgctttttgatcaaaagtttttgatggctaacattggtgatagtcggggctatctttttcgcgatgggcaactccaccaactgacggaggatcattctttagtcaatgagttggtcaagcgaggagagatttcagccgaacaggcccgacaacatccgcagaaaaatattattacgcggacactaggcatctcaccagatgcggatatcgatacgaacctttaccagatacaacctggggaccaattgttattatgttcagatgggctgacgaatatggtgactgaccaacagcttgcgacggttttggcaacgacgcagacttcgacccagaagtgtgagacgttgatcaaattagccaatgcagctggtggtaaggacaacattacggcgctgctgatggcgcttgatggtgaggtggccagtaaatgacacccaactatacccttagcggacgatatcggatcgttcggtccttaggtgaaggtgggatggccaacgtttacttggcacatgacttaatattagatcgtgatgttgcggtcaaactgctccggttagacttacgtgatgatcctaagaccatcaagcgattccaacgtgaggcactggcaacgacggaacttgttcacccccacattgtcagtttgtacgatattggcgaagaaaatggcatgcaatacttggtcatggaatacgtcaaagggatggatcttaaaaattatattaaagagaactttccgttaccgttacagcaagtaatcgacatcatggagcagatattaagtgccgtggcaacggcccacgcgcataatattattcatcgggatttaaaaccacaaaatattttaattgatgagcagggcaatgctaaaatcactgatttcggtattgcggttgcgttatctgaacataccatgacgcagactaacacgattttaggttcggtccattatttgtcaccggaacaggcccgcggtagcatggcgacaaaacaatcggatatctattcgttagggattattttatatgagatgttaacaggctcagttcctttcaagggtgagacggcagtttccattgcgttaaagcattttcaaaatgcaatgccatccgtgcgagagtttgatgcggatattccgcaggcacttgaaaacgtcgtcttgcaggcgacaacgaaagatccacgggaacgttatgctacggtcgaggacatggccactgacttattgacggtgcttgctagtagccgtgcgggcgaaaagcgctttgtaccgcaagatgtcggtaatgatgagactaagatcatgcccagtgcggatattcaagcagcaattgcggccaatcaagacggtaagacccaggtcgtggcgcataaaagcaagcaaccaacactccagcgcccggctgaaacgactgagagtcagacagatgctgatgaagaaccgttaccaacacgttcttggtccaaacgacatccgttgcggcgtcggctcctcttttggggcggtattattttgttattagtcgtggccgtgatcgtcggtttggaattaagtcggccacagatgacgacggtgccgaaagtaacgggcttaagtcagcgtgccgcaactaaggtcctcaaaaaacaccatctcacggtcggaactgttcaacatgctaaaagtaatcaggtagccaaaaatcaggtgatcaaatcaacgcccagtgttaagacgcgggtccaagaacgtgctcgcattaatttggttatcagcaacggtgccaaggttatgagctttggtaattatgtcaatgataattaccatgatgttcgacagacgcttaaatcggcggggttcaaagttaaggaaacttacagtacgtcgtcggttgcagcaggacaaatcatcagtcaggatgttgtcgctggtagtcgcgtgatgccgacagatacgacggtgacgtttacggtcagcgctggtagccgctacgtcgagctaaaagatttaactggtgagagcaagagcgatattctggactatgctgaggcaaatgatcttaatgttaactttaagcagggctactcttcggaacagaaggcaggttattcctatgatcaagatccagatggcggtggcaatgtccggactgggtcgactattacggtgaccatgtcaaggggcagtgataataacgtgacgacaccacagaatttttatgttaaactaacggtgccatacaaagcgttatcggccaccactgcccaggccaacgatgttaagatttatttgtatgatgatacccatatgattgagaccgtttatcgcgatattgcaatcatgcggtcgactaagattagtttaccgtttcagctgaccggtaatacgaaggggcattaccgaatcgtgcgtaacggggttacgatcatggaaaagaagaatattacaagcaaaaatgcaacaaaataaagataagtcatgcgcaatgcatgacttttttggtacaatagagaaaagtggaccgtaccaaataatataaaaggtggtgctaatttgaaaattggacaaattcggcaatcgctaagcggcttttatgacgtttatgctgatggccaaatgtatcggacccgtgcacgcgggaatttccggaagcggcgcattacgccacttgtcggcgacaatgtggagtttgatgcggcgaccccacaagagggctacgtgttaaatattcttgatcgacagacccagttggtacggccgccagtggctaatgttgatttaggtatcgtggtaaccgctacaacggaacaagaattttcaacgaatttattggatcgacaactggtagctttggcagtggcaggtattgaaccattactctactttgcgaagactgatttactaaccgatgaggtgtaccaacaacgattaacattagcggacgcttatcggcagattggttaccaggtcatctgcgaacgaaccgcattttcaccggccgccttagccgcagttaaaacggctctggctggtcatgtggcggttgtcatgggccaaactggtgctggtaagtcaacactgctaaatcatttacaaccagggctggcgttagcgactggtgaaatctcgcaggcgctgaatcgtgggaaacatacgacccgtaaagtcagcttgatcccgattgcggatgggttggtcgctgatacgccgggtttctcatcctatgaagttttcgatattgccgctaacgagttgacccattattttccagagtttgtgcgacttagcgctgattgcaaataccgaggctgtgtgcatattaacgaaccgcaatgtgcggttaaacaggcattggcagctggggagctgttagcgagtcgctatgataattatttacaattctatgaaaccattaaaaataaaaaagtaatctataataagaaaaagtgagtgagactaatgattaaagttgccccttcaattttaagtgcagattttgcgaaccttcaacgtgacgttcagatggctgaaaatgccggtgccgatgcgttgcatattgacgtgatggatggtcagtttgtccccaacttgtcattcggaatgagtactgtggcggatttacggccagtaacgtcattaatgttagattgtcatttaatgattatggacccagagcggtttgttgggcagtttgcaaaggccggtgcagatttgattggtgtgcacgttgaaagtacccgtcacatttatcacgccttacaattaatcaaagatgctggtgtgaaagccgaagtggtcgtgaaccccggaacaccactcggcatgattagtgaattattgccactagtggatcaagttttgattatgaccgtcaatcctggctttggtggtcaacattttctggaccagatggttgctaaaattgcggcgttgaacgaattgaagcaacaacacggttatcaatttgagattgaagttgatggtggaatcaacgaccagaccgtcaaggcgtgctatgacgctggtgctacggtcgctgttgctggttcgtatgtctatgacagtgcggacccagcgcaacgtattcaagatttgaaggtggcgaccaattaatggcaaccatcgtaaacttactggttggcggaccgactgctaattatccagcagatttaacgacgattccaggaccatgggtcggcgctgaccgtggcgcgttgcgtttggtgaaacgtggtatccagcccgtgatggtcgtaggtgattttgattcaattgatgcggctgaactccagactgtcaaagatgcgttggtgggcgctatcgttgtcaaacccgaccaagaccatacggatacacaattggcgattaaatccattttcgagcagttgcaaccggatgaagtgcatctatatggtgccacgggtggtcggttagaccatttactggccaatatgtggttagtacttgatccggtatttcgtcagtgggctccgcagatcaaactgattgataagcaaaattcggttcggttctttctaccaggggactaccagatcacgaaggaagcggataaacgctatttggcgtttgtaccgctgatgccgatgcatctcacgttacccgatgaaaagtatcagttggacgctgcttataatgcgtacccgatttcatgggccagtaacgaattcagtggcaatactggtcactttagctttgatgcgggggttctagctgttattcaaagtcgtgatgacagcatggcagatgcgtagggtaccccaaggtttcagctaaaataagaccggtcggtgagtcataaactcatcaaccggtcttttaatatgcagtaacgacgtatcatcggggagcttgttggtgaaacgtgctgatgtttaggtcggtggtcgttagtagacctaaccggaaagcttatgttgaagcagaactttttggtcagacccagctggttgtttccgacgatggtacggcaagcatcctcaatgattcaggtcatcataatgggctggtcaaggctgaattataaactttataaaaagttgacgagaaattagtaattttagacaacaaaaaacgccagccacaaaaaatgtgctggcgatttgctgcgctaaacgcgcgtaactttacctgatttcaaagtccgagctgaaacccaaaccttctttggtttaccatcaactaaaatgcgaactttttgcaagttagctttccagctgcggcggctgtggtttaaagcgtgagaacgcgtgttaccaaagtgcgtccgtttgcctgtaacgtagtcttttgccatgttgatctgcctccttcggtaattcattgataaaaggtcgtctttatcattcactagaataatttatcatagattaataaaggttgcaatacatttctatcaagtaattttactttactgctaaattcccagtttccgggcttctgttaagcagtcgcttaatttttctttcaagagtggttgtgctatgataaactatcgtaaatgaacgcgttaaaacaaggaggctattttcatggctgtcaaaatcaaaacgcaatttggaaccattgatattgataatgatgttatcgcgacggtcgtcggtggcgccgcaacggataactacggggttgtcggtatggcgagtcggaaccagattcgtgataatgttaatgaaattttacgccgcgaaaactatgcgcgcggtgtggttgttcgccaagaggataatggggtggctattgatgtcaacattatcgtcagttatgggaccaaaatttcagaagtctcacgcaatgtccaagccaaggtcaaatataacttacaaaacatgcttggcgttacggccaattcggtcaacgtcattgtccaaggtgtccgggtaatgaacgactaaattgatgttggtggaagccaaggaggaattttgaaattgaaaatcaccacgattactaatcttgaatttggcaaaatggtgcaggctgcttcacaaaagctgaaccaacgtgctgaatttattaattctttgaacgtctttccggtaccagatggtgataccgggactaatatgagcttatcgatggccagcggtgccaaatatgaacgtgaagaaaccagtacaaaagtaggcgacctagcgtcagccttagccaagggactcttgatgggggcccgtggtaattctggtgtgattctatcacaaatttttcggggcttttctaaagccgtagcggataaggagagcttaaccgctaacgatttagcagccgccctcgcagccggtgctcagaccgcctacaaggccgttatgaagccgactgaaggaactatcctcactgtcatccgcaaagctgctggtgccggtaaggaagctgttaaaacgaccgatgatatttgtgaagttatggatgccgtcgttacggctgctgaagctgcattgaagtccacgccggacttgttacccgttttaaaacaagttggggttgttgattccggtggtcaggggctgaccttcgtgctggaagcctttagtgactcattaagcggcaaggtcgacgaatcacaggactatgttccggacgatgctgaaatggattcgatgattgatgctgcccaccatcaaagtgtgcaggggcaattagacccgaatgatatcaagtatggctactgtaccgaaattatggtgcgaatcggcgatggtaagttagttgatcacaagttcgactatgacactttctatgagtacttagcaaaattgggcgattcattacttgtcatcaacgatgatgaaatcgttaaggtgcacgttcatacggaacatcctggcgatgtcatgacgtggggccaacgttttggggcgttgatcaaagttaaagttgataatatgcgtctacaacaagaaaccatcatggaacatgataaggaagacgaagcgcaagccgctgctgagcccgccttaccttcacaaccacaagttgacatgcatggttatgcgatcatctctgtgtcatcgggtgatgggatcggcaagctatttaagggcttgggtgtcaccgacatcattgctggtggtcaaacaatgaatccaagtaccgcggatatcgtcaaagctgttaatgacagtggtgcccaacaagcattagtattgccaaacaacaaaaacatctttttggcagctgaacaagctgcggaagttgccgatgtcccagttaaaattatccacagtcagacgatttcgcaaggcatgactgcaatgttggcattcaatgctgaagctgatttagacgataatcaggccgcgatggaagaaaccttgagtacggttgttagtggtcaagtcacacatgctgttcgcgacacgacgattgatggccttgaaatcaagaaagatgattacatgggcttagttgatggcaaaatcgtaattacgaatccagatcgcgataccgctgctttggatatggtcaaagccatgctcgacgaagatagcgaactcgtaacgattatttacggcaaggatgcaactaaaactgacgctgatcatttggcagctaaggtgcaagagttggatgatgaattagaaattgaaattcatgaaggtgatcaaccagtttacccattccttgtgtcagttgaataggactaaccgttaaaaatagggcttagcagtgatgctggggcctgtttttgtacggacggatacttcccgcgggattgaaacgtttttttggtataattaatattggtaaaggcaattattttagaaagggcggtggtcaggcatgggacaacagttgagtgacgcggttgcaactttaagtggtgtcggcccagcccgccaaaaaggtttagcggagcttgggattaatacgattgcagatctattgacctattatccctttcgctatgaagatctacaggtcaaagacgtcaatgaaatcgccgatcaagaaaaggtgacactaaagggtactgtggcttctgaacctgtgctagcacggtttggccgtaagaataatcgcctgaattttcgcttgttaatcgaccatgacgtctatatggtgactttttttaatcaaccatacttgatgaaacagattgagactggccaagatttagccgtttatggcaagtgggacgccacgcgcagtagcttgacgggaatgaagatcatcaatcccaataatgcggattcagcgtttggttcgatttatccggccagcaagacggtcaagcaggggacgattcagaagatgatcaaacaagcatatgagttatatgccccagtcattacggacattgtgcctgctaacttacgtgctaaataccgactgttaccgcggcgccaaatgattcatgatatgcacttcccagctagtcaagccgattcaacggccgctcgacgctcagcgacctacgaggagttcttgttgtttcaaatgcaaatgcaagttctgaagcaaacggacgcgacgacgaacggtattgcgatcgcttatgacaatgaccgactaaaggcgtttattaaaacactgccatttgaattgacccacgcccaaaaacgtgtcgtcaatgaaatttgtttggatttgaagtcaccgaagcatatgaatcggttgcttcaaggtgacgtggggtccgggaaaacgattgtggctgccattgtcatgtatgcggcgattaccgctggttatcaggccgcgttgatggcgccaaccgaaattttggctgaacaacacgcaaataacttggcccaggtctttgccgacacggatgtcaacgttgcgctgttaacgggtgcgaccaagccagctgcccgcaagacattgttagcagcgctggctgctggtgagatcaacttattgattggcacgcacgccctgatccaggacggggtgacttatgctaatttgggattagttattaccgatgagcaacatcgctttggggttaaccaacgggccgcctttcgtcaaaaaggcgggcaacctgatgcactagccatgacggcaacaccaattccaaggacattggcgattacggcgtatggtgaaatggacgtttctgaaattgatgaattaccggctggtcggcaaccgattcaaaccacttgggtacggagcaaccaagctaattcggcgctaagctttgttcatcaacagattgacaatggatcgcaagcctatgtggtgacaccattgattgaggaatccgagacgctggatgttaaaaacgccgaggctctgtcagctaatttacaagagtattttggggcgagtgttaaagttggactgttgcacggtcgaatgaaacctgaggaaaaagacgcggtcatggcggcttttaaggcgggagacattcagttacttgtttccacgaccgtgattgaagtgggtgttgacgtcaagaatgccacaatcatgatgatttatgatgctgaccgttttggcttggcgcaactacatcaattacgcggacgcgtcggtcgtgggaccaaggcttcatactgtattttggtggctgatcccaagaaccagcaagggattgagcggatgcagatcatgacgcagacaacaaatggttttgttttggcacaaaaagacttagaattacgaggagccggtgatgtgctgggggtcaagcaatcgggaatgccggaatttaaagtgggtgatccgattgcggatttgaccgtgctacaagttgcccagcaagatgcccacgcaatcgtgcagcaaccggattggcaaagtcaaccggataatcgggcactagccgcctatttgagccagaagttggctgcggtggggacgctcgattaataacctaaatacagtactgtgatgagaggaatggtgacacaatgattaaaattgcgattgatgccatgggtggcgattacgcccctaacgctgtgatcgagggggtcgagcaggctcgtgatttgtttgaggatacggtctttttattatatggtcaacgcgacgtgattaacgcgcaactgaagaaccgtgatcggattcaaatcatcaatgctgatgaagttattacgatggaggatgaacccgtacgtgccgttcgccgtaagaagcattcatcaatcgtaatggcggctcaggccgtgaaggatggtcaggcggacgccttcttttctgccggtaattcgggggccgttctggcagccgggttatttatcgtgggccggatcaagggcatcgaccgaccgggattagtgacggtattgccagtggtacgcaatgctaaccaatcgaactttgtgatgatggatattggtgctaatgctgatagtaagccactgaacttgcaacaatacggtgtgttagggacgtactatgcagaacggatgatgcaagctaagcatccacgggtcgccctactcaataacgggacggaagatgacaagggaaataaggtccataaggcagcgtttgaactcttgtcacagactgacggtatcaattttgtcggtaatgttgaatcccgggacttgttgaacggggttgctgatgtcgtcgtaacggatggttttacgggtaacgccgttttgaagagcattgaaggtacggcgcgttccatgctcggtttagtgaaagatgccgtctataacaccggtatcagtggcaagttaggcggcctattgcttaagaatgggtttaatgaaatccggtctcaaatggactattctcagtacggtggcgcggtcttactaggattgaaggcgccggtcgttaagacgcacggttccagcaaagcgccaacaatcgtgaatactatccgtcaaattcgccagatggtcagtacggatatcgtcccaggagttgcggaatattttgctaatcaacaagctaatcagcaagcaagtgtagacattcctgctgaaaacgattagaatactttagtgaattcaagttagtgagggatctttacatgacgaaagaagaaattttcgataaaattgcggatatcattgctgatcggttcgaagttgataaagcaacgattaccaacgaaatgaacttgcaaaccgatttggatgctgattccatcgattttgttgagtttgtactggaattagaagacacctttggtagcgaaatctcagacgaagatgccgaaaaattgtcaacggtcggcgaagtcgtcgattacgtggcagcgcaccaagcaaaataagttaattgaccaagcaaaaacaggtagccaacatggttacctgtttttacttgtctgactacgaaagtaccgatatcattgttattgaccactaaatcatagtataatgttatgatatgcaatgtgtgacctgttgactgactgattatcagatgaatccttacttaagcggacctttaacttgtgtttctattttgttagcttctgatcatccacggtcgactgccacggctgggtgagactgaacattgcgtgtaagagtagcactaaatacatgtcggaagcactcgaacggcagatgaatgaccaccttaaataatgattcatgctaagttaggcaccaccagtaacagattgtgataactggctgatccaatggggttagtcgatagaatgataacgaaaggaagtttcaaatgattacagaattagctgcaatgttgaaggaacggtttggcattgtgtttaacgatcccgatttattggcggaggcgtttacacaagcctcgtatgtcaatgaacatcaggaccaacagttgaagtattacgaacgggtcgaatttttgggggatgccgtcttggagttagtggtgtccgaatatttatacaaacgttataaagacatgccccaaggtaagttgactcgtttacgggccgccatggtttgtgaagaaagttttgcaagctttgcccgtgaatgtgactttcctcagtacatccggttaggcaagggcgaacaaaaagcgcatgcttgggaacgagattcacttttatgtgatatttttgaatcatttgtcggggcattgtacctggatcaaggacgggaacctgttttgaagttcgttcatcaagtaatttttcctaagctggatgagggtcgttttgatggcgtttttgattataagacgaccttgcaagaatacttgcaacgggatggcgatgtcgcaatcgactatcaattaattgaacaagatggtccagccaatgagcggtcttatgagattgccgtacttgccgatggtcaaaaaatcggtgagggctgggggcattccaagaaggaagccgaacagagcgctgctcggcaagcttattcacaattacagcaaaagtaaccattaataattacaggaagtttgtgtcgaatgcaacttaaatcattagaaatcagcggatttaaatcatttgctgataaaaccaaaattgattttcaagccggaatgacgggaattgtcggcccaaacggtagtggtaagagtaacattattgaagctattcgctgggtcctcggagaacaggccgtcaaaagtttacgcggcactaagatgaccgacgtcatttttgccggctcggctaatcgaaaaccgttgaatatggctaaagtcacgatcacgtttgataacagtgaccactttttacctttggattacgcagaagttagtattacgcggaaactctttcgtaacggtgacagcgattatttaattaataatcagagttgccggttgaaagatattacgaatttgatgattgatactggtctgggaaaagactcattttcagtgatttctcaaggtcgtgttgaggcggtctttaatgcgaaaccagaagagcgccgcagcattatcgaagatgtcgctggggtcttaaagtacaaaaaggataagttcacgacggagaataaattagcggaaacgacggattatttagaccgcgtgaacgatatcattgctgaattgaatcagcaaaaggggccgttggaagaacaagcgagtcttgcccgggattatcaagatcaaaaacaaaaatttgattatttggaccgttcgcggctcgttaagaagttgacgattgctcgtgatcaactgcaaggtgtcaatgaaaagttagctagtgccaaggcgttagtggctaagtatcagcaacaagttgatgctggggcaaccaagctagctaatttaaaaacccagcagacagctcaattaaagcaaaaagatgagctggtagcacaaaatcttgagctgattaagaccatcgaaaacacgcaaggacaacaaggggttgacgctgaacggcggcaaaaccaacagtctgagcaggaacggctgacggccagtttgaccgcaactgagcaacagattgcgacgcaaaccgagcaacaaacccaattagaacaaacattatctgagcagcaagcccaagttaaggcagtcaaagcgcaagttgccgagttaacgacggcaacgagtgcggccggccgtcagcagttggctgatgagctggaaaaattacgcaatgcttatattgatgaaaaacaagttcaggctgaactgaataacgaagcgaagaacctcgttaagcaacatcaacagtctggcagtcagagcacagcgttagcagaacggctagctcaggctcaggctaacttgaaacgggtgcagacgaccgtggacgtgcacaatcgtgagcaacgtgatttagaaaatcaagtcagtcagcagcaggccacgctaacagcccaacaagcccaagtaaaaacgaatgcagagcggatcgacgagcaacagcaacgttggttagacgcggctggcttgatgcagcgtgaaaagtcacggctagaggcgttgcaagctgttcaggaacgctatacgaacttttatgcgggcgttcgaatggtcttacaacatcgccaacagtttagtggcgttgccggggccgtttcagaactcctgaccgttcctgatcagtatactaaggcggtcgaagttgcactgggcggacagttgcaaaatattgtttgtgacacacaacagacggctaaaactgttgttaatttcttaaaacaaaatcacgccggtcgggcaacctttttgcctatcgagcggatcacggctcgtcaacttcccgttaacactgagcgcgatttatcacaacaacctggtgtgttgggcgtggctagcgagttggtcgattgtgaatcacgattgacggcaatcaaacgttacttgttaggaacaacggcgattgtggacacgctagaccacgcgatggcaatttcacggagcagacgttttcggtgcaaattggtaaccattgatggtgaaacgattgcggccagtggggccatcaccggtggtgcgactcgccatgatgataatgggctactccaacagcaacaatccgcggaaaaaattgcagctaacgttgcccagatgcagtctgaattagtaacctatgaacaagggctagcagaccttaaaaaagctaaccaagacttgacggttcaggttgaaacgacccgccaacaactaagtgaacttaaggatcgccttagtcagacacaggcccagttacaggcggcacagagcgagcaaacacagctaagtcgtcaagttaaggctttaacttatgagcagcaacagacgcaagctgatgatagctatgaagacttagtggctcgtaatcagcaagcgcaagcggctaatgcggctaagcttaaagactatcaggaccaaatgaaaacagtccaacaacagcaaacggattacgaaagttatcaacagactcaaacgacgaaattacaagcccagcgtgaacaactgatcacgttgcaggaacacgtgaaacaaacgcaacgacaattagaacaatgtcaggcgaccttggcgcaaaatgaagagacgaaaaagcaaattcaagcggatttagcagcaattaaaacaacgttagcgagccagcaaatgtcggtcgcagaacgcgatacggtcttgaaaacagctaaggctaaacaggctgcggttgaagaacaacggaaaacgtgtgaacaacagctagcaacgcttaatgatcaggttgaagaattatcgacccagcaagttcggttgcaacaactcgcagcggccgcaacggatgattaccgtcgcttggaattaagccaaacaaaattgactggcgaagtcgaccacgccacggctgatctggctgaaaagtaccagttgacagttgccgcggcacaagctgacgtcagtgacttagcgttacctgcgattacggaacagttgaaactgcttaaacgaggcttggatgagattggaacggtaaacctcggcgcaattgacgaattcgagcgggtcaaggaacgctttgactttctcaataaccaagcttccgatttaactgaagccaaggaacacttactgcaaacaatggctgatttggatacgaccgttgccacccgctttaaaacggcatttgatcaagtcgctagcgaatttagtacgatttttgaacagatgtttggcggcggtaaggctgaattgatcttgaccgacccagaacatttattgaccagtggggttgatatcatggcccagccaccgggcaaaaaatttcagcgattaagtttactttctggtggggaacgggcgttaacggctattacgttattatttgccattttagcagtgcgccccgtgccattcagtatcttagatgaagccgaagctgcgttagacgatgccaacgtggatcggttcagtcagtatttgaatgattttcaaacgggaacgcagtttgtgatcattactcatcgaaaaggaacaatgatgcacgctgacgtactttatggggtaaccatggaagagtcaggtgtctccaagatggtctcagtctccttggcagatttaaaagatgaacaaaaataattaaaggaagtgttgaagatgggactatttagtcggttaaaaaaagcgtttagtttaccagaatcagatgacgctcaaacaacgtcagctgccagtgaagcacctgcaacgacgagtcaagctaacgcaccggtcagtgacgaccgggccccttcgtcacaacagttagctcgctcggagggcgcaacaactgaatcaactgcgacaccggtgtccagtacagccgtaagcgaagcgacaagcactgcggacgaaccagcgacagtaaaatcggcagctactagtgaagccccggccgatagcacggcggcagtgagtgcacagtctggttcacaagcaccaatgcaatcggcgacggtgtcggaagcgccactcacagccagtgcaatggttgcccagtcactagctgcattaagtgcgagtgcggcacaagttagtcaagcggccgcgagcgacgtggcgttagcgactaagtctgatgcggtagttgaaggcaacgctatgtcagaatcagtagctagtacggcgccagcagtcaagtcatcagcgccaacagcgactgaatccgccgcaccgactgttaatgcggcggctgattcggaatcggctgagccggagccaactgaggcagaacgttatgatgaaggactgaaaaagtcgcggaaaacgtttggtgatcgtatcaatgccttcttggctaatttccgccatgtcgacgaagcgttcttcgatgatttggaagatacgctgatcgaatctgatgtgggttatgagaccgcgatgcgaattagtgacgagctacgtgacgaagttaaattaaagaacgcgaagagcaagaaagaaatttcaagcgtcatcgtcgaaaagctcgttgatatgtacggtgaagctggtgaaggcgaggataactcgattcacatggctaagagtggtccaaccgttattttatttgtcggggtcaatggtgctggtaagaccactacaatcggtaagatggcgaacatgtacaagcagcaaggcaagaaggtcttgttggcggcttgtgatacgtttagagctggtgcaatccagcagttgcaagtctgggggcaacgagacggggttgacgtggtcgctaaggccgaaaaaagtgatccagcggccgtttgctttgacgcggttaagaaggctaaggccgaagattatgacgtgctctttgtggacactgctggtcggcttcaaaacaaagtcaacttgatgaatgaattggaaaagatcaagcgggtcatcacccgtgaaatccctgatgcaccacacgaggtcttactggtgctggatgccacgactgggcaaaacgcgctgaaccaagccaagttgtttaaacagtcgacggatgtcagtgggattgtgttaactaaacttgatggtacggcacgtggtgggatcgtcttagctattcgtaatgaattgcatcttgctgtaaagtacgttggtttaggtgaaaaggtgactgatttacgaccattcaatgccaatgactttgtctacgggttatttaaagatattatcacgggttaaatcagttgatgatggtcttaaattgaaagccagttaacgaaatggtaattgttctcagcacgaggacgattactatttatttttaccacaaatagcgactgatagttgacgaatggcgataaaatcggtactcttatttagtgtgtagtctgtatgataagcgtgaggagtccccacatggaaattgaaaaaaattatcgaatcaattcgttattcgagttttatgaaccgttattaacgaataagcaaaaagcctatattcaactgtactacgctgatgactattccttaggcgagattgcagcagagttctcagtttcgcgccaggccgtctatgataacatcaagcggaccgaaaagattttagaaggttatgaggctaagctgcatctctaccacgactttgtggaacgtaatcacgaagttgacgcgatctctgactatattaagcaaaattaccatggggatacccagttaattaagatgattcaacaactagtcaacttggaagctgactcagaataataataaaggttaggtgacactaatggcatttgaaggcctaacggaacgtttacaaaaagcaatgaccaatttacggcgcaaggggaagatttcggaaagtgatcttcgagcaaccatgcgtgaaattcggttagcattacttgaagccgacgttaactttacggtggtcaaggattttgttaaaacggttcgcgaacgtgcgctcggcgcaaaggtgctggaaggtttaaatccagcccaacaaatcgttaaaatcgttgatgaagaattaacgaaaacaatgggtgaaaaggcagttccactgaacaaatcgccgaagattccaacggtcatcatgatggctgggctccaaggggccgggaaaacgacgacggtcggaaaattagccctcaaattaaagaacgaacaggatgcccgaccattaatgattgcggccgacgtttaccggccagccgcgattgaacaattgcaacaagttggtcgccaaatcgacgttccagtcttccaactaggaaccgatgtcgatcccgttgagattgtgcgtcaagggatggcacaggcacaagaaaaccacaatgattacgtttttattgatacggctggtcggttacaaatcgatgagcagttgatgaacgagttggccaatattaaagatctcgttcatcctgacgaaattttgttagtgatcgatgcgatgactggtcaaaacgccgttaatacggcggagggctttaacgataagctggatgtgaccggggtcgtcttgacgaagttagatggtgatactcgtggtggggctgcactatcaattcgggccgtcactggtaagccaatcaagtttgtcggtcaaggcgaaaagatgactgatcttgatgtcttccatccagaccggatggcggatcggattcttggtatgggtgatatgctgacgctgattgaaaaggcgcaacagcaatatgacgaaaaacaagccgaagaaatgaacctgaagattcaggaaaacacttttgacttcaatgactttatcgaccaattagaccaagttgacaagatggggaacatggaagatatcatgaagatgattcccggcatggctaacaatccagcgatgaaaaatatcaacatggacccgaaagacattgcccatatccgggcaatcgtttattcgatgaccaatgccgaaaaagcagatccggatttgttgaacccatctcggcgtcgacggattgcggctggttccgggcggccaattcatgaagtcaaccggatgatcaagcaattcaaccagaccaaaaagatgatgaatcaaatgtccaaagggaactttgctggtatggaaggtctcatgggtggtgccaatggcggtggcggtatcggtggtaagatgcaacaaatggccatgaagcgaatggttcgtcaaactaagaagaaaaaacaaaagcgcttagccaaagcaatgcggcgtcgcaaacgctaatttataagtttttttagcctgtcaagaaaaagtcctttacaagctattgatttactggtatattattacctgttgaagaattcgggaggtgtttaaatgtcagtcaagattcgtctaaagcggatgggttctaagaaaaatccattttaccggattgttgtcgcagattcacgttcaccacgtgatggtcgttttatcgcccaagtcggcacatacaacccacttacagaaccagcccaagttaaacttgaagaggaagatatcctcggttggttgaacaatggtgcccaaccttcagatacggttaagaatatcttatctaaggccggtatcatgaagaagtaccacgaagctaagttcactaaataataaagcggtaatagatcatggcagatattaaagctttaatcaccacggttgtcaccccgttagttcaatatccagacgatattaaagttgattttaaggaaaccacgcgttatcttgaatacaacttaacggttaatcccgaagatatcggccgggtcattggtcggcagggacgggttgcttcggcaattcggacaattgtgtatagtgtccgagtttcaggacctaaacgtgtccggcttacgatcgaagacggacaacaaaaaaactcttgagcgaagcagtgatgttttgtttaagagtttttttatatcttgttccggtttttgaggacgagtcaaagtatctcgatgaccgtcgttgagtagattagttgtaacatgttgatgacatttaaaacgaataacaatcaagctaattaagaggaggaagctaatggattactatcgtgttggcaccctagttaacacccacggcattcgtggtgaagtgaaagtcgttgtcgtgactgattttccagaagaacgctttaaagtagggcaacaattgaatttatttaaaaccccagatgaaacgactggcgggattactgtcaaaatcgcgaaggcccgtgagcaaaaggggctgtactttcttacctttgaagggctcgataacatcaatgatgtggagcgctataaggggtggacgatcaaagttcctgctgaagcattacatgccttaccagcgggtgagtactactatcaccagattgtcggcctacaagttgtgacgaccgctgacgagcctttagggactattaaagagattctgtcacctggtgcgaatgatgtttgggtggtcaaacgggatcatggtcagtctgacgtcttactacctaagattccccaggtcattaaagatgttgacttggatgcgggcgtggtgactgttgaactaatggaagggttgattgattaatgcaaatcgatattttaagcctgtttccagagatgtttgcggggccgcttcatgagtcgatgattggcaatgccattgaaaatgacgtcatcaatgttgatgtcactaattttcgggattttacgaccgacaagcataaccatgtggatgattatccgtatggtggtggtgcgggcatgttactccaaccacaaccaatttttgatgctttggccagcgttcaggaaaaacacccggcacccggtcgcgtgatcttattggatccggcgggagtccagttcaatcaacacgttgctgaagactttgctcaggaagaacacttgacctttatttgcggccactatgagggttatgatgagcggattcggtcattagtcaccgatgaagtctcgctcggtgattacgttttaactggtggtgaactgggtgcaatggtcatgattgatgcgacggtgcggctcttaccaggtgtgcttggtaattcggaatcggctccgggggattctttttcgagcggtctcctggaatacccacaatatacgcgtcctgctgattttcgtggtatgaaggtaccagatatcttactgagtggtgatcatggaaaaattgatgattggcgcttagaacaggcgctgaaacggacctatgaacggcgcccggacatgttgacggggctatcattgtcaggaaaagctaaacagatgttagcagatatcaaggcggatgagtcggaagtgtaggctatgccgttaattaggacaagttagtcgtgaagagttcaaaaaaacttgcgtgcccaccctcgaatatggtattctatttattggctattgtgcccattaacgatgttccgctgaccaggttgtcacgaatgtcggcgaaaggaagaaatacattatgcgtcaaaaccaattgatcgaaaagatcaccaatgaacaacttcgtacggacatccctgatttccgtgctggagatacagttcgtgttcatgcacgagttgttgaaggtactcgcgaacggatccaattatttgaaggtgttgttatcaagcgccatggttccggtatcagcgaaacttatactgttcgtaagatcagtaacggtgttggtgtggaacggacattcccattacacacaccacgcgttgccgcaattgatgtcgttcgtcaaggtcgtgtacgtcgtgccaagttatactacttacgtaacttacatggtaaggctgctcggatcccagaacgtcgtcgtggctaaatcacaacgtcaacaatcatcggttgcagcttaggctgagctgatgatggaaagctagttaatcatttttaatgattaactagctttttttattggcgaagttagtgacacgctcaatcgtcaaatcatcgaccaatttaggtcggttcacaatgtgagcatgctgtgcttggatttataatttaacaatcttacgagatagctcgtaattcctaatttgaagtattatgatagtaatacgattacgcgatgcttcttgggatgcgtcaattagctgaatatgaatcacttgatatcagactaaactgatttatttgaacagggttgtcgcgtacctgacgtgtataactagtgctaagctggcggccgggttaactaaacgggagattgctcaaagcgagcacgataaaataaaagagagttaggtgaaagccgatgtttggatgtacggggaaacatcaggtcgatgaacaggcgttattgagtcagttagttgacttcgttctcgacactagtcttaccgaccgtgaacgtaaaatcgggttgatggccaaagccgatttggagcatcatcgctattcaattgctgtgttaaataaattagtggttagttttcaaatggaggcgctacgcaacaagggcctttcgaaggctgcttcaaacttttatgatcagatttatccaatattagtcgcggccaaaccaatgggaacgaatttaggctatattgggatgcatagtacctatttagattagggtgtgtcagtgatgaagttactagcgaaaccagaccgtcttcagacggctgacgatggtttttgaacgtaagaggctggcgttcatcggaagtgtgttggtaacagcttaaatgagaacatcgtgcgcatgtccgtgcccctttgaatgaaacctattcagaggggctttttggtgtggaaaaacagttcatgatctgcgcgtcttaacaatattaggtgatatggttggcgggcgataaaaattgtttggtgctgctaaatagctggtaaacgattttggccgtagaacaaatgctatacattgtttgataagtaccgaactgggatgtggatgagccagattcaaaataagtgtgtcaatatgttggttatatcagtattttaatgcagtgttatagcgtgaactgatactacaattaaataatctcaaaaataatttcgtctattttttgttatgcacttgttatttcaacttatttgaacgtatactaatgattgaaggggtcaattaggtgatagtttgatgattaacacaatcgtttcggcacggtacgaaacgcaccaaatattactcagctaaataacttgattgctccaggtacggttgaactttggaggcagaattatgcggaatcgtttaaataagttgggattggaaagtaagtctcactataagctttataaatcggggcggcgctgggtggctgctagtatcacagtattttcagttggcatcggtttgacttttagccaagttgaacaagtgaaagccgcaacgggtacgggggttgacacggccgacaatagcgctagcgttagttccgacatggcagaaccgagcaatgccgtcgtactaaaatcagctagtacggcgacagttactaagaccgcgactcaggatgcaaaagctgctactgatgtaacggccgcgactcaggatactaaagcgactactgattcaactggggcaacatcagcttccagtaatcgtcagtcgacagcagctacgaagccagctgccgaagtcggtactgcttcaagtcgcgctgactcaagtgctagcatatcaagtactgatggcgcaagtgctagtgcaccaagtgtcaccagtaaatctactgacacggaagccacatcagcatccgtaactaaaacggctactacgagtgctgacacagatgtgctaaacactgagacgacaagttcatcagtggcaaatgatctcactgatgctacgacagctagccaaacgcgtacggaaactgggaaaacagccagcatacctactgctgaagcaccgaccattacgactgcggtgacaagtcgggcactcccattgacgggtgcgctagcgagcaggtcagcaaacacgccggtcactaagtctacagtacaggcggtttcagctatcaccagtgaagctgaaacgaagccgaccgtatcgttagtaactacggggaccgtgtcgatggactatggcgaggcgtcgctggcggatctagaatctcatattagttctccagatgagacgccggctaacgacgtcgcctactacattcaagatgcagcgggcaattacttagaagatgtaaacggcaacaaggtcaatttgctatatgcactttttctggactctgctgatgtcaatgattacgttgatgttgtgtatacggatgaacatgggcaggtcacgaaatattccggagatacggacttttcaacgctcgaccaaattggtagttactcagtgacgatcaatgcagcgggtaaagctgggatgagccgggttatgcaagactataatgcttacgatacctcgaccagtgatttggatgactttgtcccaaccttttcgactggggcctccgattatacctttacaattaacattgtccctgtaaaaatcacagccaccactggtaagaatgggctaattatacttcggccttcacagttgtatacgggatcattgacaatgttgccggtagtcaccgttaaaaatgcaacaaagcaaaatatccttcaaattagtaacggcgaaatcggcgatgctaaaccaggcgtagccggcaaggtcggtcaacgtgttttaacgttggcagattttacttatacgtatcaaggcaccgaaactaacttgaccggtgcggacactggcaaatatgcaatcacccttaatgacgctggtcggaaggcagttcaagctgcgctggggtcgaattatattctggatgatgcggcagttttcaccacgactggtgcggtgcaggctgctggtctcaggttaacgatagccaatgatacagtgacctataatggcaagcctcaggggacatccgtagctgtaacgactggaaccgtgtatgatcactttgattttactacgacgactgacacgaacgtcggtacctatgacaacctgacatacgcgttagcggatcccacgcaagcggcgattttggttaaaaactataccgttaccacgacggatgggacgttggtgatcacgccagcagatctgacagtcacggtcaaggatgataatgcagtttatgacggccgagcacatggcacgactgcaactgttactagcgggaccaattatgatcagttagcatttaccgcagttgcagcagatggcagtggtgcgacgacttatactacggtcggcacttatgcaatgactgggactacggcagccgataccagtaattataaaatttcgtatgtcaatggaacgctgacaattgatccagccaaagcaacaattacgattcccaacaagatttattggtcggatgggacgcaaaagaatttggcggcggtggttactgggacagttaatggtgagaccttaaagtatcgtgtgaccaacggcatgagtgcggttggaactaagacaattacggccactcctgatgctgatgattcggtgaataaaaactataccatttcagtcattcctggcaccttgacaattggtgatattgcggttaagtacctctacgaacatgtagatgctaatggtgagactcaggtagatgcttcggaaactggtacggcgacacatgctacggacgcaacggccacggactatttgacctacacgacggcagccaaacccaagacgggctatgtgttagcacccaatactggactagcctataatggcacgttaactgatcagggcggtaccgtgacgtatcgttatttggccaagactgaaacggcgatcgtaacgtattttgaccaaactgataacaaggttattaagacggaacccttacaaggagcgtacgggacaacggatgcgtatcggacggctgatacgattgccgcgtatgagaatgcgggctacgacctggtcgatgatgactatccaacagccggggtggtctatgatcaggacggcagtgttcaagagtaccaggttacgcttgttcataaatttgtaacacgcacgccagataatccgggtacgccaggcgagccgatcgaccccgataatccaaacggacccacatatccagcgggtacggctgtgcaagacttgattaagcaggttggtcaaaccattcactatcagtatcaggataaaagtactgctgccgacgctaatacgcaaacaatcactttcaagcgcagcgtgacggtcgatgaggttaacaataagctaacttataccgattggttgactggtacggcaacgactggtcattacatgccagtcgattcaccggaaattaagggctatgttgctgattcaacgcgtattgcgggtaatgacgaggtgcacaatgcggatgctgacacgaacatcgtggtcacgtatcaggctaagccagagaacgccacggtcacgtatgtagacgtcactacgggtaaaacgctcgctataaaaagcttgactggtgactatcagactacgtccagttaccggacggctgaaacgattgcgagctatgtcaagaatggctatcaactcgtacgtgataactatcccacttcaggggcggtgttcgacgtcgataattttgccaaaacttataccgtgacactgaagcataagttagccacggttacaccagagaatccgggtacgccgggccaaccaattgatccggacaatccagacggaccgaaatatccagtaggaacgaccgctcaagatctgacgaaacaagttagtcaaacgattaagtatcggtatcaaaatggggcttcggctggcactgacagcgttcaactgattacgtttaatcgggatgccacgattgatgaagttgagtctaccgtagtttatactgattggctggatgggacttcagctactggtcgttataccaccgtgacgtcacccgtcattactggctatacggctgataaaacacaggttgctggtcgtgattcagttgctaatacagattcagacacacaggtggtcgtcacctatgcggcaaaacctgaaaaagcaacggtcacttatgtggatgtcacgacgggtaaaacgctcgttacggccaatttgactggtgactatcggacacaatccaattatcggaccgctgaaaccattgcaggttatgttaaaaacggttatgaactggtacgtgataattatcccgtatcggggatgctgttcgatgtcgatgattttgctaaaacttataccgtgacactgaagcataagttagttacggttacaccagggaatccgggtacgccgggccaaccaattgatccagacaatccagacggaccgaagtatccagtaggaacgaccgcccaagatctgacgaaacaagttagtcaaacgattaagtatcggtatcaaaatggggcttcggctggcactgacagcgttcaactgattacgtttaatcgggatgccacgattgatgaagttgagcctaccgtagtttatactgattggctggatgggacttcagctactggtcgttataccaccgtgacgtcacccgttattattggctatacggctgaccgggcgcgggtcacgggaaacgatgcagtaactagtgcggcgcaaccgaccaacattattgtgacgtatgcgattaacgcagaaaaggcgacggtcacctatgttgatgtcaccacggataaaacgctcgcgaccgtcagtttgactggcgattatcagacatcatccgattaccgcacggctaacacaattgctgattacagtaatcagggctacgtgcttgtccgcgatagctatccagtttcaggagctattttcaatgatgatggtgtcgttcacagctatctggttcagcttgcacatgtgacaactgcgacaaccgagaccaagacaatcacgcaaaccgtacattatcagagtacgactggcacgcagttgcacgatgatacggtcagagcgatgacattcactcgtactaaacgggttgatcaggtcaccggggacgtaacgtatagcaattggtcgactaatcaggcggatcacacttttgagcgcgtcgcggcgttcagtattccgggctatcatgcggtggtaacgggtactcaggcagtcatggttacgccagctagcgtggatgatgttcaaacgattcgttacgttaccgataggccttcaaccggtgagacaccaaaaacaccggtgaagacggtgacagttaataagtcggataaaattaagacgactgacacgccagataaagtcgcaacggtcaagacgccggataaggctcagaccgtcgcaacaacaactgctaaacaagctagcgtcaagcggtcagtggatctcaaacaagcacaggctgttgaacagcctgctcagacacgaccagccaatgtaaaaacggttaaactggcgaagacgactaaatccgttaagccaaccgcggctcatcaatcagccacccacaaacaagcgattttaccgcaaaccaatgataatcggcaagctagtgttgcggcggaactacttggtttgaccgcagcaaccttactagttggtgtgagtgcaattttgaagaaacgtcataattagccgttaaatggaggcgttaatatgactactttaatcgatatcacgggtcagaagtttggccgcttaacagtcattagacgttgtggaactgccaaaaatggcaatgccctctggttgtgtcagtgtcgctgtggcaatcagaccaaagctgattcgtacgcgttgcggcatgggcgagcaagaagctgtgggtgtttgacacgagaaagtcggtcgcagttaattcgacgtaatcccaaaacggctgccagtatggggcggttaagcaatctgaaaattcatgatcatcacactgatttaccgtcaaagattatgtctaagcgtaataagagtggtgtcatcggtgtcagctgggatagcaatactcaaaaatgggtggcgacatttttctacaaggggcgctacctgttacacaagccgtttcagcattttgaggacgctgttcttgcccgccaggcgatggaaagccgttatttaaataacaaagtgtaaattaaagttcttccttgatagggcctgatgccttgtcagagaagaacttttttgcgttacagcaacggtaccagcttcttaattggacttagtggagttctttcagaattgtaagtaacaaaaaggcctaacatgggaatgccagcggataaattgtgcttgatttatggagatgaaaattcctaaatgatttgcttgtatatgacaattattaaaaataagacggtccctgatcgaactagaatcataagtatcttgggggcaggtgatttaacggttcttggttgcaatatgttttttaatcaacagtctgatgaaacttgccctagaagttgaggttaactgatgcttctggatcggtgaaatcgttagtttcgtgatggaactagtcattggcgacagaagcgttaatcaatgagcaacgtaccgctccggtttcgaattttcggacgattccggtataataaacgtaactgatgactagggggataatcacatgattgaaattcacgaattaacgaagcgttatggggataagacagcattgaatcagcttactttaaccatcgcatcaggacaaatcttcggtttgttgggccacaacggggcggggaaatcaacgacgatcaaaaatttagtcagtatcattaaaccgacgagtggcacggttacggtcgatggcttagaccttgaacagcaacgacaagccgtcaaagaaaagatctcttacgtaccggacacacccgatatttttcttcaactttcggcgatggaatattgggacttgatagctgccgcttaccagcaatcagaggaagccgttcagcaacggcgacagcagctggtgtcactgttcgatatgactgaacacgttgacgaacccatggctagttattcacacgggatgcggcaaaaagccattttgattggggcgttgcttcccgatccagatatttggattttagacgagccgctgcaagggttagacccccaagctgcttttgatttaaaaaatttgatgaaggcccatgctgccaaaggcaagacggtcattttttccacccacaatctggatacggcgcagcagttatgtgaccgattggcaattttgaagcaggggcaattgatttataccggttcggttgaacaattactagctcaacatccgcaacaatcacttgaggcgatatatttacaaatggccgggcggttgacggatgatcaccttgtcgatgcgctggagggtgagcatgatgcataaaagtcagttacgtgttttgttggctgttaatctcaggttgttgaatccgcaactaacggatcggctacgtaaaaagggcgcttcggggccagccttgagtaagaagctaatgcggcaattttacttgaatgccttgatgtttcttggcatttatggcttgacgatgttggcctttgattttagcaagttgccaggcatgtttacgttctatgtggcgttatttatcttattgggagtttcacagagtatctccggtatttataacgtcttttttgccggcaatgatcttgttgaatacttaccgttacctttccgcaatcaagaaatttttatgagtaagattttggtcgtgatattcaacacggtaccctttaccattccgttacttttaatttttatcatgaccgcaacacgggccggaatctttgtggtgttaggtgtgctgatggccgtcttgatgtatggcctaatactgagtctgttactatgcttgtgcgccctaatagtttttggcttaaccaagctaaccgtgtttcgcgcccatcaaaaaatggtgatgaacgtcatgttaggccttaacgctgtcttagtgctagtcgggctctacttcatgaatcacggctcatcatctgacaccggaacgcaggttgaccgcgcagcattacccctattgataccgatttttaaagttttcacgatgccgttgacaatgacgagtttgctaacctgggcgagtttaattgtcatctcgctgattttgttcgcactgacaggacggtttgttttgatccacttagcggaacagcttacgcaagtcaactcagtgttagtggcaacaccaccgcgtcgacattcacgacaacataaccgcaataaaattttgcgtacctaccagtttcagttactgaaagaacccagtttagccttacaattattcacagattcaatcctgctgccattgattttagtcgggaccgttttcttttcggggaccgctcctaattttagccggctatcgctgaactggctcggtgtctggtttgtcagtgggatggccggtgcgatcgtcaatgttaatcaaacctcattagtcggtaatctcatttcacttgataaaatgaactttgactttgtgcgtgcactgccaatcccaatgtcccgttacttacgacaaaagttttacttgggttattggttccaggtcatgattaatggcgtgatggttctagtggtgggtatcgctgggcgagcaccattagccctagatttggctctaatattgggcgctgcttgggggacgtacctagctgcccaacattactttaagcgtgattatcagctacggctgacgaattggactaatgtgacccaattgtttaatcggggcggcggtaatcttggtttgatgcttaacttgttggcctgcagtattgtgggtgtgctgacaattgtgatctatagtgtgctgattcagctgttcgcggcggcagctatgctgattaatatcattgtattagttggcgtcggaattatttctgctggtttggtctggcattactacaagactttttggcagcaacttgactaataagtgttaatttcacagtcacataatattaaattaagataaaagtgttgacaaattgctcattgagttttaatgttaatgacaacttaatattcgtccatgaaaccgatgaagtggagatcaagataatgatgcccgtaaagagagtcgccgttgctgagagtgcgatcgaacgcaaattatcaaatggaccactgagggcgcgactaacgaacagttttgttctactacctcgcgacgatagggagtcgtcaattcccgggaatgtgtttgcatttcgctaagctgggacccaagtctaacctgaatggggtaatttggtgtccaaccaaggtggtaccgcggaaaaatccgtccttgactgtcattagtcatggacggatttttttgatagggggcagttcaatgcagcaacgatggcaattaaccacaactcaagtaaaactatcttattaatgaggagtggttcaatatgaatccaacattaccaaccttgattccttatcaggatcattatccctacgtaccagtgatggtcaaacgaccactcgtcacatttgaccccattgcggttgctaaaattatccaccagatggggaacggtttcgcgctgacgattgatcggcaccaacgatatagctattttagttttaaaccacagcgaagtctcacgggtcggcaactagccaagcaccaacgaccagctaatgagacactccaagccattctaaaccaatatcgaacaccacgaattcatggattaccaccatttacggggggcttgataggatacttcggctatgagtatgttcaacaatttgtacccaagttgcatttgaaatcaccagcaaccgcagatctcgatgacttaggtttattcttagttacgagtgtgctcgtctatgatcatcgacatcatgagcttgggttgacacagctgattccaactgcggatttagcggcaacttacgccgtgactcaaacggctctaacgcaacagttagccgccattattgaacaattgcagcaaccaatagctttgccaccatttgacttgcagcaaccattacacatgcaagtggaccaagcgacctatgcgcgtcaggttgaccgaattcgccaacacatctacgctggtgatattttccaaatgatatatgctaatccatgtttggggaccatgagcgggtcattgctggcagtttatcagcaacttcaaaaaacagcggccccgtatacctgttattttaaacaggctaatttcgaaatgacggtggcctcaccagaaacgttagtaacgaaggatggggaacaagtcgcgacgtatccattggccgggacgagacgccgtggtcgaacacctgccgaggatcggcagttggctcatgaattacaaaccagccctaaagagattgccgagcacaatatgttagttgatttgggacgtaacgatttaggacaagttgcaaagtttaaaagtgtccgggtgactaatttacggcgattaattcgttattcgcaagtcatgcacttagggtctcgagtggccgcagaagtggcgccgactactacagcactccaagtgcttgccgctacttttccagctgggacgttagctggcgcgcctaagattgaagcaatgaccctgattaatcattatgagcaggtgccgcggggtgtttatggtggttgctttggttacttggattgtaacggtaatttggacatggcgattggcatccggctggcctaccggataaatgaacggttggtgattccagcgggtgcgggcattgttgctgacagtatcggcgctcaagaatttaaggagtgccagaataaacaacgagtgatcgttaatgcagtacaagacgcgaaaggacgagttaaagatggaattattaattgataactatgacagctttacttataacttgtatcaactaattggtcgtctgacgcccgatgtacgggtcattaaaaatgacgatttgacggttgctgcaatcaaggcattacaacctgaccatatcattttatcaccagggccggggacgccatcccacacgggagttagtccacaagtcgtgcaacaattagctggtcaggtccccatattggggatttgtatgggattagaagtgatggtcaccgcttttggcggttcgctgcaaggcacccagcatttagttcacgggcaagccacgttaatgcacgtgcagccgtcatcactatttaaagattgtccgatgcagttcatggcagcgcgctaccactcgttggtagctgatgcgggccgtttgcccgttaactttcgaatcattgggacaagcgatgatcaggaaatcatggcagtggaagatgtgggccgtcagctgtacggcgttcaatttcatccagaatcaatcatgacgccagccgccgttggtgagcaactgatccgtaattttttagcacttaaacattaagcagacgagagtggaggaatacttatgattgaaacagcgattgcacaactcactaaccaagaaaatctagactttacaatgagccaacaagtcattacggaaattatgaaaggtcaggccaccgacgcacagattgggagctttttgaccgccttagccatcaaaaaggcaactatcgatgaaattgctggtgcagcaactgcgatgcgttcccaggcgttaccttttaaagttaaacggcccacgctagaaatcgttgggacgggcggtgaccggtcgaattcgtttaatatttcgacgaccactgcgctagtggtcgccgctgcgggtgtaccagtgaccaagcacggcaatcgtgcggcgtcgtccaagagtggtgcggcggatgttttagaagcactcggtatcaaaatcgatctaacgcccgctcagagtctagcattgctagagcggaccaattttgcctttatgtatgcgcgcgaatatcatcaggcgatgcgatttgtcgctccggctcggcaacaaatcaagattccaactatttttaatatactgggtcccttagccaacccagctcatgctgagatgcaactattaggggtataccggcaagctttaatggctccattagccgaagtgttgacgcgtttagatgttaaacatgccatggtcgtgcatagccgagacggcttagatgaaatttcagcggcagcccctacggatgtgatcgtaattaatcatgggcagcaagtaacgcgaatcctgacgcctgaacagtttggactgacgcgttgtgaccatgcggctcttattggtggtagtgcccaagttaatgccgccatcacgcgggcagtactcactggagaaccgggggcccctcgtgacgtggtgttgatgaatgccgccgcggcgttgcatattgccaagccacagttggatctagcggccgcttttgagttggcccagcaaacaatcgatcaaggagcggccgcggctaagttggcccaattaattcagagtagtcaggcggtgatggcctcatgattttagatcaactcgtccaggcgagtcagcaacgggttcagaaggtgccagttagggagcgtgtgaagcgcattcaacaagctcgaaaaatgaccacccccgttttatcatttgaagcaatgctggcccagccgggcttacagcttattggtgaagttaagcgggcgtcaccttctaaggggctgattgcggctgagtttgactatttacagattgcgcaagactatgttactgctgggatcgatgccatctcagtgttgaccgaaccccggtattttaaaggacagttgtcttacttacaagccattgcgcaaacggtctcggtacccacattacgtaaagattttattgtagctgctagtcagattgcgagtgctcgtattgctggtgctagtgcggttttattgattgttgctattttaacaccggttcaactgcaggctttcattacgttggctcatgagctgaatttaagtgcgctagttgaagtccatacaacggctgagattaagcaagcggtggcggctggggcccggattattggcattaataatcggaatttgaaagatttcagtgtcaattttgcaacgagctgtcagttacggcaagcagttccagctgagtgttatgtggtcgctgagtctggtattcaaacggccacacaggctcaacagttggccgctgctggctttgacgccatgctagttggcgaaacattgatgcgtgcaccagataaaggtcaagccgtcatgcaattgcgtgcgggggtgcgtggatgactcaaatcaaaatttgtggcttaatgcgaccagcggatgtcgtgatggttaatcaagcgctcccagacgcaattgggatggtatttgcccccggtcgtcgacgacggattacgatggcgaccgcgcgccaactgtcacagcaattagatccgcgtatccggcgtgttggcgtgtttacaactaatcaattatcggaaattttagctctcgtgcaacaacacattattcaggtggtccagctacacgctaccgtcgatgatcctcggattgcgtccttaatggccgcccatgtgccggtgattcaagcgatgacgccagcgaatgctacgcaatgtcaagcggattacttattattggataatgcccgtccaggtagtggacaggtgttggattggaatcaattacaatcacagcgtcccgtccggccgtttatcttggctggtggtttaacaccgacgaatatcgtaacggcaatcaacaaggtgtacccggcaatggtcgatgtggctagtggcgtcgagacggcgggcaataaagaccgtgaaaaaatcaatctgatggtccaacgggcgcaccaaacgggcgtgtcaacaccattattaacagaaattaggaggaattagtatgattaaaaatcaatcacaggcggggcgttacggcgactttggtggtcagtacgttccagaaacattaatgaccgagctacagcggttggatcgcgcctttcaacattaccgacaggacgcgcagtttcaagaagagttgactgacttgttgaataactatgcgaaccggccatcgttgttgtaccatgcacaacgattatcagatcaattaggtggtgctcagatttattttaaacgtgaggacttgaaccatacgggtgcgcacaagattaacaatgtcttggggcaggcactgttggcaaagaagatgggcaaaaagcgattgattgctgaaactggggctggacagcacggggtcgcaactgcaactgttgctgctttgttcgggatggaatgcgacgtctttatgggtaagaaagacacggatcgtcaagcattgaatgtttaccggatgcaactattaggggccaaggtccacccggtcacgactggttcaatggtgctaaaggatgcgatcaatgcggccttacaagagtggacgcggcgctgtgatgatacagcttatatcatgggctctgcaacgggaccacacccatttccaatgatggtacatgaatttcaaagtgtcatcagtgtagaagcccgacagcagatcctggaccaaacaggtcatttgccggatgccgtcgtggcttgtgttgggggcggcagtaacgccattggaagttttgcggcttttcttgatgatacgtcagttgagctgattggctgtgaggcagcgggtaagggtgttcaaacgccgttgacggctgcgacgattgaacgtggtcggactggtatcttccatggcatgaagtcactctttttacaagataaagccggacaaattgccccggtctattcaatctcggctgggctggattacccgggcgtcggaccggaacatgcctacctggctgcgagtggccgggcgcaatatgtggggatcaccgatgaccaagcagtacaagcatttgaactgattgctaaggtcgaaggggtgatctgtgcgattgagagtgcccatgcagtcgcctacgtacaacaattagcaccaacgatgcgacgtgaccaaactattatttgtacgttatccggtcgtggagataaagatgtggcggcaattgcaaagtatcgaggggtgacaattgatgactgatttaacaacaatttttaaaaatcataaggcgtttattgcttttgtagtggccggtgatcctaattttgaagcgacagttgaccaagttgttgcgttagcagaagcgggttgtgatctcgttgagattggcattccgttctcagaccctgtggctgatggtcccgaaattcaggccgctgatctccgtgcgtttgaccaacacatcacaccccaacgcgtttttgaattggtggtggcaattcgagagaagacaactattccactcgtatttttaacctatgcgaacattgtttatcagtttggttatgctgcctttgcccagcagtgtcaaagtttgaatgtcgcaggcttgattattcccgacatgccactagaagcctctggtgaacttcgaccaaccttagaccactatggtattgctttgattccattgattgcgccaacgagtgatgatgcacgcatcgcagcgattgcccagcaggcgcggggcttcatttatgtcgtatcatcactaggtgtcacggggacccggcgacacatcacgactgatttagcaacactggtggcgaagattcgccatgcgactacgttacctgtcgcaattggttttggtatccatgagccagcccaggcccaggccatggcacaaattgcggacggggtcatcgttggtagtgcagtcgtgcatttgattgcgacgcaccaaccagcgacagcagtcttaagagactatacgcgacggatgcggcgcgcattggatggtcgcacggctgatacagttgactgatcttgtttgttacgatgttgttgtgccgggctacttcgattaaatgctgggaaacgctaggataatgtgctagtctaaaaacagcttactgctttgtgggcgtcgttaataatagttgacgctaaccaagccagttaaattaatttaaggagggctcgacatggcggatgtactgattattattgatatgcaagttggtgtctgtcgtgggtcccaaccggttgccaatttggcaaccgtgattgcgggtattcaacagcgcattacgagttatcgggctcaaaataagccaatcgtgtttgtgcaacatcacgatgctgacttagtcactggttctgccgattggcagatgataccagagttgccaattgaagcaaccgatattgtggtccagaaaacgcacgccaacgctttttatcacacggatttacaagcccaattgacggcgattggatgtcaaacacttgaaatctgtggtgcgcaagttgagttttgtgtggatacgacggttaaaatggctcatgggttaggctaccacctcgaaatggttcgggggttgacgacaacgacggccaattccatgatgagtgcgcaacaaacgattgatttttatcaagatcggatttggaaccaccgtttcttgacgttggtaacagcatcgggccgtattgacgatttgttagaaaagacgggtgattagttaaaagcattattttttaatgattttggcgatgcgtcggtcctacagtacggtgaggtggcggacccaatcgttactgcaaatactgtattggttaaaacaacgtatatcgggctcaactttgccgacatttatcgtcgtcgtggtacctatcatttggaaaagcatcaaccgtacattgatggttatgaaggcgtgggaacggttgtggcagttggtaagcaagtggcgaattttaaacgcggtgatcgggtgttattcgttgacgtgccgtttgccaacgctagccttgtcgcggttccagctgatcaggcgattaaagtaccacgggcaatcaatgatcagcaggtcgctagcattggattgcagggcatgactgcggagttcttagtccatgacttagcacaaagccaaccgcacgatcgagtcttgattcatggcatcagcggtggtgttgggcagctattaacgcaactgctcgtggccaatgaggtggctgtttatggtgtggcgtcaacaccggcgaaagctgaattggcctatcaagctggcgcaaccaccgtttttatgcgccatgatccttgggacacgacccatcataatttttttgatacggtgtttgatggggtcggtaagacactaccagttagtctggcgactaccaagcaccgtgggcgggtcattttttatggcatggcagctggcaatccaccagtaattgatccagtcaagctaatgtccgaatccaagagtttgatgactggtgatttatgggattatttggacagcgcggctgctcgtcagtgccgtgccaatcaattgtttgatgatgtgctcacgcatcgcgtgacgatacgaccagcgacagtctattcattagcagaaggagccgctgcgcaccgggcccttgagaccgggcaagttgctggcaagattttattgcgcccatgaagtacttgaatcgtatttgaaattaactggtttaatcgaatatcaccaaacggcatcgggcagtttttccgatgccgtttttgtggtggattagtagtgcaggctgaatcgagcgccagttagtcaattcaacaattgaattattaaaattcccagtcatgaccacggactgttacactaagtgctaaatcggtcaaatggaagtgtgatggtcatgattcaattagtacgttattcgacgacacggggagcactgaagcaaatacaacagtatcaactggttaatgtgatgtacacggcgacgccacaacaagttattcgtgcttgcaaatctgatttagaacgaacggccgttatgattatgaatggcaaccaattagtgggctttttctgtttgcatgttggtcaaggaccgctcagttacggtgaaacggaagtgaatacgattttgttgcgagctttatctgttgatgatcgctttaagcatcagcgggttgcgtctgacgcgcttgccgaattaccacgttatcttgccagtcattatccgatgattcaaacaatattattagcggtcaatcatgccaatcatgtggcgcaacatttatacctgacccatggtttcactgatacgcatcgccgcatagatggtcgattggggcgtcaatttatttatgaacgcccagtccattgtcccatggatttaaattttgattgaaatttgcttagttagttcagtcaatctagtatttggaatcttatcggaactaggtgcgatactttagaatcgtttgtgtcgttgcgaatgagattagatttaaacgaaatctgattgaacggctcgttttacgattggctttctgttagattatgataatacgattagaaaaagccgatcgtaaattaagctaatggaagtgatggtaatggtagcaattctttctctaatggttgtcatgggttttatgatgcttggcgagtgggtttccacgcgcagtcgggcctatgttccatccgtatttattacggcactcttatttctagtgggtttttggacaattgttcccaaaaacattgtccctgctgcttcatttggcactgcctttattcaaattacccaagccgttttattggttcatatggggacgttgatggatctgcaattgttgttaaaacagtggcgcgcagttgtgattgccctgagtggcgtggttgggatagtggtgctcacgatgggaattggccgtcttttatttgattggcacacgatcgttgccagtgtgcccccgttgacgggtgggttagtggctgcctttctgatgacagctggactcaaggcccaacatattaccgcacttgtggcgtttccggtggcaatgtttgtcatgcacagcatgctcggttatccgctaaccgcgtggatgctaaaacgggagagtcgccgactattgcaagtccgacatgtagacgtcacggtcgcgaccgctgattctgccaccagtgcgacagttcaaacaacggcgcaattaccagtgggcccgctaccaaccgtaccagcgaaggtgaaatcagttcaacctcaattacggcattggcaactaccggctgcttatgatacttcagcttttatgttatttaaagtcgctgctgtgactgggctagctgaatggactgcccagttagcccatggcacgattaatcagtacatcatttgtttagtgtttggtgttatcgcgcatcagttgggctttttagaagatgcggtgttggagaaagcgggcgtctttcactggctgatgtatggtttgctagcttatatttttgccaatctaaacattgttaaaatcagcatgttaagtggtattttgatcccgattgtaacgttgatcgttcttggtgttttagggatgtggattgcatctagcttattggcgcgaccgttgggatttagccgcgaaatggcttttgcaagtgcattgactgccttatttggtttccccgcggactatatcgtcacccatgaagtgaccgaaattatgggatcgactgcggaggaaaagcaatatttactagaccagatgttacctaaaatgttagtgggcggttttgcaaccgtctcagtggcgtcagtgattattgcgtcaatcttcttgaaaattttatagggggcttttcagatgatgacaacaactttagcagcttggatgacaaccttgcgccatcaattacacgcacacccagagttagcactgcaggaagtcgcgacgaccgctttaattaagcaaacattgactgagttgaacattcggttggtagactatccgggagaaactggggtggtggccgagattgggcatggtgcgccaatcatcgcgttgcgcgcggatattgatgcactcccaatccaagaagacaatgagttatcctttagatcaacgattcctggtcggatgcacgcttgtgggcatgattttcacacggccgccttattagggggagcgcgattattgaaagtgcatgaggcagatctcaatggtacggtgcgactgatctttcagcctgcggaggaaggacaccgcggtgccaaaatgatgattgataatggtgttctagcaggtgttcgtgcgattgcgggattccataatatgccgaatttaccagtcggcactttagcgatgaagtctggaccactcatggctagtaatgataattttgacgtcacaattttgggccagggcgcccatgcagcgatgcccgaagcaagtcatgatcccatcgtgacgcttggtgaattgatcagtaatttacagaccattcgtagccgaaatattgcgccagacgcagcactggtgctaacgattgctgccgtccaagcgggaacgacttttaacgtgattccaaatacggcgaatttacgaggcacgattcggaccttcaacacggctaaccgggatctagctaaagtacgtttttacgatattgtgcgtgcaactgccaagatgaatcagcaaaccgctacaattgattgggaccgaggaccaagctgtgtcaacaataacgcggcacttaccgctgtactatcacgtgttctgaaagatgattttgatattgtgcctgcccagctatgcaatgccgacgatgattttgcgttatatcaagaatgtattccaggattctatggattcttaggttcaggcggcaatgggaccttacatcaatcaaattaccgctgtgatgacgcaggcctaacctatggcgctcgcttccatgaattggcagctacggcactattaaagtgggttcgagcttgaattgaaagtggtcaatcgacaaagggaagacgcccgaccttgctaggaaactaacatggttgggcgcattttttatggaaagcttctgaatgataagtaacaagcgagtctggtcacaattatctgagtaactaaagtatttgttgatacccgacttggtgcaatcattaactgatacgtgcagattattgttataatatatgtgtattagttttaatattattattttaatgatgaagggaacgaccgctgattgaattttggttgaggcggccaaaggtgattaggatgaaatcaacaattttcgaaaaagctggactagtatctgttcaggaagttgacaaaccaacattacaatctgatgatgatgtcattgtgcgcatcgtgcggacttgtgtttgtggttccgatttgtggtcatatgcgcatggtgatgacaaggctgcccattcgatcaacgaaggacatgaagctatcggaatcgttgaggcaattggctcggccattacgacggtcaagccaggcgactttgtcatcaccccatttacccatggctgtggtgagtgcacggcttgtttggctggtttcgatggtacttgtgatcggcatccggaccacacaaattggtctaatggctttcaagcagaatacattcgcttcacttatggtaattgggcgttagttaagattcctggtcaacctagtgactatacggaagggatgctcaagtcattgttgacgctggcagacgtgatgccgactggttatcatgcggcacggtgtgcaaacgttcaaaagggcgataaagtcgtggttattggtgacggtgccgttgggcaatgtgctgtgattgcagctaagttgcggggtgccgcgcaaatcgtcttgatgagtcgccacgaagatcggcagcaaatggcacttgcttctggcgcgaccgcggttgttgctgaacgtggtgacgaaggcattgcgaaggtacgcgaaatccttggtggcggcgcggatgcggcgttggaatgtgtcggcactgaagcggccattgaccaagctttaggtgttttgcataatgggggtcgcgtaggctatgtgggtgtaccacattataataaccggccacttgggtcaacctttgctcaaaatattgcggttgctggtggttccgcctccgttacgacttatgacaaacagttcttactcaaagcagttttggacggtaatattaatccgggccgggtatttacgcaaacgtatccattagccgacattaatcgggcttatcaagacatgcaaaatcgaaagacaattaaggctatgattaccattgattaatctcgactaggtaactagtcgcttaaaagcaatcgattaaaagtcgtttcagtactgattcatcgtgctgaaacgactttttcgatggcgataatttaatggtaaaaatcaatcaagcttagttgatctagactagtctttgcgttggtattagaaaaaagacatgcaaccagttgaaccgtgtcattaaagctagctggtcgcacgattgtagttggcttcgataattaaccgtttaaaagaacgcattttgctgtccgtgctgtcgccagcttgctatactgggtcaaaaatgaggtgagcgtaatgcgagtctttacttggatcgtgcgaacaattgtggctggtgccgttttgatatgtgtcattatgattggtttggcaccgcaaacagttgtcacacattttaatagtgccggcttggctgattcattcggcagccgctggtggctagtgatgttaccactattagttgtggtaacgggtgaagtcatgattaagttagcccgtcaaaaacggcgcaagctcggactcttgcaactgccgacgctaacaggctttgaagggcagtgtttaggtgtcatggtgggtttcagcgtcctgttgtgggttatattgcaaccggaagtgcagtgccggctagttagcgggggcattggcggatggtgattaggatgagaaattggcagcaggatgtttatgaattcgcctgaaattaatttcaagcgaatttttggtggtgtagttattttaaaatgcttagaccatcagggcttgatcaacagcgccaggcgtaatgagtgcgattttgcagttgtctgagttgattaatatcagctgttaatggcctgcgccaaaaaatggcatgttatgttatgatgatgacgtgataaatcattaagccgttgcgattttctatgtaaactattgttattgaaaaacataggaggtcattgagatggcagttattttaattacgggtgcaagcagcggtattgggtttcagacagcgaaagacttagcacagcaaggtcacgttgtttacggtgcggcgcggcggttgaataaacttgaagcactagccccatacggcgttaagcccttgtcactagatataaccaatgagcagtcgcttagtcaggccgtagcaactttaattgccagtgaaggacgcattgatgttttgatcaacaatgcggggtatggctcatatggcgctgtggaggatgtttccattgatgaagccaggcaacagttcgaggttaatttatttgggatggctcggctgacacaattagttttaccgtatatgcgcgcgcaacgtgaaggacgcattatcaatacctcttccatgggtggacggttggtgagttatatgggcgcatggtatcacgcaaccaagtacgctgtcgaagcgtttagtgacgcattacgaatggagactaaagactttggcattaaagttgcaattattgaacctggtgggattaaaaccaactggggattcattgctgcggatcatttagaagcctcagcacgtcacagtgcatatcaaacacaagcgaccaaggctgccgcgggtatgcgccgacaatactcgtcgcgaatgatgtctgatccaaaaattatttctaaagctatttcgaaggcggtcaatcagaaacgaccacgggtgcgttatttaattggatttggggctaaaccgctggtacttgctaaggcgattttaccgactcgtgtttttgattttatcatgatgcatgccagttagtaggagtgattagtgtgaagattatggtttctgaacagtttcagtgttttatggcaagccttggcgttgatttaaatagcctgcttgaagctgccggtattaataaagtggtttggcaagaacaattaatgctttctgatgtggagtattggcagttaatgaacgaattcgacaaccaattgacggatgaaatgattcttagtttagggaatattactaacattaatacgtttatgccgtccttttttgcagcattagctgctaaaaatggtgaacaagcgattgcacgcatggcaaactataaatcattggcaggtccggttcatttagagatagtgaccaagccagatattgtcaatattcatattttgggaaatagtcttggcgtcgagttgccgcgtttcacgattatgacggaacaattgttgttaatcagcttgttacgagtaggtacgggaaaactcatcaagccaatttcagttggtagtaagtatccgtatggtgatcagattgatgccgtgatgggcattcgacctcaacaattggctgataattgcattcagtttcaagtcacggacttacagcgggcgtttatttcggccaataattcaatgtgggcatttttgcaaccagggttagaccaacaaaaactggctattgaacacaaccaatcattgctcgcgactgttcaagcactattgttgaagaaaattcctagtggttccttctcaattgacgagattgcaacaagtttgaatctcagtaaacgaaccttgcagcgtcatcttagtactttaagcaccacatttaatgatgaagtccaaattgcgcgtcgaaccctagtggtacccttgatgaaagatcaatcgctaaacttgattgaaatcagctatttgttagggtattcagacccagagtctttttcgagagcttttaaaaaatggtttcatcagagtccatccgtttaccgccaacaatctctggggatgttcaaaaattaacaggcattgccgtttaggttaaaagttatgggcgttaaaatcttatggatgtgatggctttagactgatgggtaatcctttaaattaatagatcgtcataacaattgtgtttaagaatgctagttcttagatgcaatttttttttgcgtgcatttaagctagtgacagttgaacagattgtatcactgcttgctgaagtcaaaacttgttagcaatttgattataaactttatagtcaaattgctaaactgtgccagttcgttgacggattatgaccgcaaaaaatggatcgtcaagaaattttcgcaaaaaaataaagctcgattagagcccagcttaccgggatttggctactaaaaaatgtaacatactgtaaattaatctgctgaaatcaattgacaagatttggccggacgattaacttaatgccattcccaaacgccgtgaaaggagcgactaactatgagtgtgttagaagcaagtgaaattatgcaattaatccccaaccggtacccaattttattcatggaccgggtggatgaattaaatccgggtgaatcgatcgtggtgacgaaaaatgtcacgatcaatgagtcatttttccaagggcactttcccggtaacccggtcatgccgggcgtgttgattattgaagctttggcgcaagccgcgtcgattctgattttgaaatctgaaaagtttgctggtaagacggcttatcttggcgccattaaggatgccaagttccgcaaaattgtccgtcccggtgatgtcttgaagttgcatgtccaaatggtcaagcaacggtccaacatgggaacggtgagttgtcaggcgatggtcggtgacaaggcagcctgcacaactgatttaacctttatcgttggtgcaactgattcaaaatagaaaggtggtaatggcaattcggcgattgtcgtttgggaaagttttttaaaagcattgccgaattgtaaccaaccatgacaactaatttttcgattttagcgagtgctaaggcactgccgacgaccaaagtcacgaatcaagaactaacgcaactgatggcgacttctgatgattggatcaagcagcgaacgggaattcgttctcgccacgtcgcgaccgatgagacaacgacgagtttagctgtttcagttgcccagcagttgttgcagcaaagtcggctagcggcgacggcgattgatttgatcatcgtggcaaccatgtcaccggattatttgacaccggcgacggctcctcaagtacaggcagcaattggggctgaaaaagcaattgcctttgacatcaatgttgcctgtgcgggctttgtttatgggatgcagttggttcaccaatacttacaaccgggccagaccgctttgttaatcggtagcgagaccttgagtcggttagtagactggcatgatcgtagcactgccgttttatttggtgatggtgcgggtggtctattgattactgctaagcctaatacggccactgggcactggctgggcggtcattacgcgacgtttggcgctgacgggcattatttaacggcgggacagcaacctcaggtgaatccgtggtcgacacggactgatggtgcagattctaaccgctgggcctttcagatgaatggtcggcgggtttatgactttgccactaagcaagtgccgcactcaattgagcaggcgttgatgcaggcacggctcgagtcgagtgatattaaagcatttgtgcttcatcaggccaacgcacgtattgttaagagcgttggtcaaaaattaaacttagctacggaacaattaccgatgaacattgcacagtatggcaatactgcggcagccagtgaaccgattctatttgccgaaatggttgcccaaaagcaagttcaacgtggtgacaagctggtgtttaccggttttggcggcgggttatccgtcggtagtgtcgtaattgagtattaattgataactgaaatcaagcatttaaaattaatttaaaaattctggaggaatcaacaatgactaaaactgaaatttttgaccaaattaaaaagatgatcgtggaacaattagacgtggatgctgacaagattacgatgacaacgaactttaccgaagacttagcacttgatagtctggacgtttttgaagtgatcgataagatcgaagacgaatatgatatcgaaatcgaaacggatgacgctttagccacggttggtgatttagttgattatgtggcgactcatcaggaaaatagcgaggactaagttatgaaaacggcaatcttattcagtggtcaaggacaacagtttgccgatatgggggccgatctttatcaaacgttaccagcgtaccaagccacgattgacgaagctaatcaagtgttggactgggatctgcgggtaactgctgattggatcgatgatgctcaacggatgccggttgcaattacagcgatgaatatggggttatatcgtgctttaacagcgttgcttaatgagtgtccaaccgtgttaacaggattgagccttggcgagtatgccgcattgattgcagctggcgtcctgccatttgctgatggcttgaagttagttgccgatcgggctagatatatgcaacgagcgggattacagcatcccggggagatggtcgcggcgttgaaggtaacgccggcactggttgcagccgcttgtcaaagtgcccaagcagtgggggttgcgtatcccgctaattacaatctagctgatcaaattgttattggtggcgatgcagctggtattcaagctgcgcgaacctatttaaaaacacacggcgttaaacgggtggtcccattagacgttgcggtggcttcacacacgccgttaatggcagcagcgagtgaggcgttggcgcaacgattacgatttgttaatattgcagcaccccaaattccggtcatcagtaatacgaccgtgaccccctttagccaggcaactgtcaaggaaacgttggtaaaacagttagtatcgccaacgcactttgcggcctgcttacaacgaattgcgacatatgaggtcgatgagattattcaagttggaccagggcatagtttagcaacttttgccaaacaaacattgccgggggtaagggtttggtcaattgaagatatgacagattggcagaattattgtcaggatactgaggaggtacgtgagcgtggatgaagtgattttagtcactggagctgctaagggtattggtttggcaacagtcaaacggttggcagctcagggggccagcgttattttaaacgttcatcatgaaattgaagcggccgattggcaagcattaacggctgaatatccaaggttgacgcaattagttggtgatgtgagcgatgatcaaacggcggctgatttaattgagaccgtgatgacaaattttggtcgcttagatggactcgtgaataacgctggtgtgacccatgatcagttattaacgcggctacacgcggaagatttcatgagtgtgattcaaacaaatttattgggcacatttaatatgaccaaatacgctttaaaagtcatgcagcgacagcgacaaggcgccatcgttaatgttgctagtgtggtcgggttacatggcaatatcggccaggcgaactatgcggctagtaaggctggaattattggtttaactaaaacgacggcaaaggaaggggctcggcgccaagtgcggtgtaatgcggtggccccaggaatgattacgacggccatgacggcacaattgaatgaccgtgtaacggcggctgccttaagtgatattccactcaaacgctttgggacgcccgacgaaattgcccaagcaattgactttttattgcaccaaccgtacttaacgggacaagtgctaacagttgacggtggcatgacgatataagatatgggaggttatccaatgacagaacgagtagttgtgactggaatgggtgcggtgacgcccctcggtaatagtgttgatgaatttttaacggggttattcgcgggacaagttgggattaagcccatcacgaagtttgacgcgacgcccactgggattacagttgccggtgaggttaaggattttcagccagaagaacgaattgaaaagaaattagcgaaaagattggatttattttccgtttatggtctatacagtgcaagtgaagcgatggcgcaagccggactaaatgaagcaaatattgatccagaacgattaggcgttatttatggttcgggtatcggtggtttaacgacgattgaagcgcaagtgatcaagatgcacgacaagagtcccaaacgagtttcaccgttattcgtccctaattcaatcatcaacatggttgttggtaatatcgcgatgcaatttaacgcacagaataccagtcaagcgattgtgaccgcgtgtgcgtcggcgacgaatgccatcggcgatgcgtttgaatatttgcgtcaaggaaaggcagatgtgatcatcacgggtggttcagaagcttccgtcaacgaaatcggtattgcagggtttgcgtccctgactgcgttgtcgaaagccactgacccaacgttggcttcattaccgtttgatcgtcaacgcaatgggtttgtgatgggtgaagggggtgcgacgttagtcttagaaacgttggcccatgcccaagcccgaggcgcccagattcttggtgaagtcgtgggttacggaacgactagcgatgcttatcatatgacagccccccgaccggatggtgctggtgccaaacgtgcaatgcaacaagccgttgcggaagccggcattcagccgcgtgatgtggattacatcaatgctcatggaacagccacacctgcgaatgatagtgccgaagctcaagcaattagcgcgttgtttggtcaagatatacaagtcagcagtactaaaggaatgacggggcacttattaggcgctgcgggtgcaattgaagctgttgcaacgattggtgctctgcaagcgggtcagttacctgcgaatattggttgtacggaccaagatcctgagtgtccagtcaatttagtaacgccagcaactcaacatcaagccgcaacctatgctttgagtaattcatttggttttgggggccataatgccgtggttgcctttaagaagtgggtgaatgtatgagtatgacggatacggaagcgatgaccgccctgatcaatcagtttaatcaatccagcgctcaagtcatggacgtcaagacgacaacctttgaactgcatttgaataaacaagctgaaactgctgagacaaattcagcgcgttcacagccggcagtgaccgactctacggtaccagtggtcaaaccgacgactgaagtggcgactcaatcgggaacaacgatggtcacggcgcccctagttggggtggcttacttagctgccgacccgaaacaggcgccgtttgttcaggtgggtgatcgtgtcaagtcaggggaaaccttgtgtgtaatcgaagcgatgaaaatgatcaacgaagtccctagcccagttagtgggatcgttaaagaagttttaattaagaatgcaactatggttgaatttgatgaaccattgtttgcaattgaggagacgaccgtttaatggaagttacggatttaattccccaacggtttccgctgcaattattagaccgtatcatagcggtccaaccaggtgtcagcgcaacagcggaaaaattagtcacgattaatgaatggttttttcagagtccgacactgaccggaagaacgatgattcggccagtattattagaaattttggctcaaacgggagttgtggctttactatcgatgccggagcatcatggtaataacgtcttttttggcggaattcggcaggctgattttaagacggatgtgcgcccaggtgaccggttagaagcgatggtaacgttaactaagttgcgtcgtcaaatcggaacaggccatggcgtgattacctgtgctggtcgtgaggttgttagtgctgatttaacctttgtaatgcaagcctgaaggaggtatggcgattgtttaaaaaagtcttagtcgcgaaccgtggtgaaattgcggtccaagttattcgcgcgcttcatgagatggggattaaagcggtcgctgtctattcagtggctgatcaggagagcttatttgtacatctggctgatgaggcggtctgtattggggcgagtcccgtcaaccagtcatatttgaatatgcaagcaattattagcgctgctaatttgaccgggtgtcaggcgattcatccaggctacggctttttatctgagaatgcggaatttgcaaaaatgtgtgcggattgtcagttaacgtttattggaccgcgtcctgaggtgattgaccagatgggtgacaaagaaaatgcccggcagaccatgcaacgattaggcgtacccgtgattcccggcagtccatcggtgcttaaggatgttgaggcggctatgcaagctgcccataccttaggttacccagttatgatcaaagccgctgctgggggtggcggtaaagggattcgcgctgttagcaatgatcaagatttagcgaaggcctttcgaacagctcagcaggaagctcaagcttcatacgatgatcatcggttgtacttagaaaaaatcattgccccggcgaagcatatcgaagtgcaggtcttagccgatcaacaggggcatgttatttatctaccagagcgcgattgttcgctacaacggaatcatcaaaaagtgttagaggaaagtccatgtgcggtcatcacgactgctgaacggaccaaattgggacaatcagtggctaacgcaaccaaaaagttgggttatacaaatacgggtacctatgagtttttaatggatcagcagcatcatttttattttttggaaatgaatacgcggttgcaagttgaacatacggttactgaaatggtaacgggtattgaattgattaaagcgcaagtacaaattgcagctggtataccattaaaaattaaacaggcggatgtgaaaattcatggtgttgccatggagtgtcgcttgaatgcggaggatccgtaccacgattttcgaccgcaacctggaaaaatcacccggttgatctacccaatggggacactgggagtccggattgatgctggtgtggtgactggtagcatgattgcaccgttttacgactcgatgattgcaaaaatcattgttcacggtattaatcggaagatggtcagtcgcaagatgcatcgttgtttattggaattgaccatcgatggggttcaaacgaaccggaccttcttagcaggattagttgcagattcgactgttagccgtggtacctataccacagcttatatcgaacaagactttttgaaaggatggttaagtgatgcccaagcgcaagtttcaagcacccactgaacggcagttagctgttcgacgggataatatcccagacgcgttattgacgcgctgtccagtttgtcatgaagattgttatacccaagatctcggtgaattcaaggtatgtccccattgtgattatgggtttcgcttgcctgcttggcaacgtgttcaacaattgacggcgagttttgaagagcgggatgcggacctaagtgcgcccgtcagttttgatgaccctgcatatttagaaaagttgcagcgtgccaaagcagcctcacacttgaatgagagcgtattgactggtattgggacgttagcgacttatcaatttggcttaggtgtcatggaaactaaatttatgatggggagtttgggggcggcaaccggtgagaaaattacgcgattatttgaaacttgtacgacccaaaaacttcccgttgtgatggttactgcttctggcggggcgcgtatgcaagaaggcgctcgtgcattgatgcaaatggctaaggtgtccacggcggttgcaaatcaccgaaaagctggactgttgtatattacaattttaactgatccaaccactggtggtgtcacggctagttttgcgatgcagggtgacattatgttgagcgagccacgagcgctcattggattcgcgggtcggcgagtcattgaacaaaccattcaacagacaccacctgcggattttcaacgggcggaaaccttattagccaatggatggttagatcaaattgtaccccgaccagccttacggaaaacactacaacgattattaacaatcactcagggaggtcatcaggatgtctaaagtaacggcctatgaacaagttcaagcagcccgtgatgctagtaagattagcattcaaacgttgattgatggcttgacagaggatttttttgattgtcatggtgatcgtcaacgggcggatgatccagctgtaatcgccggcttagcaacaattgctcaacggcccgtcaccattattggtattcagaagggtcaaaatttggccgagaatcaagctcggcattttggctgtgcgacgcctagcggttatcgaaaagcattgcggttaatgcggcaagcagaacaattacggcagccggtcgtgaccttaatcaacacgccgggtgcctatccgggtgttgatgcggaatatgagggacaaggacgagcaattgctgactgtttgttagcaggattacaattgcgagtaccatttttgagtttgattgttggtgaaggtggcagtggtggtgcattagccttagcatgtggtgatcaagtctggatgttggcgaatagtacttactcggtgttatcacctgaaggctatgccactattttatggaaagaatcgcaacgtgctgctgaagctgcggaaaaaatgcgcttgacgccgacagaattattggcagatgggattatcgatcggattattcctgaagtagcaaccgcagcagattgtcaaccgctgaaaacagccattgacgagacgttaactgctttaacagcaaagtcggtggcggaactggttacgcaacgccaagcccgttatcggcaattttaaataagtgaggaatgataagtatggatggaattttatcgggtaagaccattgtggtcatgggtgtggccaatcagcgcagtattgcctgggggtgtaccgaggcattaattgcacagggggcccaggttatcttgacttaccaaaatgaccgtttgaagcaaagcttacaacggtttgttgcgccagatgtgccgttaattgcctgtgatgttgctgatgatgacaatgttgagcgggcatttgcaagcattaaacaacagtatggtgccatcgatgggattatccatgcgattgcttatgcggataaagcaaccttagaaggtgattttgtgaataccacgaaagctggatatgatttggcacaaaatattagtgcgtattcgctgattgcagttgcccgagcagctcggccaatgctgaaaccaggagccagtctcgtaacgttgacgtattttggatcagagcgagccgtaccaaattataatatgatgggggttgctaaggccgcgttggaagcaaatgtgcgttacttggcacgtgaccttggaccacaacaagtccgcgtgaatgcaatttcagccggagcagtcaaaacgttggcggtaacgggtattcatgagcatcagcaattattaaaattatctcgcagtatgacagttgatggagaaccggtaaaaacgcgtgagatcggcaacgtggctgcctttttattaagcaatctatcgactggaatgaccggggacgtggtatacgtggataaaggggtccacttaagttaatgccaatcactcaagttgtctttaaacggcagtggcttcagatgccggtcgatgtttctaaaaaaatgcggcgggtcactcagcgaaccgtgagtcgccaattaattcagcaagtgttatcggtaccattagcttatcatcgattgggccagccgtattttccaagtcatcctcgattaggtgttagtgttagtcacacgcaccagttagtgatggtggcggtcggtccgggacctttggggatcgatgttgaacaggtccgtccatatgatgtaactgccattcggcgagcctttacatcggcggaatggcagctattacaggctttatcggtgcaagatcgttatcggttagggtggcaactttggacggctaaagaagcggtattaaagttagtgggctgcggcttgacccatgcgccccgccgtgtcgaggttcttgatttacaacgtggactagcgtgctatcaaacacagttataccagttgacgccgttagaattgcctgcgacccacgagggatttttggctcgtcccttgtcggttggctgattggagcgcatggttggtattaactttagtacgctcttttttaagtttagtgaacaatggccactggattttattatcggccaactggttgacctgctagtgcaagccttctacgtgctgactaaaagcagttctgagcaagccataattgtgggctcagaactgctttttaatttatccttcaataatttatctataataatggcaatgcaaaattcatccataaccatgaaatcggcatgataacgaccatcatcggaatcatatcggcggtcggaaacatcttgacggcaataatgcgaaagccgctggcaaccattaaaataccaccgaccgctttgaaatctagaatcatgtcaggagtggtcaagggaaagactaggtgagcgactaagaataaagcagtcaggatgattagttggggaacagcaattaaggaaacaactaaccctaagttagcaccgaaaattaccgcagcaaagaagtccagaattgatttggaaatcaaaattgtggcgtcgccgttcatcccttcagttaaagtcccataaataccagttccactggcacaaaataatacgattaccgtgaccattgtctgttcaaaggcctgtttctcaaaagttgctggtgctttgacaaaccgtgaaatgaaacgttgcatcgcggcagcgccgtgattgattgcagttcccaaatggcaaagcaatccaatacctgttccgataataacggcaaagatgaccgccgctagattttttaatggtgcaatcgcgtaaatccccatacacatggaacagatcccaaaggacatattcagcccatcttttaaacgttgtgacattcgtttgccggtcaatgcgcccacaatacccccgaaaaagatcgcacacacgttagtaataattccaattggcacgcaagccctcctcaatatttaattgataaaaacaacagctattagtttagagcttgtttcggataagaacaattctgaatatgtggtaaactattctaaataggaatagttagaagagggttaattatggaaacacggaaattggcagtgtttgttgaccttgccacgacccagaactatagtcgcagtgctgaacgcatgtttttgtcacagtcgaccatttcaaaatacattatggctttagagcgcgattggcaggtccaattatttgaacgtgcgcatcggcaagtcacgttaacacgggttgggcaacaattattgccacgggcccaagcaattctgcgcgaagagcgtcagctacaacaagttctggccgctaataccgctcataatgcgcagtcgctggttgttcagggactaccatctttagcacaataccaggcttttcatattatcacggcatttacgaagcggtatccggaagtgaaattacaatttagtgaggcgagtgtcgatcggttagcgcatgcactggatcatacgaatgtcgacattgtatttacacggattttcggggatcaacccaataattatgacgttttattgaatgagaccgatcagtttgtggtccttgttccgaaagacgatccgttggcgcaacaagctgagattagtctgtcgatgctggcacatgaatcaattttattattgaaagataccatcggtgaagataacccgttgttttcggcatttcaaaaaatgcatacgccacagatggtttatgatggtcaacgaattgatctcattttagaaatgctgaatcagggtgatggtgtctcggttgtcatggcgcggtcatttgatctcactggttttgacaacattaaagccattccactgacgcctactattcgcagtcagatggctttcatgaagcgtccagataatcacgctgccgtggttgctaaattttgggcgtttgcgacgaagtatagccaatcactttcagattaattgtggcggctgatcacattctaacgatgtgtcttgaatcggaatcaaagccgacgatgacataaggataaaagcagtcggtttcggtggtcgtagcaggaaggacgtgtccgaacaacaatcgagctagctagtctgttttaatcacattgtaggtcgtttgcagtgatataaataaaataattaaagatgacggggtgcagacatggaaccaattcatatttcacagactttatcaattagcaatcaccgtgtgttttcagctgatttgaatgagcacgacacggttttcggcggaaaaatcttggcgactatcgatgataattcatcgattgccgcatcgcgagtggctcgaattgagacggtgaccgtgtcagtcgatcaggtcaattttttattgccgtttcggttacaagactcaatgtgtgcggaatcttacgtttcgggcgttggtcaccgctccatcgaggtatttactaaaatcattggtgaacacttgaagaccggcgaacggtttttgggattgacctgcttttcaacgttcgtggtgacggaccgtaatattgaattaccactgttagtcgctgataaaccagaatacacgtttgttgctcagggctatcaagagcggcaggccgcccggttagccaaactaaagcgccagcaagactttaatgcgcacattagcgttgaattgccgtggtgaatcgctttaaattgacaattttggtgagacttgttaaattgtaattatcaaatataggaggggtgttttatgtcgggcattcgttagggtgttgttgagcgaaaaaagtgggttggacccgcttagtttcgtgtaccctaatgtgacgaatagcctggcagatagacatgtcggacggtttttgcgcacagttgggataagactgggcgcatttttaattcgcagagcgttagggtaagtcactttgcgaaaggattataaaaattgacaattaatttaattaaatatggattgacgacggcggttcaagccgacttgactaaggaaaacggtcaaatacttggccggattatcggccaacatcgtgattggtaccaagtcatcacgacggctggggaacgttcagcacaagttacgggaaaactggcttatgaagcggccagtcccgcggcatttccggcggttggggattgggtgtgcctatcttcatccgctgataatcaggcgcagattgaagcaatcgcgccacggcagagtgtcttggcgcgcggtgccgtgaaccgccaagacggccaaatcattgcgacaaatattaataccatctttatctgcatgtcattgaacgcggattttaatgtgcggcggttagaacgttacctgacgattgcgtgggatagcggtgcacttccggtcattgtcttaaccaaggcggatctctgtacggatctagccactaagttacgggctgtggcggatgtcagtgtcggcgtaccgacgatcacttgttcggtcgaaacgggtcagggtttggatgaattgcaaccatacctaacgactggtcaaacggtggccttcgtgggctcttcgggtgtcggtaagtcgactttgattaaccgattgttgggccaggatatcttggcgacgaaatcgattcgtacagatgatgacaaagggcggcacacaacgacgagtcggcaattaataccgctaccaacgggcgcctgtgtcattgatacaccaggaatgcgtgagttacaaatcttcatgggtgatttaaatcaaactttcgcggaaattgcctcattggcgacacagtgtaagtttagtgattgtacccatactagcgagcctggttgtgcggtacgggcagcagttgaggtgggcacggtaacgtctgaacggttacaaagctatcaaaaattacaacgtgaaatgagctatcaaggactcaattcacgccagttggagcaggctaaaattcagcggatgttcggtggcaaacaagcgatgaagcgtgttaaacaacgttaccatcgcgactgagttgataagtaaattaaagaagctactaaacgggatgtcggcaacggcaccccgttttatttaggacctactttcgttatcgcgtagagtgaaccgagtgacctgttgagcgagataggccggtgtttcaaccatcccattctgttgccaatgaacgagcatattgatgaccgcaccagaaaaataagccgtgtagtacggttggcgaagcgcggtattgcttgaaccgataatacggtcttgtttgatgagtaatgcaaagacggcttcgaaactttgaataaaaatctgggttttttcatttttgatcaataacgcatttgtcgctgccatttgttgcatgagagtgaaatattgagtcatcaatacctgcaatttaacctttgattgtcgcagtaattggcgcagatattgaaggatagtctgtttttgataggccaaaataatctgatcgaagttggtgaaattacggtaaaaataggtgcgagaaacctgagcgtgctgacaaagttctgtgattgaaatacgactgagtggtttttgcgacataagctgtagtaaggccgcataaaccgcagttaaattttggcgttttcgtgtttgtgggttcattggttacaacatctccttttttgtaacgtaagtatttatttatgaccattttaccagatatactcccattaacttaacgggaggcgattatgatgaaaaaatcgacgaaagtaattgcaatgatgatgattggcatttttctatgtatgcttgatacgacggttatgaatattgcgttgccagcaattcagacgggactaaatactgatttgacgcacctgtcgtgggcactgaatatttacaccgtcctgtttgctagtctggcgattccactcggtcggttagcggatgtctggggacgtgggcggatgtacttgattggactcgggctctttggtattggttcactaacttctggattgagtctcagtgtcgggctgctgattactggccgagcgattcaaagtattggtgcggccatcgtcttcccggctagtatgacgattggtattcagagtgttgcactcagcaggcatacgggggtcattgcaagcttgggcgtgatgcaagggctagccgcagcgttaggaccaaccattggtggtgcggtcactcaattttgggggtggcggggaattttcctgattaacgtgcctttagttgccgtcgcgttgtgtggttgcatcgcctggctatcatggcggcaccctagtcatggtcaagtaaaactagacctcggtgggagtgccttagtgatgacgaccttattggcattgacgttggtcctggttaaaggtaatgactggggatggacgagtcgcgtagtcctgagcctgggcgtcactagtgcgctaacattgattgcctttgtctggatggaggcccacgtctcagcgccgatggtcccattagccctatttaaagaccgacagtttaacggtgcggcgttagcgaccgtgttatcaggggtctttatggtgggactattagtcttgatgccgagtttcttcacgaaagttcaaagtaagacggaattgatggcggcgattatgattacgcccgcttcaatgatgatttttattttttcaccaatcagtggtttcttgttagcaaagcttggtgcgcggcgcgtgatctttagtggtagtctcgcaatagctacgggttatggggtacttagcctgatgagtcctagtcagtactggcagtttgcattggcggcgttactggttggtgcgggctacggcacgattattgggccaattacggtattagcggccggtgattttaccggtgagttactgacagcgtcacaaagtgtgattggcgtgtttcggcaaattggcacatcgttggccgtagccatttttgtgtcagctttagccgctaatttgacaacggctaagacacagatacgaacgtatgcaacgacgacggtcactactttatcaattcctaagcaagccaaacgtgatacgttacgcgtggttgaccaccaattagcaactgagcaaaccgcgcaaacggtccacgagccaatcacggcggctaaggcccgccggttggttgctgccaattatatgcaagtgttaaaagcacggtcattgcagtccgctccagtgcgtatcaaagctcaaattcatcagcaggtggcccaaaaggttcacagtcaagttaaacacactaaccagcgaataaggactgctgcatcagcgattaaggccaaagccaaaattgagttaactgctgcgtttatgcgcccctaccaagtcgcttggccattcacgctattgctagtgatgacgacctggtgttttgcgggacgggagcggaaaagtggcaagccgagttaagtcacgttgatggggatggacttcacgcacgtttgaatagttgagccggtagggccgcgaaggcgatcgccattactgactttggaacttgccatcgaacttagctttgcgagcatgtgagacgcttatgctataataagggccaaagggggtagtcttgatgaaagaaaaacaagtgtttcatatcaatggctatattggtctagtgttagcgatcgcatttgtgttagttggcggttggctggtttgggccggtgcgactggcgatcattttgcgagtatctttttgggcgcattgctaattattattgcggcctttggggctagttcgctaacaattgtgggccccaacgaggcgcgcgtgttaacattttttggtaagtatatcgggacaattcgtgattcagggctgtttatgaccgttccgttaaccagtaagttttccatttcactgcgggtccgcaattttaacagtgccattttaaaagttaatgacctccggggaaatcccgtggaaattgcggccgttatcgtgtttaaagttgttgataccagtatggcactctttgcagtggatgattatgaacaatttgttgagattcaaagtgaatcagcggtgcggcacgtggcctctgaatatccatatgatacgtttgatgacgacaagaagattacgctgcggagtaatccaaccgaagtttctgaccggttaacggaagaacttcaagaacggctaaatgttgcgggggtcgagatcgttgagacacgcttaacgcatctcgcatacgcgactgaaatcgccagtgcgatgttacaacgccaacaatcttcggcaattctatctgctcgcaaggtcattgtggaaggggccgtttcaattacggaagacacgatcgcccgtttagagaaagatacggggatgcagctatcagacgataagaaactgcaactgatcaataacatgatggtcaccattatttcggagcggggtactcagccgattgtgaatacttcggaagttaagtaggaacgttgatataacaacaatcaaagttgtagcagtaacataaaaggcgctcatttgctgagcgccttttatactacagttaagtttaaacagtaacaaaaattgacatcatgacccgctaatcttttaaaaagatgctcttttggggatgcctgcaatgggtcaaatcgtagctggaacactctttatgaattgctaggtttactttccaataccgctcatggcaattaggccataccaaccgtgggcaaacattttatttgtagaagttgttaagttggcaattaactgatcttgttcagatgagaaatggtattttttagcgacagccatcacttgaagttgaccgattaattcattgattgcgtcgggtatttgttgataacgcttagtaactgaatctggttggttgatagttgcgtaggcttggctaattaattttctgatttcaactttttcaattggaactgaagtgtttagctgttctaaaagctgattaacagttgttaaacgcgctaatttctgttgctgtttcatcattgaatcccccagtgtagtgtttagtttaaacaaatgaattagttatagtgatataaatttcacgtcaccactatataggctaacatacaaatgaatactgtactgcatcagcaatttagtttttatgttaatttagttgtccgtttagataggctttgccaataataataattaaccctattatgattaataataaactaacataattaagtggccgacttttgctctgatagtgagtgaaccagccatacttgatccgggtgttaaagacattgatgatgaggccaatgccagtgatgaggccgccaattgcgataatgaaatccatttgtaatacctccatttagtttaagcaatttagatgtaatgactgcagtaaatattgatgctgaacaatctcgatgtttggcaacagacactagttcttggtatttaaaaaaataggtcattctgaatttaacatcagtagtttaagattatcaatataaatattatgaacagcataattttcagtataaataaaactggcagtcattgctattattagaaataccgttggctgttcaatacaggttcagtgaaataaagacaatcaatctttcagaaaatcaaattcaggtatataatgtttcatacacaaaacattatataggagactgttatgttagacaaaatcatttataaaaacttatttagtaaagcgttcgatgttactattgaagtcacttattgggatgggcaaattgaacggtatggtaccggcataccagctgttaaagttcgattaaataaagaaatcccaattaagttattaactaatcagccaacattggttttaggtgaagcatacatgaatggggatattgaagtagatgggagcattcaggaactaattgcctctgcttaccgccaaaaagacagttttttgacacataattcatttttgaaacacttaccaaaaatatcacattccgaaaaaagcagcacaaaagatattcaaagtcattatgatatcggcaatgatttttataaactatggttagatggtaccatgacctactcctgtgcgtactttgaacatgacgatgatactttaaaacaggcacaactcaataaagtgagacatattttaaataagctggcaacccagcctggtaaaagattattggatgttgggagtggttggggaacattattatttatggccgcggatgagtttgggttagatgcaacgggtattactttaagtcaagaacaatatgattatacacaagcgcaaatcaagcaacgtcatttggaggaaaaagtgcatgtgcagttaaaggactatcgagaagtcactggccaatttgattatgtcacctcggtaggtatgtttgaacatgttggtaaagaaaatctagggttgtactttaataaaattcaagcgttcttagttccaggaggccgagctttaattcatggcattacaggtcaacatgaaggtgccggcgttgatccatttattaaccaatatattttcccagggggctatatcccaaatgttgctgagaatctcaaacatattatggctgctaagttacaattttcagacattgagcccttgcggcgccattaccaaaagacgttagaaatctggtatcacaattatcagcaagtcgaacaacaggtcgtcaaaagttatggtgaacgatttgatcgcatgtggcaattatatttacaggcatgtgcagctgcttttgaggccggaaatatcgatgttattcaatatctattagtgaaagcgccgagtggaactggccttccaatgactcgccattatatttatgattgatcttgtcggttctgcggtagtcgtatcgaaatatagatccacaataaacatgtagtttcattgatctgttatgatccctttatggttgtcagatgaaatgatataattcatctgatatttcatggagggattttcgtatgccaagatctagatattcagcagttgaaaagttagctctaattactgagttccagaacgctaaccgttgtcaggtccgtcagaagaaacgttcacgtatccagcaacaggaacagtatttacaagacaatgttttagaccaacagtttaacgctagtcggccaaatcaggcctggttggccgattcgactgaattggtctatggagtcaatggccaatacaaagtgcgtctaagtggcgtgctggatctttatggtcggcatttaattgcccataggttaagtgagactgaaacttcaaatgcggagattcaggtttttcaatgagcctttaatttcgcgggtgatgtccatcccttagtgcatactgatcggggctcagcgtacacttcgagcgcatttaatcagtttttggcacagcatgaagttacacgcagtatgtcacggccaggaacgccatatgataacgcaccaatggaacgttggtggaatgaatttaaggtacgctggatagcgcggcacgccagaccagccacctataaggagctggtcgctttagtcgaagaaggtatcacctattttaatcaattagaccgttcaccagcaagaaacgacctcacaccagcagaatattggaataaggccgtttgaagtgaatcaaaacttatattatttcaaatgacaacttgacagggactagtacatcccttataagaacacgagggattttttattatgcatttggaatgattgacaaggagggcaaccattccagacttgttcagtattaggctggaatcgataagcatagaaaagatttcggatctctgtgcatcttggtggctatcatgttttcagggcgttatagtgacaattgaggaggggatcttatgttgagcaccaagaagaatcatgtattacggtacttatttattatagttggtatgatgatcgcgtttttaggttgtggcgtgattcaagtttcagcacatggctttgtgacgaacccgggtggaagagcttatctggggagtacttggtatccaggtgggcctttgaataccaatattggttcggttatgtatgaaccacagagtattgaagcgccccaaaatacatttattgatggcaaaattgccagtgccggtattgctaactttgcaccactggacgagcaaaatgccaaacggtggtataagacacctgtgaaggccggcaatcttagtgtgacttggcagttaactgctcgtcataaaactagtacttgggattactatattaccaagcctggctggaatccaaacgcaccacttaagtttagtgatttcaagaagatagctagttataatgacaatggtgccatccctagtgaatttgtaacccaccaagtcaatatttctgctaatgaaaaaggctatcaagtgttactcagtgtttggaatatagcggatactggtaatgcgttctatcaagtctcagatattgacgtacagtaattagatgaggtctaaatttactttgaggtgattttagactataaaagttgtctttgagatatcgtaaaggtcttactggcgtttattggctagtaagacctttttaaatgtgctttaaggattcatagaagcgaatagcgatgaccggtctttactgattagtgaagtacaggttgctattgtaaattagtggtaataattaagcggatgccgggaatcggatttgcgattacagcttggcagctggcattttagcattaaggggtacgcgcatgagcatcctctcaatgcaagttagctgaacaaaggtggctcaaatttgtgattcaataggtgactgtcagttgcgctcatgtgactacagtaccaagtcgctagtgatccatccgggtaatttcaggctcagttatcagatactcgttgatatgggcgagaaagttttgaaagtgcggcgtttcattgtgaaaattaacggcggcttggtcttgccagtgctcaataatctcgtagtcactgttatgatccagttgcttgaagtggccgtagaaaccgttgccgggttcttgtgaagaattgaccactagttcatgaataaaggcttcatattgagtggttaactcgggtttgacgtgtagtgcgacattaatgactttcattgaatactccccctgttgttcgtgcttgtagactgaccgccactcggtggtgaactttaaaattgcaaaattcgttaagtgactaaaggtcaccaccatactacggtaatcatacaaaaagaatattctgattatatcgtacgagaccaggattgtacaatgaaaacaggtatcaattatgcaactgcatctgattaattactcatttatcaaggccgattggtgcgggcgaaaatttaaacgaattaggcggtatatcggggtatcagtgacctgtacgattatcattttttagtaataataaccagcagatgtatatttatggatttgtcattcaagacgcggtatattaacaatgttaaatactaattcctagggggtggacaataatgagtaaagtttatacggatgtgttcaacatcaagcatacggattgtacggtagtcgataccattaacgaatttagtcgaatttttattatccaggataaacacggctcacggtttacgtgtctcaaagatgatgcccgcccagctaaaaagggtagtggccattggacgagtgccagtccggaagatgcgccacaagattacgctgtgccgtatcgttcaagaaaacggcaacgtagaacgctttaaatagttgattggtaatcagtgccgatacacggggccctggcggtgacaacaccagttaagccgcgttaaaactttaatacaataagataacggtcccatcagtaacaatgactgatgggaccgttatttgatttgcgattatatttaatttaataatgcgacgcctaatgtcaaataagttgcaaaacagatccagaccaagtaggggaccatcaaaattgcggctagccgactactgcgatagaactgtaatatgcaaagtaagacgactaaatcaagcacaatgataatgactaagccccaccaataagccgactggctgaaaaagatgatgctccaaataaagtttagtaacagctggataccaaacagggtggcgtccatgaggcggtcacggtgtgtcgtagcctgctggaaaactaagtaaccagcaatcgcaatcagcgcatataggatcggccaaacgatgccaaagaggccatctggtggtgatagtactggcaagttgagcccattgtaaacggccttaatgtctcccgcgagccatgccgacagactaccgattgcttcgacgaccacaatgaaaatgagcagatgaagccaattgaatttagggcgctctttgatcattgatttttccttccttctattagtcgtctaatcagggtcgtcaattgtgttaatgactgtcacgttgacttccgctttttgtacgacgtacgcggttgttgagcctagcaaaattcgagaaaccgcattggtgccggatttgcccatgacgattagatcaattgcatgttttttgggaatatcagttgcaatgctagcttttggtgaactattaacttgaattggtagggattcgacttgtgctgccgaagccatttgctgaccacgatccagaatgtcctgactattatcttttgcgacttttagaaggtttgtatatagcgttcccccgtaagctgcaggactatacgcattcaggcgtgtaatatcaataacattgaccagaaataatttagatttaaacgtctgggctagtttgaccgcgtgttttaaagccatgtaggcattatcagagccatcaagcgggactagaatattttgatacatcctcaggacctcctaaatgaaatgatgttatttattatattaatgataacattcacataattagtgcgtctattaatatgattaactgccaacgctcagtcacaaaaggcgcaaccattatgggccgcttagccaataaaagttgcgcctagttaaattattgccaacgatttgagcgtgacggcaacaccattaagatgaagaaccaaatggtcccaattattggaactaagtcaattaaaatccaccatgcagtgtgatcactgtcatgcaatcgccgaaacttcaacgagagtgttcctaaccaaatgattaatgcgatgagtttactcatcgtattaacactcagatcgctccaattgtaaatatcctcgatggggtgtcccataatcatctgaataattgcaatgataataccaccaagaatgtagttaatgataacgggccaccagtactcagagcgtgttgctgtacccgaaaagtttaaaagattgtcccaaaatttgcgataagcagatgccatcgtaatccccccaataaagttatgatgtgaacattattattttttccctgtgttaattgggattaattaataactatgtttaactataatcaaaaagttaatagtacgcaatcaatatgttgattatattaataaaaaatacgtcgttattcgatgactgctggtacgatcaattcgaagcggtccgtcaaataggtcaattcaattggtagtttaaccgctgggtcgccgtcaatacgtgtcgtcacggcttgaccagttgcactcgtaattcgtgcactggttgccgttagctgtgtaatggccttggagttttgcaagttccccgttagtgcgaaccaaaaatatggaattacttgccgccagccaatgttgttaagtagactaatatgcatttttcctggagcagacgcgctatagacgtgtccaccgactgatttggtcgttgtaatcaaacagaaccatgtttttaaggtgtggcttccttcgtgtttgaattgatatcgaattggcagtgacttattgtgaccaatatggcgaatagcacggtaaagatagcttaatttaccgaatcgctgcttctcagattgtcgaacttcattggaaatgtcagccaaattaccgaatgtcagtgaactcacgactgcccggcgttgattacaaactagcatgccgactgcttgggttgccggctgagtacaaattagttcgatggccgcttgggggtcagttggtaactggtagcgggttgcaaaattattaaccgttcccatgggaataacgccgatacgaatatgtgcttcagcttggattagggctgtcattgcaacgttcagtgtgccatctccaccaacaataattagtgctgacagttgaggaagcgtttgcttaattaacgcaattgcccgggggattcctggtgttgtcagtaattgagactcaatgccgtggttcgatagcgcttgcgcggtttgatgggcgacggttgccgcttgcccattacccgcttgtccgttacagaaaatgccgtaagttgttgccatgacaatcacctcttgattaaaaaattaagtttattcatcgcttatttagtaagcttttgatagtctcagtatagcttgaacactagtttgactggaaatgatatgcatcattactgaattagtcgggtcaatgagcattttgattgctcaatataaatattatagttatgataattttaatcacacaatatcgggatggagtgtgttcacaatgggatggataggtgttgcgatattaggactaacaataggtatcgttgcaaatgcggtaggcgcacatggtcggcgtcaaacgacaattaatttaatcgcaggcttattcggtgcacttgttggccagctgtcttttggatggttcgggccaacagttgctggaatgacgttgttgccagtcgtgagcggggcgatgatacttattgtgatcggaaccgttgctgcccaggcgcttcagccgcagtaattgtgattaggcataaaaggatttgttgaagtagcacttgttagcgttatcaaaagatggaggtgtccgtaatggctaaaattaaacgacagacccctggtttttggggtaaattgtcactattgattgcaattgggcaattaggattgactgtgtttcgagaagtgcggcagttcaaacaccgccgctaaaaaggggatgacagcatgcattggttatgggtaatgattgttggcgcggcggttggtgcttttgcaggtgctatcatgagccccagtcaatcgcggggttggatcggtcacattattgctggcgttcttggggcactcattggtgaaggtgtgctggggccgatggggcctgagttagccggaatgactgtgataccagccgcaatcggtgcaattgccgtcgttctgataatgatgttcgtggttcagtgggcacgggttcgacggtcaaaacacaattgaacagtgccaattgacagcctggctgttacgctcggcatcaaaaaatgttaaacatcaccctaaacagccccacaggtgacttcgaggtactagcttactcgaagttgtttttgtgtgcgccgatgggggctctcatttgaagtggcgtaatcataaaaaaacggatggtgattttgatcaccatccgtttgcgccgtgcccacgacaaattttaatcgtcagatttcttcttcattttatccttagcttcatccacgacgcccttaacagtttcttctgcgtcagctaatttgtccttagctttgcccattaaggattgtgttttgccctgggcttcacgtgcacggtccccggttactttaccttcgacttctttggccttgccgctcaactggtccttcttgctatcgaacttcttgttaacatcactcataaaaagcgcctcctaatataagaattaaccttagtttgcgataagtgatgacaaaacgcaaccaatatgcacaatgctcataaccactcggtcagaaaggcaatcagtagggcagcaaagttgatcagccaaatttgttgtcgctgggggagcatgattgtcggatgatgtgtcaaaacgatcgtgttcaacaaaaccattaaaataatcagggcgctgagcccgtaatttgtagcgatcaacagatggtcgctggcaatgccggcccaatgagtcagggcaaaaatcaagtttaaaaaacacgcaattaggatactatggcgtagatactttaacgtggtcatcaatggtaacctcccttagaaataatcatgctgatggtttctaagaaaaaatacaccattgccaggttaacggcgtgcaccgagttttatttggatagtaacggaactaagcgcattttgaccagtccgaaagccgcgccacatcaataatggttgccctcaaaaacggatagggggtgtgatttataggtttaaatcagtatcgtaattcaacggtgacatatcggtgcttttagtaatcaggtcagcggcgagagcttgcattgtgttcaaggcctggtcagcggctttttgattggctttggtcagtgccatagcgagttcgtcgccagtcaaagcggcaacttgctgatccgtgacaataatgtggtgaccaagttgaatcgccaattccttttgtactgtttgtaattccccgtgtagttcatggtagtgggcgtcgactaggataccgacgtgcttgaaaatccagtatgctgaggtagcatcgtatttttctgtagcaacttgataagctgctggagtggtcgtagcaccggcatagaatggaacgtagacactttcagcggctacacccatcgccagccagtgaatcccgctcagcgtgacgggaaggtccggtcgcaattgtaagacgtgtgattcttgcgtcttggcgagactgatgggccgatactgatgtttctccgtagcagtgccctggccgacgggatcaaacggtgtgccttgataatgggacgctaagtagccttggacttggtcaatatgaattaagccatccgcccgttgaatgaacggtaagtcaaacgactcaggcgtctgggtgacacttggtgtaaagcatctttgaccataccaaacgcgaggcgtgttgtaatatcgatcagaaaggtcggccgtaccgaagacttcccggaagttcagtccattgtccattgaagctaactgattgtctaatacaaaattacgaatgtctttagcataaagataattgtcatggtcactaaagtcgatttcttggattgcaagctggttagcaacgactgcataggcatcatccgggattcgttgtgcgacccagtaatgaccagcaccagtttccatgtaccaaacttcgttgacatcactaaagagaatcccgttagtttcgtaggtgccgtgttcttcaataatatgcccgagacgttcaacgccttcacgagcagaatgaatgtacggtaaggtgacagtgaccattgcttcttcaccgatgccgtccttaacatacgggtcagcagccagtacgcgtgtattacagtaagcactttcagtagcactcattgccacgccgtactcgttaatgccatcctcctcgaacaggccatattcggcagtccattcaggggtggctgtgtatttcgcacgaatctttggcagggtcatggtaaagggatgagtttgatcctgagacttgaaggtctgtggttcttcgaattcgcggtgcgcgtggataatcatttttttcgcccaagcggcgcgtgaatcttcattacggccaatcatggtcgaaccatccgcgctggcatttttacccactaggatactagtgcaggcggaataaggattaaactgatgagtcaacatatggggccttctttctccacggtaggagcagtcaatggcggtatcgtggcataatcatttttgttaaattaattttagcatgtttagtcatcaatgggggttttcggtttgtgcttctgattagttttgcaaggtagccttaattggtcagcgtgctgggcattagaaaagaaccgttaaatcaacaacgtcgtggcttgcaaaatagaaaagattaaagtaagattaaaacattcgaaaatagtgaattaagataggagcgtggcctcatgccaatcgtacacattgatctaattgctggtcgttcacaagaacaacttaaaaacttggtgaaagatgttactgacgcggtcagcaagaataccggtgcaccagcagaacacattcacgtgattttaagtgagatgcagaaaaatcgctatagtgttggtggtgtcttaaagagcgacgaagaagcagaataggttgttcattgccggaccggtcgaatatgacgtggccggctttttttaaaagtttagaaggtaggttaaactgtgaacgaacaaattaagacggatgcattaaattcggcgcaccatttaatggtcgggggcgtcgatacattgacccttgcaaaaaaatatcaaacaccgctatatgtctatgataccggtgaaattcgtgccgaaatcgcagcattcaagcaagtttttgaagaaaaccacgtggactatcaaatcagttatgctagtaaggcgtttgcaacggtcgcgatgtatcaattgatcgcccaagaacacattcattgtgatgtggtttctggtggtgaattgtataccgcccaacaagcagatttcccaatggccgccgtctcgtttcacggtaataacaagtcactggccgagctaaccatggccttagatgccggtgttggtaccatcgtggtcgataatttcggtgaactacgacaactgacgacgttgacgacgcaacggcaacagccgaccacgattatgttgcggattgccccagggatctcagcgcatacgcatgattacatttcaactggtcaggccgattctaagtttggatttgatttggacagtgggcaagcagaccaggctatcaaagccgcgcaagccgcatcatatttgaaactggtcgggattcattgtcacattgggtcacagatttttgaagtgaatggttttaagatgattgttgataagctcgttagtgagtttgctcgctggcaacgcgaacttgatttttacccacagattatgaatgtggggggtggctttggcgtgaagtacactgccgaagatcatccgctacagccaaccgattttgtcgatgcaattattaaggaaacgcgcgcgcaaactgcagccaaacaagttccaatgttagaaatctggatcgagcctggacgctcgttagtcgctaccgctggaatgaccctgtatacgattggcgatgagaaggatattccgggcattcggaagtatttgtctgttgatggaggtatgggtgataatattcggccagctttatatcaggccaagtatgaagcggtattagccaagaatccggccttaccagctgaacaggtagcctcgattgctggtaaatactgtgagtcaggtgatatgttgatctggaatcagcaattaccggccactgcaccaggcgacgtgttagcggtcctagatactggtgcatacggttattcgatggctagcaactacaatcggaatccacgacctgccgttgttttttgtgaacagggacatagtcaacttgttgtgcagcgtgaaagctatgctgacttaacacggctggacctcccactctcagtgccggagaaaaccaagtagattagtcaccaaaaagcatttcaagagttaggctcttgaaatgcttttttgggtctgctgctgtcgtcgaagggcttgtgtcaacgtttgactaggatcagtgctaaaatgggcagtatgaatttattagttacggtatacttatcattgaaggatgttaatggctgctatgaagtcattacgctggtctgaagatggctagcaggggtgccagcatgtggcgtgggatttccaagtgaccggttgcatactggccctaatttttttgttaaatctatccgctttgcttgcgttaggcgtgaagtttgttaaaatttgatagttaaagtcttcgacggtgacgatggtcaataaggtcccaatagataattaacgatttaaataaccggtgggggagttgttaaaatgtttaaaaaatggctaacttggccagtattctatgagctgacagaaatttatacggcaccacttaatatcatgtggtttgttctcggaagcgccattgcgcaatatcacttaggtacggtgaattggcttaacgtgacgctgtgtttagttagcgtatttatttttgatttagccgtcaatgtttctgataattattatgattatcggcatgctcgtgatcgggaaggctatgcgcagaagacgaatccgattggtcgcttgcagttacccgtagcgggtgtcggccgcttagcattgggattgtacctgatttcattgattcccggaatctggcttgtcatgcggactgggtggttagtgctcgtccttggattagttggctatgtgattggtattttttacacagctgggccctatccaatcaacgcgaccccgctgtgtgagacggtcgtggcgttagcaattgcatttttaattgaattgacctgtgtggtcgtatcgacgtatggacagcatccgttgacttggtcgatcgttgggacgactttcttactatgtttaccactgaccctgattttcttttgcctacaactggctaataacacagcggaccgtgatgaagatattttgaatcatcgctacaccttggcctactaccttggtaagccaggttcggtacggctgattcaagcgtttttaattattggtggcatttggccgctcgtgaacgtcttactgggactagcacccattgttacgatttgggtcgtactcttactaccaattatgtggcaaggtatgcgcccgttctttgaggtgcaagataaaaagaagacgtttattacgacggtcaagagtgcctcgctgttcttcattctatacccagtgctatttgttttagggacttggttgtaacgaattagtaaagctcacttaatttttcgcacttatcgtggttatttttatgaaagtggactatattattaccagtttataaaataggggtaagcaggatggaaacagaacagcgacagcaacgaagaattgcggtgtatcacttaattgtcacacttttgacactctggtcagcagttaacgtgatcctattatcgtttcatatcggtgattggcacgttgaaacccgcatcagtaacggcttattagtcatgtttgcggtggactactttgtgcgcctaattcgttctcgagatcggaagacttttctcattcattcagcgttcgatttgatggggattattcccatgcacccggtgtttgcactctttcgacttgggcgtttggcacggatggtccaatatcaccatttgttctggaagctcggactggatggtaagtggacgcacgattttcaccgctttatctatagcaccgggtttatctacctgttttcaattagtattgcgattattgttcttagtgcgttgctcttttccgttttcgagcatcaaagcctgtcagattcactgtggtgggccatcacaacggcgactaccgtgggttatggtgacgatacgccccatactgccgttggcaaagtgatcgcggtcgggctgatgttcggtggaattggttttattggtttgttaacgagtacgattactgacttcttcacaacgcaagccagtcagaatgtcacgatcgaggaaccacagcatgatgacgagctgcgacaactactgattaaaattgacacgttgacgacgaaggtcgatcatttacaaaatcaagttaaacgtttagaaaaatcaggctacaaaaaacaacattgaattttcggaccgttggatgcccttaatggggcgcagcggtccgttttgctatgctataataacggtaacaaattcgaaacggtggtggtgagatgggacaagcaataacacggtgggtctggctaccagccccaattgtgacccgtcaatcaacgtttaaaattcatgtgggggatttacagcggcatccagtgccattacgtgccgcacagtggtatcaatttgagcagtcacgaacaaagcgaatctgctcggtgccaatcacaacgactcagtatgcggccgttacgcacttagcagctcagcggcttaaagctggtcaagcgggaatgttaccagcacccgagcagcccgtgatgacccgggggacgacgattacattcacaatgtaaagcggcgtgatgaaagttacttactgtaaagatactttgtgaatggtacttgacggttggggggcacgatgctcacgtgttatattcaggctaatcaaattgccgcgaggtcgcgaattcacgagggagtgatttttcgatgaaaacacgctatcagttacaagtcaagtacgacggaatcagatcgttaacacgttgccgcgtgttggcaatcatcattgcgagtttcacgggttggctgaccggctgcgaattagcgcaggccgccacggtgcctactatgatgcaaacttaccatccttggtccgtacgggggctgaatctagaaagcttgcgtttgctggtggcaacgaccgtcttagggctagtctgttggggcctagccgcttacttaaaacctaaggccaagtgagactgagtaaacaaacgattgttgtctgacccttgataggggacggatgataatcgttttttcttaccgcttatgtggcactgagcggtgtcgttcaatgtgggagcgcccattcccaacgtgcactagcacgccacggacctcgcgcgcagcaggtgagctgaggaaaatgatggcgaccagcaaggcaagtttggtggtcgcgttcacaatttaaaatgatcccagcttgttgattcgctgttagcaattggttgaatgaaccggtgatttttttaatttacatcttattaattaaaaaattgattaacgctaaagctagggctatgctggtaaagacgggtatttgtaaacaaaaatatgggcgcaaggacttgcatataaattaaaatatgattaaaataagtcttattaaattaatggaggcttgcgaatgattagtcaaaaccatcgtttggatcagcaacttattgaacgtgaagaccattatatggcgacggcggcacgaatcaattactatgatttagttattgaccatgctcacggggccatgcttaccgatgttgatggcaaccaatacatcgatttgttagccagtgcttcggccattaacgtgggccatacgcaccctcgcgttgttaaggccattcaggaacaggcagccaagttgattcattacacgccagcatattttcatcatcaaccggaacaacgattggctgagcgactggcaaaatcagctcccggcactgataatgaggtggtttttggtaactctggttcggatgccaatgatgccattattaaatttgcacgggcctatactaaccgacaatacatagtcgcctatacggatgcctatcatggttcaacgtatggctcaatgtcactctcaggagttagcctgaatatggtccgtaagatgggaccgttactacctgggatcgtgcacgtcccgtatcctgattgttatcgtacgttgccgcatgagacggaacatgaacttgcattacgctattttgaagcgttcaaggcaccatttgactcatacttaccagcggaggaaaccgcgtgcgtcattattgaaccgattcaaggtgatggcggtatccgcaaggcaccagcagagtatgtccaattagtctatgatttttgtcaccagcacggtatcttatttgccgtcgacgaggtcaatcaagggatgggacgaaccgggaagatgtggagcattcaaaacttcccgggaatccgcccggacttaatgtccgttggcaaatcactggcttcgggattaccacttagtgcagtgatcggtcgccgtgaagtgatggagagtctagcagcgccggcgcacacctttacgacggcggccaatccggtttgttgtgcggcggcgctggcgacaatcgacgttctagcagatgaacagttggttgcccgttccgccaattatggccgctatgccaaggaacagtttttagcgcttcaacaacgccatcctaaaattgggcaggtacggatgtacgggctgaacgggggcattgaattggtgacagaccggcagagtcagcaacctgatcctgattttgccagtgacgtcatttatgccgcttttgaacggggtgtcgtcatgataacgctcaaaggaaatattttgcggttccaaccaccactagtcatcacgaagacgcaattagatactgcgttaaccgtattagatgaggcaatggctgctgctgaacagggcctggttaaacggccccaaggcaagattggttggtaaaataaggaggattttgatgcaacggttattaaaacggttaactttaaaggaagatccaagcatatatgaagacaaagattctcacctagctcgagtattgacggtcaaggacttcttggctttaggggtggggacgattgtttcaacgtcaatttttacattacccggagtggtggctgcgaaccatgcgggccctgcggtagtcttctcattcatcgtcgcagccgtcgttgccggcctggttgcatttgcttatgctgaaatggcggcggcgatgccgtttgccggttctgcttattcgtggatcaacgtaatgttcggtgaattctttggttggatcgctggttgggcgttgcttgcggagtactttattgcgttggcattcgtcggttcaggactgtccgccaatctgcgggggctcttgtcaccattaggactaactctaccgaaagctttgtcaaatacgtttgggactgatggtggtgtggtcgacctgattgccgtcttggtgattgcgctggtctcgttactgctctcacgtggaatcagtaaggcctcccgggtcgaaaacgtgttagtggtgttgaaagtgttagccgtactcacgtttatcgtcgtgggtgcgacggcgatccacgtgcaaaactacgtcccgtttatccccaagtatcatttaaacgctgatggtagtgcttttgggggctggcaaggaatttatgccggggtatcgatgattttcttagcttatattgggtttgattcgattgccgctaattcagcggaagctaagaatcctggcaaaacaatgccacgaggaattcttggttcactcgtcattgcggtggtactctttgtggctgttgctttggtcttagtcggtatgttcaaatattcatcatatgctaataacgctgaaccagtcggctgggcattacgacaagctggccatccgattgttgccagtgttattcaggccattgccgtgctgggaatgtttactgcgctgattgggatgactttagcagggtcacggctaatttattcctttgggcgtgatggtatgttacctaagtggcttggcaagttacatcataatcaacctaataacgcgctacttgtgttaacaatcgttgctattatcattggggcgttttgcccgtttgcttttctggcccaattgatttcagcgggaaccctgattgccttcatgtttgtctcgctgggaatctatgctttgcggcgtcgtgaaggtgttgatattgcggtaccagcctttaagatgccgttctatccagttttaccagctattgcctttctaggcgcactgttcgtttttatgggcttagatatccaggcaaaattatacgcgggcgtgtggttcatcgtcggcttagtgatctactttagctatggtatgcgtcactcatatttggctgaaaaacgtctgtctaagactgatactgcggctaaatcagcttcgaaggtggctgattcgaccgttgaagagcgtgactgaacttagctaacgcaatcccttgatagttgaacaacaactaaaatggcacttccagaattgaattttatctggaagtgccatttttgagtggtgattacgagctagtgtaaagtccgaaaattaatagtgatgcgcagtcagcaacttaagatacaactgtcgactacttgcatctgaacgattattccgcaatcgcaaaataatcgttcaagtaacgagcaacaccgttttgatcattattataggccgttacatcgtcagccgttgctttgatcttgtcagtaccattggccattgccacaccgagacccgcgtatgctaacatctcgaggtcgttatgttcgtcaccaaaggcgatgatattgcgccgtgaaatttgaaagtaatccgctaagtaggcgacacccttggctttgtggacgcctttggaggtaatctcgaggatggcattcgggccgccccaaacaccaacgtcaacttgatcgccaaagcgttcagtgatccagtcaatgatggcagcccgccgatcaagctggactagcaagacgagggaattcggattacgagtcaacgtatctggtgtaagtcgggggctgtcagcaatctctgggaagaattgaccagcaatcaaatcttgacccgctgtcatggtactgtttttattttctgcaataatttcattgatccccaattgttcgcgatatttaacgagtgctaagacaatcgctttgttgattgtgaactgatattctgaggcccatgtttggtgaggtaaatggcccagagaaccgttaaagttgatcattgggcttttgagacgcagctggtcatagattgcttgtgaaccctgatatgagcgaccagtaataatgctaacaatgtgacccgctgcttgtagtcgttgcatcgtttggatcgtcgctgaattgagtttggattcagcattcaaagtggttccgtctaagtctaacgcaattagttttctttccatattcaacaaacatctcccatatttccggcagttaattaatttaatttagcataaatcccacctaattgcgaatctttgctaccttacagtcggggcaaaatgtggtaatctaattgaggatgctttttaattgaggaggaaatttgggtgcaattaccagcagaatttattcaaaaatatcaacgactactaggcgatcaagcgcccgcttttttggcagctttcgatggccctgttgaaaaagggtttcgggttaatccgaacaagagtgtgacggccacgatgcgcgccaagatgacagcacccgttccgtatagcccaattgggtattatggcaaggtgaacggcaatgcgctggaacacttggctggtgccgtctacagtcaagaaccaagtgccatgaccgttggcgagtttgcaaaaccagaacctggtgaacgagtgttagacttatgtgcggcaccgggtggcaaaacgacgcatctgttaagctatttgcgtcagactggtctactcgtgacaaatgagatcaatcggcaacgggtgaccgcccttggcgataatgtggaacgctacggcgcccgcaatacagtgattaccaacgatacacccgccgcccttgccaaggaattgccaggcttttttgaccggatcttggtggatgcgccgtgttcgggtgaagggatgtttcgtaaggatcatgacgcagttcagtattggacgcccgactatccagcggcgtgtgctgaacgccaacgggagattttgacggaagcggtcaagatgttgcgtccgggtggacatttgatttattcgacctgtacctttgcaccggaagaggacgaacagatgatggcctggctgttaaaaacttatcctgagtttgagctggagccactggccaagacggctgggatggtcgatgcaaagccggaatgggcggatggcaatcctgaactggctaaagcggcccggttatttccgcacttgatgcgcggtgagggtcactttattgccaaattggtctatcatggcacgacggtgggcaaggacaaaaaagtggttcgcgaacagttaaacgccacgcaacggcagctatggacggactttttaaaaaaacaagcaatggccggtttaccacagctcgtgttacaggcacatggtgatcagttatacggcgtgccagcgatgatgcccgttacgcgaaagctcaaggtctttcgccccgggattttattgggaacgtttaagaagaaacggtttgaaccaagttacgcgttagccttagcgagtgatgatttgtccttacccaaaactgaaataacgcgtgaacagtgggcattgtatgtccatggtgagacatttgaattgacaagtgcgcctgtagctggttttcgggtcttaacttgtgatgggttgccagttgggtttggaaaaatcgtcgccaagacggttaaaaatttctttcctaagggcttacggttcttggcgacctctgaaaacgcgacgctctaacctgacatgatattgactaagtcataacgtccgcgtgcgattgacgctgaacaggtgatgagcagcggccgtcatgaatcattcgatccgtggtaaaatcgggggaacgatctacgcaagttgatggtcaaatggacccaatcaatcgtgatattggaggaagagtttatgtattgcccaaattgtgggaaaaagaatgatattgacgcgttattttgtgaaaattgtggtgcgcggctgattatcccagccagttcagcgcaaccaacaccggcgtcagctgtaagttctgctactcaatccacgtcgtcaacggctgcttcagaagcaccgagcgccagtacatcgatttcggctgcaccgactgcacctgaacctggcacccgttcagcgcaacatgcgcgtcaaaatgcgcaaccacgttcaacgtcaaaactgtcttgggttattttgatcgtggtattagccgtggcacttggtggtggctattactggctgggacatcagcgtcagagtaattcgacggcaacagcgacggccaaatcttcgtcgcgcactgctacatcggaaaaagccgagtcgtcatcatcgtccaaggcatctgctagtacggcaactcagacggcattgtggtcgacaaccaagtcgagcgagttagcctcgtttatgtcgtcatggcaagataccatgaaccaatcgtacgaggggacttatgatggtcagtcggtaactattggtgagttgaatttaccttcagacatcaaaaacaatcagtaccaagataagattacggtcaatggtgacacagtcaagctcaagtggacgacggctgctgataccgatgcgaagtaccaagtcgttgccgcggccactgatccgaacgcgtctagtggcgtaattacgtatctgtatgttttccataatggttcgccagacgttctggtctcgcaagacagtgccactgccacaacgtttaacttcactagttcacaaaatacggatttacaagatggctttgcaaagattgccaatgcggattaataactgaattattcggaatcgtgtgtttatgctaagtcggcctgaacacacgatttttttgcgccaatattcgacagaaaatggcgtattggcgctttaaaactgaataattagtgtcgggtaatggaaagcgatgctgatttacaatcgattattgaaaattattatttacccgaattgtcaaatcaag

SEQ ID NO: 3 - DNA, 111299 bp, Lactobacillus plantarum
tcttgaggcgactattatttttatctgatgagtcgttggaaaattagctcaattcttctaaagcttcagcttgttcggtccattcggtttcaacttgttcttgttgagtattgatggcttcaagttctttttgtaggtcttgtagtttaccaacatcggccgatacttcaggttgcgccatttcagtttgaatctgtgtggcttgttcatctaaggcagtcatctgttcttccagggcggcaactgagcgctcaagcttgcgtttttcacgttgttgctgcttgctggcttggtaattttgctggcctttggagcggggagcagcagttgtggcactggttgaatccgctgcaccggcttcagcagctttttcggccgcttggctagcagccgcagccgcgatttcagcttgctcttgtttcttgtcgatgtagtagtcgtaatcacctaagaagagttccgtgccttccggagaaacctctacgacactcgtggcgacttggttaatgaagtagcggtcatgtgacacgaacaaaagggtgccgtcaaagtcgttgagggcgacttccaaaacttcacggctatcgatatccaagtggttagttggttcatctaagattaagaagttgtcattttgcatggcaagtttggtcaacagtaaccgggctcgttctccaccagatagggcatgaacgggtttatcaacatcttcaccagtgaagagaaaactgcccaaaatggtacgaatgtctttttcaggagtggtgggatgttcatcccaaagttcactgaggacggtttttttgtcgtttaaattacgttgctcttgatcgtagtagcccgtaacgacgttggtgccaaaaacggcctggcctttaatgaatggaatctgtcccaaaatactctttaggaaagtcgattttccaataccgttcggtccaacgatggcaatagcttcatgtttcttaatattcaagttgtcgggttccgaaagaatctgaccatcatagcccacggctgcatctttgacggtcaacacaatgttgccgctttgtttagccgcatgaaagccaaagtgggcagtcttctcgtcactatcagggcggtcaaggcggtccatctttgctaactgcttacgccgagcctgggcccgttttgtcgtagaagcacgcacgatgttacgattaacaaagtcttcaagcttgctgatctccgcttgttgcttttcataatgtttccattgtgcttggattcgagccgctttttcttgcacaaactggtcgtagttaccagtgtagtgcaccatttcatggtgtgataagtcatagacttcgttaacgacccggtctaagaaataacggtcatggctaacgattagcagcgcaccagagtaagactggagatagctttccaaccaagtaagggtttcgacgtccaagtggttcgtcggttcgtcaaggataagcaagtcccgtttttcaagtaacaacttggccaaggccaactgggtcttttgtccaccggatagtgccgtcaccgacttatcgtacacatcggcgtcgaattggaagccgtgcaacacgccccgaatctcagcttggtagccgtacccgtttttttgttgaaattcagtttgaatctgatcataggttttcagggtctgttgataagcctgctcatcattcatgattgcggggtcgctcaattgattttcgagctggtgcatccgtttttcgatggcatgtaactcagcaaagacactactcatttcttcccaaatcgtattgttactatccagtccttggtcttgcgccaagtaaccgattgttaagcccttgcgcattgaaatatggccttcgtccggtaccgtttcgccggcaatcattttaagtaaggttgattttccggccccgtttcgaccgacaagggccacccgagcgtgttcttgaatatccatttgtacgttatcgaacaagacatcggcgccaaaacgccgcataacttgctgtacttgtagtaaaatcacgctttattaagctcctttcacatttaattcgtgacataattgtagcatattgtaacggcctgacccaattattcggaataataagtaattattatttcacaaagtcacgcgttatgctagaatagtgtcagcaaattcacaaacttttaattaggaggacacgtccgaatggcagaaacaaaaattccacgggcaacggcaaaacggttaccgatttattaccgctatttaaatatcttgctagatgcagataagaagcgggtctcatcgaccgagttgtccgaggcggttaaagtagattcagcaacgattcggcgagatttctcgtattttggggcgctcggcaaacgagggtatggatacgatgttgaaacgttacttgcatttttcaaaaagattttaaatcaagacaccttaacgaatgttgctttaattggggtcggtaatttgggccacgccctactgaactttaattttcacaaaaacagtaatgtccgcatttcagcagcatttgatatcaacgaggcgattgccaatacagtccaaagtggggttccagtgtacccaatgacggagctcaaaaagcaattgatcgaacaacagattgagattgctatcttaacggtgccaaccacggttgttcagaaaattaccgatgacttggttgatgcaaacgtcaaaggaatcatgaactttacgccgttacgaatctccgttcctgagacagtacgggttcagaacgttgatttgaccaacgaattacaaacattgatctacttcattgaacattacggtcagcaattaggtgacaatggtaatgacgatgaaaatgagactgaagattaataactcgctttatctttgaaattaaatggctataaaaaggcctctctgaattattcagggaagcctttttaacatacttagatcacgaatcattgattgtaacgtataaatattcggtgaaaattaacgttgaaacgctaggttagcgctacctagtaatgatactagtgcagtaagcctaataatgtgggtaacacaaccgatgcgttcattaggatgtgagccgtcatcgatgtttgaatccgaccggtgtgctggtataaccagcagaataataacccgataaaggcatagaggataaagtgaccatccgcatgtgcaaagctaaatagcacactagaaatcaaggccgccccaatctgaccagtaaccgcacttagattgccaaagataactttgcggaagacgatttcttccataatcggggcaccgacaatgatggctaagaagaaagcgggatattgttgcccaacagttaagagggtggtcgtgttggttgacgctgttgactgtcccagtaaagccgtcatttttaaaatgatgacttgaccaacgatgactaggacaagaccgatcaatccccagatgaacgtcatgaaccagttacttggttgtttttcaacaacgttttttgtccgcatgcgactcgccaaccagatgagtaggattgcaccgactaagtagtcgaccgtttgaatcacgaatacttgggcccctagctgatggaaagcagtcacaaggacgctcggtagtgcgtaaataataaagtagatgataagaataaagattgattggcggcgattaaccatcaagtcacgtccttttaaaagtttgatttaagatttattgatacttcaatagtattcattatagtcgatttgacattctttgactaataattgacaaatcacttgcaatcttgaattaaaatgatatagttgacaatgtaattagcacttgaggttgaggagtgctaaaaaagaataaatggagggattcacgtgttaaaaccattaggagatcgcgttatcttgcaacaacaagaagaagaagaacaaacaattggcggtattgtcattgccaataacgctaaggaaaagccccaaagcggtaaggttgttgccgtcaatgacggtcgtgttttagataacgggacaaaagttgaccccagcgtgaaggtcggcgatcaagtattattcgataagtatgccggtaccgaagtcaagtatcaaggtgctaagtatttggtattgcacgaaaaagatattgttgcaatcgaagactaatccatttaaattgcgcaacttaaaataaattaaattcatgaggtgaatagagataatggctaaagaattaaagttctctgaagatgcacgttcagcgatgctaaaaggtgtcgatcaattagctgacacagttaagtcaacgttaggtcctaagggtcgcaacgttgttttggaacaatcatatggttcaccaacaattactaatgatggtgtaacgattgctaaggcgatcgaattagacgatcatttcgaaaacatgggtgctaagttagtttctgaagttgcttcaaagactaatgacatcgctggtgatgggacgactactgcaacggtcttaacacaatcaatcgttaatgaaggtatgaagaacgttacggccggtgctaaccctgttggcattcgtcgtgggattgaagaagctactaagacggcggttgactcattacacgctatggcacacgaagttaagacgcaagaagatattgcgcaaatcgcttctgtatcttcagcaagtgaagaaactggtaaattgattgccgaagccatggaaaaagttggtcatgacggtgttatcacgattgaagaatcacgtggtgttgatactagcttagacgttgttgaagggatgcaattcgaccgcggctacttatcacaatacatggttactgataatgataagatggaggcggatcttgacaatccatatatcttaattactgataagaagatttcaaacattcaagatatcttaccactattacaatccatcgttgaacaaggcaagccattgttgatcattgctgatgacatttctggtgaagctttaccaaccttagtcttgaacaagatgcgtgggacgtttaacgttgtcgccgttaaggcacccggttttggtgatcggcgtaaggaacaattacaagatatcgctatcttaactggcgggacggttatcactgacgaccttggccttgaattgaaggacacgaccatcgatcaattaggtcaagccaacaaagttacggttactaaggataacaccaccattgttgaaggcgctggttccaaggatgctatctcagaacgggttgaatttatccgtaaccaaatcggtgaaacaacttctgactttgacaaagaaaagttacaagaacgtttagctaaattagctggtggggttgccgttgttcgtgtcggtgccgctactgaaactgaattgaaggaacgtaaataccggattgaagatgctttgaacgcaactcgggccgccgttgaagaaggctttgttgctggtggtggtactgctttgattaacgttatcaaagatgttgctgcattgaaggaaactggtgacgttcaaactgggatcaacattgttaaacgtgctttggaagaaccagttcgccaaatcgctgaaaatgctggtttggaaggctctgttatcgttgaaaagatgaaggaacaaaagccaggtgttggtttcaacgccgcaactgatgaatgggttgacatgatcaaagctggtatcgtggacccaactaaggtaacgcgttctgctttacaaaatgccgcttctgtttcagcccttctcttaacgactgaagccgttgtcgctgaaaaacctgaagaaaatgcaccagctgcaccagccgcaccaaacccaggtatgggcggtatgatgtaaacaaatcgtaacattaagcacttactcggctgagtaagtgcttttttagtgctgttagggtgtgaatcgactagaataaaggtattgatttatccatattagagcggtaggattagtcgttaacgcaaaatgtgggtgcggtgaagcacccgacatttaactggtagtatttggcagggtaaagtagtagaatctactttgactcagtttactttgggataattattttggaataaaggagttattatcatgtggcgttatttaaagcggttagttattgggaaaccgttaaaaaccatggacgagggtgggcaagcactcaccaagttcaaggcactggcgctgctatcgtcagatgcgctatcatcggtggcttacggtactgaacagattacgaccgttttgattacactttcagcggccgcgttgatgtatcaattgtacgtggcggcgcttgtgttagtgctgttgtttgctattacgatgtcgtaccgacaaattattcgggcttatccatctggcggtggcgcctacgtggtggcaagtacgaactgggggcggccagccggattagttgccgggggatcactgctggttgattatatgctgaccgtagcggtttccgtcacttctggtactgaagcaatcacgtcggcgattccggcgctagctaattatcaagtattgattgccgtactgattgtcatcgccatcatggcgttaaatttgcgtggaatgcgcgaatccgcatcattcttaacgtttcccgtttattttttcattattatgattatcggcatgattctatggggcgttatgaatattgcgagtggtaacttaacttaccacgcctccgcagcagttggagcaccggttcaagggatgaccttggtgctgttcttacgggccttttcttccggttcgtcttcgctgactggggtggaagcaatcagtaatgcggtgccaaacttcaaacgaccgaaacgcaagaatgcggcgaacacgttagcaattatgtcattagtcttggccgtcttctttggtggtattacttatttaagttattacttaggcgttaaaccacaagtagacaataccgtcttgtcacaaattgctacggcggtctttggtcacggcttattctactacttgttacaattatcgacggcgttaattctggccgttgcggcaaatactggtttttcagcctttccaattttagcttataacttggctaaagataaatttctaccacatgcttacatggatcgtggggaccgcttgggctactccaatgggattatctcattggcggtcggggcaattgcgttgatctttatctttcatgggaagacgacgcttttgattccactttatgcggtgggggtctttgtcccatttactttgtcgcaatctggtatgattattcattggttccgcgaacgggggcaatggtggtggatgaaggcggcggtaaacttacttggggcgttgatttcgattctcctagtgattttcctattcttgctacatttcggcaatgtttggccatacttaatcgttatgccactcttactgtacatgttctaccgaatccacgtgcactataaccgggttgcggcccagttacgcgtggttgccaaggaaaaagcgacgattcatgattatgacggtgcaacggtgatcgtcctcgtctcgaatgtgacgcgggtaactgctcaagcagtcaactacgcgcgatccatcggagattacgtcattgcgatgcacgtgtcctttgatgagaaccctgaaaaggaacacaagacggcggcagagttcaaagagaccttcccagacgtccgtttcgtggacatccattcgtcgtatcggtcgattgcaacaccgacgttacgattctgcgatgtgattgctaaacgagcagcggaacgcaacttctcgacaacggttcttgtcccacaattcgtgccgaagaaaccatggcagaatattttgcataatcaaacgagtctccgattacgagcggtattaaattctcgtgaaaatattattgtttcaacttataattaccatttaaaagaatagtgacttagtattgaaacccggtatagctaccgggtttttatttttgtgtcataatatgagtaactaaggttataatttagatacttaatcagcccagtgaccggcaaatgtgaacgaattgtgttgcctttactaagttttagtgaagcgagttgtcaagcgtcactgggatttgtataattatcgtaatagagtgagaagggagttacgcacaaatgatcagatttgaaatcctagtaagcctagtggcgaccatgatactttctgcgatcttgacgccgtttgtgcggaaacttgcatttaaaattggtgccgtggataaaccaaatgtacgacgggtcaataaaattccaatgccgacaatgggaggcttggctatttttatctcttacaccgttgggacgactgtgttgtatctcatgcaccagtttcccagtcgcatttttttcgcactactcggtggtgagctgatcattattgcgactggtgttatcgatgatatttatgagctaaaaccacggcaaaaaatgttagggattacgttagccgctttggaggtctactttattggtggtatccgaatgacgaccttcacgttcccgttgctggggctgattcactttcagtggctgagtttaccggtgactttactgtggatactggctatcacgaacgcggtgaacttaattgatggactggatgggctagctaccggtgtttcgattatttcgttgagtaccatggggatcatcgggttgttcttcttgaatgctaatatgttcgtttcgttgttgatttttactttagttgcggcgatgattggctttcttccgtataatttctttccagctagaatttatctcggtgataccggttcgttgtttatcggttttatgacggctgtgttctcattatttggattgaaaaatgtcaccttaatctcagttggtattccggttatgatcctgggagtgccaattacggatacggtgtatgcgatgattcgacggatcctgaataagaagcccatttcgcaagcggataagcatcatttgcaccaccgcttgatgcaattaggattgacccatcgacagactgtgatggtaatttatgggattgcacttattttctcatttatttcattgctctatccgatctcatctatttggggttctgtgttattgacgattggtttattatttgggctagagttattcgttgaagcaatcggattagctggtgacaatcggcaaccgctactggattggatcaaacggaccgtcgcgcgtttgacctccaagagtaatcattaaaaaccaaataaatcattgaaaattattaaagtgttacaggcatctaccgtgtgattagcggtgatgcctgtttttagttggtcatcagttggttcatcaattttaactttaccaaaactatacaagcaatttacacaatcgtcattcacaatttacaaacgattagtaatattaagcatgttccgaagcaatcaattacgtgtaaccgtcggatggtgatgttgctccatcactagtcgtagcactcctacccagttttgctatgatggttgccgggttggttgcttaattttgatagtcaattgaagaaggggagtttcaattatgaaaaaagcactgacactcggcgcattggcagtaacgatgaccattttactagctggttgcggcagtagctcagccacaagtacgaagagtactagtagcagtagtggtagttccaagactactaagatcgttgcaactggttcaaccgctttacaaccattagtggaacaggctggacaggcttaccagaacgaacatgctaacgtgaccattaacgttcagggtggtggttcaggagcaggcttaagtcaggtggcgaagggttcagtcaatattgggaactctgatttatttgcacaggaacaaaaggggttagacgccaaagggttagttgaccataaagtggctgttgtggggatggcacccgttattaataaggatgccggtgtcactaatatttcaaaagaacaacttatcaagattttccaaggcaagatcactaactggaaagatgttggcggtaaggacgaaaagattaccgtcgttaaccgtgctcaaggtagtgggacccgggcgacgtttgaaaaatggggattagacaacgcgaaggtcgcaactagccaagaacaagattcgaatgggaccgttcaaaaaattgttagcaccacgcctggtgccatcagttacttagcattctcatacgttaagagtgacgttcaggcgctttctattgataacgtcaaaccaaccgaagctaacgtagcgacgaacaagtggaagatttgggcttatgaacacatgtatactaaggggcaaccaactggggagttgaagaacttcttaacttacatgacttctaaagccgttcaaggtagtttagttgagaaattaggatatattccattgacttcgatgaaggttgatcgtggccaatctggtgcaatcactaatttaaaataaataacagacaaaaagtcgagcgatagctcgactttttttatgggccgcaattagtgcaacgcggactttaacaatgaaaaaacaaatcatcggctcaagtgctgggtgttattgttaagacgagttggctgtttcgattttgactgccaatcaaagtttgtgaggctcccaattatatataaccagcaatctagttgccaggcgtagtgaccggaatttctgtaaattgttcaccttgctccgaaaaggtaacttgaccgctcaagaggttagtgatgtcctgctgaatcgttgcaatttcggattgagtgactgcgatgatttgtgtgacttgaacaccgtagtcggtattcagagtcgttagcttattttgttgtaaatagtaggttaaagcatcgacgttacgatagtcgagcgtgatggcgatgcgggtttgtaagattcgctgaaccttaccactgacttcaattgcttgcgcgggggtgccattataagctcggatcagtccaccggcgccaagcttgataccaccaaaataacgggtcacgaccgcaagcacgtcgtgtagctcgttggtcttgagcacttctaagattggtgagcccgcagttccgaccggttcaccgtcatcactcatccgctgaatatgatcatcatcaccaagcatgtaggcgaaacagttgtggttggccttaggattatctgctcgaacagcggcaatcttagcttgagcatccacttcgtcactgatgcggtatagatgagcgatgaagcgagactttttgatggtttgttcaaataccgtgtcttgggtgatggtgtagtagggtttagtcaaattaatcggttcctttcgtgaataaatcgttaaatggcgtacttgataactaaggaggtgcgcacgatggaagcacaagtcttatacggtcgtcagctcgcattatctgcaaatgaggctgccgcagtacctgctggcacgcagatactgccagccatgcaggttgatgaacatcaaattatctgtcagcgttgcggcagtcacttggaccgactgcgagcccaattacccaatcagcaatattactgttatcaatgtttaaatttaggtcgagtgagtacactagttaaactctatcatatgccagaaccgaatgcttttgcaacggtcccggtttgcacgtggcaaggaaccctaacgccccagcaagcggactgcgcgcaatcaatcaaagctaacttcatggcgcataaacggcaattattatgggcggtgacgggagctggaaaaactgaaatgctgtttccaggtattgcgtgggcgttagcgcatcagtggcgggtcgccattgcttcaccacgagtcgatgtttgcttagagttagcaccccggctccaggcggcctttgctgatgttcaaattgctgtgctacatggccgcaatcccgatccctatcagtatacgcagctgacgatttgtacgacgcatcaattgctacgttttcgtcaggcgtttgacgtattgatcattgatgaagttgacgcgtttccgtttgctgccaatccccgtttggcgtttgcagtgaatcaggcagctaaggtggagggggccattctttatttgaccgcgacgcccagccaaagtttgttgtcccaagttcatcgtggtgagcttgcaatcagttatttaccattgcggtttcaccaacatttattaccggcaattaaggttaagctacagccaaattgggctcggctgttgcaacaaggaaaattaccacgagaccttatccggcaactccaacagtatcaacaacagcaccagcgctttttactatttgtcccgcgcatccaacaattagcgccagtgtttgcggtactccaacactattttccccatatgaccggagagacggtgtactcagccgatcctgagcgactgactaaggttcaacaaatgcggaaccagcagtttcaatacttagttacgacgacgatattggaacgaggggtgacgtttccgggaatcgatgtgattgtgcttggtgcggacgacgaagtgttttctacggcggccctcgtccagattgcaggacgggtcggacgcagcagtgagcgtccgactggcctcgtctggtttatttgtcacagtcatagccgcaatatcaaacgcgctcagcgccagattcgggtgatcaatcgaaaggggcgacaattacgtgctagcatgcctactgtgtcacaacattatcacgactaagtttacgttgccctggattcttagttggcagccggttatgcggccggtcgtctgctcggtttgttggcggcaatttgtacgcatcgatcgggcaacggcatgttccaaatgtggacgtgctcaaaaacgaccacaaccgtgtacagattgtcagcggtggcctgaaatcggtccctttcataacgaggcgttgttcgaatataatgatgcgatgcatgattattttcaacgctataaatttcagggtgattatcaattacgccaagtttttgcgaagatcatgcaacaagcagtggtacaacggtgtgctgagatatgcttagtggtacctgtcacgcccacaacattgcaaacacggggctttaatcaagttgccggctggttagccgcacccctcgcgcccgggttaatgacccaggcaacagcgaagtcagtgccacaatctaagaaagaccggcaagcgcggttgagaacaccacaaccattcaagatggctcctaatacgattttggccggccggtattattagtagatgacatctatactaccggccgaacgatgcgccacgcggcaacgctacttttggaaaacggtgccaagagcgtgacggggctaacgctagcacgttaatttcgagggaaagtggtatttggattgtttattatagcgctttctattataatgaatttaagcaaagtaattaaagagtggtcctttaattactttgggtaaacagcaatgtgtgtgaagggagagaagatctatgctaaattttaatattcgcggtgaaaatatcgaagtgacccaagcaattcgggactacgttcaaaaacgggtgggtaagttacagaagtactttgacaataatgttgactcaattgcccatgtcaacttaaaagttcacccagacaagacggctaaagtcgaagtcaccattccacttccctatttagttctccgggcagaagaaacttctcctgatatgtatgctagtgttgatttggttactgacaagttggaacgccaaatccgcaagtataaaactaaagttaaccgcaaatcccgtgaaaagggttataaagcgattgattttgcagcgactgatgaaacagttgccgctgccgacaatgatcaggacgataagttagacgttgtacgtacgaagcgagtggctttaaagccaatggataatgaagaagcgattctgcaaatggatatgctcggccatgacttctttatctacgaagacgcggaaacggacgcaattaacatcgtctatcggcgtaacgatggtcgttacggtttgattgaaaccgacgacaatcactaattttaaaagcgcaacttataaggactggtcagttgaccagttctttatttttatcccggaacgcccgtataacatattgtgatcatgagagtgacttagcccgcgttagtaagctgaagttcgactcacggcacgtttttgccagcgactcaagacagttaagcaaatattgatagaattaaagaacacgggtcagtgattgttgggctgtggttaaagactaatatttagttaaggatgtaaataaaacggtcgacggtatcggttacataggggcctgtggttttcattgctagtaaataatggtaaaatgacagatggtattttattttgaaatggacaattgaaattaaaattaagattaattatttggagaggatacgtaaatggccaacattttaaaacgctgggttgaaagcgacaagcggactattcggcgtctggataagattgctaataaagttgaagcttatgccgacgaatacggcaagttaagtgatgctgacttgcaagcgaagaccccagaatttcgtgaacggtacaaggagggcgaatcgctcgacgatttgctgcccgaagcatttgcaacggcgcgtgaaggtgcgaagcgggtacttggtttatacccattccacgttcaaatcctcggtggaatcgttttgcatcaaggtgacattgctgaaatgaagactggtgaagggaagaccttaacggccactatgccagtttatttgaatgccatctctggtaagggtgttcacgttgtgacagttaatgaatacttatcagcgcgtgatgcgactgaaatgggtgaactgtataactggttagggatgagcgtcggaatcaacggggctgaaaagtcgcctgaagaaaagcgtgccgcttataacgccgatattacttattcgacgaacggtgaaattgggttcgattacttacgtgataacatggtggtctaccgtgaagacatggtgcaacgaccacttaattttgccatcattgatgaagttgactcaatcctaattgatgaagcccggacaccattgattatttctggtcaatcagaaggtacaacgggaatgtataagcgggctgaccgttttgctaagacgttgaagaaggatgaagattacaaggttgacttggaatctaagacggtcgcattattagacgaagggattcggaaggctgaaaaatactttggcttggaaaacctttacgatactgataatacggcgttgaaccattacttggatgaagctttgcgtgcgaactacatcatgttgaaagataaagactacgtgatttcagacggtcaggcgttgatcgttgattcctttacggggcggatcatggatggtcggcggttctcagacgggttacaccaagcaattgaagctaaggaacacgttgagattcaagaagaaaccaagacgatggcaaatatcacgtaccaaaacttattccggatgtacaaaaagttatctgggatgactgggacggccaagacggaacaagaagaattccgcgaaatctataacatggaagttattacgattccaacaaaccgcccgatgattcgtgatgaccgttcagatttgctttacccaacgttacaaagcaaattcaacgcggtcgttaaagaaatcaaacagctccatgaaaagggccaaccaatgttaattgggaccgttgccgtggaaacgtcagaatacttatcgcatcgtttggatgaggaaaacattccacacgtggtcttgaacgccaagaaccatgcgaaggaagctgacattgttgcaaacgccggtcaacgtggtgcggttaccattgccaccaacatggctggtcgggggaccgatatcaagttgggacctggtgtcaaagaagtcggggggctcgccgttattgggactgaacgtcatgagtcccgccggatcgataaccaattgcggggccgtgctggtcgtcaaggtgatcctggtatgtcacaattctacctctcacttgaagacgatttgatgctacggttcggttcagaacgaatcaagaacttcctgcaacggatgaatgttgaagatgatgatgcggttattcaatcacggatgattactcgacaggttgagtccgctcaaaaacgggttgaagggaacaactatgactcccggaagaacgttctacaatatgatgatgttatgcgggctcaacgtgaagtgatttacggcgagcggcaacaagtcattatggaagaaaaatctttaaagcccgttatcatgccaatgatcaagcggaccgttgaacggaccgttcagttacacatgcaaggcgatgccaaggactgggatttagatgcagttgttgactttgcccaagctgctatggtgaaggaagattcaattagtgtggctgacttgaaaggtaagtcgccagcagaggttgaagcttacttgatggaccgggtcgataagatttatgcggacaaggctaaacagctttacgatgcgggtcagatgctagaatttgaaaaagtcgttattctgcgagtggtcgattctcattggacggatcacattgatgcgatggatcaattacggcaatcgatcggtttacggggctatggtcaattgaatccgttagttgaatatcaacgagacggttaccagatgtttgaagaaatggttgcggatattgattatgatacgacgcgactcttcatgaagtctgaaattcgccaaaatattcagcgttaaaatttaacgttagtgctagcgagtctaagactaaggtcttaggctcgttttacagttaaaccagatattaaataattaataaataagttgaaagaagggtcctttgtggaattaagtgaatataaacacctgattgaagaaatgcaaagtgctgtcgacgactttagggggtcgctttgacttagatgctttgaacgaaagcattcaagaaaatgaagctcgaatggccgaacccggtttttgggacgaccaggctgccgcccagaaagtcatcgatgagaataacgtgttgaaaggaaagtatgatacgtttaagcaattagctgatgaagtcggtgacttggcagtcgcttatgagttactgagtgaggaacccgatgctgagatgcaggctgagtttgaaacggactttcagcacgctgaacatgatttacaacagtaccggctcaacttacttttggacggtccgtacgaccgcaataatgctattttagaaatccatcccggagctggtgggaccgaatcccaagattggggtgcgatgctactaagaatgtacacgcgctgggctgcgagtcacaatttcaaagtcgagactgttgactaccaagctggtgatgaggcaggcattaagagtgtgactttattaattagcgggcacaatgcttatggttatttgcggtcagaaaaaggggttcatcgtcttgttcggatttcgccgttcgatgcggctggtcggcgccacacatcttttgcgagtgttgatgtgatgcctgagttagatgataccgtggatgttgatattcgacctgaagatttgaagattgacgtttatcgagccagtggggccggtggacaacatgtcaacaagacttcttcagcggttcggattacccacgtgccaacgggaatcgtcgttgccagtcaagcacaacgttcacaattacagaaccgacaaacagcattgaacatgttgcgagcgaagttgtacgaacgtgaagaagagaagaaggctaaggaacgggcggccatccaaggtgagcaaatggacattgggtggggctcacaaattcgctcctacgtttttcatccgtatacgatgatcaaggatcaccggactaattatgaatcacatgatggtcaggctgtcatggatggtgatcttgatccgtttatggatgcttacttacaatggaaattagcccaacgtaatccgcaatagattgcacaaatactaaggtgacctatcattgcgcaggtcgtcttagtatttttttggctactagtcttataatatagagatattaaagcggtaatagcaggactgacggaattgaaacggcgttggtctccttgggcaaaaatgctatactaacttcagagtttaacgttaggggtcacgcacatgcaggtattaaagatttttgaattgtttcttttacaaccgctagtttggttaggattgctgcgtagttatttaaccgctaaacggcgggtgaagagtgaacggcagcattttcagagtgctatcaacccacaattagttgaagtccaccactttttagtggatggctgtttactaggagttctaatgacaattattagcttggcattgggattagtggtggcccccatctgggtggttatatacgaagtagtggcggccattagcttgatcattattcctggtgcactggtaccagtgaccgcttttggcctcagctggttagtttattggattatgagcccggaattaacgacggtggggggcgctttacaacggcacggtgttgccatgaccagtatgagtggcaatttggtggtgaacggactattgttattagccatcgtgctggcggctacggcggtcttgttacgacactatgattatgagggccgttcaccgcaactacagcccgaccaacgtggaaagcgacttgttcgttaccagtggcaacaattgttggtcttaccagttggggtactggtccccggtgattggttacacgcaactatcagttggtggcctgtgtttatggttggcgagcgctccttcagcattttattgttgcctttattagttgggacgagtgttcgcgtttataagcagctgccacaaattgcatggcggcagttagcggcccgctatggttgggtaacactcgcgagtgttttggttgcaatcattgcccgttttgcagtgctcagcccgcagtggttgctagcattgatgggattaatcgttgtgctaacttggggaatcttagcacagcaccgttattatgatcgacaccaacagtttcgatattctgatactgaacaaggtgtgcgggtgattgggttacgcccccacacgcccgcggataaattaaatctcgatttaggagatattatcttggaatgtaaccggcaaccagttaatacggaagctgaattttacgcggccctactgaaaagtccgacgtatgttcacctcaaagtgcgcaatcggcaacaggaattaattattaccgaaacggcgatctataatggcgccccacacgagttaggaattgtgttattcactgatcaggaggattaatgaccatggataagattttagtggtagacgacgaaccagctatcgtcacgttattatcatataacttgaagcaggcggggtacgaagttgtgacggcgacggatggtgcggacgcgttgtcattaggcctggcccaatcatttacatgtattttgttagatttgatgttgccgaaactcgatggaatggaagtaacaaaaaagttacgacaagaaaaggttcagacgcctattattattgtgacggctaaaaatgatgagtttgataaagtgttcggcttggaattaggtgcggacgattatataaccaagccgttttcaccccgcgaagtgctcgctcggatcaaagcagttattcggcggacaacgccggacgagcccgtgacaccaccggcacccatgccgcctgctaatcgtgcggtaatgcttgttggtgatttacagattgatcaaaacaaataccgagtcgcgcgcaacgggaaaaatatcagcttgacaccaaaggaatttgaattacttgtgtattttgttgaacgagaaggtcgggttctcagtcgtgatgcgattttaaatcacgtctggggctacgactatgctagtgagacgcggatcgttgatattcacatctcacatttacgtgaaaagattgaagcagatcccaagcagccacggttgatcaggacggtccggggttttggctacgaatttgtgggtgacggccatgcataatcgctggcaacagacgacacggttattgctcatggaaaatgtattactggttttgatcgtgttggtcgtgttgcagcacttttcgccaattaagtggtcctggcgcctagtcggttgtttagttggtgcttggctggttttggcagtaatcgagggcttgatcgcttggcggcaacaaagtgaacggcagcgcacgatcgaccgtatggaagctaagcttcgtcagatgagtagccagcaatttccaccacatatcttattgccacaatcggaccccttatacagcctagcacaagcggtcaaccagttagagagttatcaaaaaagtcagacgcgccgtgcggaactgcaagaaaaagagttaatgatgattatgcggtacttgcctgtgggagtgatggtcattgaccaccggcgacaggttcaactgtctaatccggcgatgagtgaactattgcaagtctcggttaatacggtggcccacatttataccaaggatattcagctgtacgcgttgactaaattgattgaagatacgattactagtggcaaaaatcaacgggcaacgattacgttgactccagcgcctaacacgcaggttgtcgaggcttcaaccgtttatatccaaggcaatcgttcacaatttcaaattgtcctgatgttgtatgatatcactgaagtctatatgattgaacaaatgcaggatgattttgtcagcaacgctagccacgagttgaagacgccgattacagccatttccggtttcactgaaacgttgttaagtggtgccaaggatgatccggacacgcttgaccaattcttgcatattattgcggatgaaagtcaacggttgattgatctcattcaggatgttctgtcgctatcgcgaattcgtgctcagaatacgacgatgttaaccttagttccgcttgctgttcgaccattgatcgaacaggaactggctgtagttcagcaggcaatcgaacgtcagcacttaacgatcaataaccaagtcgatgctgatctaatgataacgagcgattcacagaagttgagtcagatcatcaaaaatctgttaacgaatgcaatcaagtataatcgacctcatggtagcgtgacgattgccaccatggtcagtcatcaaacgtggtcgctgatagttaaagatacgggcattggtatcagtgccgatgatcaacagcgtatttttgaacgcttctatcgggcgagtccgtcacgttcacagcaacttgtgagtgggactggactcggattagcgattgttcaagaattggtcaacgcaatgcacggaacaatcgacgttgtcagtcaacggggcgttgggacaactatgacagttacattgccactagctgcgagtgcttccgagcagtagtaaggcgttaagcatacggacagttctgattgtaactggtggtctatcaaatgatgacgtggtgacggtatgagttgcattgctgagtcaaaagatgtcattagttgagcattgaatgtgtcgtaattaagccagacgaattgataacgatttttaaggtaaatgtaaaccttgaaaatcgttttttttgtgcacttttttaattttcctttcatattgggggctaaaagccggtaataattaaaaatatatcgacgtttacacaatctttacaaaactcatataaagcatttacacaaactttgtattattgaatatgagcaatgggtaggaggtatatagttatgagaaaaagtcgggtcatccaattaatcgtgttaatcgcgatcattggactagttggattagggtacacacatcgcgatcaaactagtgccagtgaatcaattaccgcggttggatcaacggccttacagccactggttgaagcagccggtgaacaatacagcagcaaccataccggtgtgtttatcaatgtgcagggtggtggctctggaacgggactcagtcaaattcaggcgggggccgtggcaatcggtaattctgatatttttgccgaagaacagtctggcattacagcgagcaagttaattgatcaccgggtagccgtcgtcggtattgcccccatcgttaataaaaaggcgggcattaccaatttgacgcagcagcaactcattcagatttttactggcaaggtcacgaattggcgtgaagttggtggacgtaatttaccgattacgttaattaaccgtgctcaaggctccggaacccggaagacatttgagcgatacgccttaaagggtaatcagagtgttgattcccaagaacaagattcgtcaggattagctcggtcaattgttgctagtacacctggcgcaattagttatgtggctttttcttacttagacaactcagtccagaccgtcaatgttgatggtattcggccaaccgaaaaaaatgtgcggaataatcgctggtacatctggtcctacgaacatttatatacggggaagcaccccaatcagttaaccaaaaaatttattgattacattttatcaaccgctgttcagcagaagttagtcaagcagttaggttatatttcggtccatgacatgcaagtacagcggaatgcggccggtaaagtttcagttatgaaatgagggagagcgcatggataaaattcgagaaagcttattaaaaaaatcagttgctagtaaaattgaacggcgtggtaaggccattagtctagtttgtctagcgctaattgtcgggattgtctttttgattttctactttgttgcatcacgggggttagcaaccttttttcaaaatcacattaatctatggcaatttctgagtgggacgcagtggaaccccggaacagtcggaacgaatggacaaccagctgtgggggcactaccgatgattgttggatcgtttttgattacgattctttcggccttcattgccacaccgtttgctatcgggacggcggtctttatgaccgaaatttcaccacggcggggggcgaagattctccggccagttacggaactattagttggtattccatccgtagtgtatggatttatcgggctacaagttgtcgtaccgtttgttcgtaatacgtttgggggtagtggctacgggattctttctgggacctttgtgctatttgtcatgatcttaccgaccgtgacgtcaatgacggcggatgcgctgaattcggtaccccgttattaccgagaagcctcgctagctctagggtcgacgcgctggcaaacaatttataaagtcgtcctgcgggcagccattcctggcatgctgactgccgtcgtatttgggatggcccgcgcctttggggaagctctggcggtccaaatggtgattgggaacgcgacgttgttgccgcataacctagtttcaccagccgcaactttgacaagtatcttgacgatgggaatcgggaacactgtcatgggttcattacaaaataatgcattgtggtcattagccatgatcctgttattgatgtccttagtctttaacttagtcattcgctacattggtcgaaaggggaaattaaaccatgaacgctaaacgcatcgataaaattgccactggcgtgctatacggcgtcgcagcctttgtggtcatcatcttagttgccctattgggatacattctgatccaaggggtgcccaaaatttcgtggcattttttaacgtcgccggccctggcttttgaagcgggtggtgggattggcattcagttgtttaactccttctacttactatttttagcgttattgatttcattaccgatttcactgggtgcggggatctatctaaatgaatatgcgccgcaaaatacggtgactggcctgattcggacgaccattgaaattctgagttcattgccatccgtagtcgtggggctgttcggatacttgttctttgtagtgcagttcaagttaggcttctcgattctttccggggcgtttgcgctgaccgtgtttaacttaccgattttaacccggagtattgaggaagcactcgccaatatctcagataatcaacgggaggccggctacgcgttagggctatcacgttgggagacggtgacgaagatcgtggttcccgctgccttaccaagcattttaacgggggtcgtcttgagtgccgggcggatctttggtgaagccgcagctttaatctacactgcgggtcaaagtgcaccagccttggactttggtaactggaatccatttgatatcagtagtccactcagtccactacgtccagccgaaacgttggccgttcatatttggaagatcaactcagaaggaattatgccggacgcgaaagccgtttcggcgggggcttcagccgtattaattattgcggtattgctctttaacttcttagctcgttggcttggcaaacgcttgtacaaacacttaaccgctgaataaaggaggccgttttgatggcagataacacaatgacgacgacacaacgtaacatcatggcgtttgatcctaaagatcatgaaatcgcgctttcaactgaggatttacacgtcttttatggtaaatccgaggctatttcagagggcgatttacagtttgaacgttataagattagtgcgttgattggcccatccggttccggaaagtcaacctacttgcgttcgctaaaccgaatgaatgaccgtattgcaacggttaagggcaaaattatgtatcgcggcttagatattaacagtaatgatattgatgtctatgagatgcgccggcacattggcatggtgtttcaacggcctaatccgtttgccaaatcaatctatgagaatattgcttttgcactccgccagcgcggaatgaacaagaaacaagacttggatgaaattgttgaacggtctttacggcaagcggcgatgtgggaccaagttaaagatgacttaaataaaagtgcgttagctctgtctggcgggcagcaacaacgactctgtattgctcgggcaattgcaatcaagccagacattttactgctcgatgaaccagcgagtgctttggatccagtatcgacaagtcaaattgaagatactttgttagaactaaagcagaattataccattattattgtgacgcataatatgcaacaagcatcgcgaattagcgactataccgcgttctttaacctcggcaaagtcctagaatactcagagaccggtgagatttttaccaatcctcaggttgatctgacgaatgactatatttccggaaactttggataggaggaccgttcatgagtacaattttaacgaccgagaacttatcattattttatggtaaaaaagaggccctcaaaggaattaacattgattttgatgataaaggaatcacggctttgattgggccctctggctgtggtaaatccacctttttacgttgcttgaaccggatgaacgatctgattcctaatgtaacgatcacgggtgaggtgaacttcaatggtcacaatatttatgcacccacgaccgatacggttcaattgcgtaaagagatcggcatggtgtttcaacagccgaatccctttccattctcaatttatgagaatgtcatttacgggttacggttgacaggagtccatgataaagaacgcttagacgcggcggtagaaagaagtctgaagcaggctgcaatttgggatgaagttaaggaccggttgcatgccaatgcgctatcattgtctggtgggcaacaacaacgggtttgtatcgcacgcgtcctagccgtcgaacctgatattatccttttagacgaggccactagtgcacttgatccgatatcgagtcggatgattgaagaaaccctattgaatttgcgccaggattacactatcataactgttacgcataacatgcaacaggcgtcacgaatttctgaccgaacggcgtttttcctgaatggtgaattaattgaggtcaacgacacgaaacagattttcatgaatccagttaaacaggaaaccaatgactatatttcaggacgatttggttaggaggaaaaaaacatgcgacgactttttgatgatgaactaaacgatattgatgcaaacttcactgaaatgggaatgatggttagcgagacgattgaaaaggcagtcaaggcgtttatcgaccatgaccgcgacctcgcacaagaaatcattgataatgatgctaaaatcaaccaacgggaagttgaactagaacagaaatcatttgagatgattgcgttataccaacccgtcacttctgatttgcgagaaattgtcaccattttgaaagccgtctctgaattggaaaggatggccgattatgcacgtaatattgctcacgctacgattcgggtcaaaggaaatgtgcgcgtccctgaaattgaggcagcgttatcagaaatggggaatcgcgtgcgaaagatggtcgaagagatgttggcagcttacgtcaaaagtgatgatcaggaagcacgccgggtcgcagctaaagacgcaaaagtcggggagatgtatgatcgtattaatgagaagggaatctccaagatggagcgccatcctgagacggtcatcggttccacggattacctgaatgttgcaacttacctaatgcgcatcggggcgttagtaactaatattggtgagtggatcgtgtatttgaatactggtgagattatcgaattgaatccagaaagttctaatttagtgtaactaatcataaataattgcttaaagccggtcgtctagtttgcaaccggcttttacaattagtaagatatggttagataaactgataaggagcgtctaacgatgaaatcaaatacaaaacaaaagttaactaaatctaataatcgcgttttcgccggcgtcctcgggggcattgctgaatatttgaactggaatgcaacgattctacgagtactctacgttattttaaccttggttacccatggctttggtgttttggtatacttagtattaatgacaattatcccaagtaaaccagacaatacgggtttcttcgaacagatgcggcaaagtaccggtactcaagctaaaccgcaagcgcatgggcgcaaagagattcataacgttcatgaagaggatgatccgcgtcactaagattaatggagtgattatacagtgggcttttggaaacgaattttaatcaatacaatcttatttattgcgattgctggcttttttcagagcagttttcacgttgcaagtgtgtggatggctttaattgccagttttgtgcttgcaattttaaacgccgctattaagccgtttttgctgttattatcgttaccgattacgttattgacactcgggctattcagtattgtcatcaatggttttatgcttcagatgacatcctacgttgtgggtaaggccaatttcggcttttcgagttttggcatggcgatggttgtttcgattctcatgtcaattgctaacgtgattgtttccaactttttcgcgaaagacggcgttgatggtgaataaagcgctttaaagtgctaagattagaagatagaaataatccgttttcagtcataaaagtgtggccgcttgaaagggtagcgtaatggcgcgactggacaacgcgggccacacttttttattagtggaacaattaggagggattcttttggcaggaagtgtaaccgttgccgatttggtgaaaaatacgcgcctggatgtgtatcatggcgctgacttattagaaaagaaagatattacaacgagcgacatttcacgtccggggctggcgttgaccggttacttcaactactatcctcgtgaacgagtgcaattgctaggtaaaactgaaaccgcttattcgaaaaatatgagtcatgatgaacgactgatgatttttcgtaagatgtgtcagttaaccacacccgcgttcgtcatttcaacggggttacccgttccagaagaactcgtgcaagccggtgaggaaaatggcgtgccgattttaggaacgaaaatgacatcatcacggattctaagtaatatgacgaattacttggaaggtaaattagctgaacgacaatctgtccacggggtattagttgacatctatggattaggtgtgctgattactggtgattccggtgttgggaagagtgaaacggccctggaattagtcaaacgggggcatcgtttgattgctgatgaccgggtcgatgtctatcaacaggatgaacaaacgcttgtcggtgaagcacccgcaatcttgaatcacttattggagattcgaggtatcggaattattgatgttatgaatctttttggcgctggggctgttcgtcaagataccgacattgaccttatcgtgcaccttgagaattggacgcctgataagcaatttgatagactaggaaatggagaacagaaccggaaattctttgatgttgaagttcctgaaatctcgattccagttaagactggacgtaacctagcaatcattatcgaagcagcggccatgaactttcgggccgagagcatgggctacgatgcgaccaaggtctttgacgataacttgaacaagttgatcaaaacgaattccgtgcatgattctcacaagtaataaggagatggcagtagcgtgaataccgttttaggggcacttaacccaattgcactgcggttaggaccaattcaggtccattggtacggcgtcattattgctagtgccgtcgtcattgcggttgcactagcagtacgtgaaggtcagcgacggggtgttcggcccgatgacatttacgatatgattttatgggcacttccgtttactttaattgcggcgcggacttactatgtgattttccagtggtcatattatcgtcagaatcccggtgaaatcatccgtatctgggatggtggaattgccatctatggtggcttgattggcgccggaattgtggtcattttattctgtcggtcacgctttatcccaacttggctaatgcttgatattgccgcaccaacggtgattatgggccaaggtattggtcgctggggtaactttatgaaccaggaggcttttggtcgagtgactagtctgagtttcttacaaggcttgcacttacctgattggctgattaaccagatgtatatccgtggcgcgtatcggcaaccaacattcttgtatgagtcggtatgggatctattaggatttgccttactgatgctcacgcgtcatcgcacacattggtataagcagggtgatgtcttcttgacttatgttgcttggtacgcctttggccgcttcttcacagaagggatgcggactgactcgctcatgctatttaacgttattcgggtctcacaagcgttgtcagtggtactgttctttggtagcattggcttaatgatctggcgccggcatcacaatccgaataatcgttggtatttagcgggttctggtcaaaaggttgtcgcagaaaataagtagattagagggttatttgaatgatgaaaaaaattgccgttttaggtgctggctcatggggtagcattttggcaaatctgttggatgaaaatggccactcagtgcggctctggtcgtactcaccggcccaagtcacagaattaaatgagaaacacacgaatgagcgatacgttcctgattttaaatattcagaaacgttgactgcttattctaatctaacacaggcgattgatggtgcggatgtaatcttgtttgtcgtaccaaccaaagcgattcgcgaagtggcccaacaagtgactgccgtgcttgccaagacccatcagcggccgattattgtgcatgctagcaagggactcgaacaagagacacacaagcggctgtcgcaagttttggcagaagaaattcccaccgaattacgacaagcgatcgttgtcttatcgggccctagtcatgctgaagaagtggcccgccacgatattacgttgattacggcggctagcgccgatgaatctgcagccgaattagtacagcaactcttcatgaatgactatttccgcatttacacgaataccgacgtggttggtgttgaactaggtgcggcgctcaaaaatatcattgccctgggtgctggtgcgctacacggcctgggctatggtgatgacgccaaggcagccttaatgactcgtggtttagctgaaatcagtcggctcggagtggcgttgggcgcagagccgttgacatttatcggtttatccggtgttggcgatttaattgttacggcaactagtgtccattcgcgtaactggcgtgctggtaatgagttaggtgctggtcaggacctcaagacggtgattgataccatgggcatggttattgaaggtatcccgtcaactaaagccgcttacgagcttgcacagcaacaaaatatcgaaatgcccatcactgaagcgatttatgatgtattatataagagtgccgacattaaggaagtcattctacaattgatgcggcgcgaggggaaacctgagattcagtaggaatttccaaactaatttcactatttttaggaggatttatcacatgtcaaaagttagaaaagccgttatcccagcggccggattaggaacacggtttttgcctgctactaaggcgatgcctaaagaaatgttaccaatcgttgataaaccaacgattcagttcattgttgacgaagctcgtaaatcggggatcgaagacattgttatcgtcacgggtaagagcaagcgtagtattgaagattactatgattctaacccagaattagaggataacttacgggctaagcacaaggaagaaatgctcaagctggttcaagaaaccacagacattaacttgtactttatccggcaatcacacccacgtggtttgggcgatgccgttttaacggctaaagctttcgttggtgacgaacctttcgtcgtcatgcttggtgatgatttaatggaagacaaagtaccgttaaccaaacagttaatgaatagctatgacaagacacatgcgtcaacgttagctgttatgaaggttcctcatgaggaagtttctaagtatggggttatcaatcctgaaagtgaaaaggaaccgggcctatacaacgttaataactttgttgaaaagccatcacctgaagacgcgcctagtgatcttgctatcattggtcgttacttattaacaccagaaatttttgatgttcttgaaaaccaaaaacctggtaagggtgacgaaattcaattgacggatgccattgatacgttgaacaagactcagcgggtctttgcccatgaatttaaggggactcggcacgatgttggctacaagtttggctacttgaagacgacgatcgaatacgggttaactcatccggatgttaaggctgacttgcggacttacatcaaggatcttggtgctaagttatctaaagaagatagcgccgctcctaaaacaacgaagaaaccaactaaataatacttgattaattaaaacaaccgtgaaatctattaagatttcacggttatttttagttaactgctgaataattgcgattcactaattaagctggcacctagtggtcggcttttaatttgaataaatggggcttgccataataataaccttggcgtagtgaaatatttaagtcattcgccatttgatcttcggcatcgttttcaacaccctctagaattaaccggatatcatgttgtaccgcaatgtcgcgccagaattttaattgaatgggaatctcgttttcacgatcttcggcccgaaagttttgcatggcgaatttgatttcttcggccgattcgagtagcggtttaatgtggtcgtaaacgttgattcccgtgccaacgtcatcaatgctaaattgtaggccgttagccttgtacttatcaatttgttgttgcatcgccgccagtgtaaacgtatcttcaccgggttcttctgtgacttcgacgataacatgaaccgggaatagctttttctgagcatcaatgactgcggcagcaatatcatcatttaaaaattgcttgcgattaaagttaattgatactgacccgatttttaatgcaagctcactagccgtagcctttagtaagctgacttgtacatcgatcggaatattatcgaagctttctggtaaggtccaccggtcctgatcagtctcacgatagcgaatcagcatctcgtagccaatcagtgaattattaaatttatctaactggggctgaataaaatagcggtacataagggaactccttagacttgaattaacacgatttgatgcttcctaatacatactataccaaaaaatgaataagtgaaactgtttgacaccatcttttttgcatggtatcgattatcaattgggctaatgatgattgtgctaaactgcttggtgaacaaggcaattttctgaaaatgagtaaaaagtcaattagtggttacctggcaaagctggtatggacgatattatgagaataactgcttgccagcgtatcgctgattggtttttaaaagtagttatgtttcatcatgacctgtatttatattgactagagttatgtatttgcgcagtaaagcggttataatatacctatggttaaataaataaaattataattgggagcaaaatgaaatgaagattgtaattgttggatgtacgcatgcggggaccgctgcggctgcacaaattctgaaggatcatccggaggctacggtcacgatttatgagcgtgatgacaatatttcattcttatcatgtgggatctacctttatctcgggggaaaggtcaatcacttggaagatatgttctattcgtcaccagaaacgttagccaagttgggggcaatggtcagaaccaaacataacgtgttaaaaattgacgcccagtcgaagaccttacaagtggttgacatgactactggaaaagtgtttggcgatacttatgataaattgattatgacgactggttcaaatgttgcggtcccgccgatttttggaatcgatgagtctaaggtcctattatgcaagacctacagccaagcacaggaaatttaccaaacagcccaagacaatcagcggatcgcaatcattggggcgggttatattggaaccgaattatctgaaagttatgcaaatacacatcatgaagtaacgttattccaatcgcatgatcaaattttgaataattacattagtaaagaaatttcagaccaagcagttcagctattaaaagatcatggcgtgaacgtgctattgaatcaccaagtaactgcctttactggtaatgatgatggtgaacttgtcattgaaaccaatcaaggcgattttaatgctgatctagcaattgtcggaactgggtttgttcccaatacagaactgttacgcggtcaagttgagatggataagcacggtgccattatcatcaatgattacgttcagacctctgacccagatatttacgctgctggtgattcttgtgtcgttaacttcaacccaactgggcgttcggcttatacgccattagcaaccaatgcggttcggcagggtgcgttagcgggggccaatgtttttggtaaccagcaacgatatatggggactcaagcgacatcggccatgcaactcttcgatcacacgctggcaaccacggggttaacactggcaatggcgaaattgaatcatattccagctgaacgggtgacttatgagggcaactggcgaccagcttacatgccaagtacggcgaaactgacgattgaattaatttataatccggaaaatcgtaaaattctcggtgctcagttcttaagtgcgcatgaagtggcacagtctgctaatgcgttatcaatcgtgattcaaaatggaaacaccatcgatgatctagcatttgtggatatgttattctcacctaattttgatgaaccattcaattatctgaacctcgtcgcccaacaagcgattgaacaagaacgccaggcaggccgcaatcacccacgaattacggcctatggcgattgggccaagcaaaatgacaaggatttacaataagaagtaagtcttaccatgggttgaattcaagtgaactggcataattttatttatttaaatctcggtttttagtcaatatatggttaaaagctataattgacttcagttgtgtacaaacaagatagtcgacaaatgtaaattttgggggtatattaagcgtcataggaatttaagtggaaggggtctttagaaatggcaaagagttacgacgtgattattattggtgcggggcctgccggcatgacagccgccctctatgcttcacgagccaatctatcagtgctactattagatcgcggaatctatggtgggcaaatgaataataccgccgcaattgaaaattatccgggcttcaaatctgttttggggccggatttggctaaagacatgtatgaatcagcgacccagtttggtgctgaatacgcgtatggtagcgtcgaatccgttgaagatcgcggcgatgttaaaatcgtgacgacggatagcgatacgtttgagactaaggcccttgtcattgggactggttctgaatatcgtaagctgggtgttactggcgaggatacgtatggtggccgcggtgtctcatactgcgcagtttgtgatggagcgtttttccgtaacaagcatgtagttgtcgttggtggcggtgactcagcgattgaggaaggcacttacctgacacagcttgctgataaggtgacggttattcatcgtcgtgaccaattgcgggcacaacaaatcttacaagatcgggcttttgctaatccaaagatggaatttgtttggaatagcaacgtgacggaaatcatcggtgatgataagaaggtcacgggagttaaggttaataataataagactggtgaagacagtgagattgcggtcgatggtgtctttatctatgttggtattaacccaattacgaagccattcagtaatcttgggattactgacgaaaacggctggatcgaaactaatgaccacatggaaaccaaggtccctggtatttttgcagtcggtgatgttcgtaagaaagatttacgccaagttgcgacggcggttggtgaaggcggaactgccggtcaaggcgtttacacttatatcactgctttaggcgacaaagttaacaattaaataaaattaaaaaatgcgtagctgatttaattgagatcagccacgcattttttattggtaaatatagcgttagtcattgtttgacgatgaccaaaggttcgcgaattagtgttgatagggaaatagaagcaattgcttgttagtatacgttgccaggtaaatatcactgacagtatagtgctgggcctgcaattgggtcagtaaccaggcttcatcatgattactagtttcaagcgcatcgaggttgacctgaccatcgacgattattggatacttgacggcgtcgtcgcccacttgggtaatcgtcagttggccgttttgttcaagtacggcccgtttgacgtagcgaatatccgtgataccttccgtacgcaagcgaaacatcagatcgttagcactcatcccatttttgagggccgtgctgacgagtaattgcccatttttaatcaatagctgtggctgtccatcaatcaaacgtttcacgtagcgattgtgatgtgttaggaatcgcaggaccagcactagcagtgtccagatgagaagcactaaaatgtattgtaaaacagtaacgctggtactataaatcatgcccccaacgattgcaccgagaacgtagttttgaacttggtcgagggcgctgattggcgcaaggttacttttaccagatagattgatttgtagaatgatggtcaatagcccgagggccagtttgatcgtcacatcccagtatgaaaacatttattgcccctccttaacataattgattgttgattgaatcggtgtggctttagtcagggtataactgtttccatccgtattgatcgtcacgttatagatatggtcatggactttaatgagcatcccactgctgacagaacttgtattagaccagaccgcggttttacgaacccctttttctttggcgacacgctgcataatttgtgtcacttgtgatttttggttgaaactatttttgattgtctgccattcattaaattgaatgccgacgagcagcaataataataaaaccatgataatgaataagtcgcggtattttaggtctgttttatggcggtaccataaccagctgagtatggcgattattaatataatgatgccgatggctgcgagttggacaagagtatgattgttattttgatggactaagtagttgtatgaataaaaagtcatgatggcctccttataagatttattatagcaagttttgatagtgactgaactaactagcacttcagaatttatgggtattcgcactgatgcgggcccactacgcatttaaaatgcattaattaatggattttcttagtaaattttactttgtaaagtgtgtcaatgttgtatactatttttgtaagcactaacaaatatcggaattggagatggtttttgtgagttggcaggatacttataatacctggaaaaaccaagcgacacttgaaactagtttaaaacaagaattgacgggcatggctggcgatgacgccgccttagaagacgccttttatgaaccaatggaattcggaaccgcggggatgcggggggtacttggacctggtatcaaccggatgaatatttatacggttcgtcaagcaacggaagggttagcacgcttcatggataccttgcctgctgaggttaaggaacgcggggtagcaatcagttttgattcccgccatcattcagaagattttgcgcatgaatctgcgcgagtattgggccaacatggtatcaagtcatacgtttttgaaagcttgcggccaaccccagaactttcatttaccgttcggcatctgcatacttacgcagggatcatgattacggcgagccataatccgaagcaatataatggctacaagatttatggcgaagatggtggtcaaatgccacctaaggaatctgatcttatcacatcatatattcgtaaagttgacgatgtctttgcgattgccgttgctgatgaacaacaattattagctgataagacggaaaccattattggggatgatgtcgatcaggactacttagctaaggtcaaagaagtgacgatcaatcaaaaactagtggatgaagtcggtaaggacatgaagttagtcttcacaccattacatgggactggccggatgcttggcgaaaaggctttgaagaatgccgggtttaaaaacttcagtgttgttaaggaacaagctgtggctgaccctgaattctcgacggttaaattccctaatcctgaatttcctgaagcctttaagatggccattgatttgggtaaaaaagaaggtgcggatgtcttgattgcggttgatcctgatgctgaccggttagggacagctgttcgtcaacctaatggtgagtatgttctgttgacgggtaatcaaattgccgctgtcttgttacactacatcttgcaagcaaacaaggatgccgggacgttaccgaccaatgcggccgcagttaagtcaattgtttcaagtgaatttgctactaaagtagcggcttcatatggtgtcacgatgatcaatgtcttgaccggtttcaagtatattgctgaacaaatcgaacattttgaagccactggcgaacatacctatatgtttggttttgaagaaagttacggttacttaatcaaaccatttgttcatgacaaggatgcgattcaaaccacagtgcttttagccgaagtagcggcttattataagcaacaaggtaagaacctttatgatggattacaagacttgtttaaggaatacggttacttccgcgaacaaaccacgtccgaagaatttgatggcgttggcggcagcgataagattgcggctctgatgactaagttccgaagcgaagcaccaactgcctttgccggctacgatgtcactgggactgaagacttccagagtcaaacggaaagctttgctgatggccacacggcaccaattgctttgccaaaggcgaatgtcttgaagtatcatttaaatgatggcacttggatcgccattcggccatctggtacggaaccaaagatcaagttctacattggaacgctaggtagtacgttagaagaagctaatgataagttagcgaaatttgaagatgccattcaagcgtttattaaagaataaattggttatttagtcagaagttgtacggcccagctgactagccatgctaagtgataaataacgccttacgaaatttcaagttaatttcgtaaggcgttatttagttgttgttcacattagaaattaattcattgtcggatattcaaagttgacggggtcaccgggtaggcgtaataattgcggtttgccatagtaataaccttgtcgaagattaatatcgaagtgactactcaagcgatcatcttcggcgtcttcaatcccctctaagattaaacgcaatccgtattcactactgatggcccgccaaaaatggagcttttgctgaatcttaggatctttgatatcactgcggaagttttgcaacgcaaattttaattcagaagctaatggcaaaatttcttggatactcttgaaatcgttaattccggtaccaacatcatcaagtgaaatttgcataccatgttcgatgaacccccgtaagtgtgggattaacatggtatctgaataatccttaggactacgttcctcagttagctcaacgactaatttagcaggatagagctgaacctgactttgaataatggccttcgcaaccgttgtatccatcaattgttcgcgactgatattgactgcacaataacgaacttttagtccaagaattttagtcgttgcaatgagcagatcagaggtaacttgtgaactaattgcggcaaaggattcaggcagacgccagccgtctggggttagttgtttgattagtagttcgtatccgtaaactgtattgttgagtaagttaagttgaggttgtacaaaatagcggtaaattggttccataagtaccatcgccttttataataagtttaaaatcattgaatcgttttaatatcaaccgaatcgctgtatactctaagtatacgtcaacttaaataaatgtttaacttaatccaagttaaattttaacttttaatgaaagctgtggtcgaaacaatgaaagttgccattattggctgtacacatgcggggattgccgccatgaaacaaatcttgaaatattatccgggcactgaaattaccgtctatgaacggcacgcggatatttcatatatgtcttgtgggacttatctacacttagggggtaccatccataatttggatcaagcgttgtacgctaatcctagtgaatttagtgaacaaggtgtgcagatgcggatgcagtatgatgtgatcaatgtgaatgctgataagcatacaattttggctcaaaatttacagacaaaagaattacaaacggatcactatgataagttagtcatggcgacgggttcaatcactgcaatcccggctattccgggcgtagagaatcctaaggtcatgctttgcaaaacatgtgaacaggcccagcaactctacgaagcagctaaacatgcacaccatattgcaatcgttggtggtggctattcgggggtggaacttgctgaggggtacgtgaagtccggacacactgtgacgttgtttcaacggggcccccacttaattaatgagtatcttgatccacaaatttctgagaagatcgaagacttgttaacgacgaaaggcatccaagttagaaccaatgcacaagtgacggcttttagtgatacggctgataatcgactacgagttgcaaccgctgatagtgaagaaatatttgatatggctgttatttgtccgggggtgattccacaatcagagttattggcgggacaggtcaaccgaacgaagcagggggccattgtaacggaccgttatatgggaacctccaacccggatatatttgcggctggcgatgtgacggaagttaactttaatcctacgaaggaacacgcctatatgccattagtctcacatgcaattcggcaaggtgcactggcaggaattaatatctttgataaacgcttaggtgcaattggtacgcaagcgacgactgggatgttgatttttgatcagaccgtggcttgtgcaggtctgaccttaacggcggccaaagcagctaacttcgatgcccaagcagctttttatgaaggcaattatcggccggactttatgcctaccacggcgaaagtcatgattgagttggtttatgatcaacaaacgcggaaggttttgggtggtcaactaatgagtgctcatgaagtttcacaatcagcaaatacgttgtccgtagtgattcataatggtaatacgattgatgaattagccttcatggatatgctattctcacccaactttgatgaaccgtttaattacttgaatttagtggcgcaggctgcagtagatcaggaacatggctatcgtcggaataattaagtttttgcactaattatggtcagaaggtgctggttgttaaaatcaagaacagccagcttagacccgctggaataagttcagattagcgtaaacttgtgtggtgagtgtgtccgataccgttcttcagttattgctgccaatcggctgggatggtattcaaaacgaatgtgctacgttaacgtttgttccaagtctaacggagtaggatggttcagcgacagtttagcttgggttaagcggtcgttcatctgccactcgagtggtttcctggaagtcagacgaggacgcgcatatgctgacgggcaagaatccaactaactggcatgttttaataataagtgctggtgaatccataaaaataatgagccaaataaggtggccgcctaacagtgggtttcataacctgactgttaggcggccacctttatattatttgaaagcgattggtcaagcatagtcgttgggatcagcggctaggggttggtaagcgtccatttcggtgtcgcggtagtcccaccattcgttaacgtagccgacaaagcccgcggcggtcatggcggtgtccagcagctgataatttttttcttgaagtgcggttcgaggagcgtcacggtgagcagctgccgtgaagtcatcgaaggcagttggcattgttaactcgctaccatcaggatgggccagggtcaaatctaaggtgacgcctttttggtggctgaaattaggattaggctgggcaacaaattctggatcaggatacacttcaaataaacggcgctgggcgctgacgggccgataagcatcccagactttgagccgataaccttgttgtttaaccagggcgcttgccttggcgagtttgtgggccgtgccagtgcgaacaatggccgtggtaaagtcgtaaatcacttgatgagtaaagttattggtggtggcataacgcaggtcaacgatgatttcggggtctaagtgttgaatattggtgaaaccagttaaagcttgatccatagtagggcctccttagaatttagttatgcttattgtatctgattggccgatattttaccgactaaaagggttgtaaatggtgtcaaactttctgctagctttcaatccgggtccctgatatgatggaaagcggtgtaaatttaacaattgattgaagaggtgaggtcgcatggatcgacaaacacgacgcgcaattttaattttagtttttagtgagtttttagtttgtttagggattagtttagttattccggtcatgccgtttattaaaaatgaactgcatttaacggctaccgatatgggaataatgaatgcgttattcgcattggcacaatttgtggcctcacccattattggccgggtttcagacaaagttggtcgcaagcccgtattaacggtagggctagtcttatatatggtctcggaagtactatttgcgctaaccaaccagctgtgggtctttaatatttcccggattgttggtggcttatcagcagcgatggtcgttccgacggcgatggcgttagcatccgatattacgaccaaacgacagcgagctaaagtaattggctggttatcggcggcctttagtggtggcttgattttaggacccggtatcggtggggtattggctggcattagttataagacgccgttctgggttgctggtgcattgggattactcagtgccattgtgctcgtcattctgttgcctgcggatcgtcagattgatcctgatcgcgaagcaattacggccacgacaacgacgaccaatcatccgatgacgcgggcattttggaccgtcccgattattatattatttacgatgattttagtgtcttcctttggcttacaggggtttgagagcatttatagtatttacgtgaatgaagtctttcactttagtctgagcaacattgcgttggtcttgactttaaatggtttgatttcgctcttcctacaggtggcactatttgatacctttgtccagcgttggggcgaacggcgggtcattcgggtgtgctttgcagctgcggcgctctgcactatctggattacgcaggctcattcgaaagttgctgtcatggttgcaacgctcgttattttttcggcattcgatcttttgcggcccgctattacgaccctattaacgaaagcaagtgaggccaaccaggggctaatcaatgggcttaacatgtccttaacgagtgttggcaatatcgttggcccaatcatgtcggggatgttactagatatgaattatcactatccatatctggtggtggccggattcttgattgtttcttatttaatggcatttatgttacgattaccgaaccaggttcattcacatcagcaagtttaacattgcataacagttaagctaatcagcgaaagcgctccgggtttgcgtccccggggcgcttttgttacacttaggccaaattagattgaaggatggtgggctgcaatgggaatgcatcaatattttcagagcttaagtaatttagaaacgattcaacgggccccgggtttttttaagtatcagaatcattcagttgcggcgcattcatttaaggttgctgaagtcgcccaatttttaggtgatgtggaagaaaatgccggaaaaattgttgattggcgagccctctatgagaaggcgctgaatcacgactataatgagcggtttatcggggatattaagacgcctgtcaagtacgcaacgccgacgctacggacgatgctggcggatgttgagcataaattatcacaaaattttgtgcaaaatgagattccagctgagtttcaggcagcttattcacggcgtctatcagaaggcaaggatgaaacgctagaaggccagatattgtcggtagccgataaaattgacctattgtatgagtcgtttggtgaaattcaaaagggtaatccggaaccagtttttagggatatttatcaagaaagtttaaaaacaattgtcgcgtttaaaaagatgactagtgttcaatatttcttaaaagcagtgctaccagagatgttagcggaaccgttcacgcatcaggatcaattacaggcgctgacgacccagattttaacggccgggccgcaatccgattaatggcgaaagtatgttcgatgtgctaaaattaaatgcgatttgaatgtgatagggaagcgcgggcttgcctattttttatggtgcgacagtaagatttagttatcaatagatgatatgaacgggtgaccgtttaaaaggaggactacgtttgattgatcgggtagataataatcattttgacttagtttcagattaccaaccaacgggcgatcaaccccaagcgatccagcaattaaccgctggcattgaatcgggagaaaaagagcagatcttgttgggggcgaccgggaccgggaagacctttacaatttcgaacgtgattgcaaaggtgaataagccaacgttaatcttgtcacataacaagacgttagcgggtcaattatacggggagtttaagaagtttttcccgaacaatgccgttgaatattttgtgagttattacgattattatcagccggaagcgtacgtgccttcgagtgatacctatatcgaaaaggactcggcaatcaacgatgaaatcgataagttacggcactctgcgaccagctcattattggaacgcaacgatgtgatcgtcgtggcatcggtctccagtattttcggtttaggggatcctcacgagtaccaagatcacgtagtctcactgcgagtcggcatggagatcgaccgcaatgatctgttgcgtaaacttgttgatattcaatttgatcgtaacgatattgatttccagcgggggcgttttcgggtccatggtgatgtcgtagaaatctttccggcttcacgggatgaccacgcattgcgcgttgaattctttggcgatgagattgatcgaatccgtgagattgacgccttaaccggtgaaattgtggctgatcgtgaacatgttgcgatcttcccagcgacccactttatgacgaatgatgcgattatggaacacgccatcaagggcattgaagatgagttggacggccgcctgaaagaattgacagccgatggcaaattgttagaggcgcaacgactcaagcagcggacgacctatgatgtcgaaatgctcaaagaaatgggctacactagtggtatcgagaactattcacgttttatggatggccgtaaacctggcgaaccaccgtatacgttactggacttcttcccgaaggactttttgctcgtggtcgatgagtcacacgtgacgatgccccaagttcggggaatgtataatggggaccgagcacgtaaacaaatgctagtcgattatggcttccgtttgccaagtgcgttggacaaccggccattgaaacttgaagaagttgaacagcatattaatcaagtggtttatatgtccgcaacgccgggcccttacgaaatggatcggaccaagcacgtcgtccagcaaattattcgaccaactggtttattggatcctacgattgaggttcgaccgattatgggtcagatcgatgacttagtgggtgaaatcaataagcgcattgaggtcaacgaacgggtctttatcaccacgttaactaagaagatggcggaagatttgaccgactactttaaggatttaggcatcaaggtacggtacttgcacagtgatattaagacgttggaacgaacgcagatcatccgcgacctgcgtctgggcaagttcgatgtgttggtcgggatcaacttgttgcgggaaggaattgacgttcccgaagtttcactagttgcgattttggatgcggataaggaaggtttccttcgtaacgagcgttcgttgatccaaacgattggtcgggcggctcgtaatgagcacggttcagtgattatgtacgctgacaccacgactgattcgatgcaggccgcgatggatgagactgcacgtcgtcgagcagtacagatgaagtacaatgaagatcatcacatcacgccacatacgattaaaaaggccattccagagctaattgcttcgacgaagaccactgaagacgcgggtaagaaggatgacttcttagaaaccgactttgatgatatgactcgtgaacaacaattagatatgattagtaagttggaagaacagatgaagaccgccgctaagaagctcgactttgaacaagccgcaacgctgcgtgatacggtcatggaattgaaagcacaaattagctagcaggttgctggcttgagattgaggaggcctttttttggcaaatgataagattgtcattcacggtgcgcgagcccataatttaaaagatatcgacgttaccatcccgcgcgacaaattagtcgtgattacggggctgtctggctcaggtaagagttcgttagcgttcgataccttgtacgcggaaggacaacgtcgctacgtggaaagtttgtcagcgtacgcgcgtcaattcttaggacagatgcaaaaaccagacgttgattcaattgatgggcttagtccggctatttcgatcgatcagaaaacaacatccaaaaacccgcgctcaacggtcggaaccgttacagaaatcaatgattacttacggttactgtgggcccgagtcggtgaaccgatttgcccgaacgatgggacaccgattgcgagtcaaaccgttgaacagatggttgatcggattcagaaattaccggaacgaacgaagttgcagattttatcaccaattgtccgccagaaaaagggcgagcacaaaaagatctttgaaaagatcaagcgtgaaggtttcgtgcgggtccgtgttgatggtgatattcatgatatcagtgaaacttttgaactgaacaagaatcaacaacacacgattgaaatcgtcattgatcggatcgttgtgaagtccggtgaccgttctcggttatttgattcttttgaagcggcgttgcgattaagtgggggctatgcgattgcggatgtgatcggtggcgaacccattatgttctcagaacattatgcttgtcctatctgtgggtttactgtgggagaacttgaaccacggttattctcgtttaacgcgcctcagggagcttgtccagactgtgaaggtctcggaatcaagctagaagtcgatgaggaccttgtcgtacctgataagtcgctgacgttggctgaaggtgcgttagcgccttggaatccaatcagttcacagtattatcctgaaatgttgaagcaagcttgtgaacagttagaaattccgatggatgtgccgtatgaagacttatcaaaagctgatcaacaaacggttttgtatgggtctaacggaaagacgttccatttccactaccagaacgactttggtggtgttcgcgatgttgacgctgtgtttgagggcgttatcaacaatgttgaccgccgctaccacgaaacgaatagtgatttcacccgcgatgtgatgcgaaagtatatgacggaactcacttgtcagacttgtcatgggttccgcttaaatcgcaaggccctgtctgtcaaagttggtggcgaacatatcgggatggtctctgacttagccattggtaaggaactcgatttctttaacgagttgagcttatcagaacaaagtctcgtgattgctaaaccaatcttgaaggaaatccgcgaccggttatcattcttgcaaaatgtgggactggcgtacttaacgctcagccgttctgcacggacgctgtctggtggggaagcccagcgaatccggttagcaacacagatcgggtcgaacttgtccggcgtgctctatatcttggatgaaccatcaattggattgcatcagcgggataacgaccgcttgattggttcacttaagaagatgcgcgatctggggaatacgttgatcgtggtcgaacatgatgaagacacgatgcgggccgctgactatatcgtggatatcggcccgggtgccggtgaaaacggtggtgaggtcatggcggccggaacgcccaagcaagtggctcgctcgcggaagtcactgaccggccaatatctatcgggcaaacggtttatcccactacctgaaactcggcgtccgggtaatggtaagaagattcgtatcactggtgcggccgaaaacaacctcaagcaaattgacgttgattttccactaggcgaatttgtcgtggtaacgggggtttccggttctggtaagtcgaccttggttaacgatgttttgaaacgcgtattggcacagaagttgaatcgtaattctgaaaagcctggtaagtataagagtgtcagtggtattaagaatattgaacggttagttaatattgaccaaagtccaatcggccgaacaccacgcagtaatccggccacatatactggtgtctttgacaatattcgtgatttatttgcacaaacgaatgaagctaaattacgtggttacaagaagggccgctttagttttaatactaagggtggtcgttgtgaggcttgtcacggtgacgggattctaaaaattgaaatgaatttcttgcccgatgtctttgtaccttgtgaagtgtgtcatggtaagcaatacaattctgaaacgttggaagttgaatacaaaggcaaaaatattgccgatgttcttcaaatgaccgcttcagaagctgttaagttctttgaaccaattccaaagattcgacggaaactacagaccttggtcgacgttggtttgggctatgttaagttaggccaacccgccacgactttatcaggtggagaagcccaacggatgaagttagcttccgaattgcacaaacaacagtcggggaagaatttctacatcttggacgaaccaacgactgggttgcacagtgaagatattcggcgcttgattggcgtcttggatcggttggtggatgcgggtaataccgtgttaatcatcgagcataatttggatgttgtgaagtcggcggattatttgattgacttgggcccagaaggcggtgacggcggcggaacaatcgttgctactgggacaccagaacaggtcgctgaagtggctgaaagttatactggccaatacttgaagcccgttctagaacgggatcgagcacgtgaagcaactgcacctgctaaataacgggcaatgtgctacacttgagtttgtaatgtaattttaatttagaggagttgtttgtacatggctaaagtagaaagttttacattagatcataccaaggttttagcaccttacgttcgtaaaattacggtggaaaatgggcctaagggtgatgccatcactaattttgatttgcggttagttcaacctaacaagaccgctattgatacggcgggcttacacacgattgaacatatgttggctgggttattacgtgatcgtatggatggcgtgattgactgctcaccatttggttgtcggactggttttcatttgattacctggggtgaacatgacaccgttgaagttgctaaggcattgaagtcctcattagaattcattgctggcccagctaagtgggaagacgtacaagggacgaccatcgatagctgtgggaattacaaggatcattctttattctcagctaaggaatgggccaagttgattttatcgcaaggaatttcatcggatccatttgtacgcaaagtcgttgaatagaccaaaatataaaaagtaatggtggtgccggccaccaattaaaaagagcctagcttttcataacgaaaagctaggctctttttgctgtttactgacattgtgcgagcttagcggtcctgaatcgtgggaaaacaatctaagattagattaaggtagtgtttcaaaaataacaaaaaatatactgatttcggtgaatgtctgcataaaaattctacattttagtgaatattgcacaaatgatgaatatatttaaaatattattgaataaaattaaattgggtggtacgatactgtcattgataaaagcaaagataaaaatttcggaggtacaaatcaatggtcaaacaaaatgataaaattattctcgcttattctggtggtttagatacgtcggtcgcaattagttggttgaaggataagggctatgatgttgtggcctgcggaattgatgttggtgaaggcaaggacatggatgcaatcaaagaaaaggccctaaaattaggggctgtttcatcatatatgattgatgctaagcaagaatttgctgaagaatatgcgttaattgctttacaaggtcataccttgtatgaaggtgaatatccgctggtctcagcactttcacgtcctttaattgctaagaagttagtcacattagccaagcaagagcacgctgttgcaattgcccatggttgtactgggaagggtaatgatcaggttcggtttgaggttgctatccacgctcttgcaccggatatcaagatcgaagcgcctgtacgtgattggcactggtcacgggaagaagagatcgattacgctaaggaacacaatattcccgtaccaatcaatttggacagtccttactcgattgacgaaaacttatggggccgggccaatgaatgtggcattctagaagatccatggcagggcgcgcctgccgatgcgtttgaccggacgaaggccttagctgatacgccggatacgccaacgactttggaaatcacttttgaagctggggtgccagttgctttagatggtgaatcacttaacctagctgatttaatcatcaagttggatcagattgctggtgaacatggaattggtcggatcgaccatattgaaaaccggttggtcggtatcaagtcacgggaagtttacgaagcaccagctgcaacggtattgctcaaagcacataaagatttggaagatttgacgtttgagcgtgagttagctcacttcaagccaatcattgaacaaaagcttgcggatacgatctacaacggtctttggttctcaccattgatggaagcgatggttgccttcttaaagcaaactcagcaagtcgtcaatggggtagtccgggtacaactcttcaagggtaacgttattactgaggggcggaagtcacccaactcactatatgatacgaacttggcaacctatacatcagcggattcatttgaccaacaagcggcagttggtttcattaagctatggggcttaccgacgcaagttaatgcccaagtccaagcgaaggctcaggccgaagctaagactgataaggcacacgcctaatgagtaccaagaagctatggggtggccggtttaccgaaacgggtgctaagtatgttgatgactttggggcatcaattagctttgaccagttgcttgccgcagaagatattgctggttcactggcacacgttaaaatgttgaagaaaactggtattttgcctgccgctgatgttgatcaaattgttgctggtttggaaaccttggctgagcgtcaaaaacaaggtaagttggaattttcaacggtcaacgaagacattcatatgaatattgagtcattattgaccgaagagattgggccagtcgctggaaagttgcacacggcccggtcgcggaatgaccaagttgccacggatttccacttgtacttgaagcatcaattaccactaatattggaccggctacatgaactggaaacggtattggtcgataaagcgagtgagaacgtggagacggtcatgccggggtacacgcatttgcaacacgcccaacccatctcgtacgcgcactacctgttagcttattaccaaatgttcaagcgggacatggaacgcttcgagtttaacctgaagcataccgatatttcgccattgggagccgctgcacttgctggaacgacttttccaatcgaccgggaatatagtgcgaaactattaggattcagtgaagtctatcataatagtttggatgccgtttctgaccgggacttcgtgcttgagtttctcagcaatgcttcgatcctgatgatgcatctctcacggttttgtgaagaaattgtcagctggagcagttatgaattcaagtacatcagtttgagcgatcagttttcaacgggtagttcgattatgccgcaaaagaagaaccctgacatggccgaattgattcggggcaagtccggccgggtttacggcaacttgatgggattgctaactgtcatgaaagggattccgctcgcttacaataaggatctgcaagaagacaaagaaggggcgtttgatacggtcacgaccgtgttaacgagtctccacgtcttcaccggcatgttggcaacgctgaccgttaatgaagatcggatggctgatgccacgactaacgatttctcaaatgcgaccgaactagccgattaccttgcaaacaaaggaatcccatttcgggaggcccatgctattgtggggaagctcgtcttggatggcttgaaaaaacagcggccgttgcaggatattccactcaaagaatatcagtcaatctcaccgctgatccaagaagatgtctaccatgatttgaacgcaaaagttgcggtggaacggcggcattcgctaggtggtactggttttgatcagattagacaagaattgcaacgggcacaaacgcaattgtcagcctatcaatctgaaaccactgattaattaatgcttatcaatttgaccattgatattatttttaaagatgacctctaagtggcggagcctcggcatttagaggtcgtttttagtgctatcgacattttgaaaaagcattaagctaacataaagtctatcagaaaaattggaaactcttacattaactggtaagatggaattaatatcggatatgggagatgttgatgtatgtttaatgatcatcgctgggggtttgattggactgaattcatgacggggatcgttttcttgatcgccgcttactttgtcatcaagcaaccacaagcagcacttttaagtttagtctttttatttgccatcgccgcaattattagcggggtcaccacaatcggtgggtacacaaaactacgccgtgaaacagggttgcgggcaaattttgcccttgtgtttgcgattattgatattttagtggggttattatttttattccacgcaccgactggggtactggtactcggttacgtctttgccttttggttcttgatcgattcgattgaacggctaaccgtagtctcacatctacgcgtctttggaaccgggtattttgttctatctttaatcttggatattattagtttggcattgggaatcttattagtaatcaatccaatggttgctgtgattagtttcaacgtactggttagtttctactttgcagtttttggcatcaacgcaatcttgattgcttttgctcggcgtaactagcttggcagtattgactcgttagcgatacttggcgctcactattggtggtgtcagggtgttgttaaggggtcttttttttgcgcgttaatgtaatactgtttggaatcaaatggcgggtcgaagtggcacgtcagtagaaatgacacacccggtgtgttatactaccaacaatatggactagagggggccaatacagcatggcagaatcattacaactagtaattatttctgggatgagcggtgccggtaagacggttgcggttcaaagctttgaagacctgggctatttttgcattgacaatatgccaccagcgttattaccgaagttctcagaattagttgaggagtcgggtaaaataaagaaagtagcgttagtgattgatttacgctcgcgggctttttacgacgaaattatggatatgttggctaacttagacaacacggactttgtgtcgacccggattctgtttttagatgcttccaacgaagaattagtgtcacgctataaagagacgcggcgttcccatccattagccatggaaggtcgcgtcatggatggcgtgcgcaaagaacgagaattattggcgccattgaaagatcgggcttcatacgtcattgatacgtcgacgttgacaccacgtgaattacgcgaatcgatttttgataaattcgaaacggatcaggatgagacttttcatattgaaatgctatcattcggttttaaatacggactcccgattgatgcagatatcgttatggatgtgcgcttcttgcctaatccatactacattcctgaattaaagaagctgacgggactagataaacctgtggcggattacgttatgcagcaaccagctacggaagctttctaccagcagttcttgagtatgctggaaagcattatgcccggctatgaagccgagggcaagagtagtttgacgattgcgattggctgtacgggcggtcaacaccggtccgttgccttgacgcaacgtatcggtgaagcgctggctaagcactacaaggtgcacatcagtcatcgtgatattgagaaacgaaaggaaactgttaatcgctcatgagaaaatacacatttaagactcagcggcctaaaattgtggtgattggtggaggaaccggtttgccggttgttctgaacggcttgcgtaagcaggcagtcgatattaccgcagtggtgacggtggctgatgatggtgggtcatccggcattattcgcaattacgttaacgtggttccacctggtgatattcgtaatgtaatggtggcgttgtcgagttggccggatttgtataaagatatttttcagtatcgtttccagggtgatgatcaattttttgcaggtcatgcgattggtaatttaattattgcggcactaacggaaatgaaatccggggtgtttgacgcggtgcaggaattatcaaatatgatgcaagtagatggtcatgtttacccggcagccaacgaggcactcacgctacatggtaagtttagtgacggtactgagttagtaggtgaagccgaaattaccgcggcccataagtcattggaacgcgtttgggtcactgacaagaatggtaaggaaccacaagcagttcaaccagttattgatgcgattatggcggcagatcagattgttttggggcccggtagtttgtttaccagcattctaccgaacctaacgattggaaatattggtcgggccgtctgtgagtctgatgcagaagtggtttatatttgtaatattatgactcaaaaaggtgaaacggataatttctccgatgctaatcatgtgcgggtcttaaaccgccatttggggcagaactttattaatacggtgttagttaacaccgaaaaagtgccagaagattacatggattttcataagtttaacgaagtttcaaagcaagtgagtcatgacttccgagggttacgtgaacaaaactgtcgcgtaatctcatcgaacttcttgaaactccgtgataatggggcctttcatgatggcgaccaagttgtcgctgaattaatgaatctagtcggtcattccgacgttttcagataagggggtcgtggcatgtcatacgccagtgacgttaagaaagaattgactaacctcgctgtccatcgcgagaatgctaaggctgaattaatggctttgattcgaatgaatggggcgatcagcattgctaatcatcacttcattttgaatattcagacggaaaatccggccatcgcgcggcgtatttaccggctactcaaacaattttatgacgtcgatagtgaattgattgttcggcgcaaaatgaaattaaataagaataatttgtacatcgtacgattgaagaccggtacggacatggtactcgctgatttgggtattttgaaggattatcaaatcgttgaagtggcaccaactgaagtgttaacggatgatgctgcggtgcgttcttatttgcgtggcgcctttttagcgggcggttcggttaataatcctgaaacttcccggtatcatttggaaatttactcactgtatgaggaacataatcatatgatctccgagatgatgaatcagtatggcttgaattcacgaacgactgatcggcgtggtggtttcattacgtacatcaaggaagcggaaaaaattgccgatttcttgtcgttggttggtgcgaccaatgccatgcttaagtttgaagatattcgaatcatgcgggacatgcgtaactcggtcaatcggttggttaactgtgagaatgccaacatggataaggttgccaatgcctctagcaaacagattgaaaatattttattgatcgatgctacggtgggattacaacagttaccaccaaaattacaagaagtcgctgttgcccggttggaacatcgtgaagttagcctcaaggaactaggaacccttgttccgggcgggcctatttctaagtctggaatcaatcatcggctgcgtaaaatcaatcaatttgcggaacaattacaaaaagatgcttagttgtcgataaggatggcttaagcatgagttttgttgaaaagcttgctaaccactttagatggtgttagcggcttttttgggttgaaatggattgattgtcgttcgccatactcgaaaagcacttgacaaaagtaagtgcaactatttatactgaacacatcttattgaaatcggagagacgtaattatgcaaaaatcaacaatgcaaatgatgatgtgctgcccatgttgtgaatcaaacaacatggctatttgcgttgaattacaagcgtctctgcatcaaaaataacgggattgagctcaaatcgttaattttgaaacgcctgcttggaatctgacgagattctgaacaggcgttttttgttacaaccgatgggaataagtagatcaacacatcaaaatgggaatgtaaaggggcgagaagtttgaagaagcgatcagtgttagcagtggtaatgagcctagtattagtgacggtgctggctgcgtgtgggaagcacaatagccagtcttctggtaatggcaagtatgcaagtagtcaggttttaaacttgtcgtaccctagttcattggattcaatcgatatttccaatatgtcgggatatggcagtacgggtaatatttttgaaagcttataccggttaggaaagaatggtagcattacaccgggattagctaagtcaactaaggttttaaaggatggcaagacgtatacctttacgattcgcaatgcaaagtggagcgatggttcgaagataaccgcgcaagactttgtctattcttggaaacggaccgtcaccccagcaactaagtcacagtatgcctacctcttctcaggggtgaagaatgcggatgaaattgtcgctgggaaaaagtcaccaagtacattgggcgtcaaggcgcaaggcgaacatacttttattgtgactcttgataagccaattacttattttaagaagttaatgacctacccgttgtttggaccaattagtgagaaagcggtcaaaaaatggggtagcaaatatgccactaaggctcagtacatgctctacagtggaccgtttaagttgactggctggactggaactaataatagctggcagtttgtaaaaaataatcagtactgggataagaaagctgtccacctacaaaagatcaactacacggtcaatgagagtactacgacaacattgaacttgttccaagaaaagaaacttgatctaacgcaattagcgagtgaacaagttaagaatatgaagagcagttctgactataccacgtacccttattctatcaccgcgtttctggtttataatttccaagacagtaatgcgacaatcaaaaaggcgctcaataacgctaagattcgtcaagcaatttcattgtcgatcaatcgcaagacgttagtaaagaatgtgattggtgccgcatcaacggtctcaaagacgtttgttcctcaggatttagttaaagacgctaaaactgataaggattttgcagatgaatcaacggttaagaattcaacgtcatataacaaagcgctggcacaaaagttatggaaacaaggccttaaggaaacgggaattaagaaattgtccattcagttattagcttctaatgacgaacctaataagccgatttcacaatacttgaaatcagcattagaaaagaatctcgatggtttgacggtcaacttatccaacattccatcaaaggtagcttcaagtcgtgctcaaagtggtgattttgacctttatctcagtggttggggtgctgacttcaacgacccaatctcgcatttgcaaattatgactaataatagtggttataattacggaaaatataacagcagcacgtacaatgcgttggttaacaaggctcaaaaccaggatgccaatgatactagtgctcgttggcaagatatgatcaacgctgagaagacgatcatgaaggaccaaggaattacgccattgtatcagacggtatactcttatttacaaaatccaaaggtaaagggtattattcataatactgctgggacacagtggaattataagtatgcttatattgccaaataattaactgattgagggacgctcatggtaactggtcgtttagctgttaccttagtaggaacgccaggtccatacgtgccttgatcaaaacaaaatagcggtccatttcgacttgtcagagtgtcttgacgaatcgaagtggaccgcttatttatttcgacgaatggttctacagtgcttgagttgtcacgcaagacaactacactgattggtctatgctggtgttacgtcgttaaccacgtacttgattggctgatgttgggccatcgcaatcacattctccgcgacaatggtagccatgccatcgcgagcttcgaccgttgcgttgccaagatgaggtgtcaaaatgacgttgttcatcgtggccaaaccaggtgtgacttgcggttcatgttcgtagacgtcgagtgcagcgccagcaatttgatgttgttgcagcgccgtcacaagtgcttgctcgtcgacaattggcccccgtgcggcgttgatgaggagcgccgtggacttcgttttgctaaaagcagcattatcgattagatgcgttgtttgtgtggtaagcggcagatgtaaagtgacgatgtcggcacgctgtaaaagttcatcctgggagacaaaggttgcgtcaagttgcgtttcacggctaatcggtaggcggtggtgttggctgtataagatgggcatgtcaaaggcgtgtaatcgtttggcaacagcttgaccaatttggccaaggcctaagatgccgagtgtcttgccttgtaagttgtggccgagaaagaacagtggcgcccaaccgttaaagccgctagttcgcattaagtgatcgccttccacgatacgatgcgctaggctgataatcaaaccgaccgttgattcagcggttgcgaccgccgaaacgttcggcgtgttcgtgactggaatctggcgcttagctgctgccgcgatatcgatgttattagtgccagcaccaaaattagcaatcagtttaaggtgtggggcgtggtctaagacatcttgatctacttgagttgagagtggggtaatcaaaaagtcggcatcagcgactcgacggatgagttccgcgtgactgatcaggttatcgccggtataagtatcaatgactaactgactttgtaaaagtaacgtattagcttgggctggaagctgaccagcaataaagacttttgtcattatagagactcctttttacttttaagttcaaggacaagtaatattgtccgggtagtaatccctgcttatgtgcagtatgggctattgcaaaacgaatgacaagaaaacgagcaaaaaaactgggccaacgtcaagttagcccagtcaaagatattagcttattttaatttgttgttttccataatatcatcgatcaaaccgtagtctttagcctcttgtgcgcttaagtagttatcacgttcagtatcatggttcaacttttcaacggattgtcccgagttgtcagctaaaatctggttgatctttttacgagtcttcaagatttcttccgcaacaatttcaatttccgtttgttgaccttgagcaccaccagatggttggtgaatcaagatttcagagttaggtaaagcaaaacgcttgcccttagtaccagatgaagctaagacgctggccatggaagcagccatccccataacgatggtttgaacatcagatttgatgaagttcatcgtatcgtagattgctaagccggcagtaacgacaccacctggtgagttgatatagagatagatgtccttacctgaatcttgggcatccaagaagagtagttgggcaataatggcgtttgccatgttatcttcaatgggaccggataacataatgatacggtcctttaatagtcgtgaatagatgtcataagcacgttcgccacgtgatgactgttcaataactgtaggaactggatacatgatttgttagcctcctaaggttgcattatttgattagctgattgctaatataaatgtagtttaccgctaaggtcagtgaaggtcaaaagaaaaacctcaaaaacagaattccgtttatgcagttaacgtggtatacttaggtttctatcataatacggcttgagattgggtgaacccaatctcttttttttcgacgattttagttagtaggccttggattaagtgttgcgtctaccttggcttgaaaacgatgttctcttataataatgattcaagattaagcagtaatgaacttgcatattcagcactaatgtggtgatttaaaagtagtcgacccgcataattttattatcgcgatagtaggtgaatcaatttactgatagtgacccacaaagatgagtctaatagaagttggaaattcgcacgtgagccgacatattaaacgacttgaccttgttgctggactcaagttgctcgcaacgaattaatcagtatcggatgcatgaatgaaatttaccatgattaaaacgattctataatataataacaattgtagtaattattatttgaatggtgtaagtttagctgttattaaatctactaaacgactacactggtatatggtttacttgaactgattactttttgattatttttacttggacgagcgggtataggtactattactgaccccgaaaggatattacttgttgtttggtttaaattaagttactatatggagatgtgactggtatagtccagtagttgtcacttaaataaatgcacaaaaaaagctgagaatcatttctcagctactgatgcgcccggagggaatcgaacccccatctcaagaaccggaatcttacgtgctatccattacaccacgggcgcctaaacaacatattatattctagcgaataatggataaaaacacaagggttttacataaaaatttattcagggaggtatttttatggcactgggaccaggatttcgccagcaacagcggcaatcacagaagttagcgatgacccagcgactacaacaatccattcagatgttgcagtttaatgtggaagaactaagagattttctaacgcaaaaagcattagaaaacccattgatcgatgtggatacaaattggaataataatcacgccagtttgaacgcagccaaaaatgtaaccaccaaggcggatttcattgagcgtgtgtcgacctctaatcagcattcgttatttgaatacttgttggatcagattcacctaacgatgcgtgatacccatttgcgtcagattgtcctttatttaattgagtacgttgacgtgaatggttatttgcggattgatgagaggcaggttcggcaagaaactaaggcaacgccaattgagttgttggatgcaattaccttattacaacaacttgatccgccgggtgttggggcccggagcttgcaagaagcgctgatgttgcagacagaaaatgatgaccatgcaccgaacttagcctatattgtcttagaagaaagttttgacgagctggttaatcgacaatgggacttgttggctaagaagtatcaggtgacgcttgcggacatttcaagtatttatgattatgtgcgaacactaacacccgtacccggtgcggcaatcgggcaggagacgaccgggtacatctttcccgatttagtggtgacgaatcagggaggccagctggcattgcgaaccgcatccatggctcaaccggtggttaaattccgcagtcggtattatcagcagatggggcagcatgatgatcaggaagttacggaatatttgaaagaaaagaaaagtgagtatgactggattgctaacagtttgcagcaacgcgaggcaaccatttttcgagtgggaacggccattatcgagcgtcaagcagacttcttcttggaaaaaacgacggatttacggccactattgttacgagatgttgcccaacagttaaaagtgcatgaatcaacaatcagtcgaagtattaatggaaagtacattcaaacggacttcggtatgtttgagcttaaacgtttctttaccaaagcggtcagtaaacgtcccactggtggcaaaatcgtttcggccgacagtgttcaacaccgaattgtgaccttgatcgaacaggaaaataaagaaaaaccgctttcagaccaaaaaattgttcagattcttaatgcggaaaatgtcgaactttctcggcggacagtggcgaaatatcgcgaaaatcttaatattccgtcgtcatcaaggcgaaaacaatacttgagaaccgaacgataatttaacgcgccatttggaccagtcggttataagtttaattggggtttcatttgcaaccaccttatgaacctgttataattcatgttgtggtaagagaggtatgcaacattgatttcttagtgaatttgcgttgtgtgctttgttttttgaagtctttgggtcgcttttcgacatagctggaccagacccgtcccactagagagcaggttggatgccatgcattcagatattcaatggattgaggcaattgccccagatatggttgacatgctgagtcgtcgttacttagtattaagaaccattaattggatggccccagttggacgtcggctattagctcagacgttaggtgttagcgaacggacgttacggaccgaaacggatacattgcggaagctagatttgattatgacaaacaaatcgggcatgcaagttacccagcaaggtcaggacgtgttagtaggcctaagtcattttatggatgagctaatgggcattcgccagaaagaacgacagttggcgcaatactttaatattaagcgttgcatcatcgtttctggtgattccgatcgacagttgaaagttattgggaccatgggcgaagaagtgaaccagctattacagcaattattgccggaagggcgtaatattattgctgttatgggtgggcataccatggaacatgtggcaagtcacttaactaataaattaggtgataaacgtgatttgttatttgttccggcgcgtggtggtgttggtgaatcggttgcgattcaagcaaataccatcgcgtcacaaatggcacaacatactggcggtaagttccgctcgttgtttgtaccagaacaggtcagtgaacgaacgtatgaaccactcctcaaagaaccaagtattcaagaggtgctggcgattatcgggcaagctaacgtggtcgtgcatagtatcggtgaagccatttcaatggcccatcgccggaatatgtctgaggatcagatcaaggtgttacgcagtcgtgaagcgattggtgaagcctttggttacttctttgataagaagggtaacgtggtctaccggattccgcggattggattgcaaatcggagaactggcccatcgggagattatactcgccattgcgggtggggcttcaaaagccaccgcaattgccgcgtatatgaagaacattgcacctaaacagacgtgtttgatcacggatgagggtgcggctaacttgattttaaaaaagtaatcttctatagtgaagttgctttttaaaataaaactatttttatttccacaaggaggaaattctagtatgtctgtaaaaattggtattaatggtttcggacgtatcggtcgtttagcattccgtcgtatcttagaacttggtgaaaagtcaagtgatatcgaagttgttgctattaacgatttaacttcacctgcattgttggctcatcttttgaagtatgactcaactcatggtactttgaacgctgacgtttcagcaaccgacgattcaatcgttgttaacggtaagaactaccgtgtttatgctgaaccacaagcacaaaatattccttgggttaagaacgacggtgttgacttcgttctcgaatgtactggtttctacacttcaaaggctaagtcacaagctcacttggacgctggtgcaaagcgtgtcttgatttctgctcctgctggctcagacttgaagaccatcgtttacaacgttaacgatgacatcttgactgcagatgaccgtatcgtttctgctggttcatgtactactaactgccttgcaccattagcattctttgaaaacaaagaattcggtatcaaggttggtactatgactactatccatgcttacacttcaactcaaatgttacttgacggccctgtacgtggtggtaacttccgtgctgcccgtgctgccggtgtaaacactattcctcattcaactggtgctgctaaggctcttggcttagttatcccagaattgaacggtaaattacaaggccatgcacaacgtgttggtgttgttgatggttcattaactgaattagttgctatcttagacaagaaagttactgctgacgaagttaacgccgcaatcaagaagcatactgaaggtaacgaatcatttggttacaacgatgacgaaatcgtttcatctgatgttatcggtactactttcggttcaatcttcgatcctactcaaacagaagttacttctgatggtgacaaccaattagttaagactgttgcttggtacgataacgaatacggcttcacttgccaaatggtacgtactttattgaagttcgccactctctaatatttgattagatagttaagaactttaaaaccgcatatggttttgacggcggggggaggcaaaactcctcttgccgtttttttaatttcagcagtcacgaattctaggaggattttaacattggctaaattaatcgtttcagatttagatgttaaagataaaaaagttttaattcgtgtcgactttaatgttccaattaaagacggcaaaattggtgacgacaaccggatcgtcgctgccttaccaacgatcaaatacgtgattgaacatgatggcaaagccatcttattctcacatttaggtcggattaagagcgaagacgacaagaagggcttaagcttacgtcctgttgcagaacgtctttcaaacttattaaacaagcctgttaccttcgtacctgttactgaaggcgaacaacttgaaactgccatcaacaacatgaacgacggtgacgtcttagttgttgaaaacactcgttttgaagacgttgttaacggcgaacaagttaagcgcgaatctggtaacgatcctgaattaggcaagtactgggcttcacttggtgatgtctacgtcaacgatgctttcgggactgctcaccggagccatgcttctaacgttgggattgcttcaaacatggatcaagttgccgctggtttcttaatggaaaaggaaatcaagttcttaggtgacgcggttgacaatcctaagcacccattcgttgctatcttaggtggtgccaaggtttctgataagatcggtgttatcgatcacttaatcagcaaagctgacaagatcatcatcggtggtgggatgacttatacgttctatgctgctaaaggcatgggcattggtaactcacttgttgaaaaagacaagattgaattggctaagtcaatcatcgaaaaagctggcgacaagttagtcttacctagcgactcaatcgttgctgaaaagtttgataacgatgttcctagcaaggttgttgaaggttcaattcctgatggctacatggccttagatattggtcctaagtcaatcgaagaattcgaagatgttttacgcgacgctaagaccgttgtttggaacggaccaatgggtgtcttcgaaatgagcaactacgccaagggtacgcttgaaattggtaagttcttaggaaccttatcagacgcaacgaccatcgttggtggtggggactcaactgccgctgttaagcaacttggcgttggcgacaagttaacccacatttctactggtggcggtgcttcacttgaataccttgaaggtaaggaattacctggtattgctgctatttctgaaaaataatctgttctccgaaaggaaggtttatcgtgcgtacacctattattgccggtaactggaaaatgaacaaaacagctagcgaagctttagctttcgttaatgctgttaaggatcaattaccagatccatcaaaagttgaatcagtcgttgctgccccagcccttttcttacaggaaatggttgaagctgccaagggttctgatttaaagattgctgctgaaaatgcttattttgaagatgctggggcatttactggtgaaacttcaccagctgccttagctgacttaggcgttgattacgttgttattggtcattcagaacgtcgcggttatttccacgaaactgacgaagacattaacaaaaaggcacacgctatcttcaagaacggcatgaagccaatcatttgctgtggcgaatcattagaacaacgtgaagccggcgaagcagaatcatgggtttcaggccaaatcaaggctgctttgaaagacttatcagctgaccaagtaagttcattggttattgcctacgaaccaatctgggccatcggtactggtaagactgctacgagtgaccaagctgaagaaatttgtgcggttgttcgtaagactgttgctgacctttactcacaagaagttgctgataaagttcggattcaatacggtggtagtgttaaaccagccaacgttaacgaattaatgggcaaagatgatatcgacggtggtttagtcggtggtgcttcattacaacctgattcattcttggaacttgttaattatcaaaataactaataatagttattgcaagttgattgacaaacttctacaataagtgtgaaacaaataacaagccaattttaaggagagaaattaatgtctattattacagatatttatgctcgcgaagtcttagactcacgtggtaacccaactgttgaagttgaactttatactgaaagtggcgcatttggccgcggtatcgttccttcaggtgcctcaactggtgaacatgaagccgttgaattacgtgacggtgacaagagccgtttcatgggcaagggtgttactaaagccgttgacaatgttaacaagttaattgctaaggaaattgttggttacgatgtaactgaccaacgtgccattgaccaagctatgatcaagttagatggtactcctaacaaagctaagttaggcgctaacgctatcttaggtgtttccattgccgctgcacgtgctgctgctgacgaacttgaaatgcctttatacaactaccttggcggattcaacgctcacgttttaccaacaccaatgatgaacgttatcaatggtggggcccacgccaacaacgacgttgacttccaagaattcatgatcatgcctgttggcgcttcttcagttaaagaagctatccggatgggttcagaaactttccacaacttgaaagcgatcttgaacgagcgcggttactcaactgccgttggtgacgaaggtggttttgcgcctgacttgaagaacaacgaagaaccattcgaaatcttagttgaagctatcgaacgtgccggttacaagcctggtaaggatattgccattgcctttgactgtgccgcttcagaattctacaacgaagaaactggcaagtacgacttaaagggtgaaggcgaaaatggtcaatcatttactgccgaagaattcgttgacttacttgacagcattgttgacaagtacccaatcgtttctatcgaagatcctttggatgaaaacaactgggaagactggcaaatggcaactgccaagcttggtaagaaagttcaaatcgttggtgacgacttattcgttacgaacacggactaccttgcaaagggtatcaagatgggcgttgctaactcaatcttaatcaaggttaaccaaattggtactttaactgaaactgttgaagctatcgaaatggctaaagaagctggctacactgccatcgtttctcaccgttctggtgaaactgaagacacgaccattgctgacttagttgtcgcaatgaacgctggccaaatcaagactggttcaatgagccgtactgaacggattgctaaatacaatcaattaatgcggatcgaagaccaacttgaaagcacttcagaatataaaggtatccacggtttctacaacttagacgaagctgcacggaacaccattactagcaagtaatttgaagttctaatgaaaacgtcgttccgatgggacggcgtttttattatacataatttaaggaacatctgtttgattttagggtctagggacggacgagtcgtggtagaatagaaacatgcgtattttgagtaaggagcgagcagaatggatgactttcagcaacaaattaatgagtggtctgattggcaaggactgcaactgaatgccggtgcttttgaaccggtgattcaaaaaatttatgccagtgaaaatgagccttataaaacgccagaacccgttgcggataagttggccgcccgctttacggtcggacccacccaaatcgcgatttttccacccagtgaggttatcccccaaactcgggcctattatcaggcggaacgttttggactgacccggatggctcgattgagcttgggtgctccgcgtctattgcatgcgggcttcatttttgataagtaccagttctactacgtgatttatcagccactacaaggtctgacgctaactgaattttgcgcaacggctaagccccttgctaagtcaacgctggggcgccagattgggacgatgttgacgcgacttaatactgaagttcctgcatttgggccaaccgctgcccaatcaaccgagtgggatatactgggccccgactttgttgccgagcgtacggcctggctacaagtacacaccgtaacgcctaatcaatttgttcatggcaatctagtgggcgagaatttaattgtgactagtggtgaattaggtttacagcgattcagtgccgcccatcaagctgcaaaacaaacggaattagtcccgctatttttgcaagcatttaatgatgatactgacttattggctggatttaaggaaacttatcaaactgacgacttagaaaaggatctgttattaggtttgttattacgcctagatggaccacagcagattcaggcattacatcctggagcgcccgtgacgttagcggccgtccagcaagtgattgcacaacgattatcatgattaagagggggaactcatggtggcacagcggccgcacattgcaaaacaacactttgactttacacggttcagctcgattggccgggcactaattgtcggtgtgattgctgggatcgtggttagtatttttcgtttcagcatcgagcagggactgaggttcgttcaatgggtgtacgcacaaattcatacaaattggctactgctctttccatggataggcttgtctgtggctgtggcgttctttgtgggttggttagttaagaatgaaccgaatattaaagggtctggcattccacaagttgagggtcaattagctggcgagcttgattatagttggtggtcagtgctctggcgcaagtttgtcggtggtattctgggcattggttctggactgtttctcggccgcgaaggcccctcgattcaattgggagctacgattggtcagggtgtcgcgtcgaaactcaaacagacgggatcagatcgacgctccttgattgccggtggtgcagcagctggcctttcagcggccttcaacgcaccgattgccagtacgttatttgttctggaagaggtttatcataatttttcaccaatcatttggaccaccgcattagttagtgcgatggccagtaattttatttcgctcaattttttggccttgtaccagtattacacattccgtacggccataaccttccgttgagtcaatatggcaatctgattgggctcgggatttttctcggtattttcggttatctatatcaaaacgtgacgctgacgatgccaaattggtatgccaagttgcggttgcccagttggttggatggcttggtgccatttttactggtgattccgattggattaatttggccgcagctattaggaggcggcaatgctgttattttgaatttggccgcagtaacgccagcgttactcgccttgttaggaattttcgtgttacggtttaccttttctaccatttcatatggatctggtttgccgggtggcatcttcttgccaatcttgtcactgggcgccatcttaggtgcaatctatgcccagttcatggttgccgttggttggatgccgacgaacttgattccgaactttattatttttgcaatggctggatactttgccggcattggtaaagcaccgtttaccgcaattttattgattactgaaatggtcgggacactacatcacttgatgccattagcagtcgtttcgatgacggcctacttagtcgtggatctcttaggcggcgctccgatttatgaggctttgctagagaagttaattcagccgcggttaccggaacatagcggtatccaggatcggttagaattgccgatctttgaaggctctaagttagagggccatcaagttcgtgattttaaatggccagcagagtcattattgatcgctattcgccgcggggagcgtcaagtgatcccgcatggcgacaccttgatgcgggctggtgataccttaattatcttgactgaccgggataaccgtgcgtgggtgcgccatcaaatcgcacatttaacggtcgcgacgccctgagcactaaacaaagcaacgaattgttcaggatactggaaaaataaggcaaaatatgttaaattgttatagacatagcggaggctttaggaggcacatttcttgtataatttattgttaacgttaatactggttgtttccgttttgattatcattgcggtgatgatgcaaccatccaaaactaatgatgccatgtcttcattaaccggtggtgctgatgacttgtttgccaagcagaagccccgcggttttgaagcgttcatgcagaaggtaaccgtggtattaggaatcgtattctttatcctggcgttagctctagcatggtactcatcgaagtaattgaccgtcctcctgtgatttcaggaggcttttttttaaggtggtgtaatgatgctgaaacaaccggaaccgtttttctttgaacatggccaacatgccgtcattttattgcacgcctatgcgggaagtgccaatgatgtgcggatgttagcacgagcattagaacgggaagattatacagtttatggcccccaattcagtggacacgcgactgatgatccgcgagatattctcgcacagacgccggcgcaatggtggcaagatacgcaacaagcaatatcatttatgcggcaaaaaggctatactaaaattagtatctttggcttatcattaggtggtatttttgcgacggcggccttggagcgtgatcctcagttgttaggtggtggcacgtttagttcaccactatttgctggtaatcgtagtgacgttgctgaaatgtttatcacgctgagtcaccatcaactggcgcacagtcaattctcaattgccgagcgtgaacagatcttaatggtgttgccagaactggttcagcggcaactgcaggcagtcaatacctttaccacgacggaggttacgagtcacctcagcgctgtgacccaacccttcttcattggtcagggtgggcaagatgaattaattgatgcgacggtggcgcgacaattacgtgatcaattaccacaagtaccagttgattttcattggtatgctgatgctggacacgtgattaccgtcaacagtgcgcatcaccaattggaacaagatgttttaacatatttaaaaactatttataaatgaggtaaataatgtcagaagcaaacttacaagaacaaatcctgacttttttgcaagctcatcccgatcgcacgtatagtgttgaacaactaacggatgaattgcattttacaggcgcaacggcgtttacttttctagtaaaggaacttgcgaatatggaacgtaaaaaattagttagtaccgatgatcatgatcatttcaagctggtccaggaaacgaagactgttgaaggttcatttcatggtaatgacaagggctttggtttcgttcgttacgatcccgatttgcctgatatttacattaatccggacaacacgcagtttgccattaccggtgacgatgttgcggttgaaatcattcgaccagcccgtcccagttccgaccgcggccctgaaggtaaaattgtcagcatcgttaaacggaactatacccagattgtcggtgcgtatacaccaagtacggatgaagacgggattattggttctgtggaaattaaggataagaaattatccaaatatcagttattaatcactgatcagggcttacaccccactgagggggaagtcatcattgctgaagtggctgcttatcctgacgctcagcatccaacgcggatgattgggattgccaagcaggtcattgggagtgttgatgatcctgggatggacgtcttacaagtggtctaccaacacgacgtcccgtcagtgtttccagaagaagtgacggatgaagccaaccggattccggattacgtgactgatgaagaaaaagttggtcgggtcgacattacggaccagccattagtaacgattgatggcgccgaatctaaagacttggatgacgcggttgttgcttggcgcttgccaaatgggaacttccatctaggcgttcacattgcggatgttagccattatgtcaccgagaactctgagttagaccgggaagcattcaaacgtgggacgtcagtttacttaactgaccgtgtgattccaatgttgccacggcggctatcaaacgggatttgttccttaaatcctgatgttgaacgattagccatgagttgtgagatggagattgatcaaacgggggaaatcgttaaccataagattttccaaagtgtgattcggtcacacgcccggatgacttatgacgctgttaatcagattctcgaagcccatgaccccaagactcgtgaaaagtacgcggacttggtcgacatgtttgatacgatgggcgacttacaccgtatcttgtacaagcatcggcggcatcgtggtgcgatcgattttgatgataacgaagctaaaattatcgttgacgaagccggtcatccaattgacattcaattacgggtacgtggcttagctgaacgaatgatcgaaagtttcatgttggcagccaacgaaacggttgcaaaaaactatagtcaacttaaggtaccgtttatctaccgggtacatgaaacgcctgatagtgaccggatgcttagtttctttgaattcgtcactaactttggtgtcagtgtcaaggggagttctaaggatgttaagccgaagatgcttcaagacgttttgaagaaggttgctggtaagcccgaagaagccatggtctcagtcatgatgctgcggagcatgaagcaggcccgatacgctgaccagtcgcttggtcactttgggttggcggcaccgtattatactcactttacgtcaccaattcggcggtatccagatatgatggttcatcgtttgattcgccattatgctgaaaacggcactggtgaagaagcccgggcacgttatcgggataacctaccaaatattgcggaaacgacttctgatcatgaacggcgggggattgatactgaacgcgacgttgattcgatgaagaaggctgaatatatggctgatcacgttggtgagacgtttgaagccgttgttgattccgttatgaaattcggtctgtttgttgaactagaaaataccgttgaaggcttagttcatatcagtacgatggacgacgactactacgaatacgttgaaaaacaattagcgttggttggccgtaagacgaaacggacatttagaatcggccagcccgtcaaagttcaactaatgcgggtcgataaggatcaacgagaagtcgactttaagttattgaatcctgaagaagcgccaaagactgatttattgccaaagcgggaacatcatgataactatcgtggtaataaccggcgtggtggcaataacggtaactaccggcgaaatgggaacaataataaccggaataacgaccatcgtggtggccacaacaataaccatcgtaatggcaatagcaatggtcgccggaacaataataatcataatagcaacaataataatcatagtactaacaacaatcggcggtcatcaactgatcgtcggcgttaatttttaagtaaggggatgtgcggcaatggccaaacaacacggtaagcacccagataccgccctcgctcaaaatcggaaagcacgccatgactacgctgttgaggaaacctatgaagctggcattgcgctgacggggacggaaatcaaatccgttcgcgatcggcgggtcaacttaaaggatggtttcgttcaagttcgcaacggtgaagcctggatgcaaaacgttcacattagtccgtttaaagagggtaaccgttataacgttgacccgttgcggtcccggaaacttttgttgcacaagaaagaaatcagtaagctaggtgcagcaacgatgactaagggtgtgacgattattccacttaagatgtatctcaagcatggatttgcgaaagtcttaattggagtcgctcacgggaaacgggaatacgacaaacggcaagatatcaagaaacgcgaacaacagcgtcaaatcgaccgggttatgaaacattactaggcatcgattacgttagcgttgcatcgctgcaccatacaacgagtatggcagcgtcataaaaaggtcttccaagaattaattcgattcttggaagaccttttttagtatgtgttgttggtggttctgtgccgtggacggacgacggcaagcatatattttatatgtactgatgtagtgctcactgttataaatgttctagatactagcaaaatggttatcaggctataaatattttgcgaaaggtcgggtacaagcacttgcgacttagctggtaattatgttagcatataattgtattgatagttaaacgtgctatttattaattgattcaataaatataattgatactaaactttggagaatgttattattctgatattaatcagatttagtataactcaaattgataataagttaattttgatatgatttattgcatggattcttggggggacatgtatgaatagatttataacgagcaagcagcattataaaatgtataaaaagggacgtttctgggtatttgctggtattaccgtggctacctttactctgaatccactgataagtcgggcagatacggaaacgacgaccgcagccaccgcagctacgaccactgctggggcatcctcatcatccaactcacaggttttaaggactactacgactagtacaacaggggcaacgactcagtctagtgcgacggcgattaatgcggcaacaacaaatactagtgctcaaaaaaaacaggcggttagtggcaccactactgactcaaagactgaacaaccggttacggcagtaggagaaaatgaaaacgaaaccagtaatctcagtacctctgattcggcatcagcaagcagtcaggctaaaactggttctggcgacagtttggaccaaacgtcaaacagctcagtaagtgtcgcatcgagttcacagaaagtcacaacacaaaattctgattatcaaaatgatcaaggaacgggctctgagagtggcattcaatctaatgtgacggacacggtggtggctgatgaatcactacaaactaatcgttcaagtgtcgcatcgccaagtactagcacaatggccagtattggtgactcagactcgaaagattctaatgaaactgaaaaagttgtggattcagaaactagtccgatagctgtaactgccacaactaatacaattacgacgactaacgataaagtccagttaaatcgggcactattagcgcgagccgccatacccgcaactgttgtctcaactgggactctgggaacaagtgcctggcagtacacagatgatggtgtgttgacgattcatgctggtgattggaccggagtgggtgatgtcagcgacgtaccgggggattttggcagtgagttaacgaaagtagtgattgatggtccaattaatgcggggactgatactagttatatgttccggtataatccaaatttggccagtattgatggccttgaaaatctggatacttcgaaagtcactgacttttcaatgatgtttatgggaactaagattgctgacttttcaggattagcgcattggaatgtcagttctggtacgtcctttgactctatgttcgccagtgactcgcgagttcaatcttatgatttaagtcagtggcagttgaatacggttcaaccagtgagcttaaaaagaatgttttcatttaacacggccttgaccagtattgatctaagtacttggaatgtgcggatggtcacggatatagatgggttattcaatggagataagagtttaacaacggcggatttacatggctggaacttgttgaatgttacagcgttgtcatcgatgtttttaaatgataccaatctcactgatcttgatataacgggctggcagacgggcagtacgttaactagtactaagtttatgtttgagggaacccctggattaaaggcaatcaacattgcgagtttggacatgtctaactttgcagcagtcactgaagctgatatgaataaggaacctgcagatcatgatatgtttttgaatcaagatagtagcgggaatccgttgcccatgaacctaaacgcattaacggttgggtcaaaaacatatttagtcggtagttcattgccaaacattccaactggaactggctataccggtaaatgggtcaatcaagctgatgccacccagacgtatacgtcgagtgagttaatggctttgtataatggcgtcgataatccagccgatacaatcacttgggtctgggaaactagcccatcctatgctgatttcacgtccaagaatgtaaccggattaattgccgggccgaagacgacgtggcgagttgccgatagtgttgcaacactaaaagatgtgaatgggactgatatttatgcgaccgctgacacagtcgtcaaagtaattagcgtgaacggcgatactgctgtaacgacggtcgacactcaaactgccggtacctatcaagttgacttgcagtatacggatgcgtatggcaaagtatggcagcaaactagtacggttgcggtagcggtaaatcaaggcaaactagttggtaaaccgttggcgatcaaaacgggtgctaagccaacgtatacgattaatgatttaatcgacacggacaactcccgcaatgcggccggcgataagctaagtgctgacgaactcgcgacggctacggttacaggcttggatacgagtaaagctggcgcacaaacggttacgctggcgtatacggatgatgctactggcatggtccacacgacaaccaccacggtgacgatggtcgcaactaaggccgacttaacaatgcgtaatagtactatcattaaaggacccaaaaactcaagttgggactaccgccagtatgtcacgagtgtcactgattttgatgggaacccggttagtttagatggacttaacattgtggttgatcagcaacctgatttaacgcaaattgggtcgcaaactgtcacactcacgtatacggatgcgttgggcaatgtcatcagcgtcccaactcaagtaacagtcgttgcttctcaggcacaagttacaaccaaggcgccgttaacgatttggcccagtgaggttgctcaattaaaagtcgccgatttggtgacaatcacggctgccaacgggaaccccgtcgatactagtaccaacctaacagatgtcacaatgagttcaattgacacgagcaagggtggcgcgcagaccgttactattacttatacggatgaagctggcaatctagtgacagcttatgccaaagtaacggttgaccaatcagatttgaagaccaagctaacgaatccaattgcggggcctaaagctaaatgggactatctagctggtttggaatgggtcaaggatgcaaatgaaaagttgcttgataatctcgcaaccgctgatattaaagtcgttactgaacctgatttaagtgttgcgatggtcggccatgaccaaacggtgacactcagttatacggatgagttgggcaaagaacacttagtcactgcggttgtcaacacggtggcttcgaaggcgaagattacggctgtcagcgaccagatcatcatacctgatgaagccaaaaagctgacggcaaccgacctggtcagcgagttaattgatgcggcgggaaacaaaatcacgaattttgatggtgtgacgatgagtggttttgatgctaaagctatcgggccacaaaccgtgacactgacgtattcggatgcgtatggtaaccaaacaactgattcgacgacagtcaccgtggattccgcaacgctaacgcttcagaatcacactcaagtggcaggacctaaggcgacttggaattatgctgataacatcaaagccatcactgattctaagggccagtcgctaacattaagcgatgccaagattacggtcgtgcaacgtccagatttaagtgtggctggaacttataaaattgtacttgaatatactgatgatttagggcaagcgcacacagagactgccgatgttgaagtgacggcttcaaaagcggccattactgccgtttctaagcaggtgattttggcagaaaaagcgaacatggtaactgcgtcgtcactaatgtcgacactgtacgatgcggatggcgttcaaatttataattttgatgatgtgacgatgagtggctttaatgctaaagctatcggaccacaaacagtaacgttagcgtatacggacgcgtatggcaatcaaacgactgtttcgacgactgtaaccgtggatttcgcaacgctaacgcttcaaaatcacactcaagtggcgggacctaaggcgacttggaactatgctgataacatcaaagccgtcactgattctaagggacaatcgctaacattaagcaatgctaagattacggtcgttcaacatccagatttaagtgtggctggtacgtatccaatcgtgattgaatataccgatgatttaggacaagtacacacaaagactgccaatgtcgaagccacggcttcaaaagcgtccattactgccgtttccaagcaagtaattttagcggaaaacgcgaacatggtaactgcgtcgtcgctagtgtcggcactgtacgatgtggatggcgttcaaattcataattttgatgatgtgacgatgagtggttttgatcataaagctatcgggccgcaaaccgtgacactgacgtatacggatgcgtatggtaaccaaacgactgattcgacgacagtcaccgtggatttcgccacaatcactggtcaagcgacacacccaattgccggtccaaccgcgacttgggattaccgggacagcgtcactcaagtcatcgataccaacggaaagacaattgatgtcgatactgctgacattacagccacaacgcctgatttaactccggcaaaaactggcaagccacaaacggttacattgacctatactgacagtctgggtaaagttcacacgaccgacgtgattgtaacgacggcgctttcaaaggcgaagattacggctgttgctgaccagattatttggcctgatcaagctaaacaactgacggcaacggacttagttgatcgtttatacgatgctgaaggtcatctgattacaaattacgacaatgtcgaaatgagtgcgctggattccaagttagcggggcagcaacgtttgacgttgacttacacggatgttgcgggtaatcaatccgtcgcttatgccaatgtgacagtcgaccaggcaaagctagtgacaaaaccaagcacggtaattgctggcccgacggcaacgtggagttacgaagccggtattagtcagttgacgaatgcagctgggcaacttattaccgtccaaccggggacaattaaagtgttgaacaggccagatctgaatgttgattcagtcgggcaacaacagctgatcacactgatttatacggatgagctcgggaaatcccagtcggtcacggcaatggtgacagctgaggtctcacaagctacgttaacggccaaggcggcagttatcgtgcaaccggatgccgcggcgaagctaacggctaatgaccttgtaacgagcttaacggacgcctctggacaagcggtgactgattatcaaatcgttcagatgtctaagctagacgcgactcggccaggtgttcaacccgtctcattaacttatacggatgcggctggtaacgaagtaagtaccgttgtaaaagtaacggttgatcaggccaagatggagagtcagaaccggactcaaatctggggaccaagtatgacttgggattatcggcaacaattggcaactgttacggattcgcaagggcatcagttgaatcctgatcaagctaaaattacggtcataaccggcccgcaactgacggctaaaatgatcgataagccgcaaacggtcaccttgatgtacacggatgatctgcaacagacgcatactgtgtcagccattttgaccttaacggcatcacaggcggcactcgtgccacgtccggcacagattgtatgggccaaagatgcggggcaactgacgccagccaactttttgcaaacgattaccggcgcggatggcactcaagtgtcgtctttgactaatgtcaaaatgagtgcagtcaatgctagccagcctggtgcccaaacggtgactctaacgtataccgatgattacggcaacgaggtgacaacaactgcccaagtgacggttgatcaagccgccttaacgacccaaaccgctcgaccggttgccgggccgactgcccattgggattatcagacgaactttaaaaccgtgacgaatgctgccggcgaagtgattaatgtcggtgatgctaatattaaggtgttgacaggcccagatttgagcacaggcatggtggggcggcctcaagtcgttacgttcagttacactgatgaattaggattgacccaaaccaccacggcggaggtcacaacagtcgcctcacgggcgcacatgacgactagtgctgaccaggtgatttggcctgcagctgtcggaaaattaacggttgcggatctagtcactggtttaacggacgcctggggtcagactagtcagaattatcaaaatgttacgatgacgaccatcaatgctcaacaggccggaaaacaacaagtcaccctgacatatactgatgaggtgggcaacgtaaaaactgcgactacgacggtgacagtcgaccaagcagcattaacgactcagccacaaatggtcatcgcgggtccgactgccaagtgggattatcatcagggtattggaacgattactgatggtatgggccagccgattgcggtcaataatgccgctattacagtcgtggcgatgccagacttaacggttgcccatattggtcagccacaaactgtgcaactggtttacacggactcgctgggacaacaacaaacggcgttgatccaagtgacaaccgttgccacgcaggctaaaatcagtacgcggccagttaccgtgattgccggccctaagacgacctggtcactgaatgatagtgttgactggtcaacgagtttggcagcggatggcacgttgctgacagcggcgcagcgccaacgggtgactgtagatggtaccctgaacttacggcgggccggcaattacccactgacactaagttacatggaccgtgcgggtaatctgattactgtcacgacgagtatcgatgtattggctagtcaggcccagttacaagtgcgtgatagtcagttgaccgtcggaaacacttgggctgctcaggataatttcgaacgtgcaaccgatgcccagggccaagcactgacattagccgatatcgcggtcgatggtacggtcaacacgcaacgcactggccggtacacattgacttaccactatattgatgttgccggtaatcagttaactaaaacggccgtggtgaccgtcgtcttacctgacgatgatcacattaacacgaccgaccctgataacaatgatcatggtggaacgaccgtacctgacaacaatgatcacggcgaaacatctaaccctgacggcaatgatcatgcaggtatcgctgatcctagtgaaacaccgaagccgagtgagcgacctaacgattcggatggtcataccgtcgactggggcgttgatgatcggattacgacaaagcaacaaccggccgcggctactcgtgcacagactaaggtcaagacgaccgctgagccagctctaccggccaacaatgagcatactagcgcagccaaagcagcagcgacacctgtgacacgagtaactgacacgactgctgacacactgccacagacgggcgagcgcgaccgctcagcacaacaaggcgcggtagtactcggattaacgggattattagggttaatgggattaggacgtcggcggcatacgcatgaggattaagcgtacgattggcgtgttaggttcatcgattagctaaaattgatagcgatttcttgcaacggaccgattcattttgaattggtccgttttgttaactgctgctgtttggacttaatggctggttgcgcgggttgatgaatctagtgtcaagtattcagttaagcagtgattaatgcttgaacaaaattttaaaacataaagagggggtactttcatcagaatctttgctagaaatgactatttactttattttattaagtaaacagctgatgatagtgacatcattaaagctaaattaaaaaagtataaaaaattgaattggtcgcgagacatgaattatgttatattttatgacataccgttccggtaaactatttgaggaggtctcgtcgatgagaaagtggcaagttgcagttgtcatgttgttagcagcgttgggaagctggtttgcgattggtacccaggcccaggctaagacgtatacgattgcgacggatacaacctttgcgccgttcgaatttcaggtcaagggtggtaagtataagggaattgatatcgatattttgaaggcaattgccaaaaaagaaaatttcaattataaattaaaagcgcttagttttggtgccgctgttcagcagcttagtgcgaaccaagttgatggggtaattgccggaatgaatattacggctgaacggaagcagacgtttgatttttcagacgcttactatacttccggggtggtcatggctgtggctaaagatagcaaggtcaaaacgtttaaagatttgaaaggtaagaccgtggcccttaaaacggggacagctggtgcaacctatgcgaagtcgattcagagcaagtacggcttcaaaatcaagtatttcaatgactctaataacatgtataacgatgttaaggtcggcaactcggctgcttgttttgaagactatcccgtgatgtcatacggaatcaagaatggcatcgcgttgaagattgtttccaagcaacacgaggccggcgactatggtttcgcggttaaaaaaggtaaaaacgcggaactgttaaagaaatttaacgcgggtctcaaagcgattaaagcggatggtacttacaaaaagatcattaacaagtacttgaagtctagtgaagcatccttaacgggtgaagacgcaagcagtcggacctttattggcttgttcacccaaaacttggatacgattggctcagggttatggatgaccttggaattaacggttatttcaattattttagcgacgatcctcggactgattcttggggtcttaggcgttatgccgggtaaacttggtccggccatctccagtacgattatttatattttccgtgggatgccattgatggtgttggccttctttatttacattgggttcccagacctgattgggcacggctttaagattcccgcgttcgttgctgggatgattacgttgatgcttaacgaaggggcctataccggagcctttgttaaggggggctttgccgcggtcgacgatggtcaaatggaggcggcccgttcactcgggttgccatactggacggccatgcgcaaggttattatgccccaaggaattcgaatcatgattccgtcgttcattaaccaatttattatcacgctgaaggatacgtcaattctatccgttattgggatcgttgaattaacccaaactgggacgttgattattgcccggaacttcgaaggctttaagatttggttaatgattgcgattatttatctgattatcattacgttattaacatggttatctaactgggttcaaaggaggattaactaagcatggcgaaagtaattgtcaaagatttgcataaaagctacggcgataacgaagtcttgaaagggttaaaccttgaagttcaagataacgaagtagtctgcatgattggaccatctggttctggtaagagtacgtttttacgctgcttaaatgacttggaagttccaacacaagggcaagttgtcattagcggttacgatctttctgacaaggggactaacattaatttggtccgtgaaaatattgggatggtgttccaacactttaacttatttccacacctatcagtgttacaaaatattaccttagcaccgactcaactcaaaaaggaaagtcaacaggaagctgagaaaacggcgcgtgacttacttgctacggtcggcttgtccgataaggcggatgccatgcctaagtccttgtctggtgggcaaaagcagcgggtggccatcgctcgagcgctagccatgcatccgaaaatcatgttgtttgatgaaccaacttcagcactggatcccgaaatggtcggggatgtgttggatgttatgaagaaattagccgcagatggtatgacgatgattgtggtcacgcacgaaatgggctttgccaaggaagtggccgaccgggtcgtctttatggcggatgggttgattcaagaaacggggaagcctgaggatgtattcgaacacccacaaagtccccggttacaagatttcttacaaaaagtgatcaacgtttaagtatcggctggtcataataaaataacccgtcaaataggcgcgctaagaattggtttaattcttggcgcgcctattctgtagtaacgtgcttgcatagcagatgaagcggtgttgctctgaggacgattaactagtgaataccgtgatatgggcaacttgatcggcacgtcaactttgatagggtgttaagctggcaaactagttatgccaacttaactaaaaacaacggtcatcccgaaacaggggtggccgttgttttatggctagttctatttagtgttggggcaccttattacggggtgtcaatgtataattactttcaccaaagctaacattgagtccctttttcgcaactggtgtccgcgcgcggttggtcggcttttgccagtgatccaggatcgccgcaatgcaaatacacagtggttctgtggattgatcagtaattgctaattcaaatgcttcaccgttagtggtgacaactggtcgcatcgtcatgattaattcagtaccatgataaacgcggtagttttcggcactcaagcttcccatgataatccagcgaagcttgcgaacatagagcatttcatgccagaagcccagcgttttactaatagaaccgacgttttgacggttatagtataaatcgaattttggcaacaatccgagggttgtttgtcgaatttcggcaagtagctcaccttggatcgcgtataaactgagcgcgtcttggcgccgcccccaccgaccaactaagagatagtgagattggttgtgcgcatcgcgaacaatccgggcaccttgggcgaagctattgcggctgaaatataatttacgcatcttcaacctccgttttccggaaactattgtttggcaagcacttctaagattgctttgccgacaccatcgttgacatttgtatcagtgatatagcgggccaactgtttgacttcgggactggcattacccatagcgtaacttacgccagctaattcgagcatggagacgtcattattattatcaccaatcgccatgacatcgctcattggggtattcagcatattcgcatagcgctcgactgcaatccctttttgcgcattaatattattgatttcgatatttgatgcggatgaagatgtgattttgagggacgaatgttttgccagaatttcatcactaaggggttttagcttagcgggcccttcttcgctgaaagcgataatcttcatgacatgcttagtcggatcatccaataactcgttatagttgtccacgtaattgatgtccataagttctaagcgggctgacgcgagcgataccgcaattttgaacgttgtatctggattcaggttagttaggagatgtgcaatttgttcgattcgcttggctttactgttagagtaaataccatcgttgcctacgacttcaaaatagtaaccttgtgaggttagcgtgtgaaaaacggtgcgggccacgctattggttatgggcaccatgtcgagcattttgccagaagcgtcgtatacttcggcaccgtttaacgtaatcaagggtgccgtgatgccttgagcggccagtagtggctgagcttcagaaaatcggcggccggtggagacgataaagtgcacgccttgctgttgtgcttgacggatggcattagcgttaaaatcggaaacgaccatttcattgttgagtaacgttccgtccatatcagaggcgataatcgaaatcatgttgtcacatccttagttgttttaataattacattttaacatgtttacgtctgaatacagaattattatcattagtggttttggttatgatacaataaaacgagaggtgttaaggatgaaagcgtttattcacacggactggtgggacgtcttaaaaccagagtttgagaagccgtattaccaccaattacacgaatttttgaaaaatgaataccgaacgaaaaatattcacccagatatgtataatatttttcaggcctttgaatggacgccatttgctgacacgaaggtcgttattttaggtcaggatccgtatcatggtcctggtcaggcacacggactgagtttttcagtgttaccgggcgtggcagtgcccccatcactagtcaatatctataaagaattgcaagatgatgttgggtgtacgcccgtcaaccacggttacttggaaagttgggccaagcagggagtcttgttattgaactccgtgctgactgttcaaaatggtgtggccttttcacacgctggtaagggctgggaacgacttacggacgttgccattcagcgtttatcggaacgatcgacgccggttgtctttatcttgtggggtaaggcggctcggtccaagattaagctgattgatacccagacgaatgtcgtgctacaagcacctcatccgagtccgctttcagcttatcgcggattctttgggtccaaaccattttcaaaaacgaacattgcgttaacatccttcggcgaacagccaatcaattggcagttaccagagcacgtcaatcttgagcattaattaatttattggagggttatcacatggatttatttgagtcattagcacaaaaaattactggtaaagatcaaacaattgttttccctgaaggaactgaaccccgaattgtcggtgcggcagcgcgattagctgcagacggcttggttaagccgattgttttaggtgcaacggacaaagttcaggctgtggctaacgatttgaatgcggatttaacaggcgttcaagtccttgatcctgcgacatacccggctgaagataagcaagcaatgcttgatgccctcgttgaacggcggaaaggtaagaatacgccagaacaagcggctaaaatgctggaagatgaaaactactttggcacgatgctcgtttatatgggcaaagcggatgggatggtttcaggtgcaatccatccaactggtgatacggtacggccagcgttacaaattattaagaccaagcccggttcacaccgaatctcgggtgcatttatcatgcaaaagggtgaggaacgctacgtctttgctgactgtgccatcaatattgatcccgatgccgatacgttagcggaaattgccactcagagtgcggctactgctaaggtcttcgatattgacccgaaagttgcgatgctcagcttctcaactaagggttcggctaagggtgaaatggtcactaaagtgcaagaagcaacggccaaggcgcaagctgctgaaccggaattggctatcgatggtgaacttcaatttgacgcggccttcgttgaaaaagttggtttgcaaaaggctcctggttccaaagtagctggtcatgccaatgtctttgtatttccagagcttcagtctggtaatattggctataagattgcgcaacgatttggtcattttgaagcggtgggtcctgtcttgcaaggcctgaacaagccggtctccgacttgtcacgtggatgcagtgaagaagacgtttataaggttgcgattattacagcagcccaaggattagcttaaacggtcacttagtttgttaaacgagggaaacttcagagcttgtactttgaagtttccttcgttttttctataataagaacagttaatttggatgaggagttggaagaatatggaatcaatcacggtaacgtcgccggaagcaaccatggcaatcggggccaaacttggccaattagtgcaacctggtgatttaatcttactagatggtgatttaggtgctggtaagacaacttttacaaaggggttagcaaaaagcctgggcattcctaataacgttaagagtccgacttttacgctcatccgggaatatcgtcaggggcgactaccgctctatcatatggatgtttaccgcttggaagatggcggtgcggaagatttaggcttagatgaatactttgatggtgatggcgttagtgttgtggaatggtcacagtttattgccgacctcttaccgacgacttacttgcgaattgcaattagccgggacactgatgccgatgaccagcgggtaataaccttcaagcccattggtgaacactatcaacgactggttgatcaattgaaggagtgacaaccatggcagaagaagttgttgatgtacggcctgctgaagtcgcggatgcagcacaattattagcgctactcgctcagctcggacgtgaaagtaatactttcactgttgatgagggcattgaggatttgagcgaaacggatgaacaggcgcaaattgagcgtatcaatggcacaacgaccaacattattttcgttgcgacattagattcacggttgattggtgtgagcaccgtgcaagctagtacggattttagtgcggcgcaaggtgaagttggcgtagcggtacttaaagaattttggggcatgggtctggggactgctttgattgaggaagtcttggattgggctcgtaactatagctcattggaacgcctcgtgttgacggtccagttacgaaatgtgcgtgccgttaagctgtaccagcatcttgggttcgaaaattgtacggcaacgagctatgatgtcgttgacccaaccggcaaacgggttccagctattgatatgggaatctgggtttgaaatccgggattcgctgaactgacggcaaacaggttctgatagtagatgggccggaatttaagcgttgacgaaccaggcctaaccggcgacggcttgtgaatgattggctcatctcccagtcggttgggggaattgataagctgtctacgagtattgataatcggtagtgatgcgtaaacaaaaaagtccagcatcttattgctggacttgcataaatttaattttaaccctgaacgcgaacgaaaggtttgagttgctcagttccaaaagcttgcgcttcggtgagtaaaatgttggcgcaagctaggctgtcatctagtgcattatgatgatgctgcaggtcgatatccagtgcttgacagactgtatccagcttgtgattaggcaattctggatagaaccgttgactggtcttgacggtatccatggataggtactccggcgcgctgatgccgtagtgggcaagcgtattgcgtaacacaccaatatcaaaaggcgcgttgtgcgcaattacgaggcggtcgcgttggaagaatggtgcaatgtgttgccaaacgtctggaaacttgggcgcgtctgcgacatctgcttcatgaatcccatgaatttggacgttccgccagaaaaaatcgctctctggtttgatgagtgtgtaaaactcatcgctgatttggttattacggacaaccgttagcgccagtgaacaagcactgtcgcgtttcgcgttcgccgtttcaaagtccattgcgacaaagttcaaagttgccaccaccgtttctaaagaataggattatcgtacaaagaatctcgttaattttcaagttaatggttcggaaggataatatcgagttccactggacagtgatcagaaccaaaaatttcattatgaatgcgggcgtttaggagctgactgtctaattgctgtgacgtaataaagtagtcaattcgccaaccagaattgttgtcacgtgcatgcccacgataactccaccatgagtaaatgtcggtttggtcaggatagaaatgccggaatgtgtcggtatagcccgctgcaaggaggcggtcaaacttggtccgttcttcgtcagtgaagccggcactatggtgattgctacgccagttcttcaagtcgatgttttcgtgggccacgttaagatcaccacaaaagatcaacggcttgttggcactcaaactgttaatatatgtgagaaaagcatcttcccactgttgccgatagtcgagacgttttaattcaccgcctgaattaggagtgtaacacgtcaagacgtagtagtccgcatattcaagggtgatgacgcgaccttcgtcatcgaattctggtacaccgataccataagttacattgagcggctcgtgtttggtaaaaatcgccgtacccgaataacccttgcgctcggcatagttccaatattgataataacctgggaagtccagttcaatttggcccgcctgtaatttcgtttcttgtacacagaaaaagtcggcatcgagttcattaaaagtcgtgacaaagccgtgtttgacagcagcacgcagtccattaacgttccaagagataagtttcacgtgagtttcagacctttcaagtaatttactcatattgtaacacggcagccactggttattttaatgacaattgaatcagtgcgccgtgattaaagccagacacggcggatagatgtgcgatagggtgacaaagcatgctggtgtctttggttggcctagtttcagcgcgtccgagcgggtatctttggctttcagtgatggcacgtttttccagctaacaatcactggcatgaattggacgctgaatgatttaaatcagtgtgccacggagcaatcagtagtagctaaaagaagattgatgataaaattggaggaatatcgatgttaaaaattggggtcattggtttaggtaacattgctcaaaaggcgtatttacccgtcatggcggcgatgcaagaccagtatgaatttcatctaacgacgcgtaatccggaaaaacgagcacaactagcgacgatgtatgggtttcaacacacccatgcgacccttgaggaattaatggcagttaaaccggcggccgtatttgtgcatactcccacggacacgcatgcagcaatcatcaagcagttgttattagctgggattcacgtttatgtcgataagccagtcgcgactgatcttcaggtggtccaaagtttgtatgatttggctgcggcgcggcacctgttattgacttgtgggtttaatcggcgttttgctccttttaatcagcaattgaaggcattgcctgacaaacggatgttagtggctgaaaaagttcgcgaagtgggtagtcaagatcctgaaacggcggttttcgacctgatgatccacatggtcgatacggggctattcttgttagatgaaccacttgaacacactagtggtcggttgacgacgacggcaactggcgcgttggcgcaagtctatttgacggtgcagacggctcatgagcaattagaagttatcacgaatatgtacggtggggtcaatctggaacaagtgacagtccaaacgacggggcaacgtgcgtctgtgactgatttaagtactaaaaccgtgatgacgacggcaacaactaccacgacggcttttccggattggacaccgacattggaaaagcgaggatttgcaccgctgatccgtgcttttctgacggcggtaacaacgcacggacctaatccagtcgacccaactggcgcaattaccagtcacgcggtgtgccgtcatttattaagtgattaaaaagtgctaaaattaactgataggcttacaaatttcaacctgattatatcgtttcaatagcgtttcaatgctgcggtgcttgatacgtcggcctaaattaaaaacgctatgcggttaaagtgattattaacgtaagtgaattaaatcgaaacacgaaaggaacttttcaccatgaccaaagatgtcttggccacttttccagccatcgaaattaaaaaaaatgaatcactaagtcattatacgaatactaaaacaggcggtcccgccgattacgttgcgtttccaaagtcaatcagcgagacgaaagctctgattacgtttgccaatgagcaaaatttaccactaaccgtgattggtaatgccagtaatttgattgtcaaagatggtggtatccgtggattaacgatcattctcacccgcatgaagcaaattcatgcgagtggcaccaaagttgttgctgaagctggtgccgcaattattgcgacgactaaggttgcttgtggcgctagcttgactggtctcgaattcgcagctgggattcccggtagtgtcgggggtgcgattttcatgaatgctggtgcgtacggcggcgaaatgagtgaagttgttgaaacggtgacggttttgacgccagcgggtcagcttaaaaccctggatcatgacgaattagattttggctatcggcacagtacgatccaggactatgatgatattgtcgtatcggtgacgtttggtctcaagccaggtaatcagaccaagattcaagcgcggatggacgaattgaatacgttgcgagcagccaaacaaccgttggaatggccatcatgcgggagtgtttttaagcgaccaactgggtattttactggtaaactgattcatgatgctggcttacagggccatcgaatcggtggtgctgaagtttctaagaaacacgcgggttttattatcaatgtcgatcacgctacagcgaccgattatatggatatgattcactacgtccagaaagttgtatttgaacggtttggcgtccatcttcagacggaagtccgaatcattggtgaagacgtcgttcaaggttagttatgtcaatttaacaaagggggcaaccactagatgccgattatcgaattagtgattttactggcatgtttagtgctgctgtcgaatgtattgagccactatctagtcgcaatcccggtcagtttaattcaagtcgggctgggtctaggagtggctttattattaaatgtacaggtaaaattgcaaacggattggtttatgctcgtctttattgcgcccatgctgtacaacgatggcagagaatttccaaaacaggaattatgggaactacgcggggcaatttttgcgaatgcaatcgtcctcgtctttattaccaccattctcggtggctttttgattcacgtattgatcccaacgattccgctcgctgttggaatcgcgttggcggccattttatcgccaactgatccgattgccgtgcagtcgatctcggaaggggtcaagttacctaaagaaattttgcacttggtcagtggcgaaagcctgattaatgatgcgagtgggttaattgggttcaaatatgcgttagcagcagcggttaccggtacgtttgtactcggtgaagctgttggggatttcttctatattagtctggtcggtttggccgttgggctggcgctgatcacgatcattcaactcattcgggacgtgttacgacgagagggtatcaacgatatcgtgttcaacgtggtgttacagattctcacaccgtttgcaatttatttcattgctgaagaatggttccacgcgtccggtgttgtcgccgttgttgcggccggggtattatcgcacttgcaaaattcacatgaaagtgaagatgcgccggaattacgattagtgacggaacgggtctggaacgtggttgtttacttattgaatgggatcgtcttcctgattcttggtattgaattgccggcagcaacgcaagcaaccattaaaggcgcgcatacaaatacgtttcatgcggtctttgacgttttaatcgtctgggggattttgttactgattcgggttgcttggacatacgcttacatgttgttcaactggttacgacatcacaagaaggctaaacctagtctcagaattgcagcattgtccggtttatcaggtgtgcggggggccattacgatggctggggtcttcacgattccaaccgtggtggcctcgggcaaagcctttccggaacgtgcgctcgtactgttcattgcggctggagtcatcattgtaagtttagttgctgcggcggctattttgccattgatggcggccaaatcactcccctttgttactcggggatccagtccggatgaagacgacgcggtcttggcagagggaacggatgacggtgatgatagcagtgggcaattgccacagttaacatacaagcaagcccgcatttatatcttacagttagcgattcaaaacattgaagaacatcggcggccagctaaccaacgtgcggcctatgatttgatcttggaccagcagtttcagattcggcgtctagaagtggcgtcgcagactgcggatgagttggcgccaatgctgacagatgaattggaacttcgcttagtggcactgaatggtgaacgggcagcagttagagaaatgattgccaataaacaaactagtaagttagctggacaggtctacttgcggcgtgtcgatcggcgcgaacaacgtttcttacaggcgacacatcgacaggggcttccgacactgcgctcattacggttgttgttgacgcgtgcaatgcaagggattcgactatggttagcacctggcgatagcgaagaattacgagtggcgttgttggatattcagcgtgaggcttctaaagctgctattaaagcgttgtcgcggtatctcaaacaggccaacgttgatgagcaacagtttgatcgccaggctctgtatcacttgatcgttcattaccggaatcgcatcgagaatgcgaaaaatgatcacacgttatcacgtgatgattatgaacaacagctgcatggactacgcatcaagagtcttggtgccgaacgtgcgggtgtacagcatttgttagagagtggacaaattagtttacgcaccgcggcaaagttacggcagttcattaattactcggagaacttattgatgctcaatgatattgaggccgatgaagattagttaactttttagattgtaaatcagtagttctaggttataatgatgttagagtagtattgacggtgaatggttaggtttgcaaattaatcattacttaagcggacgaataagggcaagccttacagggggaaacatcattatgacagaatcagaaattcatgaacgcttcgtggacacttatatgcatattttaaaatatgtcggggacttcgtttcagtgccgacccggccgtataagataacgtttgaggcctacacggttatgcggatgattgcaacaagtgaggagccgctgacgttggtcaagattgcgaaagagcagcgggtttcacggagtgcgattgcacgtcaaatcaacgtgttattagatttgaagtacattgaacagaccacgaatacgcatgatcgccgaatcaagtacttatcgttaacacctgctggccataaagtggaacaggaaatcaccacggcttccgaggaacgttttcatcaatgggtccaagtctatggtgaaaaacgggcaagcgatacgttgcgttatatcaacgatgcggaacaaaaggctaccgaactgggtttcagtggcttcagtgggttgcatgataagcgggggcggcataccgaatatagtgatcctaagacgaagaattagctaatatttagttaataataagaaacaccgtttgaaccgattatcaaatcagttcaaacggtgtttttgattacgctaggacttatccggtgtttgataaggaaccgttggcatcgtgaatcgccaagccgcgtagatgaggagttgaagtaaccacatcatcaagacaaaagcgagcatctttagcgaccacatttcaactaattgtttcacaatgtactgtggcgtaattagtaagtagatggagtgcagtcggaggaatcggccaacgtagacaccgacactagcaaataggaagagtgcggcacagatgataccacgactagcagggagtcgctggaagtgtaaacgttgggtcagttgctgggcaattcggtcaacgccccaggtaccaatgattgtagacaccatcattggcccaaccaagtaagcgaaatcccgccacatcggtaagtcgaagcgcaagagaccgttgatgccatacggcttcaataggctgaggtggaataaatcagtcattaagtacggtgcattcggatagaaaagcaaccaaatgaccgcaatcagccaaaataatagcgggctacgtcggggtgtcagccaaaaactcagctcgatcgggacataagccaaaattgaattaagtaatagaaaatggaacgcgccgtgcaagtcgactgctgcgaagatgaaaaatccccagaatgcgagtcgcacaaaccactgttgtaacctagtcattcagtcacttcccttctagtgttaattttaacagaaatattaatcaagctatattaaataacatcaagcttaatatttattcaaaatctagctaaaaagcgcagaccctgctgaaatcgcaccgcgagaaccgggttgccgtgctataatgtgaaagtaaatgattttcatgaggaggaggactatgactttcaattggagcggtttgttgaccttacaaaactttgtccggctccttgacattcttgcggtatggtttgtcatttatgagctgattgtgttgctgagaggcactaaagccgtacaactgtttcgcgggatcgttgtcattgcgattattaaagctgtgagtgttttgattggtctggacacggtttcgtggattatggaccaaattattaactgggcagtcattgcaatggttattatattccagcccgaaattcggcgagggctagagcatttagggcgtggttccatgtttgcacgtggtaagcgtcagaatgaagatgaagagcggatgattgccgaactagataaagccatccaatatatggccaaacgacgtattggggctttaatgtcaattaagctggacacgggtctcgaggattatatcgagaccgggattgccttagatgctgatatcaccggcgaattattaattaatatctttattccaaatacgccgttacatgatggcgccgttatcattcaagataatcaaatcaaggttgcagcggcgtacttgccgttatctgaaagtaatctgattcccaaggagttaggaacccggcaccgtgccgcggtcggaatcagtgaagtaacggatgctctcaccattgtcatttcggaagaaaccggtgaagtgtcgattactaaggacaatgagctgatgcgggggatgacgcgtgaaaactacttgcggtatttccgccaagtcctattaacgcctgaggattcaaccaagcaaaacgcgcttcaaaattggtttggacgagttttcggaggaggtccccgaaaatgaaaaaatttatgaatagcaattggtcaatgcggctactagcactgctgtgtgcgctggtgctcttcgcctacgttaattcgttaaagacaacgcataacgccagtattttgacgaatagttcatcgaaaacgacattgacatctaaccgtaaagtgaccattagcgcgcccttggagctgaacgtgaatagcacgaagtactttgtaacgggttatcccgaaaatattaaagttacgattgaagggccgtctgctttagtaacaactacagctaacacgcagaattttaaagtttatgctaatttatctaagttggcagttgggcggcacagtgtcaaagtcgaagtcgatggcttgaataaagaattgagttatggacttagtcaaaagtacattcatgttaatattcagccacgacgaacggctacttataaggtcagcgcagacttcaataaagccaacgtagcagatggttatgaagttggatcggcacggctcggaacatcatctgtcaaagttacgggcgccgtcagcgaagttagcaaagtcgcgaaagtcgttgcggtcgttaataccaacaagaatttagagaaatccgtgaaccagcaggctatcattgaagcattagatgccaacggtcaaaatttgaacgttgtcttgacgccttcgaccacgtcggtgtatattcccattacgcaggcgacaacgacgaaagatgtgccaatcgatttgaaagccagtggcaagaccgcggcggacaccagttattcattctcatctgacacgaagtcagtgacggttactggcacgaaggcggcattggcgaagttgaagtctttgccagtcaatgttgatgtgacgaatgttgattcaaccacgactaagacggtcgatgtttcgactagcgatgaggatgggatctcgtcagttagcccaacgtcggtcaaagtaaaaattacagttaaaaatgattaatcatgacacttttgaaatgaggtaaattataatgaaatattttggtactgatggtgttcggggaattgcaaattcaggcttaacacctgaaatggcttttcgtttaggtcgtgctggtggctacgtattgacggaacatgcggaaaacaagagtacgcaaccacgcgttttagttgcacgcgatacccggatttcgggccaaatgctggaagaagccttgattgccggcttgctttcagccggaattgaagttttacgtctcggtgtaattacgacgccaggagtggcctacttagtacggatccaagatgctgacgcgggtgtcatgatctcggcttctcacaatccagttgaagataacgggatcaagttcttcggtggcgacggcttcaagttgtctgatgccaaggaagaagaaatcgaagaattactggatcaaccgaaagacactttaccacggccagcagcagaaggtctggggacagttgctgattttccagagggtaatcttaaatattcacaattcttggaacaaacgattccagatgacttaagtggcattcatttggctgtcgatggtgccaatggttctacaagtaacttagtttcccggatctttgcggatttgaacgtggaatttgatacgatggctacggcaccagatggcttgaacatcaacaaaggggtcggttcaacacatcccgaagcattatctaaattcgtcgttgaaaaaggcgctcaagttggtttagcctttgatggggacggtgatcgttgtatcgcagtcgatgaacttggaaacattattgacggtgacaagattatgtacatctgtggaaaattcctcagtgaacgaggcaagttgaagcaagatacggtcgtcacaacggtcatgagtaacctgggcttatacaaggccttagaagcagctggtttgcacagcaagcagacccaagttggtgaccgctacgttgtcgaagagatgttgaaggacggctataaccttggtggtgaacaatctggtcacgtggtcttcttagactttaatacgacgggtgatggcatgttgactggaattcagttattgcacgtcatgaaggaaacgggtaagaagctttctgaattagccgccgaggtgacgacttacccacaaaagttagtgaatgttaaggttcaagacaagaaagccgctttgaacaatgataagatcaaggcagttatcaaggacgttgaagatgaaatggccggtgatggtcgcgtcttggtacggccttctggaacccaagatttattgcgggtcatggcagaagcgaagaccgacgaactggttagcgcttatgtagatcggatcgtcgatgtggtcaaagctgaagttggcgttgaataattaagtgatcagaccgatcatcaaaaaagtcgttactcctagagtcgcgactttttttgttgccatgaaacgaacggttattgctaaatgcggttaactggcgactgtcaggggacccagtgcctcccaaaccaatttgaccgcaaaaaagttacaaaaaattcgaaaattcgtgatgcccttgatttatcagcgtttgagattggtatacacgctaactaacacgtataccaatataatatattgttgacttttattagatgtaacggtaaagttaacttgtttctaggaaatataccaattggaggttagactagaccaattgttaattggttaaagcggaatagcgccaggactttagaatctaaagttgacgaggatgacgtttatcgataatcgacgggtgacgtcagggactgcactctacaggtcaattacaaaaatcgactgtgaggttggtgacagatatattgaccacgcagctagaaacaattcaaacagtaaaggaagattaatttatgtgtggaattgttggtgtaacgggtaaagatagtgcagtatcaatcttattgaacggattggaaaagttggaataccggggctatgattcagctggtatctatgtcaatgatcaagatggtcatgactatttagttaaggaaaagggtcggatcgatgacttacgtaaagaagtaggtgaagctgttcatggttcgaccgggattgggcatactcgctgggcgactcacggtgaaccgagtgttgccaatgcgcatcctcaagtttctgcggatggccgcttctacttagttcacaatggtgtaatcgaaaactttgaagacttaaaacagacttatttaagtgacgtgacttttaagtctcaaacagatacggaagtcattgttcaattagtcgatcggtttgtcaccaaggaaggcttgagtacgttggccgctttccgtaagacgttaggtctgctcggccattcttcatatggattcttactgatggataaggaagatcctgacaccttatacgtcgcaaagaataagagtccattattaattggggtcggcgaaggctttaacgtggtctgctcagatagtttagcgatgttagaccaaacgaaagatttcttggaattacatgatggcgaaatcgtggtcgttaaacctgatgaaattaaaatcacgaaccaggccggtgaaccagttgaacggaagccattccatgtcgacattgacgcagctcaagctgacaagggaacttatccattctacatgttaaaagaaatcgatgaacaaccgaatgtgatgcggaagctatcccaagtttatcttaatgatgcgggtgatccaatcatcaatgatgacttgttaacagctcttaaagcagccgatcgactatacattgtggctgctgggactagttatcatgctggtctggttggtgcaaagttatttgaatcgttggctaacgtgccaactgaagtgcacgtttcgtcagaatttgcatacaaccaaccattattatcagcacatccattcttcatcttcttgacccagtctggtgaaactgctgatagtcgtgaagtgttattgaatgtgaacgatcaacatttcccaagcttgaccatcacgaacgtgccaaactcaacgttatcacgcgaagcaacgtacacgttgttattgcatgccggcccagaaattgcggttgcttcaaccaaagcctataccgcacagattgccttacaagccatcttggctaaagcgttaggtgtggccgttgaccaaccagctgcaacagctttcgacgtgaaacagcagttggcgttagtcgctaatgggatgcaaagcttagttgatgaaaaggctacttttgaaaagattgctaagagtgccttattgaatacgccaaacgcattttatattggtcggggactggattacgccgtctcattagaaacggccttgaaactcaaggaaatctcttacgttcaagctgaaggtttcgcatctggtgaattaaagcacggtacgattgctttgattgaaaaggataccccagtgattgggattattacgcaaaagaataccgctgggttgacccgctccaacttacaagaagttgctgcacggggagctaagacagttactatcgtcaccgatagtttagctaaagatggtgacacggttatcttgccaacggttgatgaacgattaacggctttgcttagtgttgttcctggtcagttattggcctactacacgagcttaaacaagggcttagatgtggacaaaccacggaaccttgccaagagtgtgaccgttgaataatttaaagtaagtgtgtgggcaccaagaaacgtcaccgttcgattacggtggcgttttttgattgcccacaaagcttttgcataatttttaactactaatattcataagactattgtgaaagttgacaatcttttggtatgataaagtaagcggttgcgataacacaactaaataattagactattggggatgaatggtcatgctgaaatataaatattttgcacagccaattaataaccttggaaccaaccgaacaatcttgtatgagttattattacgacagtgggatgagaggcaacaaacttggcgaataccagcgacctttgaaatagcgccaacagaattgattcaattgctggattgcgctattcaggaattaaataaccatcatgtttccatcaatttaacggcgcgtcagtttgctaatcctgactttcaagctgcaattagtcactatgtgcagacgcatttgttaccacgagaactaactgttgagctagttgcgacacctgagctaagtgagttacagcaattaagtgttgggtaccgggcagctggtatattacttgcttttgatgatgttggttctgataacctattccaacagatcaaaatgatgttgccatatgtgaatacggttaaattcgcgttacaaaatatgcgaccgctggggaccccaactacggatgcaattgtttcgacgctcaaattttggtttgataaggcggaggaacagcaaatgctatttacctttgaaggcattgaatcagcggctgatgttcaactggctaatcatctaggcattacgcgagggcaaggatattattttgccaaaccgcaactacccgcgacatttatggcatgacaataatggtatgctacaatagtattcgtagcaatgtaactgagtgccatgttgatgtttaatcggctgaatcacatgacgagacgaggccgattttgttagtaaatgataaaagatggggtggctacttgtggcaatcaatttaattgcaactgacttgaatggaacattattgcatcaagatcagcgttttgacaaagaacggtttaaacgggttttggcgcagttacgggcgataaatgtttccctagtactttcgtccggtaaccaatatgcccatcttagacagttatttaaagatgttatggcggataatcttatcgttgttgctgaaaatggggcgtcgatttatgcccaggaccgcttgatctttgatggtagtctttcagcagaccagcaacgaaagtttgtgactgttgatcgttaccagccactattcaaagacgcatacgtaatcttagttggtagccatgggtcgtatactgagttaggagcacctgataagttagtagcgatggcccgtcagttttatgatcatttacacttggttgcggatctggccactgttgatgataccgttaaaaaaatcagtatctcaacgtcaccggaccaggctgctgatctggtggcacgagctaatgattattttgatggcgagttacgtgcgcatgatagtgggtatggcgtcgtagatttggttgatcagcgggtcggaaaattaccagcaattcaattcttggcgactaaacttgggttaactgcagctaatgtgatggccttcggtgatggggcgaatgatgtcccattattgcgatatgcagcgcacagttatgcgatgtgcaacgcaccggcggacattcaagccgcagcaaaacacgtgacggccctggataatgaacatgatggggtattagcaaccattgaacaagagttgttaaataattaaaagcctataactagtcagtaaaaagctgagctatcgaatgaacatcgttattcgatagctcagctttttgggtcctattaaagtgattgattagggtagaagaattgatgaatgccataagtgttgagcgaaactaaacgctgctttagttcagccaaagatagtcctaaatcaccattaaaatagagccggaaaaaggttaaattgttgtggatcaaaaagcttgaacagaccttagcatcgattgcagataaatgatagtttgtttgaatcgtcgttgtaagccctgctaccacggcagcgtggattttccgagacaaaaaactgtaatcatcattcaacaaaatgactcggtgaaaagcttcagattggcgaaaataggtcactaagcgatcaaagattaagccgggttggctaatgtttttcttgaaatcttgcgggtcaatgagtgctagaatcttatcagcaccttcttgaacgaacgtttccgctaaatcgtcaatggaatcgaaatgtaaatagaaagttttgcggttgatattagcgacacttgtgagctccttaacagtaatatcacgatagcgcggatactttaaagcaagcgtccgaaaagcctctttcagcgcagtctgggtgcgctgaacacgtaagtcagtagctggcataatctgatcctccttattaattacatttgatggggtggtcattattaaaccgccgctaaatgtactagtcgttaagccacatgtgggtattattatcataatagcacttattttgatagttaactcgtcctgagtcatgacagattaactcgcgcaacgtgcataatagcatatgcgcctagtaggtaaatggtaatgaggccatgtccgtcgactaaaatgggttaggagattttcgttcagtcaatggtatggtgtaacgcattattagtgagtcaaaaaagctcccagtagtttgcattctgggagatcaatttgaatcattcttgagtggttagacgtcgtaaatattagaaaaacgataggccgtttggtaggttacaggaatattaggttcgataatgatactgccaaattccttgtggtgaatagcatccggtaatttttgtgcttgcagggaaagaccaagttgagaacgcatcggtttaccgccattgagtcgataacgatcatcacggtaattagttgcactggaaaccacgactgccggagcgttcgttcgcatcgtgactttgcgtccactgatgcgatctagtaattctacttgtggatatggggtgtcgtttaagacgaagccgtgatggagcccgcccttgatgttagcaatctggggcccaacctcgactgggtcacgaaaatcaaatggggtgtcggtgacccatggcaacttaccagttggaataccgtgtttgtttaacgcggcgtactcgtctgcattgattttaagaacatggtggtcaatgaggcgttccgcatccccacttagattgaagtaggtatggttgctggggttgaataaggttgttttatcacttttaccagtgtagctaatagtaaatttaccgtcgttatctaatacgaaattagccgtgatcgtcattgtcccgggatagccgttctcaccgtccaaggtaatatattgcatgacgagtccaacttgatcactagtgtgcagtttacgttctaaaaaccatggttcaaatgaaatttgaggcatattaccaccgtttagatgattttcgcccgcattttgagttaagtcatactgccgccaccgggcatttttgatgatccccgcaacccgagcgatggttgcaccgaaaaaagattgataggtgatgtagtcggcgccgtcgtcaaatcccaagacaatatttgcaaaattaccatctttatcatgggttttgatcgcggtgactgtggcgccccagtccataatagtgacgctcatatgatgattgttcactaatgtataataattcatcccgttcccctgatgctcgattattttcataatgccctcactcccatagctgcctgacatgttaccgcctacttttagtatatttcattcttaaagggaatgcgaataataacccagcaagtgttaatgcgagagtgacagggttagttgctagtgaggtcaatttaaataaccagtgtaaataattataattgattgttgataataattaaaattatctaggttgagaagtttattttaaatcttggtaattgtgaatggtaccaatctattaaataaggtgaattaattaactttgtgcaagtaaagacggcaatttagtggcgaacatggctggctgagggtgttagaaaaagattaatgagtaaatagaaataatttatctatttattttggctaactgttgacaacgcttacaatatcgcttattcttagtttgtaaggtatttaattaccttctaatcaattctctttctctcttatgccgaccactatctgcttggatagtggtttttttgagtgaaattagcgaatttatggcggaatagatgaagataaggctctcttgtaatttttgaagattgatgtttactcagaaaaaggagtgctcggctgatggtagcattttggggctgactgagttagtttagtgttcatcaagtacaggtgattaggcataccaagcctgatcacctggcaattactggtcagttttgacacgactgccaaccccgcttatactaaaatgtgaagtgagggattgcagttgaaaaaccatgaagtattagacttaattcaagaaataacacgtaatgatgggacctcatacatggagatcggaaacatgttgatgaatggccgcgctgagttagcagctgaacgtggttttattaagcaagtgcggatattacaactaaacattccgcattccacgcatgttgccaagtatgagcaatatattaatgaaacatttacgattcccgatgaaacgatggatcattgggaagaatggacaaaaacacctgacatgcaagctgaggtcgatctgattttgaaagaaaatcatattggctaaaagctgttagccaaagtctagcgcaggagtgtgagtttatcaaacggcggttgttttttagtaggcgttggctcaaaagttgaactttcagaatgtcaattctctaagctcagcttttttgttttgatcatgtaattgactgattgtggtgatttaattgcgggtgcgtggtgggggaaaataacttacaaacgctagtatcagtgttattatcaataagcatgtttaaggaggctcgttattaaatgaagaatggggcattgctacaatttattcaaagtcatttccagacccgttttcgttttcgtaacgcgtttgagacccaattgactgttcagattttaagtcgattaattggcgaacatccggaaagtttgttattgactcggcgagatgttgaagcgttggcaggctgctcattggacgcgccggcactacagcgagaatattttccgcagcgtgcgatgacactgttagaaacggcgttagatgagctggttacgttaagtgttatcatacaccaggatcagggcaggacccgttatcccttatttcggagcgtacagcttgatcaagtgtgtcaacgaattgtgtttaacttgaacctggacgtgttgccacaattaacggactggtcacgggaattacaacaagaacaggagcgattttaagtgacaaagagtgtgattgaaaccttacaggaccatcgaacgcggcgacaatttaccactgaaccaattagtgatgcgcaattcgcgcaaatcatcacaacggcacaacaaatgccgactagccaatatttacaggcatacagtttgattgagatcactcagcctgcactacggcaacaattggccacgattacgacgatgccaacggttggtgaaaacggccgtttattagttgtggttgcggaccaacaccgcaacgtcaagctagcaccgggcgcaacgacgcgtcgggcactgagtgaatttgaccgctttgctggtagtattgaagatgccacgctgattacagcggcgatggtgatggtcgctgaaagcatgggtcttggtagcgttgtacttggatcaattaacaacgacacgcaggcggtgattgacgcactgcacttgccggacttgacgttacccgtctttgggttgcagttagggcacccagcggatgttcctgaaaagaaacctcgattagggttgcccgctgtgttgtttcaagatacctatgctgagcctgcgagttatcaggcggagttggaccggtttgatggcgttttgaatcagtattatcaacatcggagtagtcacgcccgtacggaacacttagcgcacatgacgcaggaagcgacccactcagcggccaaacggcgagagtttttgacaatcgctaggcagcagggctttttgccggaattagaccaataatcgttaccataacactaataattagaatggctgagcgaaaaataaccgttaatgtaacgctcccatgtcgctattagctgacatgggagattttttggtacctgggaggacgaatcttaacattaaaataagattaaatattgttatttttactaattataatataattaattctgagacgatgtttactaagcaggcccgggctgcgttgcagattcgagtgaaagctgagtcgatccttattctgatgtgtgatagtaacattgttgcaaggcttgaaaggggcggataatgtgatcaatgccaacttcagaaaactcgtcttagggcgagcagtgggtaacgctggtgacagcatctacatgattgccatgaactggttcattctccaattgaccaacagtgcgttgtggatcggcatcatgaatgtggctattgttttaccgggcgtgttgttgtttctgtttggtgacagtatcgaccgacattctaaacgccgattattagtcgcggttgaattttcacagttagtgatcgtggtcatgctaattggattagttgcgttacatattaagttgccaggtatctatgtcgggctggtattcgtcgcggccctttttggatcactagcttatccgattcaagatacattagtaccgctgctcgttgagccagaccagctagttcaagcacaagcggacatgtcaattgcctacaagggaacggattacgtgttcaacgcgctgtcaggatttttgatcagcctctgctcagtgctcggtgttttaatcatggatgcagccacgtttgtcgttaccgttgccacttttaggcggatcaaactcgctgaaccccgtcagcaacacacccgggaaaagtccttgtatctcaaccagattttggttggtttcaaaattatcagcactgatccgctgctgcgtttattgacgtttgcgagcgtcgtcatgaatttcttctttggcggtttgaatacgtacgtcgttttatttgggcggcatttcggtggctcgatctactacggtattttggagtcgatgtcagccgttggaatattattagggatgacggtagtctaccgacagttaaaaaagttgaccgttcggcagtcttacctcatcggcaactttgggcgcgcgttattcatgatcttgacagtagtgtcgtacaaccagttctggctgtttgccatcatttacttactgagctttgtctttcaaggactgacgcaagtatttgagacaccgatgattcaatcgacggtcggttcagaccaactcgggaaggtaatgacctgcttttatacgctggtttccgtgaccttaccgctgggttcgctagcgttttctttcctagctgaccgctttgatttacggctattcttattactatttgccctcttttatgccggcatattcctgctatttctagccagtcacgccttcaaaaaagtagacgaactacaattatcataaaccccacgcgatattcattaatctgtcatcaatcatgattaaaacgtgccgattaggtggatttctgttcgtcagcaatgatcgtcctattccgacctccggggctgggtgacaattgctggaacgtaagccgacgtcgatttgagctaacgcataa

SEQ ID NO: 4 - DNA, 150860 bp, Lactobacillus plantarum
caccggctgacgaacaggaatcgagttaaccggaaccttttaacaatcattcctgacctatcctagaacgaaaaagcctgcaatcaattgattgcaggctcgttcacactgactattcgacgttgaactccttgaaataactggttagtggtttcaattcgttcgcgtcatatttttctttgaaggcactgacagaagcatccgatgtcttggctggatcaacatcaaggatttcaactggtaacccccgtttgtccgtaatcttggcatcaattaggaccggacgaccagcctttaattcggtcatcgcagtttcgaaggctgcgtgcagttgatcaaaatgttcaacacggatacctttgacgcccattccttcagctatcttagcaaaatcagcatcaatcaagtcgataccatagtatggttgcggcacatcttcttgttctgatttaataaagttcaacgtttggttagacgtgacaatattaaagattggcaagtgatacttaacttcggtcaataagtcttgcatgaccattgagaaggccccgtcgccagcaatgttgaaggcttgccgatcaggataactcatcttcgccgcaatcgcaccgggaacaccggcacccatcgtggcaaatagtgctgaagtcaataatttttgcttgggattcatctttaggaaacggaaactattaatcgtattgtcgccaacatccattgagaaaactgcatcatcggcagcgacccggttgatttcttggtagacttgttcgtattcaagtggatcggtcgtccgttcactcagcttcttcaaatactgtttccagtcagccatatctgctttagccgcttggtagtatggcgacggtgacgctggttcacttaatgccaaggcccgtttgatgaagactttagcatcgccattaaccccgaaatccaaatgatggtgccgaccaaacttgccaggatccagttcaatttgcacatatttgaagtcgtgagtcgtgtacataatctgtgcgaacgaataatctgcgccaactgaaacgaccaaatcggtaatccccatcagttcatccgccgctttcgaggctgcccgataagcgcttcccatattaccatcaaaactatcaggaatgacgcccttggctaacccagtgataataatcggtacttgcagacgctccgctaacgccatcatgtcctcggttgcaccacgcgtcccttgaccaacgtggaagacggggtacttggcgttcttgatcatcgttaataccgtcttaacttgttcatcatcaatagtaggaatgccggtcagtttagcagggacacttgctgaatcgtaattaagatcaggaatttcaacatatccaaaatcattaggaattgtcaccaccgcaaccccattttcacgataagccgtccgaatggccttatcgacgacgtatggtaagctttctggtgtcatgacggttcgattaaagaccgccacatcactaaaaatcggttcttcagcgaattcttggaaataatcatagttcatattagtgtgagcaacttgacccaccaaggcaagtacgggcacgtgatcttccttagcatcatacaacccgttgagtaaattaacggcaccaggaccggccgacccaaaggcgaccccgattttacccgtcaactttgcatccgctgccgcagcgagggcccccacttgttcgtgacgtacctgcacatattggagccgttcttgctcaacatccaacgcgtgcatggttgagttaaacgatccaccagcatagccgtaaatctgtttaacatcccaagcttcaataacttttaacattgcaacagacgcttcaatcatctttgccatagtaaatgccttctttttaaaattattgtatacgttttcatttacggttatcagaatacatctaaattgttcaaaattcaattgcaaacaatcattattttataaatattttcttaactaaccaaattcgatgacctgacactggcccgaaatcgtgttagcctgccgttgttctggaaaatatcgaacacttatccatcggcttaatctaaccaatcagcaaggtgaaataatgatgaaagataaagcaattaatattctgactgccgaactgtcagcactccccgttttaataatgacgtactatgcgcttaccgcgaaaccgaccggacagtggcagctgacctttagtctccccgtttattggctgatcagttccgacctgttggcctaccctggctcctcacccggattccccgcttgcgccacaacccccttaaaatgaattcactggctctaaaggcaagctcaagatacaactgccggctcaacgaacgggtcgcgcgctgggatgatgagatgaatctcgcgattttcttactggaacgcggctgtctaatgttactgtcagaaccactacttttaggcgatttaggctatcatagtgtccgacggttatggtattaatggcaataaaaagcacccatgctgttcagttttatgaacagtgtgggtgctgtgtgcattatttaagaatgttggtctccaagaaggcgacagcagcttcttgaatcttgtgaggtacatggtgaacgccaccttcagcgcgtttaaagacagttgccttcagggctggctcatctttaaaacggtgcttaaaatcacgaatatactgataaggtaccatttgatcggccgtaccgttgaaaaagaacattggtcgtcctgccagtgcttcggggtgttcagataagtcaaacttcgccaattgttgataagtttgttcaattagttctgctgggagcttagcttgtaatgccgctggtaattgtgcaacttgatcggttgcaaaggccaccggttctggtgaaccaattaacgagacaccagcaactaccgtgggctgcgttgccataataccggcagcggtaataccgcccatcgaagttcccatgacaccgattttattagcatcactaattccagcagccactaaggccgcgactaattgtggaaattccgcaactgaatgtccaacaatcgaccaaaaatgttcaggatgccgatcgagatcagtcccatcatttcgactgccatgtaaatacgctgtcgggagaatgactcgaaaacccgcgcgtactaactgataagccgtacccagttcagtcgctgtctgatttgtccaaccatgataatcgatgatcgttggtaatttagtttgtgcttgactagctgcaaacacgtgtaatacgggcaaatcaccaaatttggtcgtccgcaccaccacatcttcaaataaatttgttgtcatgtttatcaccgtttccaaaattaatagttaatagtgtagcagaagcccaaacgaaaaccaacccaaacgcgtccatcgtggttaaagcttaaccatcatggacgcactcgagttggctcgttttaacacggttagttatcagctaacgtcatgcctttcaaaactacttttcaagtgtatctaagaaatcttcaacttgcttttgggtcttacggaatttgtcaacatatcgaccaatttcttgaccatcttcgatcccaacgaaactaggaatccccatcacacccatgtcttgggcaatttcaatgttggcgtcacgatcaaccgtgatccagtcatattgatcgtacttcgcttcgatttggggcattactggtttaataaaagcgcaatccgggcaccagtccgccgtaaagaataacatgtgtttacccgtcttgatacgttcgcgaatttcttcgtcgcttaaagttgcagttgccatgaaaaatgcctccaatatctttataataattatagtttaccacatactaaaagtaagtaaagtcttttgctttattttgttgctcggatcagcgcttgcttgagatccgctgctaaatcggcactattttcgatcccaacggatagccgcaataagttagcggtgatcccctttgattgtcgttgctcttccgttaaatctgcgtgtgtctgaactgccggaactgttaacaggctctcgacaccgccaagactttccgcaaacgagattacgttcaatgctcgtaaaaaggtatcgacgtcggtacccgtagcgagataaaaactaatcattccaccacgtcctggatataagacacgttcaacgtgttcatctgcctcaaggaccgtaacgagttcctgcgcattagcctcctgctgatgcaaacgtaatggcaaagtcttcaagctccgtaagagcagccaagcgtcgaacgggtcaaggaccgcaccagtcgtcaccagattaaattcaagcgcatcagcatccgcctgcgacttgactaccactgcaccggctaaaacatcattatgaccggctaaatacttagttgcggaatgaacgacgatgtctgcgcctagatccagtggcttttgaatcaacggtgtatagaaagtattatcaacgattaacttgaggtcatgggcgtgtgtggtagccgctgtggccgtaatatctatgaccttcatggttggattcgatggcgtttccaaccacagggcaacggtttgatcgtctgccagtgctgccaatgtcgcttgatcctgcccatcccagacagcaaaatccaaatgataatggtcgtgtaagaggtcaaagaagcggtacgaacccccgtataagtcatcagacacaataattttgtcaccactattgaaaagcgtgaaaacgagctggattgccgccatgccagaagtcagcgcatacgcagcgatgccgtgttccatctctgccagcactcgttccaaaatacagcgggtcggttgggcctcgcgcgggtagtcaaatcccgtagattgtcctaaaccagcatgtcgatatgctgtcgacaagtagatgggcgccgaaattgccccggtcttctcatcatcactccgattaccagcttgtgctaaccgcgtttcaatgtgtaatttctcagcttgttttgtcataatctcaatcccatccaatctagttatggtcgggcagtctacagagacgccagtgtaaaaatgactacaaaaaaagccgccatcttcaagggacgccggtcgcgtgttaccacccaagttcaattacgggtcaccccgttaaactcatcaagtcattattgactcactggagtatcggccagtcccgccagtacagccttgcgaccgcaactgggcattccgagttcatcttcatcaggcgctaccttaccgctttacactccccacggctccctgtcaaaggtataacctgactactcttctcatcaacatgttatttaatgatattttcatcttactctcataataataggagcgcaagccccaatcttatttcagcacaataaaaaatggtgccagcattatcctgaccaccatttttacagaaacgcattcgacactgcctagctatcccaataatttcaagacaatcacaaaatatcctaaaatcaaaatactcaaccccagcgtcttcaagagggctaaccactggccccctgcagttcgacctttagggcccagacaaatcgcaacgccgccacaaatcacggccaaggttcctagctcacggccccagtttgcattcaataagtaaatgaacggtcccactaagccgctgacaatcgcgacgatccccagtattttcagaatcaagcggcccagtcgcttatcctgttcgtcataaatttcatgtttctcttttgccatcaaaccagccaccaatctttatgaactactttcagtatgccgtatttggtcacaatgagcaagaaggcggttacaatatcctggtcaaattactgaggcatcactaggctagcttgtcataccttaccttgggccctgccggcacttacccgtgataacagctgaatcaagctaccaaattgaccatgatgatactaaaaattaggtgttcaaaattgacacccgctgaacacccaattggcaacaactatttttcaattgtaacctgctaaacgacgccattatggctgtgttgcaacaacttgccatacgttccccttagccaactgctgttgttccaattgaccttgggcgttaatccgaaaacgacccgctaagtgtgcgacatcggcgttggtattttcataaacttccacgtaaactaaaccaccgctttgatactgattaaacacaaagttttgcttattggcggttgtttgttgatagtccttagccacttgttgccaagcccaatcattaatctgactagctgttaactgctgtggattggtcgtctgctggccgctagttgatgatgaggtcgcggatgcagactgcccggtagttgtttgactagttgcagtggtatttgaatgtccctgcgagctagctgcagtagctgtcttactaccctgactagtcgttgcactagcttcggattgtgactcattaactgaagttgtggaaactgacgatgctttagttgacgacgatttagcagctgtcgattgcttcgtcgactttgctgaagatgacgcgtcttttttagccttagtctttgacacaactgattgtgtttcactaacccgcgactgactagactgatggtcggcttctaagtaataaccgcctcccagcgcaatgatcccagcaatcacggctgaactaactaacatttttttcaagataatcaactccccaaagattaattgtctgatgctaactacagcatacgctatgttgtctcactttaccaacgtttacctgttctggatcgaaatttaactttaaattatatttggctcagttggtccatttttgggcacctaagattcattgtgccatccttttcttgactacgtatctcctcaacaacaaccgtggcatcagcagaaatgaattttgttaacttgaaagctgtttccacaaccttatttctttaaagttcattttgccatcatactgccccttataagtatatcgtaaatgacacccgactacggcccaaagcgggctaacaatgtaaccgtttcataatttgtcatcaaattgttacttatgtgaggcccccttcgcatgctatagtaatcaaccgatacaaaaaaactaggagtgtgtgaatagaatgccacgtaatttaaaagaagaagttgtctttaccgccattatggccggtttaatggtctttgtgatgaccgcctataacgttacccttgctcaaggtttcagcaacgggttagtaatggcaatccttagtggctacccactcggtttattcgttgccatcattttagacttattggtcgtgggaccaattgccaaacgattagctttcaaatatatcattaatgattacatgcgcaaacgggttgtcttgattgggattaccatctccgtcttgatggttcttggcatggtaacttgcatgtccctcttcgggattgcagtggaaggtgaattgtccggaagtcacgttttagcgacttacggtcacacttggatctttaacttgattgttgcattaccactccaactcatcatcgtcggcccaatcgcccgcggtgtgcttggaaaaatgcaacgggcaactgctaacaccgagtcagcagctgcaatgaacgaagaggactaatctttcagtccattgacggacggtcgccgggataatcttatcctgatggccgtccgttttattttacgactatccagtcgaccaccgcttttgccgaatagtccaccctatgaaagtcttatgcgtgatctgtacgcaaaaaaaaacgcgtgtcagccatccgaaaatggttaacacgcgttcatcgcggcactggtaaaaccagcgggagtgacactccacaatgtcagtgacccagacactctgaaatacgtcagagaaacgtgccccgctatcaatattagtcactagccgctcgcgcggaaccgttattgctaacgatctgactctatcgactcatcgcatggactaccatatcatcttcattgataaaatgcaagtcgcaccgccacaaaattcgtggctcctactcaccacagttgggccgcagtacttaacttttcgcaaccaaaaaaattgagtatcccgttcgatttaatgaacgacacactcaattccattggtattttgattttggcttggctccaatatcaattcttaccttaccatagtcatgtaaagatttagtaattaactcgtaaagattacgtttaagcttccgccgccgtgatctgatctaagcgatcagtctgagccgtcagccaatcggttaataacttttcagcgttggcttgatcagcgagcacgtcggcaacgcttcccagctcatcaattcgcaatcctgacggtaacgcatcggattctgcaatcatgtaaacgttgattggcagcgtatcctctgccgccgtaacctttccaatttcggtcagattagccagtggcaaattaataacactcgtctccaaccgaaagctgatagctggctcatgcttagccgtcagcgtcacttgggcaagctggtcggcattgagtgccgctaccagcttcgccagccaaggcttaaccttggtcgctagtttggcataggtaccagtcaagctatcccgcgtaaccttgtcagccgtaacatcatcaataaaagcttgtacgtttcgttgcataaaacattatccctcattcattattcaatttcgttaatttgcacgtcgccagcgagtcagtaacaccaacgtataaaagttgattcccaatccaatcacacccataacttctaacgccagtttaatttccatgccagccgtactctgatagcccgacattaaggcgctgacaagtcctaagctatatatcagtacaactaaccctaggacgtaaaaacccagcatacgattaatatacactgctagaacgcctagaaaatataagactagggcaatcagcaacccctgccacatttccgctaccgaaatattttttgcctgcaggtgaaaatggctagtcgacatcatccaattgacgataccgtaacaaaaaaaggacacaaacgcaaatgcaactaagcgagtcagtttcaacaaatcactcctattattgggcaattaagtcaataacggctgaccgttcaattcccgtgaagtactgatttaaatcaatatctgccagcgctttagcgatggcctcatggtcgtaccgcacacctttaagggcggcttcaatatcttgaacgttgccactaccaaagaaatcaccataaaatttaatgttattgatcaagccgtcatcaaccgagatccgcgcatcaatggttcccatatcaaagtgttgacgccgcttaaccgagaattccggtgatttaccgtaaacccaatcccaattagcataatagtcttcgtaaattttatcaatagctttttgttgttcaggtgtcacgtgatattccttatccgcaatctgatccaacgaatcaacatggaacaactcttttaacagggcatcctgaaattctggcaccgtgatattctgatattctggcgctaaataaggccgtaaattcgtgacccgactccgaacggacttaatacctttggaagcaatcttgtcggtcgggactgttagcgcctgtgggacaacgtttaaatcaacattcaacatcagagtgccatgggagaacgtcttgccattccgtgaatacatggcgttaccggagaatttcttaccatcaacgagcaaatcattgcgaccactgaccgtcgctgtcgtcgcccccatatcgtgaagcgcatcaatgattggcttggtaaatgtcttaaagtcgccaaactcttgactgtcactatccaccacaaagctgaagcagaggttaccaagatcttgatacacagccccaccaccagagagacgccgcgttacggtaatgtgatgttcccggacatagtcggcattaatttcttcaagggtgttctggttccgaccaacaatgatgcacggttcttcatagtagaacaaaactaatggttcatcgaaatccacgttattcattaaatattgttcggttgccaagttacggccaatctcatgatctttcattgcgacataatacatgttttaaaatctccttcagctttaggttactttaatcatacagcaagatgaaaaaaggacccacaatgtgagcccattttttggaagaatcatacaaaaagtttggcgtggcattcttcacaccacaagatgactgattcactatccacatccgtgaacgtttgattggcggcaatccgttctccgtggacataaccgtgccatcaatagatggaggttgggccagtcagttatccgaaattagcggaaacgctgctatactgcactagctatcacttgacgggtttgttacaacaattgggtaacagtttgatactgacctgtgactcttccgataaatccaatatagcatacaatgtaagcgattgcaaaccgagtaaaaaaacaacctagtcagccgaagccaactaggttgccgaaacattaatagcggtcgtaatcgctattccatttcaatacccttagtataaagccatttggacgccggaacaactaatatgcctagccttcaagcttagcaacatagtgcgttgcaccggagcgactcagatatcggagccacgtgtaaccctcagcttgaaccgtcccattgtaataaaccgtttcacctgggttatattcaccgacaacgcttgcgcgcgtacttggcgccgtacgaatattagtcgtcgttacgaagcggaacgccccttgactgtttgttaccggcttagacgtcgtatttccggtagcggcattaccactaatcgctacgtaatgttgggcgcccgaataagacaaataccgtaaccaagtctggccgttagccgttaccttagcgttgtagtagactgtatcaccagcactataggtaccgacacttggggcatttccggccggtgtattcttaatcgccgttgtttgcgtaaagcgataactaccactttgaggcgttacttgcggtttatcaacattggtcgacgtactctcaccactaatttgcacataatgctgggcacctgagtaagacatgtaacgtaaccaagtctgaccatttgtcgtcaccttaccattgtaatagaccgtatcgccagcattataagacccaaccgttgtcgcactagttgcaggtgaactcttgattgctgtcgttttcgtgaaacgatacgacccactggttgcaaccacgtccggtttagccacagcaccaacctcatcaccactcatagccacgtaatgctgagcgcctgaataggataaataccgtaaccaagttgtcccacccgtggtaatcttgccattatagtaaaccgtctcaccagcattataagtgccgaccacttgagccgttttgcttgcggctgatcgaatgttggtctttgcggtaaacttatacgacccactagctggcgtaactgtcgcctggttattattatcattagttgttgtttgactaatcatcacataccgtgatacgccagaataggactgatagcgtaaccaagttgcattaccgaccgttaacttaccattgtaattgactgtttcaccagcgttgtaagtacccactacggcactcgtggcgtccggcgcattgtgaattgtcgttgtcttagtaaacttatgtgtaccactggttggggtgacgtcttgatcaggctgaacttggttattatcatttccgccacttgcctgaccactgagcgcttcttgatcccactcgtgtagcttgttatattcaatgatgctgatcagcgaactcgcgtacgttggcgcggttgcgtagccgtcttgttgcaagagactggcaacgcgccgataatcggtaaccccaattaaattgctgtaacgcggattgacaaccaaaaaggcgccatggtcttcaacactagctgaccaattcgggtacttccgaaaagcgtcttgaatcgtaatgtattgtgagccattccattcctgggttgggaagtagattgattgcccttgataacttcccttgataccgaataagttgtttccctgagttgcaagttgtgattgtccccaaccactttccagaattgcctgtgcggccgtgactgatggcaagacttgatacttgttccaaccagagattgcccccgctttaatctgactcaggaagatttcctgactagtcattgcccgcgtggaccgtgccatcatcgctgatgactggaccgcatcagccgccacagccgtctcaatctttggtgagattttcgcggctaccgcctgctcagtcgcttgcttaggtgcggctgacgatgcggctgatttggctacttcactcgtcacagtcgcgctggattggtccgtagtgacatgactatcctgacttgcggccgcgctggctttagccgtctcattagtcgtactgtgactggcttggctcgtggctgcactagctttggccgttttatcaagttgatcaacagcactagttgtggagtccgccgtagcactagcagccgcgttatccttggtagcttcactggcggaggactggctttgcggtcctgtactgtcagctttagcggcttgactggctgcccgcactgtgacacgacttgtcgcactggtagtagccgtcgtcgtgctggtcgattcagcttgatcgtcagtcttggcaccgtcactggcaactgattggtcagtcgcaccggccgctgtcgtttccgtctgactgccagcacttaaggtcacttgttggcttgcagctgaagcagcgctgtttcccttagtcgcagctgccggtttttgatttgcacttgccgtatcagctttaccactcaacatcggcaacaaagcggtacttagcaataatgaagttactactttttttgtcattccaattttcaattttaaaatccccaaactttccgtgagttagctgttagcacaaccgatttaattcccctgtagcacctgctattacagaataatattagcatgtcgaagagggacattcaaacgagatcgcttcgaattattttattaatatcaattgattgacaccgttatcattttaactgattgatcagttaacaatttgttatcgttgaccgaattgacaatcgctgcaagacgttatgaccaggggcttttccaaaatcaactcgcttctcaattactgtatttaaattaaatgtgactgattgatcgattaacgaccttgaagaatattatttttcaaggactagtaccgactgaaaaaaattagtcatttttcagtccattaaaataattatccttacaaactcaagttatcaaataaatcaatcgattttaaatgcttacattgctgaaaattaatgctaaaatatagttattaactagccatatcaaacgggggtaaccattatgttacaacaatatcaaaatatcctggtaccagttgatggctccaaggctaccgacgaagttcttcggcggggcatcgaagtcgctaagcgtaacaagacccatctcgacattttaaacgtgttggaagtcaaccaatttagtgacacgtacggcggtgcggtcagtggtgatgtcatctacaagttgtcggaagacgttcaaaagcgcttggaagaactcaagcaacaaacgattgacgctggggtgaccgacgttgatgtccatgttcgttttggtaatcccaaaacggttatcgcgcgtgaatttcctgcagaccaccataatgaattaattatgattggctcaaccggcttatccgccgttgaacgtttgatggtcggctccgtaaccacctacgtcagtcgcaacgcaatttgtgacgttttgatcgttaagccggccgctaaaaaagaagactaacaaaaaagtctggatacgttccagacttttttagtggtttccgtgcgttgcccgtcttcttccccgttataaaggagctttattcatgacctggacttatcaactcactatcccgtctagtttgaatcaacagtcgattcgggcttgccttcggacttggctgattccaaagcggattcagggccagttacgccaaacgcggcggattcagctgaacggtgcaccaacgtcgattgcacaactcgtcaatactggtgattgcctgacgctgacgtttatccccagtgactttcggactccgacctcgaactatattgcggctgccacggccccagccacgattttatatcaaaacagcgatctgttagtcgttgataaacccgctggcgtgaaatcgcatcctaatcaaccaggtgaaaccggatcaattttaaatgacctagcagccacactccaaccaactcagcaggtgccatacatggttcaccggctcgaccagatgacttctggtgcgatgctagtcgcattgaacccggtcgtcgtcccgattctagaccgcttaatcagtgacaagcaaattcgccggacttattatgcctgggtacgtggtcactttgccacgccaactgggcatttcaccgcgccaatcggtcatgatgctaccgacaaacgcaaacgctgggtcaacacggccgatgcccagccagcactcaccgactacgaagtatgtgcaacaaccgcccatcagagtttagttaaactgaccctgcatactggccgtacccatcagctacgggtccacttggccgctagtgaccacccgattatcggtgatccactttacgactcgcaagcggagtcggcgcctcggctgatgttacatgcccaattgttggatctacaacttccatttagcaccacacgggtgacggtaccggccccattgccaagtttatttgagaagccgcgtttaatcgagaactactgattgcttgaatctgtttcaagcatagcgaaacctctaaaattagtgctaagacgcttaatggattaaggaggattcccatgttaaccgagataggcaaaatcattcggcaacgccgacagcaacacggcatcaccatcgagcaattggccgaacaatccaatgtttcaatctctctaatttctcgactcgaacgtggtaaggtcgataacattaaactacaaagtttgaccgcaatcgctgaaactctgaatttaaaaatagcggacttctttcgcgacgagcttctccaatcacctaatgttgttgcattactcgactacctgagtgatctgccagcccatcaacgtgaagaacttgccggtacgttactcaaactactccgactatccaaatcgtgagcatttgcgcaacgcactccggacagttagttcaccattgaaccccgtgattcatctacactaaaaaatgattcaccttcctctgacaagaaggcgaatcatttttaatttatcaagcttgttaacggtcggctaagcgcccttaaagccagcatacagttcttaatggtgcgttgtcactagtaacccactcatcactgccaatatgatacccaccgccatggctttgagtggttcacgaacgatgggggtggcggtcaaagcctcgaccatcgccccacctaaatacgttacaacgagccccaatacggcgccccaaaagattgtgactagtaaactagccagccacgttgtcttcaatagcaagctcctccaatgcggtcaggcacggctgaccttttgattgagtgtatcaaagttgtcacgcgtttgcaaatttattaatagaattcataacttttatataatagttctatccaaagaaaatccccaccatcaatgacaaaaaagctcagcaccgaccattcaggtcctaagtactgagcgattatcatgaccgctatgacaggctaatgtcccccactactcaaatccgcaggccaatttgattcgacgaccgtttgcggaacatattggcgattcaatagtgccagccactgccggacaatcttgctcaaggtaaagtcatgactgcgttgccgagcgcgcacggcatattcagcgcgacagtcaaaatcagttaacagtggcattaagccagtaatcagagcattaacatcgcgggccggagtcaacacaccgtactggccaccctgcaagtactcggctgagccagtattccacattgagacgatcggtaaccccatcgtcatcgcttcccccataactaatggcatcccttcccaacgcgaagtcatcatgaagacactcgcctgttgataatgcgcccgtaactcagtatctttcagcgcaccccgataaataatgcggtcacgaacatcgagttcagccatcaaccgattgaacgtcgctaattggtcttcgggaccagtccccgcgactgcaatttgccaatcagcaggcaaggctcgcgcaactgtcaacaaataatcgagccccttatgttgcaggtcaatacgaccagtgtaggcaatgatatgttgcgccaagtcggcctgctgaccatgagcttgcatggtcggtggattatagaacttgaccgtatgggcgttaaaacgtgagtagccttcccaatcataatcggtcaatgtcacgaccgtatcagccgctaagagccctgcgaccagttcatcttgcatttggacgtaatactgattgaggtagatatcaacattattgtgcatccacgcaatgacattgacccgtggaaaacgctgtttgattgccggagcaaaactcgtcagtaaacctcccgggagaataacggcatcgtaagctcccgacccaatcgtcgtgagtaaatcatctatttgaggcgcataaacggtcaacggatcagcgccaaagtaattaagtaccgtcgcacttgcaggccggcgcgccgtgataagcggtgcgctcagttcatagaaagaccggggttgggccaaggagtaaaaggcaacttcggcttgcgaggtcaacgcattgccgaggaccgtcgccgctcgtttgacaccatccatcactaaattctcgactgttatcaaaattttcattagcatcgttgactggcgattaaacaaccagtcgctcctttccacataaactcggttcatggaaccggaatcgacgatgttaggctgagctgattgcgtcagacccgttcatccttaactaatcaccatcactagtatcagcttaggtagcgttattataacaggaataattaaaaaccaattaaaatatgctcacaattcacattatgctagtcattgcaagttgcttcttgattaaacgtcagttagctaggttctgattaagacgtcataggctacattccagcaccaatcagcacttgttgacataccactagtattgcttgatatacacgcaatctgaaataagtcgcccatgctgagttgacagtatccaatcgacacaattaatagcgcacaaaaatagcgttgctactggaggcacaggccagtagcaacgctattttcaaattaagattttaactgcttattttaaacccttccattgccaatcattaacttctggcaagtcagttccggcatcccggatataggcattgtgtttagcaagcatattatccatggattgaacgaaggccgcaccagtgttttccattgctggttgcgccgcaattgccgacttagctaagtcgaagcggtccatctggttcatgacccgtacgtcgaatggtgtggtaatatcaccattttcacggtaaccgtggacgtataagttatggttgtgacgatcaaagaagatgtcacgaactaagtcttcgtaaccgtggaaagcaaagaccactggtttgtccttagtaaagtaatggtcaaactcagcatctgacaagccccgcggatccttttcaggactacgtaacttcaagatgtcgaccacgttcacgaaacgaatcttcatctctgggaaactgtcgtgtagtaattggatggcagccaacgtttcaagcgttggttccgtcccagcagctgcaaagacaatgtctggttcgctatcttggtccgtacttgcccaatcaatgataccaagaccattgtcaactaattgcttagcttcttcaatgctgaaccattgttgacgtgggtgttttgacgtaaccacgtagttgatcttttcttggctccggaaaatgacgtcaccgacagctaataacgtgttggcatcggctggtaaatattcgcgaatgtattctggtttcttttcggccaaatgagttaatgcacctggatcttggtgggtataaccattatggtcttgttggaatacagttgaagccgcgataatgttaagtgatgggtattttttacgccaatcaagttcattggctttacgtaaccacttgaagtgttgcgtcaacattgagtccacaacgcgtaggaaggcttcataactggcaaataacccatgacgtccagttaagacgtaaccttctaaccaaccttcagcttggtgttcagataactgagcatctaagacccggccagctggtgcttcatattggtcactatctggatgaatgtcttccatccattgacgattagtggtttcgaagacaccatataagcggttagacatggtttcatcaggtccgaacaaccggaagttatcaggattcttcttgatgacatcccgcaaatagtctgaccaaacgatcatatcttgcttaacattcgcgccttctttggacgtatcgaccgcataatcacggaagtttggtaagttcaaggctttcggatcgaccccaccattggtgattgggttagcagccatccgactgtccccagtaggaataatttctttaatatcatccttcaaagagccatcttcattgaagagttcttttggttgatatgattcgagccaatcaactaaagcatccgcatgttccatgtcattttgatcaacaggaatcggaatttgatgagcacggaatgaaccttcgatcttatcaccgtcccatgacttcggaccagtccagcccttaggtgcgcggaagacgatcattggccatactggcaatgtcgcatcgtcattttcgcgagcatgcttctggattgccttgatcttttcaacggcttcatccatggccttagctaaggctgggtgaaccttttcaggatcgtcaccttcaacgaagattggttcccaattcatgctttcgaagtattccttaatcttagcatcagaagtccgaccaaaaatcgttgggttagaaatcttaaaaccatttaagttcaagattggtaaaacagccccgtcgttgattgggttaatgaacttcgttgattgccatgaagttgctaatggacccgtttcggattccccatcaccaacaacaaccgcggcgatctcgtcaggattgtcaagaattgccccaaccccgtgtgaaattgagtaaccaagttcgccaccttcatggattgaaccgggtgtttcaggtgccgcatgggaagcaaccccacctgggaatgagaattgcttgaagagcttttgcatcccttcaacatcctgcgtaatttctggataaatatcggtgtaagtaccgtcaaggtaagagtttgaaaccatcacttgaccaccatgacctggaccttcaacgtagaacatcttcaaaccgtacttgttgatgacccggttaagatgagcatagataaagttttgaccggcaatcgtcccccagtgaccaattggatgaaccttaacgtcactggccttcaatggccgttgtaatagtggattatcttttaaataaagttgaccaactgataagtagttggcagcacgccagtacttatcaactttttgcaaatatgctggtgatgagtaatctgttgtcatttcaaaaacactccttaatttgcttttcacttgaacgctaactgtttaaatgttttcgtttacaagttctattttaacaactcatttcaaaaaatcaacctttttgttaattggaacggtccaattttataaattaaaacaaaaaaacaaggctcatcccttgggacaccttgcttttagattaatatattttttaataatttgtacgcagaatgattgaagcagcccatcaattagctttaatatgcccagaattaacaccggcgccctgattagttagtggcaaccagttcagtgcttttaatagatagcggtcccagaaatcccactcgtgcgctccagaaccgaccaaatattcatgcgaaacttttttggtcgttagaaaatgatcaaattcatcattcgctgactttaagccgtcctgatcgccaatcgccataaaaatcgcgggtaaagcgacgtgagctgccagtaatttagttacgagcacttgcgggtttaattccgaatgaccagcagctgctagatctgggccaaaaacgccatgctgatatgcgaccgtttccgcaaaccactgaggctttgccggtaacttttccattccgggtcgcacattcagtccggctgataaactcacaatggccccaaaagtatcgtgaaattttagtccgttatacagcgccccgtaaccacccattgataatccgccaataaaagtttggtcacgctggtgtgatagtggaaacgtccggcgtgtaaaatcaatcaattcctgaccaataaattgactatacgtctccccagaccaaggatgatcagtatagaaactattctcgcccgctggcatcacgacagccagattccgttcgtcggcccagcgctggattcgtgtgccactaatccagtcgacttcactacctaagataccgtgcaataagtacagggtggcaaacggaccctgaatcgggcgcggcacgccctgctcatctggaaccaatttatcagttggtaaacacaccatcaggggaacggtccggtgtaaactagccgccataaaattaatacgaatcagtgccatgacacctcagactcctaactattcgttgacacaaacgttgtatacttcatatattgataatgtaatcgcatattagacacttcaaagggtgtcccatcatctaaaaagaagatcccactcatcaggcccaccggttcattcggctgcaaatgtagcaactcttgatcagtcgtattggacgcatcggccgcaatcgataagaatgatttggtcactgcggcgtgcaaggtcttttgcacgtaattaaagatcgatccactgaccacttgtcggttcaactggggcacaagcttgattggaatatagccactttcaatcatgaaaggctggtcatccagtaatcgcagccgtttgatttcataaacaaactcgtcagcagttaaaaataagtcttgttgcaactcttgacttgcaggaatgacgcgaaagtctaataattgaatactgggcttagcaccctcagtatttaaactgtccgtaattcctaggttagttccttcatacttaaacgaagattgatttttaagatataatggattaatgaacgttcccgaaccccgcttcttgaaaatcaggcccttattggctagcacgttaagcgcgcgcttaatcgagctacgacttacctgatactgttcgctaagactacgttcatctggaagcttcttatcaacaaattcattcgccatgatccgtttattgagatcattgatgacttgttgataaactaggtcagccattgtaatccctcctttgaggttatttcatacctcaagtatagcagaattaatggcgtttgggtgaattgttccggtccatttataaaattggaccgtatttttaataaatgtgaggttaacaataatgtcaaaaaagaagaaaaaagatcaattaggtaaaacacttgttgaaaagattttggataaagcaaatatcagctatcaacaatatgaattcccaaccgaaacggaaggcgacgttcaacaattacaagtcgaccacctcggtgttgacgaacatcatatctacaagaccttagcgctgattggtaacaagactggtcccatcgtcggcgtcttgccgttagatgagcacctcagctataaaaaattggctaagctatccggcaacaaaaaagttggcatgattccattaaaggacttggaacgaactaccggataccaacacggcgccaacacaccagttggtatttgggaaactaagaagtttccgatctacttagacgagaccgctaagcagcaaggtaagattctcgtatcttcaggtaaaatcgggcgttcaattgaaatcgacgctgatgatctacgcaagctcgtgcacggcacttttggtccaataacggagtagcctcgtggataacttgatcaagaataacggcatcgtcttgctggtcatcattggtttacccggactattcgcttggttactgacgattatcaaccgacaaaccaaagcgaatctggtcaaccactacggtattaacagtcaagtctactgtggttttctgggcatcatcatccacgagcttagccatctaatcctcgcactgatttttcgccacggcatccaatcggtccggctgctcaaacgccctcacctccatcctgaagatgagtcggcggatgatctggcactaggctatgttaaccatacttggaatcggcacagccggtatcaagtcattggtaacctgttcattggtgtcgcccccatcttcggatgcacagcggcactccttggactagactggctactcgctcctggcctatttcaagccatcttcaaattagctgatacacccgaacaaccgcaatgggctgcaagttttcacgcgttaaccagtacgccaacgagttggtggcaactattaatgttgctctttctaaccctcgtcattgtgattggtggcttcgatctaagtcccgctgactatcagcatagtgcgatcgggttgtatagcaccatcgtcatcattatcgtgctgactaccttactgacgttcatcggtatcaccggttggatccatacgttagttacttggggactaatggtcgccattatcttgggctactcactactcgtgtccctactagtcatgttggtaacccatcttctgaccaaccgtgcctgatttagattgccagccttaaaaccagaataagggctaaaaaggccatcacaagaattcacgatacattcttgtgatggcctttttcgttagccaatataaatggtaattgcatcatctgataacatgatctcagctcaaagaactagtgattcaactagacatagggatgccattacgccttatcatccgccgtccactcagccttaaattggtcaacaaactcgtgcatcaccgctgtccggtgggctgccagcgctttggcagtatccgtattcatgagagctgctaacttgaacaacttttcatagaagtgattgatagccgtgccgggctggtgtcgatattgttcacgcgtcatatgttcacgtggcgcaattgccgggtcatagattttttcaccgacatgacctgaataatacaacgcccgggcgatcccgatagcgccaatcgcgtctaaccgatccgcatcctgaacgacttgcccttcaagacttaatttttgagggccgttgaaggatttgctgaatgacatgtgatcaataattgcaaaaatagccgtttgatcggcagccgtaacattttgcgcgttcaattgatcaatcaaatcttgatgcgccttcgctgggtcggccatcaatttatcgtcgatcacatcatgaagccaagctgccgctaaagtcagatttaaattcgccccttcggcttttgccagccggcgtgctagccggttgacccgctgcaaatgatcgcgaccatgcccactatgatcgtgagcaagcttttgcaaagcatacgtttgaattgccgttaattgtgtttcagttatcatacactcatcctatccctgggtctggtagtacgcccgtagcttcttgatcgttccccggctaaaggtcaagtgatcatgattgtccatactaatcacgcccttattaaaatcaaccgtaatcacatggtcaaggttgagggcataactttgaaactcattaaaaaaatgcatcgctgtcagttgttccttaatcgtatttaaattcttatgtacgacataggactgggtcgtcgtcacgattcgcgtggtccgcagcccatgttccttctcacagtagatgatatctttaagcttcagcgttaataataacgcaccacttcgaatcgttaaagtcggttcagcagattgctgtaacatacctaaccgtttttttacgacttgtaggactctttgtacttctggaacaaactttgccttatcgaacatatttgtttttgaaataaacccggttggtgttgtcatcgcactcaacgtatccgggatcatgtcatcacgcaccgtcacatagacaataaacccatcaggatcataatcacgaatcttagaggccaattgaatgccattgatttcgcgttgtaaaacgatatctaaaaaataaagatttggtccgccgccatcctttaccgccgctaacacatcggtcggctgccatactgagactaactcataattaaagtgcaatgcctccagctgtgccgtaatgatgtcgtttaaccagagacgctgttgttcttgatcgtcactgataaacaccttcatatcaatcactcttcccaatgtaaagcagattaacaaacaaaccactgttgatccactctatcccaatttaaattgcttacaatcattttatatgatactaaagccccgccattccagcaaccaaaaaaacacgtatggaccaaataactgacattacttggtccaccgcattcagcttatttttcaatttgttgtggcttggtctgtacttgattaagtcgcaataattcatccgtgcgcaatttattaacaatcagttgagccgctgcggttgttaaactgtgactgagatcctgatcagaaatcgtaattggatcatcgggatgatgaagttgattcgttaataccgtaataaaattgtcgtaagctcgcttgggatagccagtcgcagtcacttggtcaattccctgacgaattttatccagtggataactcggttttagtaagctaatgacaataatatccgccaattgcataatttgatatttcttcttgactggtgacaagatcactttatgtttgacataattattgatcattgcggcagtaactggatcagcacctaatggctgcaacgtttcattaattaataataggacctgatccatatataagtcaaagttcggtaactcgatccacttcggcagaatcacctttgccatgcgggcctgccaatctgcataagtctcattagctgccatactgcgtcctcctctgataaataggttacattaattatacctagattagctagtcttgtaaactagatgacattgtaaatcacattaatttctgaatatggtatcatttatgggttaatgcaaatacaaatgaaaagtaggttatgcagtatgtatgaaatgaccaaaaagctccgtgtcggtgatgatgttaaagaattgattccacaagcagtgattgccggactttgggaccgtctcaaagcgatgcgcaaagagaaattattgattgatagcacgatggccatcatgttcagtgacgattacgaagacaataaaattttcttcatgacacttcaaaaatccggctcattcgccaatgaatatgaaatggcctatgatgggcccaaagacttcctcggccatgggacgattgttattatcaaagaccgtccccgtacgattcaaatgagcatctcggacgctaataaagctgaagacaccaatgacgatgcgactgatgagcaaaaataggctcgcactttaaatcacatcatgattgctaataagctgctcaggtggtgaccgatattcactgactaccccgaatttgtacctggttatgctacagactttcagattcgtgctcacttaggttgtcacgactgattgctagctctatcaactagttgagacagcaccttgctaacaacacccctaagtgtgcaaaaaaatccgttgtcatcaatgtgtatgtaccgaataaaagcaccgtcaggattcgctgacgatgcttttatttattgtatttctatcttaccttcgctatccgcaacggtttttggcaacgtcacggtcagcagtcctgcttgataatgcgcttgaatctcttcgcgcacgacattcgttagatgaaacttccgggtaaagtccgcgtccatccgttcgcgatggagtacgcgcccgtcatcgttacgatcgtcttgcgaccggtgcgcccgaatagttagccattcgtcagcatacttcaccgtaatagcgtccttatcaaaaccgggtaattctgccgttacggtgtaatcatcgtcatgttcaaccacgtccgttttcatcccaacgtgtgcgtttaagacgttctctgcttcccggtgagcccgcttcaataatttggtgggctttagtagatcatccagatgatgaccgaataattgctggcgcatgtcaataacctccgtatcaaatcaattattagtaagcctgttggtgaatggcttcagcaagtaaatctaaggcatggtcacgcgtgccaacttggtccatatcaaagatgatcgaatcaatgtcgccacctttgaaatcaaattgttcgaagtaaatgtacgggtcttcgccttcaacttttaggaaagcggcttcaatcttttgatcaaaaccagccgcccaatccgcatcgtccatctgattgaaatctgcacgggtcacgtaaccacggtcacgaattaaatccatcgcttttttgacatcactatcttgataaaccaatttcttcgaatcctcatgaatcttagttttcgtttctactggcatcattaaagatctccctttacttggtatacccttagtttagcaccattcattggaaacgttaaccatctttctcgcgatcgcattattggcgcttaaagggttgccagtaggcccgctgactacgatagaccaattaattaaccgtcgcgggggctgacaaaacgggtgataagccttataatattagctacttcgcgttatacttaaagtaactaatattatgaaatgaggaatgtttctttggacagtggccagataattttaaatttagtcattattgtcattacgttcttcgtcgcggctttctttgtggcctgtgagtttgcactcgttcagacccgccctagcgctctcgaagaagaacaaaaaaaacgtgataaaccgtcaaaacggatcgcaacttctttgcacatggtccgcaaccttaacgagtatctttcaaccacccaagtgggggtctcgttagctggtatcattttaggttggattggtgaacaaacaactgaacactttgtgcttgatttcttatccctcttcaacctatccgtctcaaccgcggtattacgaggtattagtatcgtcattggggttttcctactgacctacttagaagtggtcttaaccgaaatcgtgcctaaaaatatcgcaatcgacatgccactcaaagtaatggcggtcattacgacaccattacggtggttccacgtgatgttctacccctttgtatggttgttgaatgtctcatcagctggcgtcgtcaaaatgttaggcattccagttgcgaatgaagataacgatgtttattcacaagccgaaattcttaacctatcacgaaatgccgtaactggcggtgagcttgaacgtaacgattacctttacatggagcgggcatttgagttcaatgacaagatcgctaaggatatcatgatcgaccgtactcagctagttgtgattgatatcaacgataccgtcaagcaagccattcgcgtttatttacagaaacgctttagccgcttacccgtcgtagctaacaatgataaggacaagattctgggttacgtttataactatgacttaattcgccaaggtgaagttgacgatgatattcgggtcaataagttattgcgtaatatcattacaattcctgaaactacaccgattcaagccattctccaaaagatgatcgacaaacaaacgccgatcgtcgtcgtggttgatgaatatggtgggaccagtgggatcgtcactgataaggatatttacgaagaacttttcggaaccgtcaatgacgaaatcgacaatgtttctaacgaatacatcgaaaagcaggccgatggcacttaccgcatcagtggtaagatgaccatctacgactttgaacgctacttcaagaccgacttacaagaatttgaagattccgatgttgtcactttgaccggttatattttggataattttcctaaaatccaagccggtgatacgattcaaatcggtaacttcaatttcaaagcgcttgattttgaaaatgcttatatcaattggtttgaggttagcgcccagacggatagcacacctgacgatcataatgacgatcaaacacaagactaaatatttacacgcactacttaaaatggcacttaaggaagttgatttcttaggggccatttttttgtatccggcgaacttcaactggtcaactttggtacttttatatgataagtcgtgtgaattgccactaacctgttgtacataaattggatgcggttgatttaagggaaagcctactaaaaattaagtttatcttaagccggccgttatcacgacaaactgcgacgattcggagccgtagtcgtttgcaattaagtagtgcccagcgtaaactaaaactaatgtaaaacagaaatgaggaactgctgtgagtgaatcaacaatcaatatcatttatatctccattgaaggcaatacccgctcatttgtcaccggtatgcaggattacgccaagacccagcatgcagctgatgatagcaacccgttaattaccttaaaagaaatcaccgaacagtcagactttgccattgagactgaaccctacttcgcctttgtcccaacctaccttgacggtggtaacggcattgacaatggggttaaggaattgatgaccaacgtgttaggtgaatatcttaactacgatcaaaactcacggttctgtctcggagttgttggttctggtaaccgtaactttaacgatcagtactgtctaaccgctcggcgttatgctgaacaacttgacacggacatgattgcggattatgagcttcgcgggactgccgttgatactgaacgcgtctataacgtgatgaaagaccgtttggccgcctatttagacaatcagaccttttaatcgaattaaccaaacaatcaaggtccaagttagttttcgctaacttggaccttgattgtgttcacagcacgaagttgaccaatcgcctcagtaacgacgatttcacgctattccgttgccttatccttatcaaatatcgtggggccgatgactagtgattccgctaataaggtttcattgtacaatttaaaaacgtacttctgatacttgacctctcgttgtgaaatcatatccaaatattgccgttcttgttcaagtgcattcataaatgcccgcatctctaattctttttctgcaccagtaaattccggtcgccgaacaacgtcaacccaggcacgcgcaaaatcacgagtcctagtccgttgtttctgggtcatcaaatcaaaaatgacggattctttcacattcgacggcaaatacattttctgaactgtatcaatcgcgtggtgaaccatcgccacccgaatctgatcaatctcactagttgcctcatcatcagtcaacgccggctttagcaaccagcgaaaaataatcgtcggcacgaccatactcagaataatcaacgtactagcagccattagaaccaagttaaagtcaccacgtccgaccgcagtatcggttaacgtataggctaaggccagcgttaccgcaccgtgcacgccacctaacgcaaaaatccatgcgggccgatttttgaaactcaaccgcaaccgaccgtagctgtaacgcaccagcacattgctaatatacagaacaagcccaatcaacaaaaagttcaaggacccatgcccgaactgttcgttaacaagaattttgataaacatgaatccaagaaccacaaacaccatgctattaaagatttcagtaatcatgctcaccaagtcaaaagcaaaatgaacttgttgtgcattaattaaccggcttcgttgggcttccgcattatgcactaatcccgcaaccacaaccgtaatgattccagaaacgtgaatcgcctcagcagcataatacaaaataaagggcgtaatcacgtacatcaacagcgacgcattcaacgaattatacgaagagcgtaacaatacttgccgaaacagaaccatgatccaggcactgacaaaaccaaagagtaccccacccacagctgaaataataaaatcaataatcgtttgcccatagttaatatagccattagcataccagagaaccgccatgttcaataagatgatgccagaagcatcattaaacaacgactccatttttaaaaaagttccctcagttgatggcatctccaaaccgttcgtcaccgattccattgccgtggcgtcggtcggcgtactgatagccgctagaataaaagctaacggcaagccgactaatcccagtcctgccaagctaaatcccgcgacaattaaggcaagaatgactagtccaactgtcgtttggataatgtgctttaattccttaccaacagcattcagtcgagtggcttgtccttcaaaaaacaggagtggcgcaacaatcaggccaataaagatttcagaattgaagttttcaatatgattgctcaaaactggaataaaaaacaagccaataccgacgatcagactcaagtagttcacagatatttgcggcattacccgggaaataaaaatactaacaaccgcagccaacaccagaataaaactggaaaccatcaaattcacgtactcacctcattttattaattaattcatttattctatccgataatgctcaaattgtatcgtcaatcgtctccatcatcactttcaaagaatcaaaaaagctttcaaggcatttgaccttaaaagctttgttaatatcacggggcccacctgctccttaaccatttaataagtgttctcgccgggcgcgccacaagactaacgccaaactacctaacattaagatagtcaccgtaataaacaataacgagtaggagaactgagccaccatcatgccaccgaacaatggtcccacagctcgtcccaatgacaaagccatgttgtatcgaccttgatattttccgcgctgatcatcagccgccatatcatcgacccaggcgggtgcaatcggtaagccaatgacctcaccgatcgttaaaaccaccatgataataataaaatcaacgtattgccgggcaaacactaatcccaagaatgataaggcaaatagcgtaatgcccaagccaatctgagtgccaatcttaaatcgttcgttgaataacgccacgatcggctgactcacaataattaatagcccgttaatcgtccaaacttcactataccggcggaacggaatccccaagttggtcatgtgcacggaaagaatactttcccataaggcataactcagataaatggtgaaaatcatcaaacaaatcatccagattaattgacggtgatttttaggcgtcacatcccgcttttgcggcgcagctttctctgtccgaacagtcggtgtgacgttaaaggtacttagcgtaatcgccataaggccaaggtagcaaactgttgccaccatgaacaccacattgatacctagttccaacaagtaaccgaccaataatgtcccaataacgaccccaacgttgagtgctaaataaagcatgttaaaaacataccggttggatctagtcgttaccgttgcggcataggcattgacgactgtcatgctgataccatcaccaaagccgacaatgatcaagccaatcgcgtaaggccacaaactatgccagaaaatcaacgttgttaaaattgcggtcgaaataccaccaccaagtagcgctgtataatatggtcgccagtgatcaaacaagcgcccgccaataaagttaccagcaatcatagccaacgacatcaaaaaaagaataattcccgaaaacgtcaagctttgtttgagataattatgcatgtagaccgttgttaatggccacataaaagcggcacccgcattattcagcaaattggctagaaacagccaccgtaaccgaacttctttttgcatctcctcaccacatttctgatttaagtttattcattgagaaaacaataccctaaatagtatacgccgcctgaccgtttttacctaccaatcaggtcgcaaaaggtgctgagtagtctacgaaatcatttttacttaagccgcgcttagcatcaagtcttacactgcatgttgtttacaatcgcaacgctgtagtcgcagcctaggcccgtgctttgaccatttggtgcattctaaatgcggcccccactccgcggagccgtttcatccgttttagtattgttccgagaagcactgaccacgtgtatactaaagtcaaaaaggagcaattgacatgagacttttcaccattccagccgaacaaacggcatttagtaccaaagaggttgtcgccatcaccggtatgaccaaggacgccctccgttattatgaacaacaacggttgattgggcccgtaccacgcaaccacaacaactaccgacagtattcacgtcaaaatttagagcgtctacaattcgttgccacttttcggcaattaggccttgatctaaaactactcagcggtgacggccacattccaaaccgggcccagcgaatccaagaactgagcgcatatcgtgctactgtgaaaaagcaaatcgctcaattacaggcaactgatcagtttttagcacataagattgcttactttgaggcttctccaaatcattaaccaacttttttactttttacttgctatcgtgtggacactatagtttatactaacggcacacttaatcaaagaaggttacgatattatgaaaacaattgctattaaccaatacggttccgcagatgaatttacgatggtcgacatgcccacgaccgaaccacaagctgatgaagttcaagttgcgattcacgcctttagtctcaatcccatggatattgctggccggatgggagccctatcctcaccctttactgacttatgggcctttccattggtcttaggttgagatttcgctggtgtcattaccaaaatgggcaaggccgtcactggttttaacatcggtgacgctgtgtttggttccgccgcgcctgcccacgcagctaataacggcacttatggtgaatttattactgttaatactaaagaattagcccatctcccagcaggcttatcatttgatcaagctgctactttgccaatcgctggactaaccgcttattacggcatgaagcacaatcttaagctgcaatccggacagaagattctggtgcagggtggagctggtggtgttggcctctttgcaattcaaattgctaaagcctttggcgcttacgtcgcgaccaccgctagtgctaatcaccgtgacttgttaactcgcctaggggccgatgaagtcattgattaccacgaaaccgatcctgccgccgtcttgcacgactatgatgccgtttttgacaccgttggtgatattgatactggtctcaaggtcctaaaagctgacggccagctcgcaaccattgccggccaaccgacggacgagcagcaacatgatcaacagaaaaaagttgcctttcagttcacccaaggctcatcacaagacctagccgacttagcccaattagttgtcagcggtcaagtgaagctaaccgttgcgacattaccgttctccgtagccaatgtcattaagggtcatcgatccatcgaaagtcgccatacgacgggtaaaatcgtcattcacgtgacggattaaccaatcctgctactcgataaatatcttccggcaccattcttagtagctagtcccactgtaaaaatgaacgttcagagttcgaaggacttctgaacgttcatttttattttagcggcccaattagccatggcacacttggtagcaaaccaaccaatttaatttaatgaatcactttaaacttcgcagcacacttaacaaccagttataattcacgatgccatgatgaatttgaactaagttcaaactgtctcaaccaggtcgtactaatattaattcgacaatccataaaaattaatattgaaatgtccggtttttgaacctgattgtcgactaccacccctgatgattgttataatataattaaacactgccaaccggtgtaatctttcaacaattgaggtgacaacatggcgaataacaactttggcttggcgttaggcttcctagtgattctgttgctctggatctatcaacgcgtgcgaatgcctaagatgcgctcactcgctggctacatgtcgcgacgcgcgattgaaaatgaggaaacatggcggttcgcacaacgcttctattcaatgtttggcatcgaaatcttttccattttgttaatcggcgcgattattggtggtctgttcaagattccgctattgcaaagctttaattttcaagccatcgccttagcggttggtttgatcatgcaaaacgttgcaactgagcgtgaactgaaacaccagttcccaaaatctccgcaacattagtactttataattgaccatcaccacgtatggtttaatattaatacggtagtttaatctgaattaatgcttatgaacaagtacttggtttaaaatattcttagtaaagaagtgaaattgatgagtaacgaaaaaattgccttattcaccatctttggcggtactggtgacctcgcacagcgtaaactgtacccgtcactatttaagctctatcaaaagggctatctcaaggaccactttgccgttattgggacggctcggcgtccttggactgatgatcactatcatgaagttattagtgactccctagctgatctgaatgctgatcaggaaacggtgacgcaatttgcgagccatttttattatcaatcgcatgacgttactgatgctgaacattaccgaactttgaaaaaattatcagaaaagctggacgcccaatatggtttacaaggcaaccggatcttctacttagcaatggcaccaaacttcttcggtacgattgcccaacacttacgttccgaaaatattctgacagataacggttttaaccgcgtcattatcgaaaagccttttggtcatgattatgaaagtgccaaggaacttaacgaccaattaacggctacttttaacgaaaatcagatttatcgaattgaccactaccttggtaaggaaatgattcaaaatatcacggccattcgttttggcaataatatttgggaatcattatggaacaaccgttacatcgacaatgtccaaattacgttaagtgaaaaactgggtgtcgaagaacgggccgtttactatgataacagcggtgccttgcgggatatggtccaaaatcacattttgcaaattttgagtctgttaacaatggatcaaccagttgaattcactgaaaatgatatcgacgtggaaaaggtcaaggctttacggagcttacgaccacttaaaccagaagaagtcgcaaccaactttgtccgtggtcaatacggtgccggcgatgatgctaaagcttaccgcgacgaagataagatttcatcagattctaacaccgatactttcgtcgctggtaaagtcatgatcgataattatcggtggtccggagtgccgttttacatccggactgggaaacgcttagccgataagttcacgcgaatcgacgtggtgttcaaacggccagtcgtcaatatcttcaatcacgaagacgtccgagctaatgacgacgcagcaaccagtctcgatccaaacatcttgacaatcaacgttgaaccgactgaaggcttcgagctccgcatgaatgctaaagcaatcggccaaggcttcgcaaccaccccggtcaagttgaattattctcacgatgctgaagccacggctggtagcccagaagcttacgaacgtttgcttcacgatgccttaaatggcgacgcaaccaacttcacccactggcaagaggttgccgattcgtggaaattcgttgacgtcattcaaaaatactgggatgaacatcaacccgaatttccaaactaccgccctggtacaatgggaccagatgcggccgatgaattattacgtcaagatggtcaccgctgggtctaccgcaactagccgtcctagcgtattcacttaaatggcttaattaaaagaaccagttaccaacacttgcctaacaacgtgttgataactggtcctttttatatcgctttaacaattggatgggttgctgcccatcggcaatacacgtttattttgctcttcgggattgcgcctgcggattagcttaactagcgtcgcaataatccctaacaccacccattccgcttataaacgcctaccctaccagttgttcacaaacttgaatcaaccgtttgacaccggtcgtcaactctgacagtgtcagcccggcaaaccctaacaagtaatagtccgccgtgggcatgtcgcgccaattggagttaagcggataaatccgaacctgttgccgttctagggcttctaataatttagcctgtgcaatgcctggaatctgaacaactaagtgtacccccgcgccggttgcaattggtcggatctgcttagtttgcgctaactggtgacaaagtacccgatacttttgtcgattagcagctcggtttcgactaaggtgccgataatacgccccatcttcaaaataattagccattgcttgttgtaacaggccggccaccatttcagcccgatattgataccgttgatgataagttgccaccagttgtggtggtaagaccaaatatcccatccgtaatgtcggatcaattccccgcgaaaatgtccccaaataagccacctgattagccgttgctagcgactgtagcgcgggtaatgggtgcgcactgtatcggtattcactatcataatcatcctcaatgatgagatgctgagtccccgcccattgtaacaacgctaatcgtttctcgatgggcaagacgactcctaatggaaattgatggccaggggtcgtataaatgatctgagaattacgcgcacgaacttgtgtcaaatcgagcccatcttccgtcactctgatggggaccgccgtctgtccataactagccgccaattcggataaaccgcggtagcctggattctcaattccgaccgttccgcgtggcaagatactaagtagaatactgagacctgccttagccccactcgtgatgacaatctggtccgctgtgcaccgcacaccacgagtcgttttcaaaaatcgaaccaagttttcacgtaaagccggtaagccctgcgcatccggataaacggccgttggttgctgctcagtctgacgcaacgctagtcggacagcccgtttccaagcgttccaacttggcgataacaactgagtcacaccataccgaaaatcataagtgaacgccctgggtttagtgggctgtggcacagtctccagcgcctgtttagctgctggccagtgtgtccgatcgcgataaaagtagccactcccgggaacggtataaacatagccctctgctagcaactgatcgtaagcttgttcgacagtggtcttggaaactcccaaattttgtgccattttacgaattgaccataactggtggttggcttgagtagcatcatagtcatcacgcatctgctggtataactgaatatataacggtgtcgttgactgacgatttaatggcatcacacaactgtcctttcatttttatcaaaattgtctatttctagccggacgattgttgtttattataaacggtaatcacgttgagaggaaggtcctaatgatgaatacaaatattcggatccaacaaattcaagtctctggcatccgacgcttcgatgaagcaatcagtcaaattcccgatattatcagattaacggtcggcgaacctgacttacccaccccaagtcacgtaaaaaaagcggcaattcaagctattcataatgattggacacactactcgccactaatgggatttgccgctttgcaagatgctgcgagtcactactttcaacagaaataccaactcacctatgcacctgagcaaatcattgcaacagtcggcgctagtgaagccgtggcaacgaccctgctcactttacttaatcctggcgataccgtcttattgccaacaccggcttacacgagctatcaacccgtcgttgacatcgcaaacgcacaattagctcccattgacacaaccgcaacgggttataaattaacacccagtgcgttacaagctgcgctagatgatcaccgtcgcgaccacgtcaaggccttaattataaactacccgaccaaccccaccggcgtcacgtacactgatgatgaattacgggctttgcaagccgtcattgctaccgccggaatctacgttattagcgatgagatttacagtgaactaacctatgaacagccccatactgcttttgccacactatatccaagcaaaacgatcacaatcaatggcctctccaaatcgcatgccatgactggttggcgactgggattcatcatggccccaagtaacttgattaccgagatgaagaagacccaccagtacctcgttacttcaacgagttcaatcacccaagcggctggtatcgaagcacttacccatggtctggatgatggctcagaaatgcgtgacgtctatcaaacacgccgcgattacgtcgtcaaacgtctgagtgaaattggattcaattatatctatccgacgggcgcattctatatctttgtccagctaccacaggatttccaaggcaccagctgggactttgcgacccgactcgcacacgaggcccaagttgctgtcgttcctggctcagcatttggtacgagtggcgagggttggttccggataagttatgcagccagtcaatcggcactacgcgaagggctaaatcgtttagccttatggcgcgcccaaactaccacacaggaggattagccacatgaatttagcatccgcacacctgattaccgctatggtcaccccatttgatgaccaacaacacattgatttccaccgcttagagcaactgatcgaacacttacttgcaactggcacggacggcttattagtcgggggcacgactggcgaaggccccacgttgagcatcgctgaaaaacgagatttatacacgcagacagctaggatcgttgctgggcgagttccaatcatcgctaatacggggaccaatgacactgccgccacaattcatttcacccacattgtcagtcaaatcgagggcatcgacgccgccctcgtcgttgtcccgccctataacaaacccaaccaaaccgggatgatggcgcattttacagccattgccgaaaaatcagacttgcccattataatttataatattcccggtcgcgtaggcgttaagatgacggtcacgactattctgacgttggcccacaaccccaacattattggaatcaaacaatgtggttccgatgaagaattggccgcaattgttgaaaaggcgcctaaagattttctcgtttacacgggcgaagatgctcagagcttgaccaccctcgtcttgggtggtcagggaacgatttcagtggcgagtcatttatttggaaatgaaatggcgacgatgcgccgcgccttgaaccacggcgatatcacccaagcagggcaaattcaacgacgtttaatgccgaagatggcagcactattcacacaaccctcaccggcacccgtcaaagcggcgctgaacgcccaacactggttagtcggaagcacgcgcctaccaattttaccgttaaccaccaatgaacaaagtcaactactcaacagcttaaaataatgcagaacggttggtagtacctggcaaaagcgcgtatactgaaactaaaataattaggaaagtggtgaccatgatgtgcggttgggcttttactggcggtatgccctttatgtggatgggtggcggcttgggcattatcagcttactgattctgttagccgttggtgcttactttttagggacacgttcacgccatcacgattaaagttctcattgggataatcaaaaaagactttcaaggcacggcttgaaagtcttttttgtttcatcatcagggatcagccaaccgggtcaaaccctccccatttcaggttacctgcagttttgcctgatagtatcagcccaaacgctgatttagacccgatgacttaatttcaagatcgtaacgtaagtaagtttaccagccttaacattgctattgagtttgtccccactaacttcattttcactcacaatccataagccgatttgaacaaactggccgccagtcccaatgccccgattccaatcacaattttaagtaatctggcaggtaagtggcgtacaattcgtggtcctaagctaccaccaattagaaaaccaatgcctaagggtaatacatagcgccactgaattggcgtttgtaggccataaacaacggctgaaacaatattggctaaacccaacgccagatttttctgagcattatagacgacgaacggtgcggcactcgtgaaagacaggatcgacaacatcaagacaccacccgcagcaccaaaataccccgtataagctccgactaaaaagatgcccaaccaagctaaagccgtcatccatttaggtgtcacaacaatttcaccgggctgtttaatatgaatatgacgaggaatcagcactaaaattcccgcaatcaaaataaaaaatgggacgaccttcgcaaaggtcgctgccgggataataaataacagaattgccccaacaatactcccaactaaagtcagcgggatgagcgtcttcaattcctgaccatgcccccgtagttcccggcgtgaggccggcacggctccaaagctagtaaagactaaacccacggtgttagtgacattagccgtaacgggcggcagtcccagcgccagtaggaccgggtacgaaaccagcgacgctaaccccgctgcagtgctaacgatacccgcaacaatcccaacaacgactaaaataacgattaactctccgaacgtaaacatgtacaacgttcccttctctcttaatagccctacaatagccacaacgattaccatagtcaaataaccatgttataataacaaatcataatactaacaattaagcatcaattaaataaggactttaaaatgaatattaaagatttgcaatattatgtttcgttaactcagctgaaaaatttttcattagttgcagcccaatttcacgttagtcaaccgaccatttcggctgctattcggcgcttggagaccgaactgaaaacacaattactaattcgggctaatccccacttacccgtggcactcaccacgaccgggattcaagtccaacgacacgccaatcagatcctattagagcaccaactgatgtgccaagaagttgcccacaccacaaccgatcaacttgtcatcgggatgccgccaatcattgaaatcaactactttccccggattgcaagtcaattaccacaggctttattcagccagattcaacctatcagtcaaggttcactcgcggcgctcaaaggattaaaaaacggacaattagacttagccgtacttgcttacctcaatgaattcacggatacgaccattcaactcacgacgtttgacacccagtcatttagtattgttgtaccaactgacgatccgctagcaaccaactcacaacttcagttcagatcgttgcgtcatcagcattttgtggcgctcaaagataactttgtccaccgccaggcgtttcgtcaactcagtcatcaaaatcatgttcggccaacgattgtctttgaatccaacgaaatcggcagtatcttaaacatggttcgtcagcatgtgggcattgccttattgagtaacgccgtccaattaccggcgggattacagcggctccccctaactgacgcgcaagcgcccacgttcaatgtcggcgttgcgtaccgccactcaatgacgtttagtccaacccaagccgacctgatccaacgactgaccgctgcttttcaatccgtcgattggcacgcatactaaccagcacctaaaaatccaccgtgtaagtttatcaatatgataagctcacacggtggattttataacgactgtacgtcaagttaggtcgccaaatgcaggtcattaaacagacaagttttagtaacctatcatggtcgctaacccgtctcaacctcagattaagcttgttgaacagccttcgagattggggtatcgccattgatcaacgcaatggttttaccgaccgttgcaggggtgtgtagcgtttgaactgtaaaagttgcgacatcatcacgcgtaatctcaccgccaacgtcagggttaacggttactttgccagtaccggcatcattgatcagcgtacctggttgtaaaatggtgtaatccaattgggttctgttttttaaccattcgtcagcataatactttgccacgtagtacggttgtaatgctcgtggccaacgactccgatccggtgtaaattcagcactaataattacgtagcgtttaacgccggcaattttggctgcgaccattgatttgacagccccatccaagtcaatcattaaagtcatatcataacccgtttgaccacctgatccggctgcaaaaacaatggcatccataccattaaaagccaacgctaaatcttcaggctgagccatcaaattgaattgtactggctgcgcaccagcatcctcgaaagcctcagcctgttctggttggcgaatacccgcgtacacttggtcaccttgggcaactaacttggaaacgattttcttaccaatctgcccatgggcaccaatcacaaagattttcatctgggtcactcctgtcctttagttaagtttcattataaagcttaccaggacaaaaaagtatcattctgttcctgatttgtccagtttacaaaattggcttataatatgagcatctaaacgagagtagtgataattcatgtcaaaatatattcgtcaagctactagtgctgacttaccagccatgatggctattatcgaacagggcaaacacgccttggctgccgatcagattccccaatggcaagatggttacccgttagctgctgatattcaggctgacattgatgctagaattgcctgggtactcattgtcgatgatcagattgctgggacggctgcactgctaacaacacctgaccccaattacgctattatttatgatggcagctgggcgcctactgagaaccaccgctatgcctcgattcaccgtattgctattgccaatggttaccacggacaacatctgactgacttttactttagcaatctcattaccatgagttaccaactcggctttcgtcaactccgaattgatacgcacttgttaaacaagcgaatgcaacacattattaccaaagctggcttcgaataccgtggtatcgtctacatgaatcatgacaacaacgatcaacggaatgcttatcagttactactatcctaatatttgtcagccacgcggcatttggctttaaacatcacgaacgctttaattaagaccaaactcaacaaaaagcacgccagattattctgacgtgctttttccaactttgtaagcaccacctgacagccaaacttaattaactggcacaaacacctgttgtggcagtgagtacaaatactgtttagtcacctttcctggatacatcgacgctagcgctgctgcatatagtttaacttgaccagcgtagcgcgtcttcaattcttcaggccgcttgacgtggtccgtcttataatcaaacaaggttaacccatcagccgtttctaaatagccgtcaataattccatgaatcaggacttttcccgtctcatgttcatcaacatcgaaaatctgacgtgctggaatcagtaacgagaatggcacttcgcggtgcaccttcgccggattatccaaaatttgactgcccagcgcactctggtaaaaagccacgatggtgtcaactgcaatcaatttcgcgacattggtcgttaagacccggttagccactaacccatcaatcgtactttgaaccgttgtttcattgaccggtttggtcaaatcaagttgttctaaaactaagtgggtcgcactcccaacttccgcactggttggcgcctgcatagtttgtaaaaattgtggtaactccagtgaccctgtcacaaaccgggatgtcggtcgtgaacgccgctgactaacagtcgggttcgcattcatcagcggagtatccggatcttcaaagattcgtttcacttctgataccgattgatatgccgtcgtcgtcgtggaagcctggtgtggataatgaaaattcagtaacgtggtcagataatcacgcgttacttgatcaacatcgatggtgacttgctgttcaactagttcaagcgcatcaggttgagtacccgataccgcttcactttgctccgccaggacggtggtggcatctcccaattcaacggctagcttggtcggatcatccgtcaattcgtaattgggccattcatctccccaatatgccttcatggccggatgccgtatcacggccataccgacccaatctaattgattagtcgccgcaatccgtgcttgggcacttaagacgcgcccgtcgctagcaaaggcctgccgccatttttcggtcgcggtatcaatatccttgattgttccaaccaaatagagctgttgctgagctcgcgtcatcgcgacatatagtttccgcatctcttcagcgcgcatcttcttgctgactacctgcttagtcacaacttgtggcaaggtcgggtacttcacacgcgtttctgggtccaaataagtaatcccaatccccgcttctcggtccaatagcgcgcttgagcgcgtatcagtctgattgaactgcttatccatatccatcacaaaaatcacggggtattcaagccccttgctaccatgaatcgtcattacgttgaccgcttccgcatcagtctcggccacggcagctgccaagtcctgatccttttcctgcatccggcgaataaaacgaacgaactgaaataagcccttaaaactgccctgttcatacgtataagcacgttcatataaagcgtggagattagcctgacgctgtttaccagccggcatgccgccaacgtagtctaaaaagccagttcgttcatagatttgccaaatcagggttacgatttgattacgtcgtgccagatctcgaaattcagtcaattgtgtcaagaaggtctcgatcttagcataaacttgatcaccatattcagtcgccggaccagtcggataatgatgataaaagtcctggacggcttgaaaataatcactcgttttattctggatacgcaaataaactaattgattttcgtctaatccgacaattggcgagcgtagaaccgccactaacggaatatcttgatatggattatcgataatactgagtagtgccatcatgattcgaatctcagtggtttgaaaataattctgggcatcattgaccacaacgggaatgtgataccgtttgaaaacatcaataattgttaaattatgattacgtgttggtactagtaacgccacgtcgctgtaacgaaacggccggtattccccattagcacgttcatagattggcttatcttgggccttaagtgccaaaatcttttgggcgaccatcgtgatactcccaacggcaggatcatcaattgaaaaattggtttcatccgtggagacatcttctgtcgacttgtcagtttccgtctggtaaagtaatagattcgtcgtttgtggcatatcggccggataatccttgggcccatacttgaggtaagccgcttcatcataatcaatttgcccgaccggcgcgtccatcagctgactaaagattaggttagtcaaatgatcgacattcgccaccgaccggaagttttcagctaatacgattcgttccccgtgttcgggattcgtcccaaaatcgtgatacttgtgcaaaaacaataacggatcagctaatcggaactggtaaatcgactgtttgacgtctcccaccatgaacatatttcctggctggtcgcgcgccaacagctgcaaaatactttcttgcaaagagttaatatcttgatattcatcaaccataacttcttcaaattgggcccgtaactgcgccaaagctgcctgaccactttcattgtcactcgttaagatttgcaacgttaggtgttccaaatccgaaaagtccaggacgtgtcgccgccgtttttcagctgcaaaagccgtcttaaactgcttggtcgcatccactagctcagtcacaattgactttgcccctaccataatatctaagacttgctgctcatcggccgcaaaataagtctcgctaagggtggtcatttgtttcttgacaccgtccacaaatgtgcccatagttttggcccgtgcagtcttctccggctcgtccttataagtttttttgagagctccaatcttgaaagtggcgacttgagtacgtaactcattccaacttgccgttgccaattgttcacggagcgtcgtcagcgttttttgtgctgtagcgagtacctcaagcgttttcgggactaagtcagcatccgtcgcaactttttgcgcctgtcgtaatttcatttgcatcccatcgacttcattaatgagcaatggtaataattgttgttgataaaaggcactggccgttaacgcttcctcatccacctgataaggttctggtaacttgctcagccagccttccggatccggggtcgactgggcaaaatcaaataaccgaaaaatcaatcgactgagaccatcatcacttcgatcattagaaaaattcgctgttaataagtcaaataacgtaccatcttcatcatataattgttcacgaacactgtcccaaacctgatcacgaatgagtaacccctcagtgttgtccgtcaataggcgaaaaacaggatccaaatcaataacgtagtaataacgctgaatcacgcggagacaaaaagcatccaacgtactaatgttggctaccccgagcaaatttaattgctgccgtaattgccgaatcgctggtgacgccgtggtttgcgccggattgtccgtcattaactgtgagattcgcttattgatttgcgattccagcttttgtttcatatgcttggcagctaagtttgtaaacgtcaccacgagtaactggtcaatattcgtgccggccaatatcttgcgcataatacgttcgatcaatacggtcgtctttccagaaccagccgaagctgaaactaacaagttatttccctgctgtgcgataacagcttgctggctaggtgtatagtttgtaccctcactcatggttttctccacctttctgtgtctttagtaaatcaagaacctgtttggctgataatggcggtagatcccgataagcattttctgccaacattgcatcaaactgcataattgatagatacggcgaatactgtaaagcagtcgtcttatcgttcagccgaattggatttagttgaatttctccagcgaaaattgcttcagcagctgcaataatcaattgactattatgctgtaataatcgttccaactggtcattcgtcaccagtgaagctgcacgccccccactatacgccccgtcctttttacgtgcgaatgggtaaactttcgaggtcccgttaccttgttgtagttcgctatctaaatgttccaataactgcggatcatcgagcaaaattcccttatacttgttcttctttaggagtgctgcttcaaaaccgccctgaatatcttttggtttcagagttggattttgaatgtgcatgtaaagtgcgccagctaatttaaccgcagcttgatcagaaccgactaaagcttgctcgttatgcagcacagcgtccaaataagttaacatttgcattgcgagaccatagtaagcctcttgaaaatcaaatttatgttgggatgacttataatcgacgattcccaggtaactttgatctgccacttgaatttggtcgagacggtcaatcttcccccgcacgtgcacactatgcgttgcatcaatttgaaaatcgagcgcttttaatccgtgttccttgccaacgttaccaaataagacctcggtttgcttcggttcagcggctgacagtttactttgattgcgaatcgcaaatgcaatctgccggactgtgttgattaactgccgttgcaagtaagccatccggttagaactcgtcaaaattgtaaactgtggttgatctaagatttgacgggtcacagtctctaaatactgtcctaactgctgatcactggcttgggccaatgggatttgatcagaccgtaacgccttgatgagcccatctaagacagcgtggaaaaactccccagtactagcagctgataactcgaacacatcacgctcacgcagtttgagcccatatttcaagaaataagcgtactgattacgataaaattcttctagttttgaaattgacgtataaatttgatgcccatacaaagcctcaacgctggctggtgtcagcttgacaggttgattgcgatagcttaatccagccatcaattgacgtgctagctcaccgaattgggggtcacgcgtcaattgttgccgtaaccacacccacaccggagcaggttgtaatggtgcgccaacacgattacggtcagtattcgtcgttaacacatcgcggtaaacctgaatcacatgactaatcgtccggcgcttagtcccaacaaatggccgcgcatcggcattagtcggatcaggcgtcccaagataagtatgttctcgcaaattgaactggcgttgaattcgccgcacatagttggaccaatttaaatctgtttcttgatcatcttttaacggggcgctgaaaaacaagtgtcgacgggcacttaaaaaggccaaataattcagacaactttcatcaccgagctgaacgacagctgaatcatttaaatagtggtcaccatctaacgaactgagcgttggttgcaaattttctttatccacatcactcaataagttgttcgtcataatccggtcaggcatcactaaatcggttgccccaaccatgaagacaactttatggtcctgactttgaaccattccgctctctgaaattaacacctggtccaacgtcgacggaatttgcgagtaactagcaccttcaaagcccgcttgtaatagtgccaaaaagtccgtaatttcaaatggctctgcacctaaaatcgtcacgtattcatctagcatcccacagaaagtttgccaggtctgctcaggctcggcagctgcccggacatcttggcgatccaaggcttgatcacgccaagctaatagctggtccgtaacgccctggcttgtcaaaaagttgaccagcaatgtcacggccgctttgccatccggtgcttgccgcatttttttaaaaaacggtggtaacgtttcagcaacaaagtgatgaatcaagttgatttgtcgcgaaatttcagcattttggtccgtctcgaccccggcatcaccctcggttaattgaaagtattgccaatcttccctttgtacccaccgctggccgtgataaccacttttaaggataaagttttcggtcagatctactgcttggcggtaggcttgccgatccatcggttgcccattgatatttggcatcaacagctcggttttcaacactcgcataacatcacgatattgatactgctgtgcgtcgatatcaaacaacgcgttaatcaactcaactaacggatggtcggccattgaacgctgtaaatcaacaaagtatggtatttctaattcatgaaaagtcggcgctaacatcgtttggtaggcatctaagtgccgtgtcatgatcaagaagtcccgataatgataatcgtcggcgggatcggcatgttttttcgcgaccattgcccgaatcatgcggccaacttgtgccaattcggtctgtcgactatcggtccggaataaatgcacattcgtattcggctcctcgtaaccggtagccgcttggggctgaccacgccaaaaatcatcgagagccactaagccgggagccacgcgcggcgtttcagcataaatatcttggctaaccggaatctgacgaatacgggcatactgataaagccgataataaagccgaccagattgataaaacagcgtgccattttctggcgcccggtcaacgactttgtgatcgagcatcaaactgattgtcacgtccgcgccctgttccagcatagtcgtgacgattccctgttcctgggccggtaattgggcaaagccagcgagttccacataaacgtgcgttccgtgcaagtcttgacgccgtaagtaagcattcaattgaacgagaatatcagcgggcttaagatacttatctgcagtcgccgccacgaagtctttgtaaacgatcgccagatcatgtagcttagcctgcaagtcacccgcctgagcattcgctgccaattgaaccacatcttctggttgcaaattagcggtctgtaactcattaatttcacgagctagttgagtcacaaaacccgtttgcgagatttcaccaccaaacaatcgcagctcatcggcatgtcgttgtagaatgcgatataatagcatgtcaatcccagcagcggagagtcgtggtacttgataagctgcttcgttcttcatcaagtaccaagcaagacgggtaaatgaaaagacctgaacctgagtctgggcatacaaatctggttgcccaaatgcctgtgccaagcggttcaacacgtcaacttcagtatcgaacttaatatggttcggtaccaaataaaaaaactgatcttgtggcttagccatcaaggttgccactaactgcgccaccatggtacggcgatggtccatcttggctggtcccaatacaaattgtaagctcaccactaattcctcctctgaactgaacaaacgttctcattaagttagtctcattatcgcatatttaaccggctaaaaaaacacctaacccgtaagttagatgtttattatcgcgtccattaaataccacgttattcagccaggtgacccgtgtgctgcacgtcttaattctcaacgttgacggccactgctgccagatgtgcgtcggatttataatggcttatcgtgcccggcatccagtaccgttttgtcatcctgatttgaaattttagaagctttaacgaacgtggtcacggcttaatgtgggcaactcgcacggccgcttattcatccggctgcaagcctcgacctcaaaacaccttaccgatcacccggtgacactcgccaatcctcagagtgcttaaaagacacgaattagcacaacccccacaatcatgacgagcaagcccatcaactggacccccgaaattgggttcttttttgaagcaaaccagccaaattggtcaatcattaaactaccggccatcagtccgactaaaacaatgacgaccgctaaaccagtgccaacgaccggaaccaagtaaacattacccaaaacatacagcgcaccaatcatgccaccaatccacatccaccaaggattaggcgtcttagttggcctaatcaatttgaattgaggtcgcaagactaacacgatgacgatcagtcccagagtaccaactaaaaaagaaacaaatgccgcgtgcactgtggagccaagcacccgacctaggtgcccattgaccgcagtttgcatcgcactgagcattccggcaaccacacctagtgcacgccaaattccaaggccactttggtcagtgtcagtagctgtatctttttccgctgtttcagtgattcgattatgccgctgttcgagccacccctgagccgcaacggtgatgatgacccccgccaagactaaaattgcacccaaaaatcgggtcatcgtcaatgtactttggggtgagtcgaaccaaccaaaattatcaatcaatagcccggccaaaatttgaccaagcacgggcataataacggtttgaacactacccagcttcggaaacaacaagatattgccagttaagtagacgacccccaatagcccacccagccaaatccaaaccggttgactcgtaaataacgtcgtcgaaaatcctaaagtatggacatcaattagtgtcattatcgccaaaaacaacgtccccacagcaaaagatattagggaggcgccaaatggagatcccactgaattgcgcaatcgcgaattaatactcgtttgcattggtaacccaatcccgattgctaagccaactaaaattgctaacatcgaatattccctcatttctttatattgtcttaacaatctgtcacaggttaatattagcacgagccggtaactaaaatagtcatgaaaatcgtctggataatccagcttaattttcatgactattttaaatatgccagccatttatggcgcgtaatcctaatcagtcactccccagtgttctgggtcctgacgccacgtatgcagcgaagctaattcttcgtcatcaatgtaatctgcttggcgagcaactttgattagttcaggatagttggacaaactgaacagcggtaatgacgcagcggcaaagttttgcgttgccgcatccaaggcataactgaagattgctccaacagcctgaatatcgccacctgctgcttgaacggccttagccgcctgtaacacactgccacccgtcgaaatcagatcatccagcatgacaactttttgaccgggctttaacaccccttcgatttgccggccagcaccgtgatccttgggtttagcacgaacgtagatcaatggtagatttaacaattccgccacccaggctgcatggggaatgccagccgttgcgacccccgcaatcacttcggtcgccgggtattcacgcttgatgatggcggcgattccgtgcgcggtatgctggcggaccgccggataagaaatcgtcagccgattgtccgtataaattggacttttaatgccactggcccaggtgaatgggtcgtttggtcgtagtgtaacggctttaatcgtcaacaaatcagtggcgatagttgctgcaatttcactcatattagttactccattctgtcataatgtctcggtaagcttgaactggttctgcagcctgcgtaattggccgcccgatgacgagaccgttgctcccagccttagcagcggcagccggtgtcatcacccgttgctggtcatctgactgcgccgacgctggccgaattcccggcgtaattccgagaaaatcggcaccgacggccgtatgaatcgcctgaacttcttgggcggaacaaatgacgccatcacagtcactcgcccgtgctagtttggcataatgcacgacactcgcccgaatcgttcccatgatttgctggtcctgattcaaaatagcttgattagtcgaagttaactgcgtaatcgctaataacttgggggcagtgactccagcggccattgcacccgcgaccaatcctcgtttggcggctgaaagcatcacgtgcccacccgcagcatgaaccgttgtataggttacccctaaccgcccgatcacccgcattgcggattcgacggtattgggaatatcatgtagtttcaaatctaagaaaaccgcatggccgcgagcttgcacgtccgtcacaatactcggtcccgctgcataaaataactccatgccgattttgacagtgacatgtaaatcagccggaaattggtctaaaaaagctaaggcccgttcggcggtgggaaaatctaacgcaatgataattggtcgcttcatccttggacctcctgaatcaacgcttgcaagctggtgatcccgtactgatccatcgccgccggtaatccagcaataatgtctgtacaagcagtcgggtgaccatacgttgcggccccaacttgaacagcatttgcaccagccaggtaaaattccaacacatcagccggcgtgaacacgccaccaacgccaataatcggcaacttggtatgttgacgcacgtcatggatcatccgaacagcaagtggatgaatggcttttccagataaaccgcccgtaccatgcgctaagatcggttgacgtgtggctaaatcgatgcccatacccgttaacgtgttaatcatcgtcagtccagccgctccaccagcttcggcagcgagtgcaattgggacaatatcagtgacattcggggtcagcttcatgaaaactggtttatcgaccgcggcaacaatcgccttagtcaacgccgttaccgtcgctggatcagttccaaatgctaggccgccatggtcgacgtttggacatgaaatattgatttccaataatttgacgttaggtgccgacgccatttttcgtgcgactgccacgtattcatcaaagctcgcccccgcgacactcccaataatcggtaaatctggataatgagtcgctaaccacggtaatttatcggccagcacattgtcaattccgggatttttgagtccaattgcattgagccaccccgcggttgtttccgcggtcgttggtcgtgggttgcccgctttcggttcggcggtggtcgacttgatgaccaagccccccaacgcactcaggtctaactgttgagccatctgttgaccatatgccgccgtaccactagccggcataaccggatttttgaacgtgacaccggctaaatttactgttaatcgtcccatcgttttcctcctatgatcaagcttatcggcgggtgtcctgatttagagcgcctgcgttacaaatgactgtgattctcgtacttgcaaaattgccgcgaccgtatctaaggccgtaaacaatggaataccgtgcataattgacgtgtttcgaatcagggtaccatcattttcagcctgttcttcatccgaaaccgtattaatgacgacttgaatttcgccagcttccatgcgatgcagtaaatcatgctcgccactatcgatcttgtcgacggtcgtaacgggtaacccgtgtgtggtcagagcagtcgccgttccccgagtcgctagcaattggtagcccaacgcatggaaccgcttggctaacgccactgtttctggcttgtcttcatcccggacagtcaaaagtacgttaccatggctcggcacgtgtagcttagccgcttcaaaggctttgtaaagtgcctttgccatcgtgacatcgctgcccatgacttcacccgttgacttcatttctggtcccaacaaactatccacacgattcaactttgaaaatgaaaagaccggcgctttgacgtgtactaagggacccggtgtgaccaagccagtctgataaccttgttcagccaatgactggccaaggattgcccgagtcgcaacttgagccatcggaatgttcgtgaccttgcttaagaatggcaccgtccggctcgcgcgcggattgacttcaatcacataaacttggtcgtcgtggattacgaattgaatgttcatcatcccgacacagttgagcgcaatggctaatttttcagtataatccacaatttgtgcttggaccgccgccgaaagtgactgtggtggataaacggccatcgaatcgccagaatggacacccgcccgttcgatgtgttccataattcccggaatcaagactgtttgaccgtcacaaatggcatcaacttcacattccttcccgaccaaataactgtccactaaaacggggtggtcatgcgacaccttgaccgcgttatgcatgtaatagtctaagtcggtccgcttcttgacaatttccatcgcccggccaccaaggacataactgggccggacaaggacgggatagcccaacttatccgcaatagctagcgcggttgcttcatcacttgccgtatcaccagccggttgtggaatagctaaagctttgatgaccttatcaaattcgtcacggtcttccgcacggttgacatccgccacactcgtccctaatattttgataccatggtcagccaatggtttcgctaagttaatcgctgtttgaccaccaaattgcacaatcacgcccactggtttttcaagttcgatcacgtttaagacatcttcaatcgtcagtggctcgaagtacaatttgtctgatactgagaaatcggtcgagacggtttccggattactattcatgataatcgcttcatagccagctttttgaatggctttaacggagtgaacggtagcatagtcgaattccaccccttgcccaatgcgaatcggccctgaccctaacactaaaacggatgggcgtttcgtgacaatactctcattttcaaactcataagtgccgtagtaataaggtgtctccgaagcaaactcaccggcacaagtatcgaccatcttataaacgggcgctagtttgtgcgctaagcggaagtcgcgaacctgatcgattgtttcgtgccaatagtcagctaccgtttgatcggcgaagccattgcgtttagcaacagttagtgtctctatgtcatccgtatgggtacgcaaagcttgttcgatttcaataatgtgtaatagtttatccaggaagaacacgttgatcttggtgagttcggctaattcatcaatcgggtaaccgcggcgaattgcttccgttaagtagaataaccgatcatcctgcgcatgaatgagcttatcgctgagtacatcatcatcaacactacgcaaagcgggttcttcaacgtggtgcactccaatttctagtgatcggaccgcctttagtgtggcttcttcaatattgcgcccaatcgccatgacttcgccggtcgccttcatctgagtgcccaaacgacgatcagcatgggtgaacttatcaaacggccagcgaggaatcttgcaaactacatagtccaacgctggctcgaattcagcgtaagtggttcccgtcaccggatttttaatttcatccaaatgcaagccgactgcaatcttggcagccatcttagcaattgggtaaccagtcgctttggaggctaacgctgatgagcgactgacccgcggatttacttcaatgatatagtaattaaaactattcggatcgagggccaactgaacgttacagcccccctcaatcttcaacgcccgaataatcttcaaagcagcatcccgtaataattgcacttcgcgatctgctaacgtttgaacaggtgcatagacgattgaatcaccggtatgaatccccacggggtcaaaattttccatattgcagacgaccatcgcattatccgcagcatcacgcataacttcaaactcaatttctttgtacccggcaatactttgttcgatcagaacttgggtcactggtgataacgccaacccattttcggtaatgtcgtgtaactgttggggcgtctcggcgatgccaccgccagtcccccccatcgtaaaggctggtcgcacgatgaccggataaccagcttgctcagcgaaagccaacgcttcgtcaaccgtccgcgcaataccagaagctggcacgggttcgcccaattcttccatcagtgccttaaactgttcccggtcttccgcctgatcaattgcgctgagcttcgttcctaacagttcaatgtgcaactcatcgagaatacccgatttagataattccatcgccatattcaagccctgctggccgcctaaagttggcaaaaccgcatccggatgttctttgcggagaatctgtgaaacaaattcaagtgtaattggttccaagtagacctggtccgcaatttctttgtccgtcataatcgttgcggggttagaattgaccaagaccacttcataatcgagttcttttaatgccaggcaagcttgtgtcccagaataatcaaattctgcggcctgaccaataataattggtcctgaaccaattaccataattttatgaatatctgtccgtttaggcattgaattggcttcctttctgggttgcttgattagccgccatcaaatcaataaattcgtcaaaaatatgatcagcatcgtgaggacccggcgctgcgtccggatgatattgcacggaaaaggccgcgtagtcacgatgccgcaagccttccacggtaccatcattaatctcctcatgggtgattaacaagtcagtctgcgctaatgaatcccgatccaccgcgtaaccatggttttgcgacgtaaaatcaatccgcccagttgcaatctcacgaacgggatggttaaacccacgatgtccgaacttcatcttgaacgtgtccgcaccgtttgctagcgcaaaaagttgatgtccgagacaaattccaaatagcggcacatgtttttccacttctctgatcatctctaaggctcccggaacatctttgggatcaccagggccgttcgtcaacatcacaccatccggattcaaagccatgatttcactcgccgtagtattgtacggcaacaccgtcaagttacattgacgctttgctagttcgcgtaaaatcgaatgcttcaacccaaagtcaacgacgaccacgttggggcctgtcgctgggttgggataggcgttattcgttgaactctgggcaacaacggcccgatttaatgccgtgactttgagccggtcaaccgtatctggtaagacgttatcgacgatggtggccttcatcgcgcccttcgttcggatatgtttagtgaccgcccgcgtatcaatatccataatgccaggaatcgcattctgttttagataatcgtccaacgactgagcattacgccaattactggctcgtcgggcaacttcgtgaacaacaacgcccttacaagttggcttgattgactcatggtcatcccgattaatgccgtaatttccaatcaaaggatacgtaaacatcaagatttcgccattataagactggtctgtgatcgactcttgataaccactcatgccggtattaaagactaattcaccaaccgtggccgttgtcgcaccaaaccccgtgccggggtaaatcgtaccatcttcaagtactaagtatcgtttcatgcttgcgttccctttccatatgccaacttaccgtcaactagtgtcattaagacgttgccataaacgggccaaccgataaacggggaattgtgccccttcgataacatggtggccgcttcgatttcatattgatgatctaaatcaataatggttagatcagccggtgcccccactaccaaccggccggctgtatttaagccaaatagttcagccggacgcgtgctcatcagttcaattaaacgaccgagcgtcagtaaccgggtcttgaccagcgccgtatatagcgtggcaaaggcagtctcaatcccagtaatcccgaaggctgccgtcttcatgctgccctgtttttcggcatcagtatgcggcgcatggtccgtcgcaatcatgtcgatcgtgccatccaacaatcccgcaactaacgctgcgcgatccttggctgaacgcaacggtggattcatctttaacatcgggttatccatcgtaatatcttcatcacaaaggagtaaatgatggggcgatacttcacaagtcacgttgatgccagctgctttcgcattgcgaatcacgcgtaaactttccgccgttgagacgtgacaaacatggtagtgaaccccactcgcttccgccaacatgacatcacgagccacttgggacgcttctgaaacattattgataccaggcaatcctagccgatcagcaacgggccccgcgttcatcacgccatgatgataaagcgaatcatcctcaacgtgtgccgctaatggcaacccaactttagcagcaccttgcatggctgcaaacatggttccggccgtttgaacaccggaaccatcgttactgacggcaaaggcccccgcagctttgatgccggcaaagtcaacgagctgttcactagtccgcccagtcgtaatgctggcatattgtgcgacgtgaacatgtgcttcctgctgattacgcgccaccatcgtcgcgacccgcttaggtgtatcgggtaccggatccacattaggcattgctccgaccgttgtgaaaccgccatgcgccgcggctaacgttccggtcgcaatcgtttccttcgctgtttgaccaggatcgcgtaaatggacgtgtacgtcgacaaatcccggactaacaaagtgctgatcggcacaaatgacgtgatccgccggtccaaactgatcgtgcagttgatgcccgatcgccttaattcggccctcggcaatcaggatatccgttgtttgtaactgccctgcttgccacacttgagcattcttaattaatgttgtcatgcgttaaacctccacttgagttgctgaaattaatccttgatgagcgaggacgctcgccaccattgccatccgaatataaacaccattcgtcatctgctgaaaaattcgtgattgcggcgcttcaactaagtcactcgctagctcaacacctcgattaacgggggccggatgcatgataatcgcatgcttgggcattcgtgcggcgcgctcagctgttaaaccatactgttgatggtaggcagacgcatcgaaggtctgattgttcacttgcgataatcgttcgtgttggacacgtaataacatcatgacgtccatcgttgcgactaactggtccatcgtctgatattcgccgtatgcttcaaagtcacggccataccattctttggggccgccaaagtaaacctgggctcctagttgcgtcagtaacgccatattggaacgggccacacgtgaatgggccaagtcacccacaatagctatctttaaaccatcaaaatgaccaaattcttcataaatagttagcatatccaacaacgattgtgacggatgttgcccactaccatcaccagcattgatcaaactcatgtcaaacccggcgtcgagaagtggttgataataacgatcgcgtggatgccgaaccactgccaagttgacgccaatggcttcaatcgttttcaaagtatccagcaagctttcgcccttagtcacggaactagtctttgggtcaaacgaaatcacctgtaatcctaatcgtcgttcggccatctcaaaacttgtatgtgtgcgggtgctattctcaaaaaataagttcatcgcaaacgttggctgtgacagttgtaccgttttcccattcttgaaagcttgggccaacttcaagtaggccatcacgtcctgattactaaattgttcaacactaactaggttttgactcgttttcatggctattgccgtctcctttgtatataaaaaaagtctagcttccgcaaaaatgtttgcaaagaggctagactccgattaagtggtcacgcatgaccaaaccgtttcgttcctctctggaaacaattaaatggttttattcaattaaatcattcttctaatttttcaatactaattccatcatgtccgtcgtgttcttcaagggcgacactgacttgttcatccaaggccgttggaatatttttaccaataaaatcaggccggatcggtaattcacgatgtccacgatcgactaagaccgctaacgaaatctttgcgggacgtccatggtccatcaaggcatctagcgcagcccgaactgtccggcctgtaaataagacatcatcgaccaagataacgtgtttgccattgatatcaaccggaatatcagcaccatttagcttcgcttgaccggcaacatcaaccgcatgatgatcatcccgatataacgtgatatctaacgaaccaactggcacgtcaacgccttccaactgtttcaatcgttgcgctaaccgttgggccaaaaaaatcccacgagtcttgataccgataaataccaggttaccaacacccttattctgctcaataatctcataagtgatccgcgtcagcgcgcggcgcatggtcattgcatcaacgacttctcgtgccattagtttgtcagctccatttctgtaatttcaccttaatccacggggtaaaaaaagagtcaccctgttttcctgcgaaaagcgtgggagaccctacatgaccgttccccttgttagcctcacaggactaagttaaaggtgcttgtttaattggactaagtgtaacgaactccaccacaactgtcaaggactaatcaacttaagtcgcgttaattatctgacgactttggtcatttgccctttatgttgacaagcatcattgaggaacctggcgagttcaatagatttccaatcgtgacacgtgatcgtcttattccggcctctaagaataaatgatgagcggtcgcctaatattagtaccattggtcgttgaatccgttgatattagaacttcaattaaagctgggagaccatcaattcactttaatgactgtttcaatcttaacgtgctaatttagcaacaaatggtctatcaaaatatcattatatgcgaaatctaccctttatgagcaacaacaaactcagcaaaagttaagtccacccatcacttgaacaccacctcgactgaaaggcgttgctgacaatactcagcactggaagccggtgaagttcagacgggttgaaactgaagattatctcaacggcaacgttgaggggtgaactttcacttagctaactggaagtctcaacccgagcgaaccccgtttctgtatgtcggcatccaacgccctaaccaggtgaatttacactaaacaaaactttcttcagcagtcctgcgccggctactcctgcgcttaaatgaggataaacctttccaatacttaaattccttaacccataacactggttcgacgcttcatttgtttttaatctgtttttcatttaattatagtcaaactgccaaattatcggtatactacttgttaaagataactaattttagggggacttaccatgcgtttacaaacactattacaaacaccatcaatgcaacatatgcgggtaattgcgggtgaacgcggtctcaaacgcgaaattagtaatatcggaatgatcgagtcacctgacattgctgactaccttgctaatggtcagtttttgattacgaacggctatcccttcgtcaatacaaccaccgacccactaactttgatcaaggcgatgcacaatgccaactgtgctggtctcggatttaaggatcatcgttacgttgaccatttaccaaaaaaagtgattgaattagcgaacgaactcgcttttccaatcattattacgcccggtgatgagttgatttctgaaaccatgcgcaaaatgctgagcatcatcttaaagtcacaaactaatgagctcagtcgcatcgtcaaggcaaaccaaacactagcggatttgttgctcaaagacccaacgaacaccacggtcttgaataaatgtagcgagctaattcatcatcctctcttcttaatggatagtcattttcgggtggtcagtgcttcccaagatttaccgatgacccgcaataccttgactgattttttacgcaatcaaaccgatatcgactatttcaacctcaatacccgcgtcattctcccttaccaagcaaatgacctgaccatcatgccactattttcggcttataaggaaaataaggcctttgtaggcgtcgtcgacttggacccggccaactcaactgatcagatgctgacgcaagtcgtcttaaacaccttgagtttcgtcaatggtcgggtggacatgttaaatgaatccgcattccgcaaccaaagtggtttctacttaaatgtaatggatggcggtatttcaaacgacctcgtgaataagactctgaaagcccgcaatattgatccgagtacgaagttccactgcgccaccattctagtcacgactaatcaccaggccctcttaagtaaccatctcttggaacaggttcagcaactgacactgtggtttattaaagaataccaagcatccgtcattgttttttcattaaagcagcaattggtcttattaatcaatgaccaacaaaatgcccagcacttcctgaccgccctcgttcaatttattcagccaaagttggacagacaggcgcgtttgattgctggctacagttattcgactctaccactaaccgaactcgcaacaacctataatgaagcggcagaagccttggcactcagcaaaaacagtccccacgcagtcacgatctatcggcccaagtacgtcaaggaactaatttcactgatcccacaaaatgaagcgcgatcgtttgtcgaacgggtcttaggtggactcgtcagtggtgtcagtgcgaatgaacaacttaatctactcacaaccctgtatggctatttttattaccatcaaaacattgccgaagtggccggccacctagatattcaccgcaatacggtgatttaccgccttaaaaagatcgaaaaaatgctaacgttgaacttggacgatcctgaacagacccaaacactagaaatggcagtgctactttggcataatcaacaatcacaaaagtgaacgttttcattttcatcttccaaaaaaatatcgttttcacgaacattaatttattcggctacatttgtattcggttttcatctgtgctagaataagtctcattcaaataagtggtaattgcctatataatgtcatgatatggttgacgagtttctacccaaccccgtaaaggttggactataagcaaacgaggtcatcccgtttgccggggtgactttttttataggcaaatcagcttaatcgagagaggaagattgatttgaaggaagtatccgcagcacctaaaattaccaatgttaaggcggccattttagggtttcaacatctgttagctatgtattcgggtgatgtgctcgtgccattattgattggcgcggccttgcatttcagccaagaacaattaacttacctagtctcaatcgacattttcatgtgtgggatcgcaacgttcctacaattaaaacgtacaccactaacaggaatcgggcttcccgtcgtgcttggctgtgccgttcaagccgtcaatccgttgattcaaatcggtaaaacatatgggctggggaccatgtatggctcaatcattggtgctggtatttttatttttctgattgccggcttattttcaaagatcaagaacctctttccaccagtcgttacgggatcgctaatcacaattattggattcacgctgattccggtcgccttccaaaatcttggtggcggcgacaccagtgccaaggatttcggtaacttgcaagcacttggcattggttttctcaccatcgcaattattttattaattagcgtgtttgcacgtggcttcatgaaatccgtttcgattctgattggtattttagttgggactttgattgccggggcaatggggatggtttctttaaaacccgtcgctgaagctagctggttccatttaccgaccctcttttactttgggaccccgcactttgaatggtcatccattttgaccatgatcctcgtctccttaacaacgatggttgaatcgaccggggtcttctttgcccttggcgacattaccggtcgtaaaattgaaggcgacgatttaaaacgtggttaccgggcagaaggaattgccgtcatcctcggtggcttgttcagtaccttcccctattcaacgttttctgaaaatgtcggcgtcgttcaattatctggtgtcaagacgcgaaagccaatttacttttccgctgcgttcttagttgtattgggcctactgcctaagattggtgcgctagcgacgattatccccgacccagtacttggtggcgccatggtcgtcatgttcgggatcgttggcattcaagggattcgaatgttagctcaagtcgatttccgcaataacaataatttactcgtggcagccgtttcgattggtcttggtttgggcgtcacggtgcaaaccaatatcttccaattcttacctggtgcacttcaaatcatgttgagcaacggggtggtcgttggtagtgtagccgcagttggccttaacttactcttcaaccgccacgcagccgaaaacacggttgatgatgaatcagtcggtctcaatgaaacagaacaaccttaattatgacgcttaaaagcagcggttcacagtcctaatctggcagtgaaccgctgtttttttgttctgctacttaatagccgctctcattctattgattgctttatactgccattttttgctgaatgtcaaccgtcgtaccggtgaagactttttttaaagtaactttctttcgacttggcataaaacttgcccatgctgccgaagagtcatctaaacctggtccattccaaaaacaagccatcgtgaggcaataaactgattaatcccctgttaccctaaaaatcagtatgttatactagacaattgttgaattgttagttttttattaattttaggagtgggtcattattctagaacaattatttcatttgcgtgaaaaccgcacttcagtccgccgcgagttgattggtggtctgacgacctttttagccatgtcatatattttagccgtaaatcccgaactattgggaagtactggtatgagtaagaccgccgtcttcaccgcaacgattttagcggccattgttggttgtctcttgatggggctagttgccaactttcccgtagcattagcaccggggatggggctgaatgccttctttacttatacagttgtccaggaatggcacattccttggcaaaccgctttggcgggagtctttgttgccggaattcttttcatcctactaacgctctccaagttacgcgataaactgatcaacttgattccaagtgcgctaaaatacgctgtatctgccggaattggcttgttcattgctttttcaggactacaaacctctgggattatcgttgcgaataagtccaacgcggtcgccctgggtaacttgcacagtcccaccgttttgttggcgattttcgggattatcgtcggcatcatgctagtcaccgctaatgtaactggtggtattttctggggcatgttcatcaccgccgcagtcggaatgatcttcggtattattcccctaccaactgggattatcagtggggttccgagcgttcaaccgatttttggtcaagctgtgacacaccttggtaatattaattcgtttcaaatgatcattgtcatcctgacgttcttcatcattggccttttcgatacgtcgggaaccttggttggggtggcaaccgaagccggcatggtggacaaagaatccggcgaagtcaaaggcgttggtaaagcgctctttagtggtgcactcgccacaactttaggagcagtctttggcacgtcaccgacgacggcttatgttgaatcgacttccggcgttgccgtgggggcccgtactgggttatcttccgtcttcgttgccctcttgtttgccatcgccgcctttttctctccaattttgacggtgattacgtccgcggtgaccgcttcagccctgattatcgttggtattttaatgttatcaaacgttcaatatattgattggaccaagtttgaaatcgccgtcccagcctttttcaccatgattatgatgctactaacttacagtatctcagaaggtttggccgttggctttatcttctacccaatcaccatgacggtcaaaggccgttggcgtgaagtaaacgccctcatgtggacgatgatggtcgtcttcattctctactttgcatttgtcgcttagaactgatggttcgctaagcaatgatggcagtctaaaacacccctgagtcgtttaactcaggggtgttttttagtaggcacggctgcatctaacgcctactagtgtttaagaacttgttgattatggtaatcttcagcgtagacttgggcaaagtcagcaagtttaacatcgcctaatcgaggttgatgtgctcgataatccgcgtaaaaatcgtggtcacgctggtaagcgaccgttttaacatattcccgtgcaaatgcgaccggggttccggcagtcactaaatgatcttgcatgacctcatcaggcacttgtgaaacgcgcaaatccggcattttaagagcctgtgacagtacggaagcaacttccaaataagttttctcatcactcgcaacatatgtcaccgtttgccccggtgtcggttcggtcagcgccttaatcagtacagttgtaacgtcgaccggcgcaacccacacgttcttaacagccaaattggcatttgtgtagattcgatgactctttttaacggttggcacactgctcagtaaattatagtacattgccgttgggcggataaacgttaagtccacgtctggtaaagcggttgttaacgtttgttcgataatatgatacatgtaaagtgcaccgacttctggtcccaagtcggcccccacgctactcagattcaccactcgttttacgccggctgccttgatcgcagcggcatagatatccgcttgtcgtttggcagcggtataaagatcatcactcgccgctataccagttaccatgaggtataccacgtcagcgcccatgaacgtcttggtcaaaaacgcttcgtcatcaagtcgaccaatggcaggggttgcgcgaaaaacctttatcaaactactgcgaattgcttgatgactgatgaccgtcacttcatgaccagcatgggtcagcttaggtaccaaggtctggttaatacgaccgattgaacccgttaaaacaattttcattttatgataaccctcttctatacttattaaaatatccgtcaaagtcattatcgattataagcgaccactaaaaccccgtcaatcactggtggtttagttggctaaacagtgttgatgtgcggttgcgcgattcgttcataagacaggactgattaacgctaatcaaaaattatttctatttatcaagagataatttttgttgaaactgtgcaaaattaggcctataatgtcaaaatgtttgacactgtcaactacgacggttagtcgcctttcctgttaccataagtttttcttacggagattatattagatgagtctagcacaattagaaataggattactgtggttgacaggctcaattgcggtcatcttcatcctgacgattggtacttactattggtactcccgcaaacgttccaacaattaccttgaaaatgatgattttaatctacgctactttattcaaaaacaagtcgattttcgtggccgcactaccggctatgaatgtctcctgcgtcaacaaaatactgatggttcgtggtcattaccaccacaacttgactcacttccacttcagcgggtgatcttcctgcttgaagatacctttaaggcgctacctgatgaagcgattacgttatcaatcaatttagaatacgaacaaatcatcagtcccgaattccgttattttgttcgctgggcaattgcgaacatcgaaccgatgcacttggcaattgagtacacacctcaataccaaccacgtcgtatcaataaacgcctatttcggcggcgaattcgtgaagcccgcggttacggcatgcagtttggaatcgataacgtcggtgcaagtctagccaatcttaaaaacattcagtggcttttaaaagatatcgacacgctcaaatgctcaatgcgctcatttcgcaaggaagacccatccgtctggctggacctgaacctccaattctggaatcagctctctaaggaaaacaatattgatctaattctaatgggaatcgaaaatgaggccgatgaacagctcgccgagcaactgcaaatcagcattcgccaaggctacttattcggccatccaatcaatccccagcaatcaaccacaaaggagaaccacgatgcctaaaccaaccactgatgatgttaatcggcaacaactatactctgatgcgtactttgacactggccattggggactcaagattcgccaaacgatcgttggtatcgtgggttggatcgcagtgattgtgcccatcaccgtgacagtcctttccatttggtcaagttataatccacacattccgcgtttctggcactaccatgaaggtcttttcgaatttaagttcatcggtatcttactggccttttgctttgcactcgcatccctttttgcagtgaccatgaccattatacagaatcgtaagcgtgaacgtgtcgttgaacagtggccaacctttaatcccattaatcagaaaaaacggcagcaactgctcgctcagttcatggcggaccgtttcggcaatgccgaatttcgtgaacatacccgccactaccgggtcaagccagaacaaaatctcgatactaatcagattcagcaactttatcaacaaaataatttagacgatattaacgattaaccagggggcgccatgacaaatatttttattgaccacatattcgccgcaaccttatttaaatcggtaatcaacatcgcactcctgattttatgcctctaccccatcgttggctcttttttctggttcgccggcgcgctatcctaccgctttatcaagaccaataagcgtgatgatgactggcagtacattccggctgaacagcaaccaatgattaccatcatgatcccggcgcacaacgaagaagtcatgattgaagaaaccatcacatacttatttacccagctcaattatacgaactacgaggtcctagtcatgaacgatggttcgactgacaagacggccaccattattcaacggttgcagtccgtctatccacggctacgaaccgttgaaattgagaaaaacaagggcaaggcccacgccttcaatattggcatgtactttgcccagggtgagtatattctcagcaacgacgctgatacgattccagaaaaggacgccctgatgaagtatatgaatttcttcatccatgaccgcgatatgaatacatccgccgtcaccgccaatatggatgttcaaaatcgaacgtcgcttttaggtaaatctcaaaccgttgaattctctagtatcgtcggtgttatcaagcggagtcaaacttccatcaacgactctatgtacgcgtatagcggggcaaataccctctaccgcaaacaatttctaattgacgttggtggctttcgacaaaatcgcgcgacggaagatatcagtattgcctgggatcaccaaatggtgggcgccgtcccgcggtttgcccctaacatcgtcttccatatgaacgtccccaccacaatccgagacctttatcatcaacgcaaacgttgggcacagggtggcacggaagtgtggttaacgaacattaagaaattcattttccacccaatcgttcatcgctatcaactatcaatgttcgtcgattcgacgttgtcaatcatctggtcctttttcttcgtcatcacttccttgatgtttttgattctgatgggttacttcctgataaccggcaattttgaacgagtctaccacggcttgatgttgtcatttgtctttgttagttttgaactattggccgggttcatgcaactgttagcggcactcctgttggaccatcatggtgcgaaactaaagtactggttcttcgccccactctacatgttattttactggatgatcaatcctatcaccgtcgttgcaacgtttattcctgcactcaaaaccattctgggctttggctccggaacgtgggtcagcccgaagcgacagtcattgcagggtaaaaagtaaaacggtgtcgctattaacgctttcaataatcgataacgggtctactggtgcgagaacttgcaaccagcccaaccaaaaacgtgcacttacctgagtgataactgactcaggtaagtgcacgttttaatattaatcccttttgatcgttttcttagctatgcaaacggagctgcccaggccaccctgtgactagctacgctgagtaacaggtcccatgtgtcacgtgccactgaacacagagatcggcaggtaaatcacgaacggcctcacgacttacctgtgtgccaagttcagtaattgatcgcccttgctgactgccgaggccctggcgattcagctgaatcgtccgcgcaccaactcgatacaagtcactcatgatctggtggtaggctgcggccaagtcatgcaccatttccgtatctgattgatagactcgattaagtgcgcgcgcattatcggaccgtttgagttctgccaagcacagctcgggagcgggcaagatttgtttatccacagttccaccactgatttgattgcgcatgaattcaaaatgcgcaacggcaggatggttgaagccactgattttaccggtcaacgcgagcgccggtaccgaacctatctcggattgggtgatgccttgtagcccccagaaaaagttaaagtgccaccaatttagattatgcggcttatcaaccggtttccgaatatgatgcataaaagcagcgtcctccatccgtttaagtcccgccgcattaatattcagcgttgttgtgccccgatgcaaccctttttgagaccgcattaccatttgccaaccatgtacacggtgcctaaccatcatcatcaatgtgccaaattccatgcccgtttagcctccaaattaattgcattctgccaatataaaaatcgtcccctactgcttaaaaaggacgatttcaacgtttgggtcagcctttaactgccaacaccaaccattattcttttatgacgaatttaagtaatgtttccagcatagaatggtgctcaccgaatgtcaagcgctaatcgtgggacgctgtcatccccttaacgccaatatcagttcggtacactagatcaccgactctgagttggttgatttgttgataaacagcccgctgtgctgcgaccaagctcggggcacttgcggtaaccatcatcacccggccacccgcactgactaattgatccggggtacccgcaacgctagcataatccgcaccagcaaccgtcggaaccggtacaccggcttcagttggtcccggataaccgggagcagctagtacgacgccaagataagttgccgtcgtttgccactgcgcgtgtggttgccgatgttgcagtaagtcgacgatgacttgataaaaatcactctgtagttgtggtaataagatctgcgtttcaggatcacccagtcgcaaattatattcaataacttgaacaccggtcgcagtcaggattcccccaacatagatgaccccttcaaagcttaacccatcggttttgagacctgcaatcgtcggttcaataattgtcgcaatcgtttgatcgataaccgcgggcgtgatttgcggtactggtgaataggcccccataccacccgtgttcggtccccggtcatggtcctgtaaccgtttatgatcttgggcggtcggtaataacgcatagtgctcaccaccaaccaaaaccatttgggaaaactcaaagccagcaacgtagtcctcgatcaagaccgtcgaactagttttaaaggccgtcttaatcgctgccgcggcttgttcataactcgtcgcaaccgtcacccctttaccagctgccagcccatcgactttgataacttgcggcaccgcttgttcatgactataagctagtgccgaatccaattcatgaaattgccggtagtcggccgtcggaatgtgatggcgactcatgaaggccttcgcaaataccttagaactttccaactgtgccgcagcttggttggggccaaagatagccaggccggctgcttgaaagtaatcaacaatgcccacggctagcggtacttcgggtccgacgaaggtcagggtaaccgtattggcccgtgcaaagttgaccaaccccgcaaagtccatttcgtcaatcgctagtgtccgaataccatcccggatcatgcctggattaccgggtgcacaatagacggtactgacttgcggacttgccatcattgccttggcaatggcatgttcgcgaccaccaccaccaactactaatacgtttgccatgcacgcacccatcctttcattaatgccggaagtgtcgaacaccagtggtgaccatcgcaataccataacggtcggccatggcaatcgaatccttatcacgaatactaccacctggttgcacgattgcacgaatgccgtgctgcgcagcatattcgacgcaatcatccattgggaagaacgcatccgaagctaggatagcattttcgtagccagcttgttgcatcgccttaccaatggcaatcttagttgaatcgattcgattcatctgaccagaaccgattcccaatgtccgatctgcggtagttacaacgaccgcattgctcttaacgtgcttcacaacttgttggccgaaagcgagtgcttttagctgcgcaggtgtcggttgggttacggtaactacggtaaaatcagctggcgtttcgaaggccgcgtcgacctcctgacgtagtaagcccccaccgactgaaatcgtttcaaacttatcggccgtgtgcgtttgctcaaagtcaaccgtcatcaagcgcagattcttcttcttggccaaaatagcaaaggcatcgtcatcaaaactcggggcaataataatttccaagaagagtgcgtgcatcttctcagccgttgcgagatcgactggtcgatttaaggcaatgattcccccaaagattgaaatcgaatcggcttcataggctttgtcccaagcagcctcaatcgtcgtacccaagccaaccccacacggattcatatgcttcattgcaactacggccggctgttgatattcactgaccatccgcaaggcagcatccgcatccttgatgttattgtaagaaagctctttcccatgaatttgcttggcacccgtaatcgagaagtgcgtcggtaaagcattttcgtaaaaggcagccttttgatggctattttcaccataacgcagggcctgcttcttatcataagtaagggtcaacttttctggaaattcttcagtcgttaaatattgggcaatcaaggcatcataggccgcagtatgttgaaaaactttggccgctaaccgttgacggagtgccggtgtgaccgcgtccgtctgcaaatcagccagaatctgctcataatcagcaggatcaacaattggcagtaccgcggcaaagttcttagctgcggaacgcagcatcgacggaccaccaatatcgatttgttcaatagcttcagcttgtgtgacgtctggttgttgaatggtcgctttgaatgggtacaggttaaccacgaccatgtcaatcggttgaataccagcttcttttagttgcgccatgtgcgctggcaggtcacgtcgtgctaatagtccggcgtgaaccttaggatggagcgttttgacccgaccgtcaagcatttcaggaaaaccggtcacttcttcgattccgatgactggaatatcagctgcttccaatgcctttttggtcccacccgttgaaatcaattcatagtcaagggcaacgaggcccttcgcaaaatcagttaatccctgcttatcagaaacacttaacaacgcacgttttgtcatcttaaattgctccttcattaatgagtgtctgtaatacatctggataaaattggtgttcacaatcatgaatccgggtcgccaggctggctagcgtatcgtctggtgcaaccggaacgacccgctgggcaataatttgcccggtatcgattccggcatcgatatagtgaatggtaacgcccgtctcagtcacaccagcggcaaaagcatcctcgatgccgtgacgaccaggaaactttggtaacaatgctgggtgaatattgatgattttatgagcatacgcattcaagagggtcggaccaataatgcgcatgtacccggccaataataccagttcaatttgccgtgcttgcaaggccgtcaaaatgattgcttccgcggccgctttattcgcataatcatgaaaatcaacaattaatatcggtacgttagctgcccgggccttgtcaattaccggcgctgtcggctgatcacacacaagtaacccaatcactaccggtaattgtcgttcaataatcgcttggtggagtgcaacaaagttggtgccgttacccgaagcaaatactgcaattttattaggcatgctcagcctcctcaaaaacaacgggtgtcgtaccagtttggactgttccaactcgataataggactgagcgttggccgtcaaattagccgtcacagctgccacttggtcggagtgaacgatcagaaccattcccaagcccaagttaaaggtcgaccgaagatccatagcagtcagcccaccgagttcggccaataacgtcataatcggcggtgccggccattgacccaattcaaggtgcgcactcaagcccgccggtaacgctctggcgacgttctcaatcaagccgcccccggtaatgtgggcgatactcgtcactaatttctgctgtaataatggttgaactgcatcaacgtaaatggtcgttggtcgtaaaagttccgtttgtaaatcatgaccaagttcgtcaaaaaccgtggtcaattggtagtcgtgttgtttgaataaaatatcacgaactagactaaacccattcgagtggaggccattagacggcaacccaatcaagacgtccccagcccgaacatttgccggtgataacaggtccgcgcggttcgcaattccgaccgcaaaaccagcgaggtcgtaatggtcctgaccatacatatcgggcatctccgcagtctcgccaccaatcaacgctgtatgggcctgctgacagcccgcgacgacgccagtcaaaatggctttgacccgtttctgatccgtatgtccaagacctaagtaatctaaaaagaactggggggtcgcgccttgtgccaaaatatcattcacacacattgcgaccaagtcaattccaatcgtggtatgttgatcagcagcgattgcgactaagagcttagtccccacaccatccgtccccgctactaacacgggatcgttggcagttgcatccggactaagtggaaacgcccccccaaacgcgcctaattgctgattgccactcatttgtttgaccgtctttaagacgtcgtaaccagcgttgatatcaacgccagcccgcttatacgcatcgctcacttgatcaccccttcatgattggcttgtaattgcgcaatttccgcatcatactcggcttggtaatcatacagggccgttggataatccccattaaagtaggccatacatagtccaccatacggttcagtggttgacaagccaactgcatcaacgacgccctgttcactgagaaaaccaagtgagtccgcaccaaacgtctgacacatctccggaatcgtttgctgagccgcaatcaattcattagtcgattgaatatcgataccgtaaaaacatggatagcgtaatggtggcgatgcaattcgtaaatgaactgactttgcacccgcatctttcaataatttgacgatccgccgactggtggtaccacgtacaatcgaatcatcgattaagacgactcgtttaccagcgacaacacctttgactgctgaaagcttcatccgaaccccctgttctcgtaatgcttgggtcggctgaataaaggtccgtgacgaatattgatttttaattaatcccatctcgtaaggcaggccactcgcttccgcatagccggtcgccgctgataaagatgaattgggtaccccgacaacaatgtcggcgtccacgggctgttcaacagcgagctgagcacccattcgtttacgtgcagaatggacgttgacgccgtgaatatcagaatctggacgtgcaaagtagataaactccattgaacaaatcgccaactgtgtatcagtcgtataatggtcgatcgtcaaaccatgatcatcgatcgttaacaattctcccggctgaacatcttgaacaaacgtcgcaccaatcgtatcaagcgcgcaagtttcactacaaacgacgtacccgcccgtgggtaactgaccgacgactaatggtcgtaacccgttaggatccaaagcggcaatcaaacaatcattcgttagtagtaagtaagcaaagcctccgtggacttgacgtaaagcatccttaacctgttccgttaacgttgctgcggggctgcgtcgaatcagatgcattaaaatctcactatcagaactagcatgaaaaatggcaccatgctgttccaaccgtcgccgcagtgtcaccgcattcgtcaaattgccgttatgtgcgagtgcaaactgtgagtcgctaaaattaaaactcaagggttgaatgttttccaatccatgattaccagccgtggcataacgtacatggccgactgcagcttgacccgtcaaacgtgccaaccgccgtgggtcccgaaagacatcagccaacaaccctagtccgcgttccgtctgcagtttgccgtgatcattcgccgtgataccggctccttcttgcccccggtgttgtaacgcatggagcccaaagtacgttaattgggcggcgtccggcgagccccaaaccccaaagacgccacattcttcattcagacctcttacttcagtaggcatggtaaggccccttcccacaactgtttggcgaaactaaccttaatatcaaacgcctgatcagcagtttgaacgtgtagccgatccgttgcagttgttcgtcctaaataggtcacatatggttccattaaactttcaaacgcggcttgctgtgctggtgtcaccgagataacaaatcgtgactgcgtttccgcaaagaagttggcagcgggcaagtcactggccagttccaccccgatattttgtggaaaacatgattcggcaatcgtcgtaatcaagccaccttcagaaacatcgtgggcactagcaactagtcctttttgaatcgcagttaacaatagacgctgattacgattttcagtcacaaggtcaaaatcaaacagctcgccactgatcgttcccgtcaacatcttttgcagctcactaccattgaaatcggcttctgtggtacctaacacgtagactgcatcgccagcgtgtttaaaatcgctagtcgtaatatctttctgatgcttaattaacccgaccatcccaatcattggggtgggatagatggcttccccgttcgattcattgttcaacgagacattgccagaaatcacgggcgtattgaataattggcatgcacgagcgatgcccatcgccgattcgtccaaatcgtaaaattgttcaggtttctctggattaccatagttcaagcaatcagtgatgcctaaaggttgcccaccggaagcgacaatgtttcgagcagcttccgcaacggcgatttccccaccgacacgggggtttaagtataagtatcgcccgttaacatcggtggtgaccgccaacgccttatccgtatgtcgaatccgtatgacccccgcatcggaacccggcttgacgaccgtattcgtttggacctgcgagtcatacgttccatataacgacgctttggaagcaatcgttggctgttggagcatcttcttcaatgtgccagttgcatcaactagtcgtggcataaattgatgatggctctgatggttcaagcgcgttggtcgtttcttttcgcgttcatagaccggcgctttggtcgcaagtgcatcgacgggaacatctgcaactaacttaccatgatggaataattgatactggtggccggctgtcactttaccaattgtgacagcatcaagaccgtacttttcaaagacttgataaatttctgcttcggcaccagctttgacacatagtaacatccgctcctgtgattcagagagcatcagttcaaacggcgtcatgccagtttcacgttgtggtaccaagtcaagattcagtgacaacccactgcctgctttggacgccatttcggctgaggaggaaactaggcccgccgcgcccatatcttgaatcccgattaaaacatcacgatgttcatgaataacctcgagacacgcctccatcaataatttttccataaagggatcaccaacttgaaccgcggaacgctgggtttcattggcgtcattaaattcagcagaggcaaaggacgcaccgttaatgccgtcacgccccgtttttgcgccgacataaataacggcgttgccaattcctgttgcttggcccttctgaatatcagcttgatccaagattccaacacacatggcgttcaccaacgggttcttctgataactcgcatcaaataccgtatcaccaccgattgtcggaattccaatacagttgccataaccgccaatgccggcgactacttgcgaaatcaagtatttcgtatgagcatcagtcggttccccaaagcgaagactgtccagcagcgcaatcggccgggcccccatcgaaaagatgtcccgaatgataccacccacacccgttgccgcaccctcataaggttcaactgcagacggatgattatgactttcagctttaaagaccacggcctgaccatcaccgatgtcgataataccggcgccttcaccaggcccttcaagtacctgttcaccctgcgtccaaaattttttcaagactggttttgaattcttgtaggagcaatgttcgctccacatgccggaaaacaacccggtttcagtctcgttaggtaagcgttgaaggaccttatccgttaataattgatactcagcatcggttaagccccaatcccgatagaccttagaatcgcgaacatctgtaggtgataatggttgctttttaagcatgggtgacctcctcttgactcgcaatgaccgattgaaaaattccgagaccgtccgtggaacctaagatcatctccacggcccgttccggatggggcatcatcccaagcacatttcccgcttcatttgtaatgccagcaatattagccgtgctgccatttggattctcgacgtattcgaagatgatttgatgattagcacgtaattgcgccaaggtggcctcatcacaataataattgccttcgccgtgggcaatcggtaaactaatttgatctgtcgatccgtatgcggtggtaaaaatcgtctcatgattggcaattcgtaatgggctgtcctgacaaataaacttcgctgagcgattggcctgcaatgcaccaggtaataatccggcttcggtcaagacttgaaagccattgcagattccgatgactggtttaccagcgttagcaaatgcaataacggccggcatgatgggcgcaaagcgggcaatcgcaccactccgtaaataatcaccgtacgaaaagccaccaggtaacaccaccgcgtcataacctgctaatgaggtcgctgtcgccggaatcaaatcagccgtaacgtgtaaaatatcgcgcaaggcattcaccatgtcatgatcacaattagaaccaggaaagactggtacggcaaatttcatcattacaaagcctccatctcagtaatttcgtaacgataagtttccatattaacgttggctaacaagcgatcacacatctcgtcgatttcagcggcaactggccgatcatccgcgtgaattttcacctcaaaatacttacctaattcaacggcatcgacattcgtatatccaagtcggtgtaaggcatcatgaatcgcctcacccttggggtctagaattgattgcttataagtcacatagattttaactaagtacatgttaggcctcctcaacggttgctagccgcgtcaatacttcctgataaacactagtcaagtcgcctagatccttgcggaagacatccttatcaagcgatgcaccggtctttaggtcgactaaccgacaactatctggtgagatttcatcagccagcaagactttaccggtggtcgtcaacccaaattcgattttaaaatcaacgagctgtacccccatcgccgcaaaaattgccgtcaaacgctggttaacctgtaaggcctgccgtttaatttccgccacgattgccggtgttgcaacatttagcgcgtggatttgtgaatcattgataaatggatcatccagctgatcactcttatagaaaaattccagtactggttctgcaaatttggttaagtgtggcacggcaaatttacgctcaaaactacccgaagccgcattccgaacaactgtctccaagggaatcatggtcacgcgacggacaagttgcacatagtctgaaggttgctcaataaaatggttggcaatgccgtgattggctaagtctttgaaaatcaaactcgcgatgcgattattcaatcggcctttctggtcaatgggaaccttccgcttaccatttagcgctgttgcttgatctaagtattcgacccatagaatttcaggatcattagtggcatacatcgctttcgctttacccgtgtaaagcaaagcttgtttctcaatcgctgccgtcattattattgttcccctttcaaatttgccaccgacgctaatgctgcgtcaatatcgtgatttaatacggtgatatgacccatcttgcgctggggcttaatggccgccttaccgtagtcgtgaaaatgccattctgggtgttcaaccaactgttgacgtgccactgttaagtcatcacctagcagattacgcatcactgccggactggtctgcgtaatggccggaatcggtaagccacagatacttcgaatatgggcctcaaactgcgagatgttgcaggcctcaatcgtatagtgaccagaattatgtgggcgtggtgccagttcattgactaataaagtatcatccggtaaaacaaagaattcgattcctagcacgccgcgtagttccagagattcagcaatcgaaaccgcaattttgcgggccgcactatgaacactgggctgaacattagctggggcaatcgttgtgtgtaagatatgatgttgatgctgattttcaactaacggaaaagtcgtaacaacaccagcagcactacgcgtcaccatcatggaaacttctgttcgaaatttctgccgcgcctctagaatgcacggctgtgtcaataaggcactagcggcttttgtcaccactgctgtgtctagatccgtttgtccgtgaccatcgtagccacctgccgccgttttgagaattgccggcgtaccaacacggttgagggcgtaatttaatgactgtaaatccgtcaccggtgcgaaagatgtgactgggatgccatgatcatgaagaaattgcttctcattaagacgatctccagtaatatgcaggagtgcagtgccctgcggtaactttgcataggcttgcgcagcaatcaaagcattctcatcaacgttttcaaactcgtaggtcaagacatcactacggcgcgctagatcaagtaaagccgcctgatcatcataagccgcaacaatctgaaaatctgcgacctgggctgccggtgctttgggtgtcgggtcaaggacacctacccgatagcccatcgccttcgcgctaagcgtcatcatctgaccgagttgaccgccaccaacgattccgatcgttgcgggtggtaagagtgcttccttaaaattggcgttcactttgttcagcctcctgacgttgacgagcacgaaattctccaattgcatgttgtacttgtggttcccgtaaaccgataatttgggcggccattagcgcaccattcttagcccccgcatcaccaatcgccatcgtcgccacgggtacgccagctggcatctgtacgattgacaataacgaatcaactccgttcaacgtatgggtcttaatgggcaccccaattaccgggagtagtgtattggcagctagcatcccgggtaaatgggcagcgccccccgcacccgcaataataacttgaattccccgtgacgctgcttcttcaccataggattgtaatgtctggggcattcggtgggccgaaataacgtgacgctcataagagactcccagtgccgttaactgttctgccgctaattgcatggttggccaatcagaaattgaccccataatcaaaccaactttcgccatcatgatccctctttccctgttttcaccattagtttagcaatcaggcgggacgctgtcaacgaatttcttgactttatctattaattaacgttttaatgttcgtgttaattaaattgataattagattaatgctacctcaacatgtacgaattacctcactgtttgcaggttttcggtgtctgaaaaaggttatcaactgatttcaagcgactatcttgataatattattaatattgaaatttccgaacaatccgtcatcatctaagtttcaccataacaaacttactgctaccattatcaacaactatccgttgaaacgggccattaacttttgtcggtgcgcaccaacaattgacagcaatgactgggaatcggcgtaggacgagcaactaagcatgtttatgctaactcagactatttatagcggggctaaactgactgccgctgaacttaaaaacaatcaacaacttaatttgcgaacgctttcctaaaggatcggattgaagtgaccaaaataacgcaaaaaaagtctcaaggaagcgattcctcgagacttttttaaggtactaattattttgctgaagcgccggaaacactatcgacatcaggcgcttcaggcttggttggtgcttctggtgcggcttccgtatcggctgaagcgccggagacatcatccaccgctggggcagcatcaggcttcgtttccttcgccttcgatgaagctcctgaaacggcgtccgtcttagcatctggatcaggtgctaacatctggcccgtctgcttcaggtaatacttcacgattggtaagaggtcgagcacaaactcgttgatacctttgtactcacccttatcgtcatgcaaagcttgataatagtgcatcacatacttattagggataccaggtaccggtaacttgaagagatcagtctcaccggttcgtagcatgtgtaccgctcgcttaacaccaggtacggcccgctttggatgacagtcagctagtggattaccggcttgagcaggtgtccgtgaagctaacatcttgtcgccatccatttgatggttatagtataaaaattggttgttggcatcggcatacgtcaattccattggcatcgagttgaggaaccaatttaattggttgacggtcagcacaccccgatcgagcttaacgtagtcgtcaccctcagccgcatgggtcttagcagccgcttgttcgacccaatcagccgcatgcatgttgacgcccttgattgtcgtttcaacttcgcccttagcctcaaggtcttcattcttccaatcatcagcgtgtgcttccgcatccatcgcgttgaccatcttgacaaacttcagaaacttgcctaacgtttcttgtaagaacgagacagtccgagcatccttcagattgttttggtcatcgaaagcctgcttaacttcgccgagcaaaaattcattaccaggcatgaccacagcatcaacacccggtgactctaaaatctggcgtagattcaactgtgcccgcgacgaaccttgatcatagtaagaagcgccaacgatcaatacgggtttccctgacatcgggtgaattttaaacgacaaccattcgatcacgcttttaagtgcagcagtaattgtatgattatgttcaggtgtcgcaataatgaccccgtccgcctgcatgatctttcgtttcaaatattgaacggcttcaccttctgtttgatcatcactctgattaaacattggtacaccttgaatatccaaaatttcaatatcaaccatgtcactaaaatgattagcaataaactttaacagtaaccgattataagacttatcttcaattgaacccgcaattccaactaatttcatcgtcgtcgccctctctataatttttcccaatccatttcacgaacttcttcatacgtcgtcgcgttggcattctttaattttttcgtgatttcgacaaagacttggaaatccttgaacaacccatcgagcttcgtcgctttctgttggtccgttaaatttccctggtcatcaaaggcttgcaatgaatgaccaagcataaattctgaacttggcatgatccgcgcccgtaattctggtgaatccaaaacttgccgcagatgtgcttgagcccgtgatgtgccgagtgccccgtatgaggccccaataatcatgacgggtttgtccacgaagggctggatatggaatgataaccattcgagagcattcagtaatgccgcgggagccgaatgatcatactctggtgtactaataatcacaccatcagcttgttcgatcttatccgccattgcttgcgcctgtgccggaatttcatgattttcgggcttattgaagattggtagacccttgatttccattaattcaatctctgcttgatccgcatagtgggactgcatatattgcaacaacttacggttggtcgactcatctgaattggttccaaccatcgcgataaatttgtgcattgagaacaactccttctatgatcaaatagtcaaatattatataatttcttagtcaataactatattgtagtggatttcactaaagaaagcaaaacaattttaagcgctttcagttttgctatgcaaacaactgaactcactgatattaggcttatccgtgcaatcaagtaaattcagtatccgcgcaacgttgccgtaattatatctgcttaacaaattttttcacaaagctacgacgctacgatcaaatcaatcaaatccgccggggcaattcgaccaaagtaatgggttaagtccaacggtgctagcgccgtcataatcgcctgccattcatatttcacaccagtcaaccgtgcaacgacgggagcaatcggttctgcaccgaagaaatcgccataaatcgtaactgcttcgatgcgccctgccaccacgtttaactgaaactcgacggtcccagcatcaaaatgccggcgctgcttaactgtaaacgctggtgactgaccgtaaatccaatcccagttggtaaaatattgttggttcagtgctgctacccctgccagtgccgtttcatctaactgatacgtcttagcttgactcaaatcagccacgcccaggatttcacgggccaacgtatcgcgaaattcctcaatcgtcaagtgctgataagccggcgccatgtacggtttcaagttcgtgactcgacttcggaccgacttgatacccttagaggccaacttatcggtcggcaccgtaagagctttcgcaatttgcgtctggtcgacatcatacatcagcgttccatgggagaacatccggccattctcaacgtgcatggcatttcctgagaacttcttgccatcaatcaataaatcattgcggccactcatcgtcgcaccagtggcccccatcgcgtgtaaagcctttagaactggtgctgtgaaccgcttaaagttaccaaaaccgtccccgtcgtccttagtaataaaactaaaactgacatttccaaggtcatcataaaccgctccaccaccagaagttcgccgcgtcaatgtaatgtggtgtgcgtcaacatagtcctggttaatctctgccttgacattttggtaacggccaacaatgatgcagggggcgttaatgtaaaagtatagaatcggttccgtcaaatcggcatgttccatcaagtaagtctcaatggcaagattcgtgcgaatatcatggctggagcttgcaagatagcgcatcgtcacacttcctattctaaataaatccgttgcaaatcattgatttcattgttagttaatttaagctcagtgtgtaaatagtggtttaaattacccgattgtcgtttaatttcggtcatagcggcgtccaaataagccgcatcaactgaccagagggcccgaatactttcgaccgttgcatctgatgcgccctgagcacgtgcttcggccatcgcaccattgatccggccaatcgaagcctgattagttaagagataatcctgcttgatcgtttcaaaatcgactccgagtgcggttaacaggtataccgcccccattccggtccgatcttttcccgcagtgcagtgaaatagtaacgtcgaatcgggttgatcatttgcaagtagattatcaaagaaccggcgatactcgtccttggcatgttgctcgtcggccaccatctgatagacctttagcatgtgcttgaatccactatctggatgcttctccaagttagccgtcatcttgtcagtaccgtcagaattccgcgtttcgtccacattgaacactggtgcgtacacgtacttagcattggcaggaattcgatctggcgcatctaagacttcttgtggtgaacgaaagtcaatatcgtagcggacgccataatcatccagcaaagcttggccggctgacgttaattgatcaagcccaccagtccgaatgaccttatgccacttgatttttcgaccgtctttagtcgagtaaccaccgagttcacggaaattaatgccacctggtacagttaatacacgttgatttgtcatttttgaaaccacctatctgttaacttttcattttctattctaacattatcggtcagtttaacggtgccccaatcaccgaatcagtcgctttatttccaagataattcgttagcaccatcgacaccaaccgacatcaacgcgtgctataatgtaagttacatagccagcgacggcccgtcaaatccagaacacgtttgctgacaaacagcatcacaaccttggaccgattagccataaatttccatactggcactaaataaaaaatattcactgaataatataacggaggatctttcgatgacatttgattatgcacaccaaactgattggcccatgactagtggtcaacatcagtcaccaatcgatattcaaacacaacacgttcagtcttcacagctatccgccatcaactggcgaggcttgtaccaagccaaaacgattacgggcgaagcgacgactttgaaggctagtggaattggtgccgcttatttgaacgaccgcgactttgcctttcaacagattcactttcatacgccggcagaacacttaatcgatgggcaagccgcaccaatcgaatggcatctcgttcatcaaagtgctaccggccagctcgccgtcgtcgccgtttttggacggattggcaagcctaattctagtttacaaggcttacttgaccagttcacagcccaaacgagccatgaactgacaacaccggtcaacttaactgagctcctcccagataccgggacggtctatcactacttgggctcattgacgacgccgccactaagtgaaaccgttgaatggtatgtctgtgccgatactgtcatgattggtgaacaacaattagctgcttatcagcaattatttgccgctaataaccgcaagattcaaccgttaaacgatcggccaatcattgccgaacgtttctaaataattttaatggggtgagctgatgcctaagaaagtaatctggggcttgattgcaagtggcctatttcttttattgatcgtcggtctcggactgacaacacaaatccatcaagataaagtcagtcacgtgattactgcgcaaaaacggccattgatcatgattggaggtagtagcagcacgcggactgactttgatgacatcgtccgttcacttaatgagcaacagcaccatccgctcatcaccctgactgttaaggcgaaccaaaaattggcgtttaaagaaaaacgcgtcgagaacaccaaccttaacgatgccctcatcgtgatctttttcgaagatagcacggactcaacagagaacattatgacccaaacgaacggcttagccaaagctattcgttatttgcaacgtcaccaacatctcaccacggccaacgcactcggttattcaaatggtggcctgatctggagtcgctatctagcaggtttgagctcgtccaaaccattagcagtccacgatttgatgttgattggcaccccattcttgggtactgatgctgcacatcctgataagacgctctatacatcacttcttgatcacaagaaccaattcaagaaattgcatgcggtcatcaacattgccggtgacactggcgagggtaacgacgatatcgtaccgctcagcagtgtgaacgctggtggcaacttatttatgaacaatgttacccgctacaccgccatgactgttaaccaaaaatcaattagtcacggtgacctgcttcacgaagcatatgttgcccggctcattcgtcaaaatctgatcaatcaataatatttttagctttagctgataaaaaactgagccacccttcatgatgatgaagggatggctcagtttttttatgattgattgtccgctatgactactggcgatcaaactatccaacaatttagtgtcacgagtagcccacacacgggttgcacagggctcaaaggggcgccacgtcgattatgaattggcagtcgctacaaatcgagctagctcatcggtcgacataccggcactgacacccaccagtaacttaatccgggctttttgtccattcaatccctgacaaaaaatcacacccatttgtttcaattgaacaccgccaccttcataagcatagacatcctgagcgataccgttgaagcaccgggaaaccagtacaaccggaatctgcatgtctaataatttttgcacagctggtaacgtcgccggtggcaaattccccgctcccaatgcttcaatgactacgccatgagtcgtgggttgtgcaatggcgtcaaatagttctggtcccatcccggcatatgctttgatcagaaaaacattatccgtgaccgtttgaatcgggcaaaccgttgatcgtagtaatgattcaaaaaagacaatgcctttattagcgactaacccaatcgggccaaaagtcggtgttctaaaagtggccacgttggtcgtatgcgtcttagtgacgtagcgggccgagtggatttcatcattcataaccactaaaacacctttttcggccgcatccggtgtactagccgtttgaatcgccgtttcgagattatgcagaccatccgacccaatctcattggcggaccgcattgcgccggtaatcacaacggggagctcattcggtaaagtaagatctagaaaatacgccgtttcttctagcgtatccgtaccgtgagtcacaaccaccccatcgaccccttcgtgtgcggccttatcgatccgttgctttaactgcaacatccgtgccggggtgatgtgcggcgacggcacgttaaagacgtcctcagtctctaactcaatatccgtgccaaatgaactctgataattgtctaaaggattttcatctccgggggtcacattgccggattcatcggccgacatcgcaatggtgccaccagtgtgtaataccaaaatcttcttcaagaatactcctcctcatcttttcacgtgcctacgcacatctaacagtaaaattattttaggcttgccatcgcctgattgcaatccaccctcactggttcttcatgacaacttccttagattctcatacaagtgatatcaactaaaaaaactagcaaccattcaaacaatttacaaaacctagcaaccagatcagtacgttttattagcctacatagtgctagtcactcaattagttcacttatcaactagttcgttaatcggttcgtcggttagttaccccttcaggacgaagtcactaacctcagtgcaccttattactcaatttcagtctcagggctaaccgattgactactcgctagacgttgataaatcagcgtttgacgtcccaatgactatcaagcgagaaaataatgattgacactcgcgttagttgcctttatagttagttgcataagtgattaaccaaataacaaaccaactaacttaagagaggtatttaaaatgacaaccacaccaatcatgaccgtcagcgacctgcacaaaacgtatggtaaggcgggcagcaaacaatacgaagcgttaaaaggcattaatttcaatgtgcaaccaggggaatttgtcggaatcatgggcgcatctggttcagggaaaaccaccttgctcaatatgctggccacactggaccaaccaactagcggtgaagtgactattcatcaacaaccgattacacatctgaaaggcaatcaacttgctgatttccgggccaaagagattgggtttatcttccaagatttcaacttattagaaactatgactgcttacgagaatatcgccctaccattgtcgctgcaaaatacgccagtcaaaaagatcaaaccagctgtcgaaaaagtcgcacaccaattgggaattgaagaattcctatcaaactatcctaatgaattatctggtggtcaaaagcaacgtgtggcagccgcacgagccttaatcaatgaccccgctattctatttggtgatgaaccaactggtgcccttgattctaagtcagcgcgtgaattactcgacctgttcaccaaaatcaaccaagaacgggctgtctctatcttgctggtgacccatgacccattttcagctagcttctgtcaacgaatcttattcatcaaagatggccggattgggcaagaacttaaacgtggggatttaagccgcagtgatttttatcaacaagtcctcgacaacctagggacgtttgaacagtaagccgaaacagtaaaaggagtcctttaaactatgttaactaaacttgccatgaccggcttcaaacaccgttggcgcgactacctcgttctcttttcaggactgatcatgtctagcgcaatcttctatatgtttgaagcactggccactaaccaagatttcttaaaacaaaatacgagtattagtatggtcggcctcatcttccaatttggttccgtactactcacaatcatcacattagtctacattggctatgctaactcattcttattaagtatgcgtaagcgagactacgggctcttcatgctcgttggtgcacgcaaaagtaagattggtcaattaatttggctggaaacactacttgtcggtatcactgcaaccattgtcggcattcttgtgggaacagccttaactgtcggcgtaagccagattctgattaacagtctaggcctgacgcttcaccattttacagcctggtacacgccagctgccattgcgacactgttactctacgttggattgttcttaattgccggtttattcaacctgctatccctgaccaagacaccagccttgaaattactacacagtaatgatcaacctaaccggccacaactaaaaccagcccgtcaactcatcgaaattgtcgtcggtgtcatttcaattgcaattggttactggtcaatggctaacctgaaaattttgcaactgatgggaattggaattgcgctcgtcacaattgttcttggaacttatctgctgtttaacgctatttttgtctggttaatggtcgcactcaaacgattctcatttgcccaacgtggtttgaatggcttcaccttatcacagctaagctttagaattcgtaattacactaagatgctgtcaattgtcgcaatgctattcgcactagctctcggcgcaattacagttggaatgggctttcacagtcaaattccatcaatggctaatattaataacgcttatgatatgggactggtcaacgctagtaccgctgaaaaagcacaaattgcagcgatgaagcccaagacaacggcgacctatcatttcaaagcaaccaagaaagtcgtttatttccaagctgctgaattcaatcggcaaccattcacgactattcatactcgcaataagaatcaactgacttttaataccgttcataataatgcggctaaattacaaaaatcagaagataattatcaactgatgcagcttcagagtggtgtcatggcaaccgcaacacccgtatttttatcaaaaacggcgtacgcgaaacttgcccagcctgaacagcgactaactgtgtttactaccaacaacgttatcgaacatcgcgttgcattgaacaaactggccaaacatcactttcacactaccagccctgaacaatttggaggtcgctatgcgatgtatctaatggttaacggcatgtactccgggctggaatttatgggtatgttcctcggaatcgcctttcttgcaatgctagctagttgcctgatgttcaagattctgtctggtgccgatgctgatcaacaccgttacaagatgctcgataaagttggaaccactagacgccagctcaacggtgccattaacaaagaaattgctgtgctctttattcttcctggaatcgttggtattgtacacgtcttgtttgggttacaaatgttcaaaatcataatggttacctcaccatataccggaatttggttaccattcttgatttttgccggtctctacctactttactatctcattacgatcaccatctatcggcgaatcgttttacaataacctttcggaggagggaaaaatcatggtatactttggattagtcgctttattaatcgttattacaccattacaccgttacgtgctcgcaagtcgtcgtcaattctggttaggggtgctcataccgcttctgtggctgagcgttaacttcggtttagccacccagattatctttgaacatcaatacattctactggccgtactgggcaccctcctcctactctctagttggattgctgcccggatcgatcgtaccgaacgacaactgcaccagccgcaacaaaaggccacaacgaaatagggcaatcactgcaatgaggtgaataaaatgcagttcaactttaatagcacggaaccaatctacttgcaggttgccgaccaaattgaagaagctatctttacggaaaccttcgctgaaggtgaacaaattccttcgacaaccgagatttctaaagaatttcatattaatcctgcgaccgtgcttaagggcatgaatattctagttgatgcccaattgattgaaaaacggcgtggggtcgggatgtttgtcatcgccggtgcacaacaacgaatcgttgaaaagcgccgggatcagttctacaccgactacgttaaaaaactagtcgctgaagcacaaaagctccacattacgcaagatgaattagctaaattaattgaacgggggttttccgaatcatgagtattcaagttcaggctgtccagcaggcctttcgcggtcaaaccgtcctggataatcttaacctaacgatcaagccaaacacgatttacggtttgctaggccgcaatggtgctggtaaaagtaccttgctgaacattatcagcaatcgtatctttgctgacagcggaacggtcaccatggacaacgaatccatgtgtgataacgaccgcacgttaggaaaggtttacttgatgagtgaagttaacctctattctgagcgttcccgggtcaaacaactgtttaaaaccaccgcactactctatggtgattttaatgacacttatgctaaaaaactagcacaaacctttggcctcgatttaaacgcgcgatttggcaagttatcgacgggttaccgaacaatttttaaactgattattgcgttatgtgtgccggctgaatacatctttttagatgaaccagtcctcggcctggatgctaatcaccgcgaaattttctatcaagaactgattgaaacctatagtgaccatccccgcacattcgtgatttcgactcatctcattgaagaaattacgaacttgattgaacatgtctttgtgctggaccatcatcatattattgttgatggtgatgtcaccgacatcctaggacaatcttacgcggtaactggcccacaaactgatgtcagcacttatacggatggtttaaatattatcggcaaggatcatcttggcggaatcacggcccactacgtttacgggccattagataacgaccgaccaattcctgatacggtcacggtcgagcatctggacctacaaaaactatttgttaacctgactaataccaaggaggaggccgccgctcatgtcaattaaggttcgcaacaccacccgttatttattaacggaacaattgaaaatgacggggtggtcggtactcgcttgtgcggtggccttcggcatattaccactgttcttcgcattcatcagtgacaatattagtcaatactcgccactgagcaacttcgccaatctcagtcttagcgccctatttttcatgataatcttcatcactggggcactcacttatgactactttaagctttttattcaaagcgggatttcccgacaaacctactttcaagctcgagtattcgcattactcatgcttagtggtttgcttgtcatcatcaatgccatttattactacggtattcatgctccgtatttacactggagcaccaacaccgcgttgatgagaacgggctattcgctgtatagccatgcgctgggaaatcaggtctggctaaacattttagctagcttatgctttaactggattttctacattggcgttggccttaccggcatcgcttgtgggaccttactcgcgttatttggtaagtgggccaaaacgattttaatcattggcactcccatcattggcatgcttattatttggataatggtcatcattatgactcgcaatcaatcgaactataattacacggggcttgaaaacttcttgaaatttattattggttatcccagccgcggtgaagcgacaactggttactttaacccaaccatgccattcatcacaatgctggtaggttgcggtatcatcggtggtctcgcttatctgttcaaccgtaagttaagaatcagaaattaagctgataatctaaaaaatgaagcaggtcgtgaagttattgacttcacgacctgcttcattttttaatggttaatacaaacgtcacaccattcgagaagtggttttcccactaacgctacttttcaacctgcgtattttgcaaatccgtcttaaccacgattacatcagtcaacgcattacgctgcacatacgttgtaaccgagccttccagcacgcgttcaacggcatttaacccggttgcccccatcatgatcaagtcattatgatgatccttgacgaagtcccgtgaaataattggtttcggacttcccattcgaatgtggaaggcaatgtccgtaaagccatcctttttgacttgatcaaccgtttcttttaaataagcttcagaatcctgaaccaattgatacgtaatatcaccatccgccaaaccagctaaattatacccaaactgaccgggatcaatgactgctaacacgtcgatatgtgcctcattacgtttagcgactgcaactgctttatcaagcgcaatctcagcttgttgtgagccatcgaggggaactaaaatattcgaatattcttgtaccattgacgtcacgccctttccatctgttaattctattttaccatttatcagcgttggttgcgttatcatttatataaactaactaccagttatgcacagcagctcgccggctagcagtgtcgggtttacataatatttacaacaacgacatctgatatttacagttaccccttacaattggagttaatccacttgggggtgaatagtatgctttctttaggtattcgaccaggcctaatcgccagccatacaattgtaatcaacgatgccctttcatatcaaatcaggttaagcaaattgcctctcggacccgatgtctatcggctagacatccgtgcaaccactacactgggccgcttgaccgtgtcccacgcacgttaccataactttgccacggcccagcaagcctttaatcatcagcgccaccaacttgaatcgcactaaaaatatccaacacgtagccatttaattatgataggatggtacctagtaataatcagctaaagtgagggtattcatctgtgggacaacttatcaaacaactctggcaacgctatcaaagcgtcctttcctatttaatctttgggggcttaaccaccctaattaatattattgtttttggaattttcaaccaattctggccctactggatagccaatacgattgcctggctcatctcagtgctattcgcctatatcacgaataaaatttgggtatttgactcacaaacacctactttccgcgctgttttaattgaaatgacatcattcttcggattccgcctactcagttactttattgaccaggggattatggttgtcggtatttcggttctgcacggaaacgaccttatcgtcaaattaattgatcaaattattgtggtattactcaattggttcttcagtaaactatttattttcaaggatcgtggtcattaaagcgaaccaacttaaacatcaaaacaagcgtcgtaggaatgtccgaaaattcctgcgacgcttattttattcataataattaccgacccatcttttttctgatacttaacttagctactatttttagcaaccatatttttcacccaaactggcgttgcaccgtatgtaacgtcgctaactttgtgaccacatcatcaatattgaccccatcccaattataaaaaatatattggcgaccacagcgcatcttaatcaccaaatgacgtgctgatgaagcataaccattgcgaacttcggcctgatccgtcgtcaatgcatagtattgaatgtcatccgtatttaaagctaactctccaattcgtatcatgacttgttgactgacctcagtcggcggtcgaactgacaaacaagtcccatcatggtgctgataccgtaactctaccgcaactaaaccggccgcggttagctgcggtcgaaaataaaactccgcgccaatatgcaacgcacttgacggccaaactgcggttagccgaaatttaaaatgccggccatgaaaatcagtcaggatgccttggtcgtaatctggttgcattaccgtaatatgcccaatcatgacgattcactcccttcacttagttattgataatgtatcacgcttcacaagcatagttgtgtttaaaacccataatcagtcgtttttaccattttttattaaaatagtaattaaattatccttactcatgctaatatttgagttaaccaactttattgatcggaggtcccgttttgatgacatttacaaatcaagaaactgactatcttatgaacctactaaccaaccagttaatggccctactaagccgcgtcacgcgctggcagacgcacagtctgagtcaacaccaatatgaccaacaagtacacgaaacgctccaacccgaactgaccatgctcacgcaaaccactgctaaactccagggacaagcccgtgaccaaactcagctaggggccattcaaactggtttgaagaaacttcaagttgccaccacctatcagctaactgccgaccaacttgcacacgctaatgaacgccggctgaatcgccgataccgcgattaacttttacaacatcagcatatttaccaggagattcaaaactatttcgcaatccttaacagaaaattcaaatttcaatcacgagttagctactttttctcggtacaatggttttatcaactcatacaaccacttgactgaaggagggcttccatgttcttaattgtttactgtacgttcgctattgcagtttttttctggatattcggttacgttaaaaccgccgtcatcattggtatactggcactgagcttgattgcttactccttcattcgccgagagattactcgacgacgtttgctcaagcgacgcacggttaccaataaaagtcgttaaaaaaattccaacacgccggtgtcggaattttttggttatttttgcatttgtgataaacaagtgacgatccgctgagccgcctcacgcacattttgcggattagtcgctaagttcaagcgaacaaacccctgatcatcaggactaaaccactcaccaaagtcaactgcgagctgacattgatcttgaataaacgctttcgttgcagctggctgaacgtacgcgcgtaaatctagccacgtcaaatacgtcccctgcaaatcggctaaaaccaacttaggcgcgtgggcggcaaaggtggtgcataaataatgataattatcacggacgattgccaaaatctggtctaaccaggccgcgcccgattcataagccgtttggccggcaacctggcctaagacgctgatctcagtctggctgaagcgcccgatttgtgcatcatagcgttgtcgtaattttggattaggaattactagatgtgagttcaaaagcgccgccagattaaacgtcttagacggtgcattgacgacaatcacccggttactaaaccgcccattggctaccgttaacgccgatttgaacggatggttggtccgatcaatttctaaatcctggtgaatttcatctgaaataacaagcacatgatactgttcacataatgctaacagccgtgtctcttcatcttcagaccagatctgccccacaggattatgtggcgaacattgaatgaacaaccgcacctcgttcgccttaatttgctgttccacatcttcaaagtcaattgtatagtgaccacgatcattgcgtaactcagatgtgaccagctgacgatgattatcccgcaccgcgttgaaaaatggatagtacacgggcgtcagaatcaaaacgccatcacctggttgcgttaaaatattaacgagcgcgtacaacgaattgaccacgccactaccaaatcgaatccaatcgcgtttcaatgtcagaccatggcgtgcctgttcccaatcgataaaggcttgataataacgatcaggcgtaatggaataaccataaatgccatgcgccactcgttcttgtagtgcttgcgtaacttgttctggcactttgaattccatgtcagcgacccacattgccaacaaatcaggattgccataccgagcttgtagtgcgtcccacttcaatgaatccgtatgctggcgcgttgttgcgtacttcttaataaatgctgcttgttccatcttaaaggccttctttctcaacaaaaaaacttcgtccttaacttactaaggacgaagtttatactccgcggtaccacctattattacagtcttgctgtcgctcacgcaacgtactcgttacgttcaacccaattatcggtggtcaatccgggctaatagcatcaaccattagccaactccgagttcatcttcacaataagctgatggtcaaattacaccactactttgactcgctaggcatcaacttattgttactcttctcatcaacatttaatcttcacgttgcttctaagttacaacgtgaagattaaaaagtcaacaacgtctttaaaattgcgcttgctctaaaacctggtagccatcgattcgttggtcagcggtaggaaacgccccggtctgtaagaaacgcttggcctgcatgacccgcggcgaactattcgaccaatttaattgatcaagtggcactcgagcggcccccgccgacattgattcggtgtaatgcggtcgtttgagcaacaaatggccccccaccggttccagtaaataataaatattaattaacgttgctggcaattctaatgttgttaaggctggaatcgtaagctggacggtcccaagttgctttgaaataacagtttgtagtcctgtttgaagttgtgcaatctgactaacggcctcactcaacgtggcccgtgtcgtcactggtgcggttactaaatcataacggttcttgaacggcccggttaaggatttattaaggaccatggccgtcgaatcaccaatgataccacaaacaaatagtggactaattgctggttcgttaatcatcaatcttttccttctctcagtcatacgattaaatagataaattaattagcctataaaaatataacagttacattttaccttagaattatgataaggttcctaaaaaaagcatgcgaatatgaatatttaacaacttttaataattctatgaaaaaaaccgaatcttggctactaaaacgcacaaggttcgattactttttttgttatttagttagattgcacatcggtcgtattaataaatgactgggctggcacacgaattaaccaccgcgtcatggcttgatgccccacatggacacctaagccattccagaatgacggctgataagtggctgtcagcttcactgcgtaggctttttcgtgctgccggtcttctttaaccagctgcttttgtgaccacggaataccagcatccgccactttaacttgcgaaagattagtcaccacggtcgccttgttacttgaaacagtatatttcgcaccattaacccagtaattataaatatgcacgggtttttgggtcgtgcctcgatccaccgcgacatagtaggaaccattagttccaactcgcaaaaccagtggttcaacttgatacgttaccttaacgtccttagcatctgacaggtcgacctggtgattgaaagtcacgtatcccatgccaactagtaatccgagactaacgattaattcaacggtggtaatgataagatttccccactcaaacgtatgcttacgttccacgatcatcttgatgcgtcgtacgcgaatatgatgaaatacccacacgactaacgccaaaacaatgatccacgcaatgatcccaatccaattccatgcagaagtcattgattgccaaccctttctcaattacattattatgttctaattgtaaataatccaaccttaaataacaagtaatccagcaaattcaacacaatcattcagaagcagattgtgaaaataatcactgaaacggtgccaatgtaatcgaattcatggtaaaataaagttattaacttgtagaaagaaggagtacacatgatcgcgtcactaatttattgggtcgtcgttgttggcttgattgtttggggtgtttggatggccatcctttccgcatattgggccagccaaaaacaaaacggcaacattttctttattgcaattatgaatacattaggtgccttggccggcctcttagtatggtgggtcttcaacaatcaagactggcagtactactggttatccagcaccgttaagacaaccaacctcttaggcatcgtcctaatctgctacgttgtcttgattgtcatcgaattcatccaaggccggggcatcaagcctgagacagctaaataatgattattttaaacgccaagcaagttgctaggcgttttttattgtcaaatgcggcaacaatcttgctcttcagtgtttgttacggtgataacatttgattaatcatgctgcatgcttcatcatgattaataaaaaaaacgattctcaaagacattgagaatcgtttttttataagcgactgtcctaatggcggctatcggtcttgaagatttcaactgggaaacacacagaacgctccaccagtcgacttgtgacactacttcacaactaagccacggttaattcaaagcctcccggtgccatctcatttgcggtaatacccgctgttaagattggcgatacaccacttactgttgagactgcctgtgcacctaaattaaagcggccttgaatcgtctgttcaacatccgtccgcgttaagattaagcagtgaccatcaatcgtccatgtcaattggctagttgctaaaaagtcggcctgttgccggcgaaacttgatcaaacgcgtgacaaattgtcgaacttgttgttcttgctcgtctggttgccagttcatgcaccgacgattgtcagggtcggcaccaccggccatggccacttccgttccataataaatacacgggctccccggcaatagcatcagtagcgtgagtgcagatttaaatttagttaactgaccatgcaacgtggtcagtagccgtggcgtatcatgcgtatccaacgcgttgaacatcgcctgttgattaggttgacgatacatcattaattccagattggttttaccaacgtaatcttcaaggttgagttgaccattaaacaacgccagaattggttgtgtcagtggataattcataaccgcgttaaactggccgttaccgactaacgattgactactatgccaagactcacctaataggtacacatcaggtttgattgcccgcaaggcaccacataacgctcgccagaaaccatggtcgacctcatcagcaacatcaaaacgccaagcgtcaatcccgaattgttcgatccaatatttggtcacatcaatcaagtaagcttgtaccgcggggttctgggtgttaactttcggcatcgctgctcccgtcgcaaaggtttcataattaagccgcttcgtcttcggatcacgtcccaccggccagccatgaatatgaaaccaatcagcaaaccgtgactgctcgccatttttaatcacatcttgccactgtggtgactgctcgccaaaatgattaaagacggcgtctaacatcacgcgcataccgcgcgcatgggcgccatcgactagcgcctgaaaatcggctttcgtaccaaagtggggatcgatttcaaaatgatcgatcgtatcatacttatgattagatggtgacgtgaaaatgggacacaagtacaggccattgacccccagtgcagccaaatcatctaaatgcgctgtaattccgggcaaatccccaccataaaatgaatcacggtgaacacgcccagcaccccacggttgaacattagccgggtcattttgccgcacaccatttgcaaaccgttcaggaaagatctggtaccagaccgtctccttaacccatgccggtggcagctccgcatcactgacgtgcatatatggcatgtgaaaatagttgcccaccgtttgccagttagtggcaacgtcgtcaaagaagccaccctcaccatagccaaccgtcgcaccggtcgtatccgtgatcagaaaggcatagaccacccggttagtcggtacggtcagcgtcgtctgccagtactggttgccctgcgtcgctaatccgggctgcattatccgccgctctagcgctgttgttccttcttgccataagtaagaatcggcaaacaaaatctccacttgggcaacatcgtcacgcgcagtttgtagtcgtacctgtagttgatgtgcggctaagacggctgtatcttcactttcagggcggtgcctaattccagctagttgcattgtaagatctccttttatgtaaacgattacattattaactagaccatttacgtcaattatcctcatgattttggtgaaaacgtccccgttcgcctcgattttagtgtatcatttagtcaaaatcagttgaaaggacgttatccatgaaaacactttatcgcagtacccgcgaaactgcaagtcacaccatgacgtcatcacaagccgtacttcaaggcctgacgccggatggtggtctctttgtgcccgtaacgctaccgaccgctaattttgacttcgaccagctcgccacgatgagctaccaagaagttgcttacgaggtccttaaactcttcttcacggattataccgctgatgaattacacgcctgcattgacgcggcttatggtgatcagtttgatgacccccaaattgcgccggtcaccaagcatggtcagcagtattaccttgaactttttcatggaccgaccattgcattcaaagacttggcccttcaaatcctaccgcatttgatgacaacggcagctaaaaagaaccatttacaagccgaagtcgttattttagcggccacctcgggcgatactggtaaagctgccatggccgggtttgccaatgttgatcagactcgcatcatcgtcttctatccaaaagatggtgtcagtgcaatccaaaaacagcagatggtgacccaaaccggagccaatactagtgttgttgcgatcaacggtaacttcgatgaggcccaaacaacggttaaaaaactgttaaacgaccaccaattacacgcggaattagccacccaccagttccaattctcaagcgctaattccatcaatattggtcgtttattcccacaagtggcctattatgtctacacctacgctcaacttatcaagcaggggcaaatcaagaacggtgatgagattaactttagtgttccaactgggaactttggggatattttagctggctactatgccaaacaactgggcacgcccattcataaactgatctgtgcttccaatcgcaataacgttctcaccgatttctttaataccgggacttatgataaaaaccgtgaattcttcttgacgagttcaccgtccatggacatcttagtctcaagtaacttggaacggctcctcttctacttgacaggatcagacgccacggcgactgctaaactaatgactgatttgcaaacgaccggccgttatacgattacaccggcaatgcgtgccaacttagctgatttttgggccggcttcgtgactgaaagccaagatcaagctgaaattcatcacctgaaccatgcccatcactacacaatcgatccacatacggccgtggcctcggcggttgccaaacagtatcaagccgcaaccagagatcagcggcccatggtggttgtttcaaccgctagtccgtataaattcccacaggccgtcctaacggcaattactggtgagcttagtgcggtagatggcctagccgcagttgatcagttacatgagttgattcaaacgcccattccagcaacggtcacagccctccgtactgcgcccgtgcgccataagcgggttgcggatgttgatgatatgggaacgaccattaaaacaattttaaatcttaactagaaagtgtgaccaagatgattacgaccattgcgttagacctagataatacgttactaacttctgagaagacgatttctccgcgaactgaagcagttctcaaacagctgcattcggccggcaaacggatcgtactgtgtactgggcgaccaattaaggcgattcaaccatacttacaacaacttgaactcaaccaaccaactgactacgcgattacctttaatggtgggctcgttcagcaaaacacgactggtgacgtccttgctcgtactagtgtgaccaaacaagatttacaacccttatttgagcaagcccagcgcgatcatttctacttagacgtgattgatttgaagcaagtctactccattacggatctaggcaagtcaccgtacgaagaattcttgcaaggcttaatgccatttaagaatgttcgttttgccgacctgcctgctgatgatctattcggtaaagtcgttagtgctggtcaagatgctaaaacagtccaggccaaattaccaagtcaaattaccgatttcttccacgtggtcccatcccggcggactttgttggaattcttaccaccgcatactgataaggccagtggtttgaaacaactcctcggtcactttaatgaagactatgacaacttgatggcctttggggacgaagaaaacgacctaggaatgctaaccgccgccaaagttggcgtagcgatggcgaatgctattcctgcggtcaaggctgcaaccaccaatgccaccctgagtaatgacgaggacggggtcgccgttttcctagaaaattacttcaactgatcccaaactgaagcctgtaacgggcttcttttttagcacaaccactcaaaatcaaactaacgaggtgtcccatgcaagatccccgcattatcccagcagaattaacgactggcgcttttttcgatattttagcagatgaggaccacagcttaagttatattcaggttagtgaagaagacatgagtcaccagcacatcgatcaccccatgctggatcacgtgcacttcgaaaatgtccggtttacggccagtcaatttgaacggcttgacttgaccgatgctgtctttatcaattgtgacttttctaattgccagtttgaaaaagccagctggctacgcgttcaattcaaagattgtaagctcgtcggtgtcgacttgaacgaggctgccctcaataacgtcgcctttgaccactgtcagctcgacttagccatgctgtgcgacatgcggttcaaaaccgtgacctttgatcactgtcggctgaatggggccagctttatgaacaatcgactaacgactgtcaagtttaacgaaaccagccttgaccaagtcgctttcaacgataccgccctcaaaaatattgacctaagtacctgtcaattcgagcgtctcgaacttgatactgccgcagcacgcggtatgatcgtcaatattgatcaggctgcttatttggctgctgctttaaacggcatcaaagttaaaccctgataccggtagaacagtcaccgtatgagtgaccaactcacaatgccaaggacgattaagctgctggctggtaaatcttctaataacactgcacgtatctgtcagaatacttttcacgcgctgaacacaaaaataccacctccgtcaggtaacaacctgcgaaggtggtattttgtcgttcatcatgacaattcgaattgcgccccggtgtaaccagtgcggtcggccgccgtgattggtcgaataacttggcaagggttgccagccgcaatcacgttagctggaatatcgtgggttaccacgctcccaccaccaataatcgtgttagcaccaatggtcactcctggtaatacggtgacgttagcggctagccaacaaccatcaccaattgtgattggtcgggcgatgcagccgcccctaattcgttcggttgcatcaaacaagtggttactcgtgtaaaggccgacttttggccccaacaagacctgactgccgatcgtaattggcgccccatctaacattacacaatcatagttggcataaaagttatcacctagatgaatgttccgtccaaattcaacgcgaaaattaggatttacaaatggcttgcgaccagctaaaacaaccaattgtcgcaataaagtttctttagtctctggatcagcagtcgcattgaccgcgttcgttgtcaacgtcgcttggtcacgcaacgccgttagttctgcatccgtatctcgatacggctgaccagtcgccatatacgcaaacttctcatctaaattcattccgcaccccacttctatcgaataaaattcaagtaccatgttattgcgcagattccttgtgctgaacgaatctggccattctttaataggtcaatcactttactgagcgggacaagttgcgtattcacgtattcgtccgcgtcaaaatgtcgttcgccatgttcttgcggatcaatgtgagtcaaaatcaagctgaccgtttcgtccgtaaaaccttccgacgagctaatttgcgtcataatttgtgattcatgggcaatgtagcccgtctcctcttgtaattcacgggccgcggccgttaacggatcttcccccgcattaatgaggccagcaggtaaactaatcgtctcggcattgcgaccgacccggtactctgaacctagcacgacttggtcatccgcggtgatggctaaaatcgtgacggcgttcccatgctgaatcaaatcgcgttttacttctaatccatcaggtgtttcaatcgtttgtttgaccaaatcaaaaatcggcccatgatacaccggtgtcgttgataggaccttaccgcgccggccaactttctcaaataaatctgccatacacattcactactccttaatctatctcaaatccggtacaccatccggcagcatcttacgaatgccacccgcggggtctggcacgtcaccttgatatcgcggtatcagatggagatgacaatgcattacggtttggcccgcagccgggtcaacgttaatgccaatattatagccatccggatgattgtgcgcatctaggtacgcttttgcttgggtcagtaaggcgagcatcgcattcctggtcgccgtgggcacatcaaaatacgtggcataatgtgctttcggaataatcaacaaatgccccggactcaccggctttttatcgaagaaggccgctgctaggtcattctccaaaatatacggcaacggctgacaaaaaatacaagccataccaaagtccccttcctattttgctaaccaaccaccatcaattggaaccaccgtcccatgaatataatcagcgtcctgactcgctaagaatagcgtcagatctgcaacttcctgcggttgggcccaccgttttgcgggcgtctcactggcaacccatttcgccatcttaccatcgccagcaaaatcagcggcattcatcggggtatcgatagcccccggcgcaatgcagttggcgcgaattccctgagccgcatagtccaagtcaagttgtttcgtataaccaatgatggcgtgtttggctgcggtatacgctgcgccgcctccgccacccaccagtccagcgatcgatgccatattcacgaaaacgccgtgttgtgcggctaacattgcaggtagcaccgcattagtcacgataaactggcttgtcagatccgtcgccaaaatatcttgccacgttttcagatccgttgctaaagttggttgatagccgtctaacttaccggccgtattgcacacgacggttggcttgccgagtacgttaactcccgatttaatcgccgcgacgagcgcattagtgtcggtcacatcagcaatttcatagcgcagggctgacgtcgttactagcgctgatggctgtggttgccgatcaatggcaatcacgtcagccccctgggctaggaaactctggacctgggctaagccaatcccggaggcagctccagtaaccaagacagtctgtccacgatattcatcaaattgcattagtcaaccaactgccagtccgtcgctaaaatatcacaatctgttggtgaccacatactataggcttcatcggccgttttgattaaaaagtacgggttcagcgggtcgccggtgaaagtggttgccgtctgtaattcgacgaacaattcggtcccttcccaaccagtccgaacagcgcgcttaccagcttttaattcaggtaaaatagcttcaaatgtcatcatgatacctccaattattaatacccaaatcgtatcataatcccgcgtggagtgacaggcaaaaattggtaccaacaaattgtctattttactggtacggaccaattatttgtgcgataatgtaagcgaatacagaaactaattattatttggaggaattttaaatgagtaaactcggtgtttccgtttatcccgaacgatcaacctttgagaaggatgcggcgtacctcgatttagccgcaaaatatggctatcaacgggtattcacttcactgcttgaaatcaaaggggaccaagccgcagtggttgccaactttaaaaaagtgatcacttacgcgaaccaattaggcttgcaagtaatggtcgacgtcaatcctgacctcttcaaacaacttggcgtgtcctatgacgacttgtcattcttccacgacctcggtgcctggggtgtccgcctcgacctaggattcactggtcaagaagaagcccggatgacgcacaacgaattcggcattaagattgaagtcaacatgtccaaagggactcactatgttgacacgattatggattattcacctgaaaaagataacttactaggctcacataacttctacccacaacaatacactggtcttggttatgattattttgttcaggcttctgaacaataccgtcagtatggcatcaacaccgccgcgtttgtttcatcaaatgatgcgacttatgggccttggcccatgcaagacgggttatgtacccttgaagatcatcgggggttaccgattgcggcacaagttcaacatttgaaaatgacggggctgatcgacgacgttttaattggtaacgcctacgcgagtgaagccgaactaaaagcggctgctgaagtgttctttagtccttacccactgctacacgtcgaaaccgttgctgatctatcggcagttgaagaaaaagtactctttgcgcaaccacagacttatcgcggtgatttttcagattacgtcattcgttcttctcagacccgggtcatctacaaagacgaagcctttcctgctcatcacctagatgccattcataccggtgatgtcttgatcgataacgatgagtttgggcaatacaaaggtgaattgcagattgcacgccaaaatcttgaaaatactggccgaatcaatgtggttggtcatattactaagagtgacttaccttgccttaacttgctacaaccatgggccgactttaaatttgtcgctgccaaatagtactcaacgaatggaggggtcgcattaatgacaactgattaccgtttaactagcgatgctgaccgcgaagctttctaccaactttaccaatacgcgttcaataatcacgatacccccgcgcggcggcgatttttcatggatcgctaccaacatggctggatctacggccgtcacgatcatggtcaactggttagtgggctatacagtctgccactagcagtcaactttcatggcgtcacctaccggatgaatggtattggcgatgtgatgagtgcgcctgaatatgccggtcagggtggcgcgggacagttgctaacgacggcgctgacagaaatggcggccaaccacgtgacgctgtcctaccttgcccccttcgcgtacggttactatcgtcgttttggctatgagcatgtcttcgaccacgcgcaccaagtcatggccgctccagacctaccacgtgtcaaaccgacggactggtctggtacgatcacccgctatggcaatgacgggctggcccaaatcaacgatttttatgcacgacaaccacaaaatcagcgtggtggtctgattcgaccagcctggtggcaacattacctgactctcaaacatcattggtcggtcgcaatttaccgcaatgcggctgccaatatcgagggctatttgatctatgaacggcaggccactaactttgcgattcaagaatgggtgactagcacgccgaccgctttcgaacgattggctaactttatcactaagcatggcaccacctttgaaacgtttagttatgatagcccaagtgcgaccaacggcttggacctactagccgacccataccgtttaaaagtgactgtccagccgtacatgatggcccgcattgttgatttatatgactttatcaagcgctatccgtttctcacggacatccaaccaattcgcctagcagtcagtgacgctaccctccctgctaatcaaggaatctggtcattgacgcggcacaacgggcaagtaacgctcaatcgggttagcgaccaattaactgggccggctgacattcagttaacgattcagcaattaaccactgcttgctttggcacccagagcttagcccgggcgtaccaacacggattaatcaccggtgatgtgaatgcgatcaaccgacttgacactagtctagtgaaagaacgaccagcacttattgactacttctaagtgcttaatttagataagcagcatgactgactcaaagtgggccgccagaataatcattctggcggcccacttttttaaatattcgtatttcccgttcaaacagtttttgtcacatatccagtatttttaacaataagattacagctaattcttgggacgtttcttttacggcaaatagtcattctcatcttagtctattcaaaaaagatgtttgaagatccgactagatctccaaacatctttttactggcattatcctggttaatcaccagcatcgtgcgtaaataaaactaacgaatattaattgattaccaatgtaatattaaccatgtcttgacattaattttcatacaaataacccgcatcccgtaaagctgccttgatggccgttaattgttctggggtctgataagcaaccgtatggctatggacgccatctgttaattctgataataaatggccttgcaatttcttgagccggcccataaacagattaacatcaccaactgagcgaatctctaattcaccccggagccggccatacaatgggtgttcgacttcaacatccttgattatgccccctgcgtgaatgatcaaggccatttcctgcatcgcttcgtttggaaaatgacggcaaactaggacagcagttggctgatccgctttttctaattcatacccttgaagagtagcaacaatggccgttccgtgagctctcaataatgaaatatccccaacaatggtctgacgactaacgttaaactgcttcgctagcgttgttgcacttacggggacctgcgtttgcgataattttgatcgaatttgttcacgccgttctgatcctgtcatgactcacccttcttactctttcaatagaatcattctaccagaaaaccagtagaatagctttcatcaaatactaaattatgataaactaagttcatttatcataggtgtcaagacacctaaatcttaataacgggattgattagcaatgcgcaatttatctttattaaccgacttatacgaactctcaatggcaaatggatttcatcacaacttacctcagaccaacgccaccttcgaccttttttatcgccgggttcctgacaatggtagctttgtcattgcggccggcctccagcaagttgtcgaagctttacaagattttcattttaccaacagtgacctcgactacttccgtcaacttaacctatgggatgaatccttcttagccatgctggcaaattttaagttaacttgccaaattaaggcactaccagaaggaaccccggtctttcctcgtgaaccactattgacaatcactggaccacttgagcaagcgcaattacttgaaacgctcgtcttaaatatcgtcaatcatcaatcactgattgccactaaagctcgtcgactgagttatgctgcggcaggacgtccaattatggaattcggtgcgcgccgtgcgcaaggcccggacagcgcactttacggcacccgggcagccattattggtggcgccaatagtacttcaaacgttctcgctgcgaaactgtttgatattcccgttgctggtaccatggcccacagttggattgaagccttcccggatgaactaacggcgtttcgcaagtgggccgaacaatatcctgacaatagtgcgctactagtcgatacttatgatgtgcttaactctgggatccctaacgcggtgacggtctttaaggagctacgagcagctgggcatgaacccgtcggtattcgaatcgattcgggggacgtcacgactttatcacaagctgcccggacacaattggacgcggctggctttcccaatgccaaaatcactatttctaacgcattggatgaacacatcattacctcgctgttgcacgaaggcgcaccgatcgataattttggtatcggtgaaaagctcatcactagcgcgtccgcaccggttctaagtggcgtctacaagcttgcggcaactgagagcaatggtcagagcacccccaagatcaaggttagtgccagtcgcgaaaaactaacgattcctggtgataagcaagtctatcgtctgtacgaaccaggaactcagcgggcctttgctgacttgattgcactagctaccgagacgatcgtcgatgcgaccagcctaaccgtcgtcaacagtgacccactcagtgtcgaccgccaacagcgactcacccattttgaagcccggcccttactcgcgccggtagatttgtccaacaccacgtcaattccggttacaaccattcaggcaacgacccaggctaaacttgccgagctcccacgaacaacccagcggctcgtcaacccagatctttacccggtctacatgacaaccacactcagccagttacaaactagtttgttgaataaaatgacgatactagcagattaacaaacgaacacgcgtagcaacgactaaagccacttctgatcagcgttcaaatgaccgcttagtacagaagtggctttagtttataacaagtaacagttagctcactgaccagtaatttgatcatgttcacccggggtcaatattttggtcatcaccgtaatcaaatacgcttgttcgcgctcaatttcagttcccggcaattccagcattaaccgcgctaggtaaccgaatagctgcgataacaaactttgcagtatcaaatcattcggccaatccacaatcaaatgatctgcttttagttgatttatgacacttcccatctgcttgaccatcttaggcgcgatctggctaagaatctgttcgcgtcgttcggcgtcaaaagctgccatttcaaaaatgacctttaactctttcacgttagctttagcaaatgcaactcggtccgtaaaaattgctgtgacgaatgcctgtagactgggataacgctgccgtaattcatcttctgaaaaatcactcgctaaaattggcacaatgtgcacggcaattggtgctaagatggcatcccgtaaggcagccttagtcttataccgccgatagaccgtcccctcagcaacgccggcccgttgtgcaatatcactagtactagtctggtcaaaacccttttcagcaaacaaatcgagacttgcctggaggatggcccgttgcttaggtgtaatcgtttcattctgacttagatcatgttgaaaataatcccgtatccgtggtcgttccatatcctcacaccttccgctaacgtttcattccaacaatattcaacattgttagtacgaccataaaccctactaatattaacaaattgacaccaatatcgccaagcccagcaccctttgtcacaacagccgtcaacgcattagcaccatagtataacggcatgatgtgggcaattgcttgcaaccaactcgccatgccatcgactggaatcaacccagcaaaaaagatttgtggtacaacaatcagtggaataaactgaatcatttgaaattctgagttagcaaaggtggaaataaagatacccaaggtcaaagccactaacgctaataataagttagtcagaaagaccagccaaatactaccaactaagtgaatcttgaagaccgtaattgcaaaaacaacggtcaggacagtctgaatgatggcaaagcccccataaccaattagatagcccataataatttcactccgtcgaattggagttgcaagtagccggcttagggttccagtagtgcgctcattcaaaagtgaaacgccagaaatcaagaacacaaagaagaagacaaagaaaccgagaaagattggcaaaaagttttcaaagaacgttgaatcactactaccataaatataatgactgctagtggtataggtcgtcgtttgtgattgactatttgttggcgccgcagcactcgctgtagcctgcctcaattgcttttgaattttagccgccgcagcagtattcccacttgcctgtgcttgggccaaggccgtctttagcttgctaaccgttgcctgtttttgcgccgcggtcaacttttgtagtgccacctgttgcgtttgcaacacctttttttgtgctttagtagccgtgaccaacgtttgaatttttaatttgaccagtccactttgcaaagaagctttgatcaatgacgtattggtcggattactattagaatacgtgatcgttaagttgccatctttttgcgtcaaatatccatccaaatcatgctgcttaatcatcgcttttgcctggttactactgtaatggtgaatatcgacatgcttcgtattaatggctttgaccacctgatgatcaacattgtgaacacctaaagtcgccacttgagtcgtgttattttgaaacaaaaaatacatcaacgccataattaagagtggtgccaaaaacatcagcgccaaggtacgcttatcacgtaacatttgcttaaaaactcgtctaacgattgccatcgttcgcatcttgcatccgccccgctttcaaaaagacctgttcgatcgtatctactgcatactgttgtttcagtgccgcgggtgtcccctcagcaagcgcaatcccgtgccgaatcaacatgagataatcacaccgttctgcttcgtccatgacatgcgttgtcacgagcatcgacttaccggtatccttgagcttatttagttcggtccaaatttgttgccgtaattctggatcaatcccaacggtcggttcatctaaaatcaataattggggatcctgaatcagggcgattgccaacgacaagcgccgtttcatcccacccgaatagccactgacccgcttgtctaattgggacgttaaatcaactaatccggctgcataatcaatcatctgcgctaactttatttttggaacgctcatcaattgcccaaaaaaggtcaggttttcacgggccgttagtgtctcatacaaagcgtcactttgggccatataccctacttgtgccattaccgccctattgggcatcaccgtatccatgactttaacagtgccactgtccacagcctccatccctaaaatactcttgatcaaggtggtcttcccagctcctgatggcccaatcaagccataaatcattccagccggcagtgtcaaatcaatctgattgagcacttgctgatgaccaaagtgcttgctgacctgcttggcgatgacataatccgttgccattttaataaccctctttctcgaagtgagtgtatactcactcacttactttatttccagcccatttgtcaccgcactgcaaacaaaaatgcgccaccccgttgttgggatgtcgcattttaattaaatatcagcactgatataagcgttagcaatgttttaacgattgttaatcttggtcagcaatttttgtcctagctcataatccaactgacgctccgattccggcatcatgtcgccgccagttgcccagacaatgtgggtgacgtctttgccagcaagcgtgggaaattgggccatgatgggggcgatcgcggtaaagccggctgcagcggatggttcgaccattacatcttcggtatcgacgagcttcgtcaaataacggtataaatcatcatcttcaaatgttgctgttccgagtaatagcgttcgcatcaccttgcccgccaatcgtgatggccggctaacggctaacccatcagcggcagtcaggccatctaaaccaatgtcttgaacagcaattttttcattcagcttggtcatcatccctaaggtcacggacggcacgtgggtcggttcacaaaagacgggataaatattagctcccataatcatcttgaggccaaaagcaacgccactaggactgccaccgaccccggccggtaaataaacgacaaccgggtgtgcagcatccatcttgataccttgtacttttaattgatgttgtaaccgtaccccagcaacagcgtacccgaggaataagtcacgtgaaccttcatcatcaacaaagtgcgtatggtcatccttggccgcggcggcacgggccaccggaatcacacttgaaaagtcggtatttagttcctcaacggtgacgccatttgcccgcagtttgtccttcttccactgacgagcatcgtgagacatataaacggtcgtcttaaatccaaacgttgcggccatgatgcccacactgagtgccaagtttcccgtcgatgcaacgatgacgccgtattgtgcaaataactcgtgatacttagccgttgccaagacactgtaatcatccatatacgttaaatccgtatgggccatggctacctgttcagcaaacttgagcacttcgtaaatcccaccacgtgacttgatcgaacccgaaatcggcaactgactatcagcttttaaataaagctgccccgccaatgactggtggttgagagcctcccatgctggtttcatctgctcaagtggtaacaatggtgactcaataatcccattcatagctgccgtttctggaaaagcaacggccaaaaatggtgcgaaacgttcccaacgtgcgaccgcgtcaaaaatatcggcccgcgttaacggcaggtccgcccgcttcccataatctgggttctgccaaacaattggtcgttttgctatcaattccttaatctgtgggtgttcttcaatcattaccgttgtatccatactttcaggtccttttcatttaattgcatcatattacgtatcgtgagttaaaattatcagttttcgatggccgtctacatacgttcagcctattccgaccttccgagactaggtaacatactgaaacgtcaccacgatcagcacaaatgccgataagtcgatataacacgcactgagccaacaagtctcccccaacccgaccctttcaaccgaacctaagttagtggcttttctctgaatctaacgattttcaatcacaactcatgttagataatatgacatcaccttcgtccatcatttaaccatatttgatacttagaaacaatctttaggcactgattaacaataattgttgattagccaatcaaacaagctaataaggcaatcgaaaaacgacgttcaaagttcactcactttgaacgtcgtcttcaattagtggttattaattgactaataatcgtcgttcgaactgcataatcattcagtagtcttctagcacaacgagtttcctacttcaaatcggccccattcgtccgaatcactttttgataccagtagaacgaatctttcttcgagcgctctagtgtcccgttaccttcatcgtccttgtcgacgtagataaaaccgtaacgtttcgacatctgaccagttccagctgagaccaaatcgatacacccccacggcgtatagccaatcaagtcgaccccatcttcggtgacggccttgatcatttcactgatatgagcgcgtaaatagtcaatccggtaaggatcatgaatactaccatcggcttcgactttgtcgcgggcacccaacccattctcaacaatcatcattggcttgtgatagcggtcttgtaaccaattcaaagaataccgcaaaccttctggatcgattggccagtcccattcgctcgtcttcaaatatggattatcaacggcttcggtcccgacaaagtggtaacttgggttatcatcctgagcggcgaccgtgttggaattatagtaactaaagccaatataatcaacggtgccttccttcaagacttggcggtcttcggccgtgatatcagggcggaaaccagtctgtttgaagtaagcttccatattatttggataatagccccatgactgtacgtctgcaaaccaataacgccgctgcatagccttttcagcttgcatgatatcttgtggcttagcagttgcaggataaatcggtgtcatgttgatcatattgccaatctggaagtcgggattaatggcatggccaatcttaacggctagcgcactggcaacgacttcataatgagcagcttgatacatcaaagcttcagcgtcaggatcatcgggcttcaacactaaaccagaatccgtcgccatcaggaattggttcgtataagtcgtctgattattaatttcgttgaaggtcatccagtacttaaccttgttcttatagcgtttgaagaccgtttcagcgtagtgcacgaaaaagtcaatgactttccgcgaacgccagccaccatattccttaactaagtggtacggcatttcaaagtgggccagcgtgatcactggttcgataccatattgccggcaagtatcgaacatatcatcatagaacttcaaacccgcttcattgggttcttcttcatcaccatttggaaaaatccgcgtccaggcgatcgatgtccgaaaacacttgaagcccatctcagcaaatagcttgatatcttccttatagtgaccataaaagtcgatgccttcatggttcgggtaattcttacccgcaatcacaccatccgtgatttcacgaggaacaccgttggcaccggcagtcatgacatcagccacactgacccctttgccaccagcttgccagccgccttctagttgatgggctgcgaccgccccaccccataagaaatcagatcgtaaaccactcgttgttgccatgcattatcatcctttcactataaatcttcaccatcactcgcaataacttgttggaaccagttaaaggagtctttcttagaacggtcaaaactgccttgaccattatcatcggcgtcaacataaatgaatccataccgtttcgccatttcaccagtacttgctgagaccaaatcaatacagccccacggtgtatagccaatcaaatcaacaccatctaatacgaccgcttgttccatcgccaagatgtgatcacggaagtaactgatccggtagtcgtcatgtacactcccgtcggcttccttcttatcgtaagcaccaaagccattttcaacaatgaattgtggtaagtgccaccgatcttgcatccagttcatcgcatagcgcaacccagttggatcaatttgccagccccaatcagacttctcaacgtaggggttctcaacaaagtcatcgggttccttgaaatcgtaatcactgtcaccgtcacgaccctttgtaacaaatgacatgtaataactgaaaccaacgtaatccaccgtaccagcctttaaagttgccaagtcagcagcggtaatatccatatcgaagcccttgcgttcaaagtacttcggtaaccactttggatattcaccgagacagtggacatccccgaaccaataccgtttttgcatggcccgttccgccatcatcacatccgctggtttagctgttagtggatagattggacacatcgcgaccatacagccgatttgaaaatcaggattgattgcgtggcccgcttgcacagctagggcactcgctactaattcataatgagctgcttgatacatcgcctgttcccaattgtcatccttgctaagttgcaggccggaattttgtaacaatgggtgcggatcactccaagctgtttggttattgatttcgttgaaggtcatccaatacttgaccttatcctgatagcgcttgaagacggtcttcgcaaaatgaacaaagaagtcgatcatcttacggttgctgaaaccaccataaaccttcactaagtggtatggaatttcaaagtgtgacagggtcacaacgggttggatgccatgcgataataaatcatcgaataagtcatcgtaaaacttcaaaccagcttcgttaggctcgctctcatcaccattcgggaaaatccgggtccacgcgattgacgtccggaaacacttaaagcccatttcttcaaataatcgatcatcttctggatagcgatgataaaaatcattgccccagtgattaggatagatttcaccatctttgacgccatccgtgactttacggggaaccccgttacgtccggctgtcattacatcggcaatgctaacgcccttgccatcaacatcccaagcgccttctaattgatgggccgcgaccgcgccaccccacagaaaatctttgggcattttgtatccttttgtcatgaactaattccctccattaatgctgctcaggctatccctgagttacagtctttgttaccttaactaacgaaaagcgtgtaaccgccacgtcaccgttgttaagctgtctgccattataagcgaccacggcatgaatgaaaaaacaagcccagaccaacaccagcaggtatttgcctaggctcaaattaattaactacttcgcctcatcggcagctaaacgccgataaacgtctacaacttcaccagctaagtcgcggaaggtgatggcattcatgatgtgatcttgtgaatgtactaataacaatgacacgtgggtatgttccccttgtgcttccgccgttaacattgaggtttgtgaattgtgtgcttcggttagaaagttatctgcttcctttaacttggcatcagcggtttcaaagtcgccttccttagcagctttaattgcttcgaaagcggaactctttgcattaccaccattaacgatcaaacccataatggtttcgagacttgcttcaacttcttttgtttgttcttctgccatttaccctcatccttttagcatttattcgtgtgcatcacaatcaaaatgccaccggccgcgattgatctaccttgggctggtagcacttacaatttaatgattagtttgcttttgcaattgatgcttcggcttcctttaaaactttttcgccgttcatcatgccgtagtcttgcatgttgataacttcaactggaatatcaacgcgcttttggaaatcacttaacatataacgaacttgtggtccaagcattaaaatgtcaggattcttttcagctaacttcgcatcagcgtcactggcagcggttgcaaaaatatctgcatcaatgccttctgcttccgcagccttttgcatctttgagactaataatgacgttgacatcccagcggcacataccaacataattgttctttcagccataataaacacgctcctagattgttttaaatttatatgttacagcggttgctttaataaaccgctttcattacaattagaattataagtcatgggtacaaatttgacaagccttattaatcagatatctgcaatttatttgatttgtacccacaaattattaaataacaacttaatattcgaaagaagtgaacaccatgtattgtgacattgcaaccaaactcgttgccgccattcaagacggcatttttaccgtcaaactccccacggaagcccaattaatggaacgttaccaagctagccgcaacaccattcgcaaagcgattgacttggtgtaccagcaggggctcctgcgtcgggttcaaggcagtggctattatattactaatattcagcttcaacataaaacggtagtgaatctgtcagcacgctcactcttcaatagtcatgtccacccacggactttaacttcgaagattctgacttttgatacgatccacggcaatagtgccctgagccgcaaactcaacattcccgtcgacgaagaactgtatcgtatcattcgcctccgctactggcacgaccaactgtattgtttggaaaaggcctactacttacgctctgtcgtcccctatctatcgaccgaagctgtcaatacgtcaatttgggacttcatcaacgaagcttacggcatcgggattgctaacagtgatgattatctttcactcaccaatcttaacaaggaagaggccgaactaatgaatttggcacagggcgcaactcacttggccttggattcttgtaactattataagaataatggcttactagatttttctcacaccatctttgtttatcccgacctcgcattgtattttcatacgacaaatcttgcaaataattaatttatggctaaaaaaagacgattcactataatttcatcacaatttatgggtatactagtaacagtatccaaatttacgatggaggaattagcgtgtcagcaccccttttttcagtggttgtaccagcttacaaccagcacaaatttatagatagctgcttgactagtctacaacgccaaaccttgacagactttgaagtcttcgtggttgatgattgttcgactgatgacactggtgaacagattgccgcgttaatcaaaggcgacgaccggttccacgtgatcactcacgcccataaccggggcgtctccgcagctcgtaactccggtatggctgctgctaagggtaagtacctttgctttgtcgatggcgacgattgggtcgaaccagactttctggcaaccttcttagccgcctaccggtcagcacccgatacccagctcgttgtatgcggtcactacggttacttagccgttccgagtcctgccaaaacatacaaccaaaaagacttgattgccaacatcaactttggcacggttggcggtttttcgtggaataaagcattcattcgcagtattattaccacgcaccacctcaagttcaacgaagatattgattttcttgaagaccagttgtttgcctttcgttacgctaactacgtacagtcctccgaatacgtaccggaccggacttaccattaccgttggcgttttcgaagcaaccttgctcacattggaattccattcttcaccgctcgtcgtaagatgatgaagattctcaagcaggaaaacaagcaagttttgaacgaagattggaataatcagtagcaacgttacgttgccatcgcccctaaaggtcggtagctgaaatagctatcaccctttaggggattttttgatacctagcataatcggctacgatggccagaagatgcgcaattattcgaggctagtagccatccactcgcagtctggaatgcgcttccaccgccaattaaaccgaccgtggcgcgaaacaagctagctgctcaaactctttttgatatcagcgacaaaataaagtggcaattaacaattaaagacttgttgaatgacgagtaacgctttacaattggactatattaattaatttgatgggagggttagcgatggctacgattcacttatacttagtccgtcatggacaaaccaagctcaacgcggccggccgtttacaaggcatctatgattcggaactcacacataccggcgtgcgctccgcccaacggttagcccgcatgctagcagatgttcatttcgacgctgcttacgtcagtgacttgggccgagcacaacaaacgagtcgcattatcaccgcactccatcctgaaataaaaaagccgacgattgacgtcggcttacgcgaatttaacttcggtgggcttgaaggtaccagaaacatgtggatcgtcaagcaagtccaaaaacaattgggcattggaacgtttgttaagttgatgttgagtcgtgaacgcttcgccaccctactatgggtctttaactccctcgaccagactcgtggcgccgagactttggtcggtgtcacggatcgaatcagtagcgcgctacgacgaatctgtttgtatgaatctcaggatagtcagcatgacaagaatattcttatcgtttctcacgggctggttctcagtgcattcctataccaaatcagcccccgtgagcttcccacccgactcctgaaaaatacaagtgttagtcgcgtggactaccaaaatcggcaattcaagttgatcgacattaatatcacccctaagaagcgggcctagttgtctcgatgctaacaggttgcgtggtacaactcggaaattgcaagcgcgcctgaataccaaaaaaggctttgattttgcgttgtaattcttgaccagttgcatgcactgaagcttcactggcatctggatcgccaactacaattaaaatgcgactgcttttactatccaaattaggcctgattggggtggtagcatccgctgaaagactggccccttgtgccgttaaatgaagctgaacctgctcagtgccaagcgtattcatatcccacgcattgatctgcactggatggcgcgcgtgaatcacttgaagcaagtctgccaaagcattctgcggctgagcaacggcaagcccttgtgcagctaattgtttttcaattgctggattcaactcacggttatcaagattgctcatcgacaaaattgctagtggaatttccgtggtagtcgtcggtaaaatttcaattttcaacagttatcacttcctaaaaacacttcaatactaagtgtgccaaatttgacgtaaaagtcaattaccaccacttaagtcatagcgaaattttaataataccacaaaagcgattcccacacacgtgagaatcgcttttttaatggccttattgtcctcgtcgatacaccgatacgcttgtaagctgaccttacttagtcgttgataatgggtgggccgcgaagtatttttctaagaatagtgccaaaccatcattataattcatatcagttacatagttcgcaactttcttaacttgtggcaaggcgttgcccattgccaccgataagtcagcttctgccatcatcccaacgtcattcaaaccatccccaaagacaaacgtgtgggcggcatcgacatgttgctcacgttgaatttgtttgaccgccgtccccttatccgtattcagaggaatcatctcaatattattcgggttcgatgatgaaagtcgcaacaatttactattagtgagcttttcgcgggcagaatccagccgtgacatgtcttcacgactgagaatgacgccgttcgtaatctggtcctcaatcgtggctaattgcgtaaaactcttcacttcttcatagccaatcgagacttcatccgcatcaaagttagccgcattacgagcaacgaaccgtgggatttgttccgtatagtaggccatgtctggcgtgaacaacatcattggtaagttatcacgacgtgcaatcagataggcaagctcaaccgcagcacccccgagtttggttagctcacggccctgggcaccatcgaacaccgccccgttagacgtcaccaaacgaacgtcagcgtttactttgtctcgaacaatcttcgccagttcgtacatgcgccccgtagcgatgtaaaataacacgtcctgcttctgaaaccgttcaatcgtcgctcgagttcgctccgagacatattggtgatccgttaataatgttccgtcaatgtccataaagactaaatattttggcatagttgaactcctcctacgtatttacctatatgttgtgctagctaactgatcatctgtgacattcagcttgactgcttttgctgggtttgccaatcagtcggtaccatcctgccatcgtcagtaaatacgtaaattagcgtatccgcactgatgagtaagccggttggctggacttgaatgggcttaaattaaaaagatgacgcaccgccgccttttttagcaatcataattagcacaaggcttatttacactcccaattgtacgctattccctcctataatggaaatcgctttcaaaaccgaactagccaccgcattttcaccacgtaaggctaaacaatcttaagtttagaagctatttagggcattatttgccctcatcagctttatataccaaagaattcaatctaactacttgacattcaccagtctagccactaaattagagaacaattaataaatgatgataaaaagcattgaacagttcagtagttgccggccgttagccttagcgagtctgagatgatgtgagcagacctaatccggtatcacgaatatcgactgtgagttgtatgggtgaaatcaagtaacccgtactggttaacacccattaacgtgtggtacttctttcatgatgtgcttaaggtcagtaatgtaaattgctgatgaataccggtggtaacccgcgctcgcgtccggcagacgacttcgtctgtcggacgtttttattttcatttattaataaatcattttaaaggatggtcatacatatgcattttacagtactcggcgcaggcgccatgggattacgttacggtgtgttattacaagaagcaggcaatcaagttgattttgtggatacttggcaagcaaatgttgatcaaattcatcgtcaaggtggcgtctacgtgtcgcgcgatcaccagaatcgacacttagttcccgtcaaagtctcaactcccgaagattataacgacgatcccgacgtgtgggtcgtatttactaaacagatgcaacttgctgattttttgactcggacggcccacgcttttaatggtcaccagtacgtgctcacttgcatgaatgggatgggtcacgttgaaaaattattacactacttcaaacccgacaaattattagctgggaccgcactagttgctacggtcttaaacggccctggtgatgtcgacttcattggagctcgcggcgccggcaccatgaatctcgccaattatacggaacaccctgacgaaatgacccaccgaatcgtgacagaattagataaatgccaattccaccctaatttaacaacgaacttccgtggcaccttgctggctaaagtcgtcttcaactcagtggtcaacaccctctgtaccctctttgaaattacgatgggcgaattcgcggcctatccaggggctgatgagctgagtcgtcaattgatcgatgaagcctatgatgtctgtgagcgtggtggtgtcaccatgttgaatacccgcgcggaagagctcgcctctgtcaactacgtcagcaaagtggctaatcccctccactacccatcgatgtatcaagatatgtctcataatcggccaactgaagtcgactatatcaatggctacctcgtcaagctcggccaaaagtaccattaccaagcaaaaacgcacgcgtttctgacccatctggttcacttggccgaaaccacccgccaaaccagtgccacaactgaacacactactgaacaaaatacgcagaacgcgaccgaacaggctagtcaacaagcaagtgcgtaaccgattccccttttctcagcaaaatcatgtacaatggaggttaagttgattttactgaggaggcggtttgctgtgcaagtcagtcgggaattcaaaggtatctttcttgctagtatcagtgcgaccttctgggggatttccggagccgtcgcacaaacactttttgatacgaccgatattaattctatttggttaacaggaattcgcatgctgggtgccggaatcgcactattactggtcagtttactgacccatgttgatttgtggtcgatttggcgtcaaccccgtgatctcctacagatcgtggcctacacattattgggcctaatgccggttcagttcacctactttttagcagttgaagctagtaacgcggcgaccggaacaattctacaattcatgggacccgtgttcattgctctgtggatgctagtcgctcatcggcaattgccgacccgtgcagaaggccttgcgattatttgtgcactactgggctcattcttgctcgtgactcacggcaaccctcagaccctagtcatctccgtctgggcgttgatctggggactcttatcaggggtctcgtccgctacgaataccttgctgccaaccaagctactcactaagtacgacccaatgaccgtcaacacctggtcaatgttgttagggggtatcttgtttaacatcgttcagccagtctggtcgatccatattccactgactatgcttaatatcagcaagttgacctttgttgtgctgtttggaacattgttagctttcctattcttcttgcaaagtttgcaatatatccggccaaccattgtcagtctactagacgcttttgaacctttatccgcaaccatcattgcggtggttctactcggtgtcagcttcggttggctcgacattctgggcagtgtcctgattattagtaccgtctttattttggctattgggcagggtcccaatgatcgcacggcagagaatttcaagcaaccataaacgatgactcataattatgaaaccagtaaaagccggttgtgactaagtcctagtcacaaccggcttttacattgccgctaccgttacatatattcaattaataaccacgattcagatccacttggttacgtaccagcgtgccatctttgacaaactgtgcaaagttcgccgcaaagattggaaaaacggtcgcccgaaagtgggcaatttgacctgaaatatgtggcgtaatcagcacgtcatctcgttgccacaacgggtggtccgccggtaatggctctggttcagtaacgtccaacgctgccatactgagttgatgatgatccagggcggccattaacgccgtagtatcgaccgccggaccacgcccaatattaatcagcatcggttgctgtttggtctgctgaaataattcagtactaaacaaatgatgcgttgttggcgttaatggcaaagcgttgacaataaagttagccgttgctaacgcgtcagccgtcgcagtaaatgccactgtttcatgaaaatgatcagcggggtgaccggtcgtattgaccccaatcacgtgcatgcctaacgcactagccttagccgctaacgattgcccaatttggcccgtgccatatatcaacaactgttgcccggtcaaggtagatgtcgtcattggcaaggcccattgccgtgccccgcgctgattcagccaggccgcatggtacccccggactacgcttaacatcgcggctaagaccgattcactaatcgcatcggcgtgaataccactcgtgtttgcaaccaccaccccggccgcttgcaatgcctttaatggcaaataatcgacgccagctgaaatgacctgtacaaactttaactgattggttggccgcgctaggatcgtctttaataacggatgattaccatacatgacttcaatttggtcgtaatcggccgccgtgaccgccgccgcatccttgaacgtccagtccggataagtggtttgtaactgttgcagctgttcaggtttggttgcttgagccatcaataccattggcataacttattaccccatttctaatttcttgatcaatacttttatcataccactatcattcacttgaaccgtaatgatccacaaccggatattagctaagattggccagtaagttaggctgacccttttttagcccacagtttggtttaaatcacaatgtttgacgctactgctgacaaacggctcgcaaaataccaacaaaaaagcgatgttcgaaagtcgcactcccgagcatcgccaatcggtaactaacctaattgggtttaatcgttgaccaattatttaacaaccgcaaagccaccggtccagccgatttgttcactggctgctaatgtcatttgcataaaccccatcgcttcaagctcacgggcccgctttaacttacctgcatccttcacttctaacggactgtcagccaaggcgcgggtgaagcgttgcttggcgctatcgtcattaccagcaactaacacggttgttggtttcttaccattgacctgcccactctgaagcgtcgccgcaaaagtcgtattgaaagccttgagcacctgactatctggtagttgctgctgtaattcttgggcagccgaactatcagctggaacaaccaagtcatcccacgtgtcaaaattcaaggggttcgtgatatcaacgacgattttgcccttcaactgagtcgcgtactgtttagccagcgcagctaaagcgggataaggtaccgccatgatcacgatttcaccgagcgttgtggcttggtccttggaaccataataagtgacctcgtgcccagcgatttcaaaattatgaccaattgcttgccccatgttgcccttaccaaaaattgtgatttccatatcaaaacacgcctctttcgctttataattaattttatatttacatcctaacattgatgtcccatttacatcacttttatgtctgacagttaccgcaaaccggtcgtcaatcgccctagctagtagtcgctccttgaatgacgacaattagtggaactaatggctaatcagctcggatattcacctgcctgcacgcttcccaggttattgacacgagtcgatcagtcactaacgaccaaaaaccgaccaacttaattatgaattaattaagctggccggtttttaaattttcagtcgatcatcaagtttactggtctgttacccccaaaaattaattattgcccgttgccgtactataaccatctgtagaagaagcagtgccaccggtcgttgttgaagacgtatctccataattcgtcgttgagctactatcggtgtttgcactataactgtagctaggcgtacttgagcttgacgttgccgagctcgtgtccgtatcgttgctataactatgcgttgaagccgaactactgttgtcactactttcactataagtcgaatatgatgaactcgacgatgattctggttcactatagctatacgtgctcgaacttgaggttgaagacgatgcgttattcgctttcgccaacttcttgcgatccgtaatcaacttctggtaatcatcggccgctaactgcgactttttgcgataagctttcaggtttgcaagtactttatcgactgtcgttgacggggtcgaagccttgagtttatttttcttgttatataatttttgaaaatcagcatcatagctgaccactttcttaaccgtttttcccgttgtcgtaaacaacttgtcatacttcttagcaaagtacggcttactactcgttaagccagcagtcgtcaaccgctgctgacccttagtaatggtgtccatggtcacgtcggtcttaagtaaccccttagcgttgcgtaaatcttggtaactagtccggaccgtcaacatcttagcagccgtatcatgctgtttctgcaaacgggtcttttcacttgaatccttcatattatcaatattattttgcaacttggtcaaagtcgagcttgaggcactcgcccgcaagtcccgttgggctgatgatgtataaacttggtccacgatcttttccgcattggttcgtgccgcagcttgagtggcttgcccatggttccacatgaagaaagctccaccagcagcaacaaccagaatcgcaacaccagccaacatcaacttccagttatagcgccgagctggcttcttaagatgtggattcttttcatccgtttctaactcagaaaagtcacggtcgtcatccggctgatcatcatgtggtagccgctgttcttcgtgccgagcgacccgtgacatggttggcttattgggctgcttgccaccgttgggctgctgatcaccatacaactcttcacgtgataatggtaactcaggctgcgtgtcatcatccgcttgttccgtccccttgaccgcaatccgcggttgctgtttacgagcaaccggtggaatatgatcagctgggatgcgcctttcgaccttcggctgtttagcagcagtcgcttgcggatccttagcggttgtggccgtggcctgagataccgcagatgtcgctgacttgggggctgtggacttcggggccgtggattgtgctaccgcagatgcggcggccgcggcactcgatgtcgaagcactagactgttgactgtgcgtcttggcctgactggcagcttcctgactagcacgccgggccatccgcgtcattggaacttccgacgttgccgccgactgatgaaccttggtacttgctgttgttttagccacacgcttctgatcagacactgcggtgctggttgcttgtgacgcttccttagcggcccgcgctggtgccgattgagccgcactagctgtcgtcgaagctgcgtgcttggaacgctggtcacttactgcctgtgatgagaccgcgctggccgtctttggcgccgcctgacttgctgttgaggccggtttagttgcggcggactttttagttatttgcgcggattccgcctttgacgacgactgagaaccagccgagcctttttgcttaaccgcactagtcgccccatgcttgacgggtgccgccgattgttttacagcctggcgattgtctccggaatggcgcgcttttttagccaccttttctggttcaattactgcgtcaacaggttgcttttcggcactgttattcgccgtcgagcggggaatattgaccgttgattttgcttcggcttcgtccgcctttgatgcggccgagtctttcagatcataggccaaagggatctgttcattatcttgttcagtactatcatcgtcgggaattggctcagtaatcgaattccagagccgtctacccaatccttcttttttattttttctagacaaaaccaacgctcctcgccaatttataatttacattagattcctggttaagcgccgaccaaaaatttttatcaatttcggtaaaataaccattaatagttaaattatagcatggaattggctactgagaaaccactggtcaagcggatttgtgaataactgcccaataccttaaattaaggttaaaactctgctataatcggcttatcaagatatttgaaagcgaggagttcatatggctactgcgaaagttatttttgctaccattaccggtaacaacgaagacgttgccgatattattactgaaaaatttgaaaagcttggggtcgatgttgccaaagaagaaatctcgcaaaccgacgcaactgaattcaacgatgttgatatttgtgttgtcgtcccttacacctacgatgagggcgccctccctgaagagggactcgacttctacgaggacttacaggatttggatttaaccggtaagatttacggctgtgccggctctggcgatactttctatgatgatgattattgccgcgccgtcaccgatttcagtaacgcgttgaagaaggctggggctactcagggtgccaaggacgtgttcgttaaccttgcaccagaagctgatgatgtaaaagccctggatgcatttactgaacaactcgttgctaaagttcagtaacctgactagtttgattgagtgaataacaaagaaacgcttcaagaattcatgactaattcttgaagcgtttcttttattaactgctatcgacacatcatcctgacgctgataccgaaaatcacaatcaccgtaatcacttttattcagtccttacgatttcgagcacgttgtttaatggcgtttcacacgccgaaatccgagccaactaccgaacatggtcaaccccaatagcactgttcccatcacatttgcacgacttggcgcttcaccagtttgcggtaaagccgatgtgccgagtttggccgttacaggctgaacagctaccgaagctgattcagtcggccgtgattcttgatgatgaccgccaacggtagtttgcgcgtgttgcagactagctgtgttggtcatctggctccgatgcggccatgaagtgactactgatttagccccattagccgtcgtttgcatgccagaattacgatccgcaccctttccatgattcgtgccaaccgcgggtgttgcgtcatcaataactgcatttgcatcaacgtcagccgcatcaccctccatctggtcagcatcattcgtaggtatttctgcttgatcatcaccatcgatacttccagtcgagccgccgttcacatcgtcattggtattggtagcgcctggctgttcagtattcgtatcgccatcgctcgccgcaacgaccgtgactgttgccacgcgagtgaaaatttgaccactcgcatccgtatactgataagtcacctggtaaacaccggcttgattagtatcgaccgtgccagttacgactaggtcagcaagcgacaattcaccgccattaacatccgtagccaagactaaattatcgcttggttgccacgactcaccgacagtaatagttgaatcatgaatctgtaaatcgctttgggattccgcctgttcatcggcctcctcgataaccagcgttaccgtcatcgttgccgtcaccaactgaccagtcttgtcagtaaattgatacgtcaacagatagtccccggctgtagtccaatctggcgttccaacgacctcaatggccgaccagtctaatgtttgaccatcactatcagtggcattctgaaaattgctttggggctgccaagtactggttccctgcccatccgtatgcaccgttgcgtggttttgatataagttcaaactggcttggttttccttaacagttacagtaatcgtctgcgtctgactaccatacgtgtaagtaatctggtaatcacccgggaccatggtgttcacttcacccgtcaccgtcacatcgttaaagtcgatggcgtgaccgtcctgatccatcgccccgtcaaaaccgtcctgcgcatgccaagtgccaccagcgtgtagttccgtatcatggacagttaaacttgtctggtcagccttcacgatcaccaaagcagtgaccgtcttacccgcatacttgaaagtgacccggtaagtccccggctgactagtatttacccggtcacccgatagtttcacagcctggggattagcttcatagagggcctgaacatcgactttttgaccaaattggtcggttaaactctcgatactgtccgtccagttccaatcatcgccaacttccagggtaatgtcgttggcatcgataactgcttggtttgcttcccagatgtaggttccaatcggcatattttttcctgaatacagattcatcagttcagcactagttaaccgttgctggggattggctacatttatccagtaaccggtatattggtcattagcttcaatgtccattagcccaaccgactcgattttggctggcgtcaaatcagtatccggaccaagtgtaattttttgtagacgctcacatcccgcaaacatgtcgagattttgttcaacgcgatgcaaattaaaaccagatagatccacctcagttaaattggaacatcctgaaaatagcaaatgaatccaagtaacctgatctgttttgaactgagacccgaatttaacactggttaagttgtgcatgtccataaaccaagcagccatattgtcaaggctatcagtcttccatttggataagtctagctccgacaaccccgttttgataaacaaaccgcctgcttcttttaggctttcaaagttcaaattctcgataccaataatacgagttaacttttcattgggaccaaacatgtagtccgcttcacttactcgacgagtgtcccaccctgaaatattgattgtcgttagttggctagtccctggagaattgaaaaacaggtaagacatatcagtcacatttcccacctgccagctgctcaaatctagctccttaacatgcgtattttctgaaaagaaatatcttaaatccgtcgcagaactaacatcaattttttcaagcccttcatagtgttcaacattcgtcaaattttcaaagaagcccccactatcacctataatgcgaattggctttgaaatcacaactttaactatttgtaacacccacgattttgattgccacggactatccccatagcaatcgtaaatttcgccaccgtccaacactaatacaccagaatccgcgtcaaaatgccatctaatgccatcggcgttgtacccagcaccccagatgccggccatcgagtcgtcgtcttccatatcatcgttgcgataaccatccgtgagatgtgggcgttctggatttcgaatcacgccagccaaatcaccgcttccccgctcattgatggtttccgttttatgctgcgacgacaagacttttgcagtactatccgtgtcaatatcttgcgactgctcgtcggcattaactggctgttcagaatcatcagttgtcgattggttcggatgcgtatcaagtgttgcagtatgttcgtctgacggaacgggggtctcactgtcaacttgatccgtgaccggtacactgacctgatcagaattcgcatgctcatcatcagattgattgacaatctcatcagtatactgctcttcagcggcctgcactttaattggttgagcttcagttaccagttcactcattgcggattcatccatggcgtcggttactggggattgctgctcagcgttaccttcagacaaagttgccactgccggttcagtcaatgcttctacgtgtgttgattcatctgctcgtcccgtcaccacattcatgttcaacgtaacgagcgtgattccagcgaacaaccacatcttaccactcttgtacatcttgtaccgtttcttcacttgttccattaatttctcactcctttattaattaaccttgccgacgtttaatgccgacgatgctggctaaaccagtcaccattaacatcatgagtcccagcaacccgaagcgattaactcgttcattagtttgcggtaactcaccagctactgacgctgaatgactgactggggccataaccacttccggttcagctgtatcaaccgtagcataccgtttaccatcaattctgccctcattgcgttcagtcgtgtccagtttcaatttatcacgaaacaccgtggtcacttgcttctctaaaccaccgttaaattctggtcgcactatcgtgtttgcttgttctctttgactgctggaaccagcgtttgcgcccgttaaaccactgttaggatcactagtatcagggtgttcagtagttcccggttgttctgattgttcaggaacttccggcagttctggttgatcaggtgtccctggcgctgacggttcccctggtatttcaggggtttcaggggtttcaggctgttcgggtgttcctggttcttccggtaactccggttcagctggttctcccggtaacggcgtttcaccattgccagcaccttcgactaccgtaatggtggctgtttgagtccactgcaggccattggcgttcgtgtattgatacgtgatttcataagtaccgggttgcgtcgtgtcaacgtcaccaatcacaactaagtccgctagtgttaatggccgtcccgtcgcatcactggctcttacgaagttgtctgccgcctgccagtggtcgccaactgtcaccgttgtatcttgaacaaccagttctgtcaggtcttcaacgtcagcctcttgttcagtcaccgtgacggtcgttgtcgccgtgactaactgtccggtcaagtcagtgaactgataaacgacctcatatgtccccggccgtgttaagtctggttctccaagcaccgtcacgttctgccattccactgaacggccatctgcatccgttgcactcgcaaaattatcccgtgggcgccagaccgcacttcccgttgcgagatcaatttcaaccgcaacctcttgcgcatgcaagtttagttgactttgattagccacaaccgtgacaaccacggttgtttgccgacccgcataagttagtatcacgtgatacgaccctggctggctggtgtcaacaggctcaccgctaactgtcaccgcttgggggtctgtactgaacaagactcctggatcaactaactggccattttgatcaactagttgcgcaatattttgtgtccagtcccatttttgattcaagaagagcgtgctgtctttaccggtaatcgcggccgcagagacggtttcccagacaaacgtcgccgtgttagcgtggtttcccgaatattgcgccaggagttcagcactcgtgaacgtttgcgagctatcagctacgttgacccatttgccggtatatttgctattcttaggcacttccggtaaatcaactaagggttgcgtgccgtgttgactaaaatcaagtcccggaccaagtgtcaacgtttgcaaacttgtcaaaccagctagcatttgccagttttgttcaacattctgcatattgaaatgggacaagtcgagcacctttagtttggcatcatcattaaacaaactattgatttgagtgactttagcgacggtaaactgcgtaccgaattcgatacgctccaaatcggacatctgcgcaaaggcaccatcgatttcaaccaggctggctgaatcaaagctcgtcagattcaagtgacggacgcctgtgcgcgcaaacatgttggccatcgtcgtcacactgcgcgtatcccagtcagtcaaaccgtcaatagttcgaagttggccgttgaactggaacatattttgcatgttggcgacattatgagtatcccagccactgagattgaggtatttaagttcagtacccatgaagttccccataaacatgttcaccattgtggtcacattgccgacttgccaagcactcaagtccagtcgctctagcgaggtattttctttgaacagagactgcatgttggtcacagcactggtatcaatcttttctaacccttcgtaacgcgtcacgctgtcaagattcgcaaacagactattcatgttagtaccggcaacaattttgtcagcaatcacgatacacttgatcatcggcgcccaagacttgcgacgccaaggattatccccataactgttatttaacgtgcccccgttcagcgttagcgtgcctgtactggcatcaaagtgccaatcaacgccaaagttaccagacatttcatcctcatccgctctagtcacagcacgagtatcaacgtgctgtgactccaccttaaggtcatctaccagctgatgctgctcaacttgttgcaagtcagcggcggatttacgttctgacgcgtcagcagtatcgagtaataactgttcactcgcttcaggctgttgttcactaacggtcgattctgcggcattactgaacagatcgtcagtccgtgatgcttcataactgttcgtcgcgggcgctaccgtatttagtccgttcactgctgccatcgaatcagcggctacctcactattgggcgcgccagatgtcccgttcaacgcagccgttgatgcagcggattgcggctcgtcattagtagctggctgtgcatcgattaccgtctgattagtaatcgaagcgttctcatcattagccacgacaacgttatccgttttagaaaccgaacttgccagtgtttgattgctgctaccttgattttgaattaacacaccgttagtcgctacgacactcgtttcgctggtcgatgcagatgttggttcatccgcatgtgcggttaacagttgagtattcaacaataatagtgaagcgctcgcaaacaaccacatcttgccacttttatacattttataacatttcacttctgattcacggtaattgataataattccccatttcttcaaaaacaacctaactgacctaacgattaatctcattaaataaagtgttcttactatatttgattatcgtgtttaactagtacatcatttacggtttttaaatataccatggtaccctcataatgctcaactgattatcacaattctaattaacctgttatcattatgattaatccgcttgtttatcgcaaaaatataattatcaactccctatttctgcaatcgttttcatcgtggtgattcattaattctggtcgttttagtattcgaccaccactattcgttcaccatactgacagttgcatcatgcaccggtcagctgtcaccatggcgactgaccagtgtcttccagtaatccccggccatcaaaaaagccttgagcaatattactgctcaagacctggtttacccattctaatagcgtatttccctaatttgaatcgaaagactccccccgcgtaatcatgagctagtagatacgataattgtcactcggccccgagtcatttggatcgtcgtttcacaacgatttgtcgaatcgcattataaactagctcaacgatgacaaacagcaccgtgatacccacaatatcaattaaatacgaactaagtcgatagcccaccttgccgatccacaaatcatacggcccttgaatcagtaagaaatagatgactaacgtttcaaaaatcgtccgggtatgccgccaaaacgatcgccattgcattgatttcacgccccttcaagtggtgccaacatttgtaacgcctgtttgacctgactcactgctaattgactttgatcaccgacccggccgacgtgtccaaaggcaactgccgaccccgtcaactgactacagacactgttataacgaccaaacttgcccatcgccgttgccacgattggcacaactaattgctgccgtgcttgctcagttgccgccattaatgccaacaccgtctgtgcatcatgtccagccactgtcacccgcacgacatcagcaccagttgctgctaattcgtgataagtcgccaataaatcgtcagttgttgctgtcgtgacggtctggctcgcaattaaccgaatttcgttggcacgcatctgtttggtcaacgtcataaaatctggctgattgaccatggctaagtcaatatccacgccagccacgcttcgattattcactaatgtttgataagtttgataatattcggtcacttcagctggatcgtttgccagcccaaacatggcaattaatggaatcgtccccaaaacttgttgcaattgggccgctgtattgactaactccgcacggttatccaattcctgataaggatctaaccgccaaacaacaatttgtgccaccgaagttaaaatctgccccgctttacgcaagaggtcctcccgtgtggcccccgctaaaacaacaccaatcttaggcatccctgtcgctaacgttaactccccaactgtaacttctttcaagaccattcctgctttcattttcattcgaacaatgcgcgtccgttgccgttaaattttatctcctcttaacaatagcaaattttcgctgttttgacactcaaaattcattttttgacttaaaatttaaagcgcttttaatattaacttgttaatactggcaccgctttcaatttggccttacaattaagcatactttagctcacaaaggagttcaacatggaaaacaaaaaacaacttcgatggtccaacattgctttaattgcattcgtggcggtctggggcctaggtaacgttgtcaataactttgcgttacaagggctttcagtcgtcacttcttggattttaatcatgattatttattttattccctacaccttgattgtgggtcaactgggttcgacctttaaggatgctgaggggggcgtctcatcttggattcgagcaacgagtaccaagcgcctagcttactatgctgcctggacttattggatcgtgcacattccgtacttagcacaaaaaccccaagggattctaattgcattcagctggctgttccgcggtaatgggaacttcgtcaacacgacacctgcgttagtcgttcaagccatttgtttagtgctattcttattcttcctctggattgcttcattgggactaacgacactgaaacgcatcgggagtgttgctggtacggggatgttcatcatgtcgattttattcatcatcttggccgtatcagcaccgtttatgaccaaggcgactgttcagacaccgaacatgttttcactcaagtcctacttacctaagtttgactttacctactttacgaccgtttcaatgttagtcttcgcggtcgggggatctgaaaagatttcgccgtacgttaataaaaccaagaatccgggacgtgagtttccgttaggcatgttagtgctcgcaggtatggtcgcaatctgtgccctgctgggttcatttgccatggggattctgtttaactccaagcacattcccgctgatttgatggccaacggtgcttactacgcgtttcaacgactaggtgccttctaccacgtgggcaatctgttcttgatcctctacgcaattgccaatgtgcttgcccaaatctccgccttagcgttctcaatcgatgcgccattgaagattttgcttggtgatgccgaccctgaatttattcccaaaaaattaagtaaaatgaacaagaaggatgtgcccgtcaacggttacatcttaactggggttttggtcagcattctcattatcattcctgcattagggattggaaacatgaatgaactctttaattggttattgaacttaaattcggtcgtaatgccgatgcgctacctgtgggtctttctagcttacatgctactcaacaagcacttaaaggaattcaagagtgattacaagttcctgaaaaacccagtcgctggccgtttggtcggtgcttggtgcttcctatttacagcatttgcttgcatcctcggaatggttccaaagacttcctacgctagcaatcctagcagttggctcttccaactgactttaaatattctaacgccaattatctttgttgccttagggatgattttgccgatgattgctcgtcgtcatcgcactaaaaccgcttagtgcgtcaccgatctttgcgcccgcatcgtcgctctacgcctgcggactcactgacttttttgtaacgttgatcgataatctattcgccaccgctgacagcgcaaaaaactgtcagcggtggttttgatattaccaaccgttgctagtaggcatgcgtgttcacatagaatttcagtcactaatttgcggctcacaatcttacactttttacacgtttagcggtatgatgcttagtgaatatagtcaatccaaatttaccaagctgtcgctcttcaaggaggttcttatctatggctaccgtcgacgctctcgacatgtttttgaccgattatgccaatatctctcgttacctgaatactcgcttaaattcactactgaccacgcaacatcttacctttgacgcttttttaatcatgcatgaaataggtcaaagcccccagccactattattaatggagatcgcacatcagcaccatgtctcacgcagcgcaatctcacgccaaatcggagtcctcctcaaacatcgatacattgagcaacaggctaatgccactgatcgccgccaaaaaggactttccttaacggctaccggccgtcacctagatcagcaactaatggccaccatgcacaaaacggttcaccagtggacgactcaattgggcccgcaacgggtgaagaccctgctaggcatcttcaccgactttaacgagcaaattatcaataatgaggttcccgccagcgattaataaccagccatcctcagcttcatcattcggcattagtcgtaacgtgccccattttagtaagctgatttttattcgtcgccatttcaagttacggcttttaaaggccttaatcaaaaaacggcgccatggatgctagtgattctagcgtccatggcgtcgttaattttcagttacaatcaaagcagcttacactacggtacgttcgtccgcgacttggccggctctgccgctagtcatctgcatgcacgtcaaaggcatgcaacaactgttctgaaacccctggcgcatctgggtcgtggtgacctttaccggtatctaaagctcgtaattgggccatctcagtcgaagttaattcaaagtcgaagatatcccgattactcttgatccgtgcactgtgcactgatttaggaaagacgatcacgccttcttgatgttcaaatctaagaatgatttgaccagcatccttatgatacttaatagccaattgttgaatgattggttctttgaataatgcttgattgccctgacccaagggcgcccaagcttctaatttaacatcttgtgccgcgagtaattggcgcaagggttgttgctgaaagtacgggttaaattcaacctgattgactgcagggatcgtttcaaattgtggcacaaatttttgccacaacgttggtgtcatattggaaacaccgatcgactttaatttcccggccttttgggctgcttccattgcttgccatgcacccggaacatcgccataaggttgatgaattaagtacaagtcaatatagtctagtcgcaacttagttaacgaacgatcgatggcgcaactggctgcatcaaagccgtagtcttggagccaaagtttactcgtcacccagatttggtcccgtggaatcccactatccttaatagcttgaccaacttcgtcttcgttaaaataggccacggctgtgtcaatgtgtcgataaccaatcgccaatgcttctttgactgcttgataagtggaaccgtcgtctggaatctggaaagtgcccaacccaattgctggaatcgcgcggccatcatttagcgtaatagttggtgtttttgtcattaataatcactccttaacttattcatgtaattgtcgtaaactagcgccaaaaatctgttcaattgtcacaggatcacgatgatcaaagaactgactgacgccctgatcaagttcggccattgctgacatttctgcagctgttaattcaaaatcaaaaacagcgatattctcagccatacgttcaggatgcactgattttggaatcaccgtaatcccgcgttgcaacagccaacgtaagatgacttgtccggtcgtcttaccatgggcctgtgcgatagtttgaatacttggattactgaaaatcgcatgcttaccttcttcaaacggtgcccaagcttcaacccgtacgtgttcaccttgattaaagcggacctcgtctgcttgctggtaccatggattgacctcgatttgattgacagctggttgcacggacatggtcagttccaagttctttagctgatccgcataaaaattggaaacaccaattgcgcgaatcttaccagcatggtaagcctcttctaaagcacgccaagcacccatcacatcgccataaggttggtgcaaaagatacaagtccaagtagtctacgcctaaacgttgtaatgacgcatcaataccttgctttgcacgttcataggtgaattctgagacccacagcttggaagtgacaaagagttcatcacgtctaagaccactcttttgaattgcccgccccactgcggtttcattttggtatgccgttgccgtatcaattaaacggtaaccagcctttaaggccgcggtcaccgctgcttcacattcattcaggtcagggacttggaacacgccgaatcccaattggggcataaccacaccattgtttaatttcgttgttggaaccatcacgcatcaacctttcactatttgattacaataacaagcatacccgcaaacctaatacttgaaaattactacttattcatactagtatacatatagcgcatactagtaacggaggttcctgatgattgaaaattatttattagaagagctgatcacattcgcccacgagcacacgctggctaagaccgcggccgcattaaacgtgacgcaaccaactatcactcgcggcatgcagaaattggaaacgatgctcgctgttcgcttatttgatcgtcaacccaatcgaattacactgacgcccactggccagttagccgctcaggaagctgaacaattattgacacaacaacggacttttgtaaccaaaatacaaaactacgagcaaagcttagtcacacgtaccgtcgaaaccaccctacctggtccacttgccttactcacccatctcaaaacggtattacctaatacattgcgagttaggcaaccattgattgccgacgaccaaatcactgagcatctcattaaccgccaggcaagtttcattttctctaatcaggaaattctgacggccggcattgaatctcgcttcatcggtactgaaaatctcgtggtccatttacagcgattcatgtaccgtgcgaaccaacctagtatcacattcgccgaacttaagggaattagcttcgtagttctaagcgcaatcggtatttggaaagatattattcagcaggccatcccagatgctaaattcttataccaaccccaacgcacggcctttacagaaatcactaaatactccgatttcccgtacttcagtactaactttaccgcattggcgcctcaccagctagatagccaagccgatgatgacaatcgagtcgctatcccgattagcgatactcgtgctcacatgccaatctatgtcaattatcttgttagcaatcgacaatcattaatgcccctattcaagcaatttgaagccgcgtggccagccaatctcaagcatacttccacgccctagcagctaccatagttaagccgttcggtctaaaactgcaaaatgaagtgttacgctcaatcacagggggtatatactggttgaagctcgccctcccagttcttgatagcaaaagaggtccacacgctcgcttagctaatctaatgcgagcgtgtggacctcttttcgtattaagtttggttcgttcaagtcttaatcttaaacatggaccctaatgtgatgattagttgcagaaaaaacagttaaacaagcattccacgccaatcatcttctaacagcaagccgtttagcagatttgaactgccgacctcttccttaccatggaagtgctctacctgctgagctaaaacggcgttaattgaccctatccagtataccaaaagcatgtctaaattcaaactgtactggttgacattcaacgtaaaaaaaaagaaatcgaattaacgattcctta

SEQ ID NO: 5 - DNA, 103144 bp, Lactobacillus plantarum
gcagaaatgcctggaggtcggtgtaggacgcgcaccctaagcaagtttacgctaactcgaactgttcccagcgaacctaagctggctgcttttgaatttaaaaaatggcacgttttaatcataatcgatgacaaattaactcgcacaatgcgtacttattccatcccaatactaatgtccacctgaaaaagtgaaaaacttaattccattctaatacaactcaaatgacaatggtgatgtaagcgctacaatagaagtgcagaaataatcagaaacgggtgaataatgatggtattaagtattattacagtattaggaatgggattaattgcagccactggtgtgcactttatcaatggcgcacaagcgatgcacgcaggaacggtcggccatcatgttggtcagatgccagctaaccttcaccaaatcgacttacgttaatctcttaaaaattcacgttaatttttagtattgccgctgaaacactgggcaatgctttttttgtcgttcctttagctgaccgtccttatcagtttggtgccttgagcagcttgacagtcaagcgtatcattaacttatattatctttctgttcgtctagtcacgcttcgaccgaccgttcagagaaggagtgacttatttttatgaatgatttatttgagaaggccccgattcccaaagcgtatttccatttagcctttcctgtggttcttggcatggttgccagcatgatttataacttagcagatacattttttgttgctcaaactggtaatgctgatttagttgctggtattgccctcggcagtccgctattttcgtttatgttagcagttggtgatatttttggcctcggtgggagtgccgttatttcaagagtccttggccgtcatgattatcaccaaagtgcacgtatcagtagcttttgtttttacattgcgatcgcgcttagcttagtactgacagccttattattactattcgaacaaccaattttaggcttgctaggtgctactgcagctacccgtccctacattgcggacttctatcgtatattggtattaggatcaacctttatcatcgtttcactggttcccggtaacattatccgaacggagggtctggcacaactttccatgattgcgaccatcagtgggacggttctgaccattattctcgatcccttattcttatttggctttcactggggtgcttcgggcgttgcttttgccaacgttttggggtacgcggtcaacaccagtctgttagtcttttttatgcgccgagccaaaacgctctccttagcaccaaagttagcccatatctcgcgaccaacccttaaagccgtcgtcgcggttgggattccagcctcactgactaacctaacccagagttttggcatgatgatcttaaacagctacttagccgcatacggcgcccaagccgtggcggccatgggaattgttcaaaaagtttacatggtcgttatgatggtcatggtcggctttgcttttggggcccagcctttagttggttacacgtacggtgctaaaaattggcaaagactacgggcaacgttgcgcttcgatttaaaagtcgaaggtggctacgcaaccatttgtgcgattattctaatgatttttgcgcctcaacttattaaactatttatgaatcaaccagtcattgtcactatgggtacacaaatgttgcgagcaatgttgattacgacaccattagtgggcttcatcctcgtgttcacgaccgtctttcaatcagtcggtgcgggtttgagtgccctagccatggcgctttcgcggcaagcaatcttactaggtatcgccatcgttattctggcacagttctttggactaactggtattatttgggctcaagcggtcgctgatgtcttaacgtgcttacttggctggttactttatcggcacaccttcaaagatattcaagtaccatcctcaaattaataataacgatatcatgtcgttagctcactgataatcattaaatggcgccatccatttcaagtactggtgattcagtgcgctgaaatgcataagtgaactaaaagctggtacttttggaatgagaggcgtcattccaaaagtaccagcttttttcactctgattcatttttttattcgtctacagactgagtatgggctaaatcggcttctaatgacgcagtgagtgccttcaatagttttagagtcgccgtcatgttagcgcggtaataacgttcagtacctgttttgctaaccgctaaaatgccggcatccagcatcaacttcaaatggtgcgatacggccggccgtgataaggcgatttgcgctgtaatttggttaaccgtcatctgatcagtccggcacagcatcaccaaaattcgttgccgattttcgtcttgaagaattgtaaaaatcggaacacccttcttaaatattgccatcgttcgttctgccaaaaaatcacacctttccaattacggttcgtattcttaaaccatttaacgcttgctaaaattgaaagtcaagaattaatcgttgactttttgtaagtaagcgactagaatcaacagcatggtttgttcaagatgttaaacatttaaaccaatatgttaggagtccactatgaaagctgccattattactaaatacaagcaaataacccccatggtgacagaagtccctgttccgacaatagctcccaccgatgttctcgtcaaaatcgttgccgccagtgtcaacccaatcgatttgaaaaccaaagatggcgatctaagattgttactacaatacaccatgccactaattatgggcagtgactttgccggtgtaattactgccgttggcgaccaagtaccgggctttaaagttggtgatgctgtttacggtcgcgcacccaaagatcgaattggaacctttgctgaatttatcgccattgatcatcaagccatcgcactgaaaccagccaatctcaattttgaagaagccgctgcaattccattagtaggtttaaccagttaccaagcactacacgatataatgaacatccagccgggacagaaggttttcattcccggcggttcgggtggtattgggattattgccattcaactggccaaatatctcggcgcttacgtcgcaaccactaccagtgcgaaacattttgacctcgttcaatcactaggtgctgataaaatcattgactatcatcagcaagactttactgatgtattatcccattacgatgccgtattagatactcgtggcgggcaatccctcgaggccgcttttcagattatcaaaccaggcggtcagattgtcagcattgccggactgccaaacgcgcgttttggtaaggattacggactgccaatatggaaacaatggttattgggtctagcaacgcggaaactgagtcaactggaacaacaagcccaagctacctattcgtttctgttcatgcaacctagtggccagcaacttgtacgcctgcgacaactaattgaacaggacgttattaagccagttattgatcggattatccccctcaccgacatcaacgacgcgttagaatactcgcattccggtcatgctaccggtaaaatcattatcagtattcaacctaattagctaacttcaaatcaatctttttaaggagtcatgatcaatgaaaaaagttttaattgtcgaaaccaatatcactcgttaccaaggaactaatgagccgactggtctttggttaggtgaagccgctgagttcgtcgatgaaatgcagcaagcccaaattgccgttgactatgttagtcctaatggtggcttcgtgccccttgacccgcgtagtatgaaatataccgatgccgccacaatggccgtgtatgaagattctgacttcattaatcgggcccttaagaacacgctcaagcctagtcaggtcgatcccgatgattacactgctatttactataccgggggccacggtgtgatgtgggactttccggacaaccctgagttacaagccatcgcactggccatttatcaacatggtggatatgtgacctccgtttgtcacggaattgctggcctcctaaacatcaaagaccaaacgggccaatacttgattgctggcaaaaccattacgggctttaccgcaactgaagagctgattgccggcaaaaaacggatcgtcccgttccttaaccgtgaacgagctactgctcacggtgctatctttagtcagcatcgattttatcgcgaatatgcaattactgacggccaattgatcactggtcaaaatccgttctcagcacgcgcggtcgcacgccaattgattgctaaactataaaaaaacgagcacaaggctcgtttttttgcgttaatcttcaaaaatccgctcatgcaaaacaccaaacggcgcatgatcgacataaatctgaccagtgtcgtgaaatccattacgttgataaaaacgctgggccacagcattatttgccagaacaagtagataattctgtggatagaccgcctttaagcgacggtgggcctggattattaattgctgaccaatgccatgatgatgatagttcgggtgaacatatagcgaatacagttcgccccacccctcatagttcgcatgtctggccggaccaaatgtgcaaacacccacaacttcaccatcagccgtcattgccagcaacatattttgccaccgccgttccggccgccaagttgctggcgtcaattgctgtaaataacttgcaggcatcaaatcacgatatgctgattgccaggtctcataatataactgtcgaatttttccaaaatcactgtctgcttcagcgcggacgatccgataggttagtgccatcagcctgaccacctttcaattcaagttgtccctaagtgaggcacattttatcatttatataaataaggtacccaccaactattcataaagagcatcaattagatgaatgtttcacgtgaaacaaaaaacacagtacaaaaatgaatccagtacaacatgttcattttgagtttggtattgacctgaactatggccgaactcgtcgcatatttaacacgtttggcagaattacggccgtaataataatgaccacgccaaccatttgcacccaatcaatagtttcatcaagcagtacaaatgcaacaacaatcgaggctggtaattctaaagaagaaaggattgggccaatgccaagctctaagtacggcataaacaatgaatacataaccagtgggaaaaccattgagaatagtgcaatcagtactccccagccgactgttgctggcgtggtgggtgccgtaactaattgcggtgaccacacgatagcaatgagtatgaaagcgcccaaacacagtaaccatgttttcgataacgggtctaagttattgcctaagctagccgtaaactgcatcgtgcaagcatacgagcatgccgctaaaaaacttaatatcaagccccacggcgagagcgcctgcgtaattggaaacagaccagcagctaaaatcgtgcctatcaataccaaaataatgctaaccacttgcagtcgggagggacgccgatgatgaatcactgctcctagtaatgttgataaccagaccgcctgcatcaacattaccgcggccacagcaactgggataagctttaacgcctgtatgtaaaaggtgttagtaaatcccgaagccgttccagccgaaattaccagtccgatttgcttccaattcgtttgctgattacgcaaacgtgcacggcgtaaaatttgaatcacacctaaaatcacaaccgcactcagaaaggaccagaatagcaatgggccattgacaaccccctgccgacgcgcaattttaaatagtgacgccggaattccaaaactaatggcccctaagccaacgaacaggggcgcaattttcttcacattaatcatcctctcgttgacaagatatgttggagccgggcacgataccaccagtctggcaagcccagtgagtagcgcatcagcatctcaccaataatttgcacaattgggcgtcccggttgtatttggcgttctaacaagctgtcataaaagtcctctggggcactgactaagtgcccgttaagattgacccgtaacggcgcattttctaccacgagcgcttgccattcataactatgagcacgctgttcgtcctcagaaacgtcttgtgccaactgtaagtaatgctcaatatccgctggcaatacttccgataaatccgacaaagtctgtaaagctagacctggccgagttatcacttgacttagcggtaccatcacttgtctcaattgcgcgtctgtgtctgctaactgctgacacaaccagtcgaatcatcgggcatggtagaccaccatactcgtagcacgcccccctgctcaacttgagactttaatattaccaacgcttgcttgacaaccgtggcatcggtactgtgtgacatgatagcaagctgtgctggatcatcagttgtcaatcgagttaaatcaccgatttgtaacgacaatggcaaactcaatactggctggtgcaactcatgttgcaaggttaccgcgaacgtcgaattaaacgtcacatccatcatctgactttcctcaatttctattttgatggcgccttaaaatgtgctaattccgcatccgaataaacgtacgggacgtgcgccatctctggcacttgattccaagctaccggataacccgcaccatgtgcgcaaaagaccgagtccggtgtattttctaaatctgctgtggggacatattcggtcttatcgacaacagccatctcgttatgacacggccgatagccatccacgatacattccaattgcccctgcccatgcgtgtaagctcgaaccgtctgtgaatagtcctgcatcgctgctactggcgccgttcccgtaattgtcgtcaagtcagtcccgtccgtggctacgcttgtattagcgaccggtgcgtcaaactgaccattcatccgctgaatatcagtcatcgcccggccaacttgttcctgaccaatttctagacggaaccgataccacggctccaacaactgacaatcaccacgttgttttaacatcatcaagccttgacgcaacgcgcgccacgtcgcttcacgaaagtcaccaccaaccgaatgaacattgctagcccgaccactaaccagtgttaccttaacatccgttagtggtgcgccaatcaggacacccacttgtgttttggcttgtaggtttgacacgacttggtgttgccaatttcggccaagcacttccaatgaacaatcggtcgtaaattgaagcccacttccccgcggtgcgggcgtcagcaacaaatgtacttccgcgtagtgtcgtaacggttcaaaatgcccaacaccttcaacagcttgggtaatcgtctcttgatacaagatactccccgttccaaactttacagtcagttgaaaacgatcctgcaagatttgttgcaaaacttccagttgaatcgttcccatgacctgtactcgcaattcctgaagtggttctgaccaagtcacgtgtaattgtggatcctcatcttcaagttgacgcaaggctgctaagcaggtgtgtaactcctcacgctgaggatcaagtgcgtaagtcagtacgggctgcatgacgggttgtagactagttgctgcctgtcccaatccttgccccggccgcgttcccgttagaccggtaatggcaccaacggatcctgccgtcagcgcggacgtggtcgcatacttagtcccgttgtaaacccgtaactgattgactttttggtcatcatacacgatatctttaggtcgtaaggtgccaccggtcatccgaatccaagtaagccgttcaccttgatcatcgtgcgtaatcttgaacacccgcgcgccaaattcaggacgcgttaattgtggcgtcgtccaataatcaagaccagccattagcgcatcaaccccgtccagcttaagtgccgcgccaaaataacacggaaaaacttcccgccgttgaatcatctgccgaatcgtggcatcacttaacgtccctgtttctaagtaatccgttaacacttcgtcattttgcatcgcaatatcttcaactgccgcagtcggtatgactggccgatcttccaacgtgtccccggctcccggcgtgttaaacgccacacaaccaggcgataatgtctgttgaatttgttgtatcaatttgtcgctatccgtccccggcgcatccatcttatttacaaacagaatggtaggaacgtcataacgggctaataatcgccataacgtccgcgtgtacccctgcacaccatcagtcgctgaaacgactaaaattgcgacgtccaaaaccgacagtacttgttcagtctgggtcgcaaaatcgacgtggcccggggtatccaagagtgttaaattaatgtctttatattgtaaattagcttggtgtgaaaaaatcgtaataccacgctgtttttcaagcacatccgtatctaaaaaagcatcgccattatcgacgcgccctaattgccgtagcgcgccagaccggtatagtaatgcttctgacagcgtcgttttaccggcatcgacgtgggcaataattcccgctacaatccgtttcatattgggctcccttcacgattagtgaatcactgcttccagtataccggttctcagcactgaacggctagtaaaggtctgccactaacgttaaatatgcatgaattttggcgtgttttagtccaatgttaatcaccaaaatcaggctagttactttccatagttgcgatcactttaaagtagtggtgacccatttcccgtgcagtatcgcaaaaaaggtatccgtagcctacaactaccgataccttaaaatcattttcagacttaatcataaaaacgctcaaaagctgccttcaggtccattttggcttgctttaatgcctgtgataccgccaccccgttcgtttgcagtccttgtgcacggacaatctcaaaccggtcaaaccccataatttcagtaaacatcttgtcaagatacagccgagaaaattccatgggtgtataacggtcattacgagtatagattgacccactggcctgcagtaacatgacacgataattatcggtcatcaaacccactgatccattttcggtataacgaaaagtctccctggcaactaagatattatcgatatagtcctttaaccgtgccggcacgttgaaattatgcaacggcatcgcaatcacaatccgatgatgagctttaaactgttgtaggagttgctgattgattgcaaacaggcgttgttcctcaatcgataaatttacatgttgcgcttgcttttcccagattcccagcaattcaggtaccgttgcttggggaatcaccgtatcatacaaattgatcacatccacagtatcattaggaaagcgagtctgaaaaagttgcaaaaaagcttgttctagttgaactgagtagtgcgccgcattacgaaaatcgggatgtgcattaacaatcaaagtcttagtcatttaaatatctccttaattaataatctatttattggttgtttttgacaacagttatatactacagtcgaaaggtgccaatccatgtcaccattaaaatcatttttaggagttatttatatgaaccgctctgaacgtcttaatcaagaattgatctttctcagttaccgacaagaattccacatcaaagaactcatgcaagaattcaatatctccaaacggaccgccttgcgcgacgttaactcgttagaacaacttggtttgtccatttacgttgaaccgggacgttacggtggctaccaaatcatgcaacaacaactatgggtacccatcttattaaacagccaggaaattaatgcgctcttttttgcgctcaaagcactcagtttattgtcggcgaccccctttgaaaagtcctaccatacaatttacaaaaaactcatggcaacactatctttaagcaaccagcgccaggtcgccaaattgcaacgtgtggttaactactactcaattcctaacttggatgccccaacccatttaagtgatttattaacggctatccttgatgaaaatgttgtccagttaacgatgactactgtgacagctgggtttcagatttttgatttattatatcggcatggcatttggtttttcagtggcgtcaatctcgataacaatgcttggggcatctatcgctgtgatacgatcaaagcatttcaaaccagtgagcaaccagctcggtatacttggaaacagctcgcgcaacggcaacggtcctacgatcaccatcatcacaatatacgttataaatgtgcactaacacctctaggccgtgaacatgtacaaaagaataattatcctaatatgcacttaacacatcagaacgaccaagattatctcattggtggttataatcaagatgaattagcctatatggtcgactatttactgggacttggccgcaacgttagaattatttatccggaagcgttaaaaactgcctatctgcaagaactgcagcaaattcaagatttctattaacgtttggttttctgaacaaaatgtcggtagccccgtcaagggctaccgatatttttactaacctgattattctcttcttaactgctttattcagccgtaatataattcaaaattgcattcagaacttgttgattctctcgtggtaccggcgtttgtaaaatttctgctgctgtttggtttaggaccgaccccgcaatataccgataatcattgacgaccatctcacgaacattgtccgcagccggctcaaagtgaaattgtaaccccactacccgatgcttccatacgaagccctgattggtcacacgatcactagagaacaacagcgttgcttcgcctggaacggtgaacatctcctcgtgccaatgcaagaccgacagttttgctggaatccccggaatcacgggactctgtcggtaaatcggtgcccaacctacttccttagctggcgccttagtgactgggtatcctaaggtcttcgcaatttgttgcgcgccgtaacacgcaccaaacattgggatatcgcggtccaataattgttgaatcaagtctcgttcctgcttgatccatggcagcgtatcgttgggactcatcggtccgccgaggataacaagcatctccgtctcatccgccgttgggagaacaccgaattgatacgggtgatagacatacatggtatgaccatgggcatgcgcccaatcagcaatcattccagggccctcattgggggtatgttgcaacacattaattcgcatgattagtcctttccacaacggcaatgtttggtctgggtatcgcctgcaattacccaagatagagtcattataccacgctaattacttgagccatgggcgcttatgttaaacttaaaaccgatcataatttagaggtgataataatggacgtccaatcttttttcgaacaagctaaaacgacgctcaaattgacacaaagtaccccattacaaagtgcttatcagtttggcagcgatcctgataaacttgcacagctcgtactaactggcacaaaaacggctaccaccagcgcttatgacctatacgaaactgatgaaccactgccaaaagtgggcgcttatgacgtcatcttagatgctcataatcagcctgtctgtgtgacccggaccgatcaagtcatgattacgccttacttggacatcgatgcaacccacgcttacttagaaggtgaaggcgatcgtacttatgcctattggcgccgtgttcatgatgccttcttcaagcaggagtaccaaagcgagcatcagcgctttgatccccatactgcacaaatggttctggaacgcttccacgtcgtttatcccgttcactaaaaatagcgttccaatcagcactggtgaattcgcttccattagtggtatattggaatagaactttcattagggggaacgacacatgcatactatcgaacaactcaatgacggacgcgcggtctatctaaatggtcaccgcgtcaatgtcgccgatgtgcccatttttcgtaaaactttagcactcaataatcagtactatgacctgcaacacaaccatcccgaagtacatacttatcaggaaaatggtcaccgctacgatattgctttcaaagtgccacgcaccgtcgctgatttacaacaaaagcaccgtgcttatcaagaaattgcgcaaagtaacagcggcatgttaggccgcacaccggattttcttaatactgggatggccgtcttagcagaacgcgctgccttcctcgggcaaaatcaatatactgattttgcagctaatgcccgcaattacgctaaggaggtcaaagctaacgatatcttcattagccatgcgcttcaaaacccacaactcaaccgtcaaaaagccatcaatgccattccgtctggatacgcgggtgttcataccattgaacgtaatcaagatggaatcttcgtttctggtgccaaaatggtcaatacgatggccccaattgctgatgacctcctgatttttaatccgccggaactgttgttagaaaacggcgataatagttatgctgtcgcctttgctacgccactcaataatccgggcgtcaagatcatttgtcgcaaattattagatcatcccaccgcttccattacggattacccactcagcaacgcccttgatgagattgacgcctacattgtctttgatcacgcctttattccgtggtcaaaagtatttgttgaaaataatgttgaaatgagtaatcgtttcttcatcgattcaggcatgtttagccacacttcccatcaagatgaggttcgaggtattactaagcttgagttagcaaccagtttagcgcttcggattgctcatatcttaggattagatggtttcttaggtgtccaagaaaaactcggtcggttaaccgctaatctggaactcatcaagggtaccatcacccgttcagaagacaacggtcatctggacgaattcggtatctatacgcccagtctccaagctttgcaagcggttcgctcgacccttcccgaatactatgacgaggccttgcgcgtgactcaacacttagcggccggttccatagttggcgtgccaagttttgcggaatttgacggcgataatgcgacaatcctcaaccaggcactcacgacggaccgagccaccgctaaaacccgcacgcgcttgttgaacttagccttcgatttaacaagttctggctttggtcagcgccaattgatgtacgaatactatcatggtggtgatccaatgcgtattcgtgcccaacattatcaacgcgccgatttacaggctggcaatcagatgattgaccgactattgtcagcggacaacgcaaacacccatgaataagtaatcacaccaatacccaggttagtccttaagtgagtattggtgtgattttttgcgcctttatattattgactatttagtcaaatataattcgcgtaactgttgacattccgctgaggtcagccctagacccgtctgcaagtaatttgaaaatgtgtcgtaccgggctttgatgacttcaaagtaatggctcaggtaatcagcgtctactaataatgcctggttcacggcccgttgttgctcatcagataattgcgacgccatcgtcgccaagatttgttgattagcagctgcacgtgcttgatttgtgagcagatagtcagccatgatttgctcgtcactaatacccaaaatttttagaaataaggcggccccgacgccggtgcgatccttaccggcaaaacaatggaacagtagtggctgatctggaaccagtagtagctgtataaattgacaataactttgacgggcagtaggatctaacgctagctgttcatataactgaaccatgcggtcatggaccgcccccgtactactaatcatcgattgtaaacttgcgtcgttcgtcatgacttgtgctagcacatccagcacgtgatactggacgtgtggccatgtcgcatctggaaattgatgacgctcatcagcactacgcatgtccacgattcgcgtaatgccaagcgtggttgctagatactgcgtctgtgccggtgttaattgatccaattgtcctgaccggtaaattaaaccatctttgattacttgctgatttttattgcgataaccacctagtgaccgtaaattagtaatcccttccatgaccaagccccctgctagattgataacttaattgtaaactgtcaccgttaaattttcagtcaaaggccatttaaaaagtcatttagtcaccagacctaactgagctggtgactaaatgactttttaaccgctaacttgatagactcaattaatcaaagtgtcgccattcgtgatccaacaacgcacgcgctacaaatagcccgagcggtaaaaacatgatgattaacacggccttcgtcagccatagtgaaccgacaccaatttgattattgccaatactataaattgcacgataaatatataatcccggaaccataattacgattgaaggtaccgtcaatgaaatccggggatagccgttataacgattaaccaccgatgcgatcaagccggcaacgagcgccccacaaaaggcggccgcggccggtggcattgctgtcaagtcaactagttcaaggcgcaatgtattcgcaatggccccaataaatcccgcggtaatggccatcttttgcgaactattaaacattattgagaacccgtaaacgccgcaaaaactagctggtaatcgtaataaaagtaccgctaacggtgaaagtcctagcggtaagaaatcagctggcttgaagctcaccagtgtcgcgactagccatccgacgagagttgcaatcagggtaaccataatcgcgtaagctaagcgctccagtcctgagcgcatatccaacttagagatatccaacatactcgtaatgaacggaaaacccggaatcacgaataacatggcaccaatataccccgcctcatgctgggcaagaatttggaaattatattcaaaaatcttaaaactaaccatataagccaaacacgccaccgcaacgctgaccgcaatcccggcaaccgtcgtcatcgaccgtttacccatcagcgcccgaacatagttaccaagacccgcgcccaaaaaggaacaaatcatctcgggaatacccccaccaagtaagaagataaatccactacaggctaagccagctgccaacccaagaaccagtggcgaatactgtttaggacgcgtctgaacttcatcaattgctgcatgcacttgtgccaccgttaaccgtgcatatttcgcatcaaagtctttgacaaactgttcaagaatatttagtttatccgtatttacaccagtatttggtatcgataatacttgcgtataactacgttcatgatgaaaacacgtgtactgaatcgaaatcaacccgatatctgccgagcacgttaaattcaggctgcgagcaatcttattcatcgcatcacgaacccgccacgctcccgtcccacacgacaacattaaaatgccaactcgaccaacaattgatgttcgctcttgtaagctagcatgcttagcgggaacatcttcattacggataaagtccttccatggaattgtcatatgatgtcgttgtgatagtggcatcaccgacttacgctctttattcatttcttcctccgtcttagatcgttcattatgttagtagctttcccccttattttaggctactaacatcatttatgatagcgattttgtcattttaaaagcataatgtttcacgtgaaacattagcctcatgatgagtttccccagcttgttaattgaactaccccctcaaaagtaaacttgattaccattcgttaatttaagcgtcacaattttcgccgctatccgcaatcatatgataagttaccgatatcatctaataaaggagcgatttgtatgtgcactagtctaacttatacaaatagtcatggaggccacttcttagctcgtacaatggattttaacgttgactttgagacccgtattatgttcatgcctcgacattaccgcgtgacgggtgaccttggtgatttcaccacgacttatggctttattggcgcgggtcgccaactgaaccatgaaattttcacggacggcgttaacgaatgtggtgtcagcatcgcagcactctactttccgaatcatgcaatttaccagcctcacagtaaccaagacaaaatcgatctcgcaccccacgatttcgtcgcctgggtactcggaaaaatcactagtgttgctgacttacgtgagcgcgtcaaagacgttcaattgattagtagcacggcagaattaattaacgaaattccaccacttcactttatcattagtgaccaaaccggtgaaaccgccgtcttggaaccaactagtggcgagcttcgcctgattaataacccagtcggcgtcctgaccaattcaccgaacctcaaatggcagctacaaaacttaagtaagtatggcaccctgactaacaccgagcggccactaaataaattcattaactaccaacctggttcacagggacctggtacgggcgcattaggtctacctggtaactatacttcgatgtctcgctttgcacggaccgtcttcttgaaacactatgcgcaagtgccagcgacaacaacagatacagtcaacttacttcaacacatcttgaatgctgtgactattcccaagggcgccaaagtagccgccaacggccaagcaacctatactgagtaccgtagctacatggacttgaatcatcaaacgtacgcactagaactgtacgaaaatccgggagtgattcagcaagttaacttaactgatcatttattagaaaaacagaccgttccgttagaatacgcccttagtcgcaccccgcacgtccaattactcactcccgatattgccaccttgccagtggcccattaagactttcagaaaagcagtaactcaaaaaagcttgcatcacaaatctagttgattttgtgacgtaagcttttcgtattatttaaacttaggctaacgcggcttttagattagctaaggttaattcgctcgttgaagtgaagttaacatccgcacccgtcaaaatggcaggatcaccaatcccaatcgacgtttcaccagcaccattaattgactgaataccgaccttagcatcttcaacgcccgcacattcttcaggcttcaagccaagcacttccgcgccacgttcgaagatctctggatctggcttaccgtgtttcaaggttgcgggatccacccgggcttcaaagtaatgcgccaagcctaactgttccagaaccaatggtgaattcttagaagctgaggccaaagataaacgatacccatgcttggcgagatcggctaagaagtcttcgataccaggtaaaattgcagttttatccattcccttcaacaggttcagataattagtatttttcttggctgcgtaagccactttttcagcttccgtatagtcgttttccttaccacccgtttttaagatcaagttcaacgagtccattcgactaacaccctttaaattatcggcaagttcttcactccaggcaacgcccaactcgtcagctaattgatgccaagcttgtgagtgataaacggacgtatccgcaatcacgccatctaaatcaaatacaaaccctttaatatctgcaaatttactcattaatggttcctcctcgttaattaccagcacaattgattgctgggtaccggacaactgcgcaatcatcaatagatgcgccaagagtgacggctacccgtcttgttttgaagcacaccgttaatgttcacttaacattataaaacgctttcagtttcaatgcaaccggttgcatagcgattttaatgacgattgttgccaatcacacgcctgcccgccgatcaaatcgcaatggcggccccattactgccgtccatcctgaatttacggatttactaataatgactgttccaaccatttttccacaaacggttgcacgcttttatgccccgcttaatcttgggtcggaattggaatatccggtcgatactggtactgatgctgggttaaaaattgccgtaatttaaaactagcagccaatttaaagcacgtttccgcatcccgtaaatcgcatccggtcagtgttgtgatatggtgcagtcgattacgcagtgtatttggatgaacgtataattgcttagccgtgcgggtcaaattacaagtcgcccgtaagtagacatctaatgttggtaccagttctgtatggttttgctgatcataggctaacaacaaacgtagggctggattaataaagaacggtaagatctcaagatgattaactcgtgccaacgcaagattatagaattggtcttcacaaaaaatcacccgaccacggccagtcttcagttgcgccgttcgttcacaaactgtatacgcggcaaaggtatcttccggattaacgtagtgctgagacacgatcaagcggcaatccgcttgcttcgtaatttgctgcaacgttagtttaaattgattctgattatatgcgaccagactaattgggatcagtgccacacattgttgctgataagtcgaaaccaacacttgtttgaatcgtggcatcatcaagtactgtagtcgctgctgtaaaatcatcggtgcttgatcagctagtggttcgcagcggattaacaccatggctgtcggtaattgcacgtgttgttcagcaaactgatcagcaaacgttcccccttgatgttccgtcaataataagtttaataaccggtcccgttgcgattcagctgttggcataatctgatttttaactaacgagccagcgataacctgaccaatcgaattgatcagtagtgcttgtcgatcattcagtggtttattgagtgctggcatcaccaaataaccgatcggctcggtgccatttgctaacggcgtaattagcatgggccccgccgacaactgatcttccgccacatagacttgcgttaaaaaatccggcgtatccggtgcaaatccgtggtctaacagccagcgtccgactcgattcgtctcaactgcagcgtgaatactagtcccattgagttgcgtcgtatgcgaccgtgtcagaatctccccgttcagatcaataatcgccagcggattctctaataagtgtactgcttgggccagtgtggtatcaaaatccgccgtgattgcttggatagcgagctgattgatggctgcttgaatttgaacatcgtggtgtaagcactgaccaagcgtcattaataatttcaataactgattttgtgccgcaatgatcgtagtcagaccggttcccagatttactagtccgaccgactgacgatggccgtgccaactataagcaagttgaactagctgacccgagtcgggggacaaatataaccggtggcttgctaacacttccgtcggatcaacaaattggacgtgagtaacttcgggattatgtgtaaatgttggatcgacagtcacctcaaacgttgtggctaactgccgcaataacggctttaattgcatactcaagtaacctccttattcacgcttgtcgccttcatcataaataatgtaagcgcttttgtaaagaggcctactgacaacccaccaccccactcgaaaggccctcagctttcttaggcccgtattcggacaaaaaagagcgggaatcccgctcttttcataaacctattaggctaagaaatcagtctgtgttttggcatcgtaccgagtcgtatggagcggttcttgcgctgctttcccgattgcgatccccattactggcacgtatcgtttaggatcaagacccagcgtcggaatcatcttttcaaagtcaattccggagaacgcattggcatcatacccatgagcccgtgccactagcagcaactgcatcccgacaacggaacaatcaatcgtcgcatcgaatttcaagaaatctggtgtggcattttcatataatggtaagaaggttcccagaatctgatccaagcgttccttcgtaatattcccatcctcataaactttgttccagacatcgcgataaacataatgcgactgggtgtcaccggcaataaagacgatggccgatgcactgtcgacctgtgggtagttgaatttcatcacggcttgtttgaacttagcctttgcctcgggggtatccacgacgacaaagtgccatgactgtaaattacatgccgatggcgcggtggctgcttccgcaatcatcttttgtaactcatcacgtccaattttaacgttcgggtcaaactgccgaactgaatggcggttaaacatcacgtctgctaaatcattgttcaccaaattttttactgcttctgacatcagctattcctcgctttcgtaatcggcctaaataatgtaagtcgctgccttgggattgaagaaactccggtcataccgacccgttaagagctttggcattgttgtcgcagcatcaacttcgtccaacttcagtgtgttgaacataactgacgtgtcgaagtgaaaccaagcggcaccgagtggcttcaagaccttcaattcgccaaatggatcatcatcggttgactccaactgaatacttaggttcccaggttcaacttgatcagctaaggaccgtaattgagtcgcaactaattggacattactgaaatggttcgtcccatcttcatgttgatcaatgtcatatttatagaagaaactattcatttcggcttccttacctaacgcgagctgccccgcaaattgtttcataattgacggatcattcagttcaccggccgtccacgaaacgttcagtaatgtcttgccatggcgttcgaccgtggctgtcgcactgttgtcattccggcgcaattcgatgtcatccgctaatttcttaggaatcccagcaccttcccgacctgcaatcacaccactctccgccccgggaccgtggagtaagaggttaatcgggtaagcgcccatcattttatccttgtagctaactaacgcaaataggctttcttcaaggtatggggcactaaaagtcggttttcccatatgaacgacataaccgcaaaccaccggtgccattaattttaatggtgctggaattaaagccttaagcaccgcttcgtcagtggcataagcaaacccaataccttcctggtcattcatgcttggtgctgtcaaaaagttcttaacatcctgatcacttgcaataaaacttgccatggtaaaacactcctttgtttgcgtgattagcttacatgataccgtccatgatgtgcacgtctggtgcgccatccgtcacgatccgtttaactcggtcttcaatcagtggattatattctggatgggtcaaaatgtagaaacggttatcctctaaggctttaaagacggtatcggcaatcgtatcaattggtttcccgttggtaatgacatacttcgcaaattgttgtccctttaagtacgcttcactttgataatacgggtccgttgggtcgctgtattgcgctggccggtgattttcagtgtgatagagatccgtctgaacaaagccagggcacatcacgtgcatgtcgatatcaatattagcccgttgtaagtcataggcggtcgcttcagtcatcccaacagaagcgaacttgctagcatgataagaaggcattccgggcgtatcaactaagccggcaatcgaagccacgttaagaatatccgcatgggtcttctgttgaatcataattgggataacgcgcttcatcgcataaacttgactcattaagttgatatgcatgatccattcccaatcacgagtcggcaattcccaaattcggccaggtagcgcgatcccggcattattaatcagtaggtcgatccgcccaaacttttccatggcctgctcaaccgcatcgtcgacactagcttcctttgtaacgtcagcggtaaccatcaacacctcggcacccttgtcgagaatatgttggtacgttttcttcaaagctggttcgtcgatatcaacaatcgtgagcttcataccccgatccgcggcgccttcagcaataacttgaccaaatccgtgggccgcacccgtgataaacataactttatctttaaaatctttcatgatgttttgcgtcctcctcgatgaaattgtgattttattaacttatcagtaaatattaacctgatgaccggtcatttatcttgactacgctttcatattaacccactaaatttgtttgagtaatggataaaagtactagtcttacgacgattaaactgtagcttttatacatgtgtgttggttcacaattataactaactaaagtgtggttccaactttaattagctcataaaaacgcatgccagcccttcttagcttacatgcgcatcattataattggatttattttcttaatactgcaaccgttcattgtgcacggctacgttgccgaaacattcaaggtccgtgccagatcaatcactcgtgctttgatctgatctcggacctgtcgaaatactagcaattggtcactaacactgccagtcgtgcgagccggatcaggcaatggccagtgtagcctggtcaccgttgccggagtgacggggcagcgatcccgtgcatcaccacacaacgtcaccacgactgcacactgattaagataggtcaggtcgattaatttagaaacctggtcactgatatcaatacccacctcgctcattacttgaacagctagtgggttcaggccatgtgtctccaccccagcactagcaacttgccagtttggtcccaataattgctgtgcaaagccttctgccatctgactgcgacaggcattgcccgtacataaaaaatatatttttggcatttcgccgtcctcctaaattactgacgataacgacactaatcgcgtatcatcaccaatattatgcccgcaagaatcccgcttgctccgctaataaccattaagatacaacatcgtcatgcgcgtaaccgcgatagattgctgtgactattccagcaatcgaataagctagccttaaccctcaagaatgcgctcactatatttttgtaatcgatttcaaaacgatttatactagaattgatattacaatattattctaaacttataaccagtccccctgagcagttactcatcgcgagaacggtcttatttcaactaatttatcggaggtcttttccatgacagtagcaattcgttatcaaactcgcaatggcaatacacaagcatttgccgaacaaatcgctagcgtggcaggtgttccagcacaatccatcgatacacctgtcgaacaagctgacacactcttttttggcggcggtacttattttatgaaacccgacaaaaccgcatctgcttttatgaagaaccttgatccgactaagatcaaacaaatcgccctattcacaacttctggcggaccagaaatggtttcagacaaagccctgacaaagattgccaccgaaaagggcattcccgtcatcggccacttccaccaagtcatgggtggcaaaggaatgaaaatcatcggcagtactggcggcaagctcaaagatgagcagattgaactcgttaaggaattcgctcaaaaaatgttagctcaataatgatttgacggcgctcgcgttgactgaaaaagtcaatgcgagcgctatttttggattagtgctgaagacctaattagcccgtctaatttgacgtaggacgtcaatgcaccgctgctgattagcgttaggcaaaaaggacttccgcaccgccagttgcatgtaacagtgtaattgctcttgggcagctagtggaatccctacaacctgatcacttagcactacggaatccgcaatgaccaccccaacaccaacgttttgagcaactagaccttcgactaacgcgttggtagctgcctcgtagacgattttaggctgtatgtggccgcgctgacaatattgttctaatgctaaccgtggtaatgcgtgtttaggacgagcgatgataggcactccttgtaagtcagttgctcgaatcgtttttaagtgacttaatggactattgacattggccaagacctgcatctgatgttcctctaagatgctcacccgtaaatccgtggcacgttctgggaccaaagttgaaaaaaccgctgcgtctaacttgccttgccgcaagtcaactaacaattgttctgaatcagcaacggtcgttgtgacctggtctaataaatcaactgagataaatttttttatcacccggggaagccaaataccacccgcaacattggaaaatccgagccgaacttgctgctcattagcgtgatgaacttccagtgccatctgcgcaacgtcttttaagagttgcttagacttaatatacaaggtccgccccgctgccgtcgttactagttgggcccgatggttggcctgcgttagtaatactgcttggtattcttcttccaatcgtcgtaaagctgcagaaatagccggttgtgtgacgtgaaacttggtcgccgtggccgtgtaatttcccgtctcaactaatgaacagaagtactttaaatcgcgttcattcacgtcaacgcccccattcaatctatttaatacctaattttaacacgaaagatgcggcaaatcgtggtcaggatcaatcacgacttaccgcatctatattgctcagttagtcttaccaaaagcctaataacttggtccacagcaagcccccacctaaccagatgacgttaaaaataaccccaataattgcactcaatcgccaccactccgcactagtcacatagcctgtacttgacaataatgccgcgggcccggccgagtacggcgtcgttgacaagttgattgaaccagcaaatgccaatagtaacgccgctaaaacatggggaacaccggcaccaatggcgatggataaaaagccagcatataacgccgaaatctgtgttgaaacactcggaaacatgtaatgtaagtaaaaataagctaaaaacaggataatgagcacgctaatccagttcataccattcagtaaatgtcctaacgttttggaaaaccatgggaaaaagcctagtgtcattagcttcttagacatcatcatgatgatcgataaccagactaaaatattccaagcaaaatgttcattgagcaaatcgttagtcgttaacacgcccgtaatcagcaaaataacaactgcgataaaacttacttcggtcgcatcgatgccaattttagtcccgatcaaccataaaacaatcgctaaaataaaggtaattgacataattttttcactagctgtcatttttccaagtgcggccaaacgcgtcgttgcccagcggtgcgcgtctggcgtttgtttcacctcagggggatagactttatatagtacccatggaataattagtagcgataaaatacctgggacacaagcagccataaaccattgcatccaagttaccgtgattccctgcatcttagctaaaccaatagccaccatgttgccagctaaaccggtcaaaaacaagcctgatgtaatattattaacttcatattcattaaaaactagaaatgagcctaattttcgctgtgtgccctgtttcggatcagatcccatttcacgagaaagattatcaataatgggatacataatcccgttgacccgcgcattattgctaggaataccaatcgccaatacggcatcaacaaaggataaggcgtatgctaagctcagcgtgcgcttgccaaataaactgacaaacagataggcgatccgcttgccaagtcctgatttaataaaaccagcagccatgaacatgcacatggcaaccatccacgccgtcgaattaccaaaaccagtagcgacttcgtccatcgtaaaaacacccgttaacgtcgcgacaacaatcccaatcagcgtgacggccatcatcggtaatggcttggtaatacaagcaataatcgttgccacaaaaattgcaaataagtgccacgccataatactaattgctactggtcgtagtggcgtaactagccataacccaattccaaaaattagcggtaacagaaagcccttccattttatttcactcaacatctgcacttcctcctaatcttcatataattgttaagattttcacatatcttgccattaacggttgtttgccgtttttcaatatcaccataacttaatttataagtctgtcaatttaaatttagttgtagttgcttgaggtgtcgcaataaaacccgttatatacagcctacagggacctgtttgcgattaaaaatacctgaaattatcatagcgactagtgccttttatcggacacttttataaatagaatttataaaaagctaaaataaagtttgccacttgcttaattctcactaaagtttcgacaacccgtcaaattaatcacagcttgttatccttgtcacaatagcattctgttggcttcgttaaaattaacggttgttttttctaggtaactatttatattgaaagcgtaaacaattcgtatacttatccaactaaaaactaataaaggaatgttaattatgaaatatattgccttgattggtacggcggcacaacagtcttacaaccgtgaattattacaatttatgaagcatcattttagtcaacgggctaccattgacgttaatgaaattacagggattcccctttttaatgaaccaactcaaaatcatatcccggcgaccgttcaagccttaaatgataaaattagccaggccgatggggtgatcatcggggtacccgaatacgatcatgccattccggccgcactcaagaacgttattgaatggctttcttaccagctccacccctttgctaataaaccggtcatgttagttggtacttcccttggcgtacaggggacgtgtcgtgctcaaggtgacttacgcaatattctcaatgcgcccggagttgatgctcaggtactccctggcaatgaatacatgttaagctacgctgctaaagcctttgatcagaatggtcaaatgaccgatgccccttctatcaagttcttggaacggtgcttcgataactttgaaaaatacgttaaggcactcaacggcacgcccgcgctcaatgtgaactggcacggtaactacgacgtcatcgttttaggctttggtggtgccggtgcttcagcggctcgttttgctgctgataatggtgcccacgtactagtagttgatgcggcaccatttggccgtgaaggtggcaacacccgctactccgcccaacacgtcgttacgggtgaaagcttagataaactaaccgcttattatcaagcactgggcgcgccattcagtacccctactaagacactcaacgcctatttaagcggcatgagtaaaattccagcatattttgaaaaatatctggggattaaagccgttagttggaaacatgatattaaacccggtgatgccgttgccatcaagaaaaccatggcggaatacccagaactagccggaagtgatacgattgactttgccctcgttcacaaacgtgataaagacgctgcattatggaaactactccggcaaaaagtccttgaacgagctgacaatattgacgtttggttggactcacgggcacaacatttgatccaagatcctaatactaaagtgatccaaggggtccaaatcaaacggggcgagcgactgcttaatatccatgccaataatggcgtcgttttagctatgggtggttttgaaaacaatcctgagttaaagcaaacctacttgcacagtgatcatctgacaccacttgggacgctctataaccgcggtgatggtatcaaaatggctcaagaagttgatgccaaaatgtggcacatgaccaattatgaatctcacggtatcttacctggaatcaccttcaaagaagacgccaatgaacggggccgtcaaattgaacactggcctttattaaaaaacggtagtattttcgttatcgctgatgacgggacacgctacttccaagaagacgctaagcaccgtcacggacacgtttacacacatggctcttggctaatcccaatgaataatcagcacccctacttaatttttgatcaaacccagtacgatgccttcaaacaagaagaaagtcaggctggtcagttaccgtatccgaaattcatgaccaagctcgtttccgcgccaacgattgcacaattggccgccaaattgggagttcctgctaataatctacaacagacggtaactgactttaatcactacacagaagtgggacgtgattttgaatttggtcgtgatccgcaaacgatgcgtcaactggacgatggcccttactatgccattgctgcggccaatgacgtcctcaacacgcaaggggggccacaacgcaatgaaaatgcccaaattctcaacgtcaatgacgaacctattccacgcttgttcggcgctggtgaattaggcggtatcgttgcaaactgctatcaaggtggtggtaatttagccgaatgtttgatctttggtaagttagccggtgaaaacgctgctcgtccaaaggtagatagtgaatctgtcaccgccaacgaagccaacggaattaatgaccttgttgatggcgaaacagcatctaatgttaaactggccgctgatcaatatctcggcagttccaatgccgggctaggtggcaaagttattgtgcgtgtgacttacaacgaccataaaattcaagcagtcgatgttattcaacaccatgaaagtgaagatgttggtttaaccgctatcgatcaaattccacaagaaattgtggcagccaactccactagcgttgacgccgtttcaggtgcctctgcatctagccgagctattaaagaagcggtccaaaatgcgctgaaacaagtcaaagattcagtcacgaattaagcacaattcaaagcgaatatgtatttgagaacatcacgtaactcacgagttgcgtgatgttttagtgtcccatggcgaaagtttcacgtgaaacattttaggacttacggtatttgatttccaaatataagttatgcaaggtgcctatcaaaacagacaccatctattgccaaaatcagcagtatccgttatactgtttatcgctgtggctataatcggccacaataaggagatgattaatgatgatggcatcattatctgtacgcaaaagtgctgctcgttagcgacacttttcgacagaacctttcagagaagtgtctggtttgaatctgaaaggaattatattatgcaaccgacaattaccacctatcaatacagttatattactcagcaagtcaatcagttaattagcgccgagctcgccgtaaacgatcttcaaattagagccgtcgtacgggcacaagctatcgagcggattacgccactgcttcctagtgacaatccaatcaccgctaatttcttgtcccatttgcaaacggaccggctaacccgtgccaaggcccctcaactacttgaaacgctaattccgctaattattccgtttccatccttgacgacaaagcaactaagcaagttgtttcgcaaggtcaaaaagttgaagcagcctgtatggtcacaattagcattacacgaattgacttacctaggttggaatgatggtggtaaccagaaaaagtatttagtaatcccggatcatgatcgtctcattggtatccagggagatttagcaccacaaacagtcaagggcgtctgtgccatttgccaaacaattggcaacgtcgcactctttatgtcgacaaccaagtcatctggtctcggaccttacacgcgtaacggcaattacatttgtcgtgacagcaatcagtgtaatcgacaattgaccaacccgcaggctttagctgactttttagcagttgtccgtccaaaacgataattaaataaaaatcagggccaccaagaacagctgcaactgccgttcttggtggcccctttcattaatcttattcggtgacactaatacaataagcgcgtgttggcgaatcactaacttcaattcgcagcagttgcgccccgttgtctcgcaatgtcttatcaatcttggtaaataaatactccgtgacattttcaacagttggattaacagttttaaattcaggtaagtcgttcaaaaatttacctgacaattcatccaacgcttgatgcaagtttttttcaatatcgtaaaaagcgaccatcgcatcaaccgtgtgcaattcacaaacaatttcccacgtgtgcgtgtgcttttttccggagccagttgcccaccgcaccgcatggctagcgttgacataggacttaattttgtacgttcgttgtttagtcggcattgcccagcctcccctatcaggttcaagttaccctccatcttagatgaaacggtgtcggttggcaatagtgtctgctggtaaacagctggttttctgctgcaaaagtgagtctaaattagttgataatatgcaaaacttgcggcgtagaaactcggtcagttcgaaattgatttaacggtttttcaggcttctcatagcctaaagcaatccccatcgccactactttattcgcaggcatcccgagtgcatttcgtacaatggccggatatttaaccaattcataagatggtactgactgtactccgcgagcagttgcggccaacattaacgtctgcgaaaaagcgcctaaatcatagattgaccaactattagggttagcgttgagtacgagataggcaatcgccggtgcgcgataaagattagcacgactatcccaataagtggtcgggtctgagtcgatcacgggccgaaaagttccgacccagtgccccatattttggctagcaaacgccgaaaaatcaccccggtgtactttggcgagatcagcgtcttccgcaatcccttactcagcggcagtagcatagtgttgtttaatattagttagtgcgtgccccgttgcaatatagacttgccatggttgtgaattgccccacgagggggtttgctgagcatccgtaacaatcattgttaataactgtggctcaatagggtcgtctttaaaagcccggactgaatgccgggtgtgaatcgctttaattgtttccatgaatttttagctcctatattttaaatagtgatgaacaaagagaataaatatcattataaaagatagcactatcttttttcaagtgagaaagcttggctagctaagcgcatcgtcataaaccagtaaactaaaaacgtggtaataccgagccattcatgctcagtattaccacgtttttaaccaaattaggcccttgaagttacagtcaacaagctatgaacactggccttaacaaggctgtcatagaccttattttaatgcaatctgtacccgtcgttgaagatctggcaccacggtcgcttggaaccatggattcttcttttgccagccataatttaggggcgatggatgcactaatgggaaataatcaggcaagtaatcctgataattttgaaccgttgcagtcaacgtcttttgccgtgaacgtcctaaataagccttaattgcatattggcccacaagtaacgtcagttgaacgttaggcatcattgctagcagcggttcatgccatttatccatgaagcccttgcgcggtggcaagtcaccgcttttgcctttaccaggatagtagaaatctagtggcataactgcaatgcggtcactttgatagaattgctcccgcgtcacgcccatccaatctcgaagtcggtcgccgctcgcatcattgaaatacgtcttggtattttgggcaatacgtcccggcgcctgactaatcactaaaatagtggctgtcggtaacacatgaaataatgggtcccaccccttcgccgtatattcagcgttatcgggatcagccttgatagcttcagtaatttctttgattgttgtgatatagatgcacctgcgattcgtttttagttttagtgacgatacttttcccatgcctgtttgattaagctcagaatatattcaatctgagtatcatcttttataattacttcataatctccatttccccaatggccgatactgctaacatctctcaataaattattgggatcgtttagttctccttttgataagttaatccaaatttttaactggcttttttgcggtaacaaatcaaccacattatgatgtttaatacgtagtccgatgtaaactttggtcggtttaacttcaaattctgaatcccacagcaaaatggcggctttaagctcatcatacaagtcacaaatattagcagtagctttatctaggaacatttcctcagtatagggcttcaaatcacttacctgatcaacatccgctgctttcgagattactttggattgtgacgataacgcactaaccttattggcaaaacgactattttcactattattcataatttgaagcagagtcaaatagccattctcagttttcctagcctcatataactcaattggcaaattggggttatcgatagcatctttttgataattagtataactaccagcgataaaaacaacccgtgtttgtgtccagtcaaagtcagccactcgcgcccgtgcaccaagcttttcattgtaggctaacgtaaaatcggctttatgttgcaaaagtgtgtttaaataggcagtgccctgatcaactacgctatccttagacgttcgtttatattcaatgattacgaaagctcgaacctcactatcatacgccactgtatccaaccgataatgacctactgtaaattcactgacaataaattgaatccctaaaactaattctaaattattttcaatcaaatcttgtaattcacgctcaatattaaaacttgagaccctaaccttatttaaactatttttactttgatttattttgtagagatccatattaactcctaatcaatgttcatacttatactagtattttacatcaattagtcatagacacgaagaaaagtcctaaccatgttattgccctagattaaacacgacttcatagtcccaacattcgcttcagcagcttttcattacgtttattatggatcggcaccattaagcgcgtagtatattttgccaaaacaccttgcttatacacagatttttgattactaaacgtctcaaagcccgtcttaccgcctttatagcgtcccattccagaataacccacaccaccgaaacccattgaatgcgaacccgcatgcaaggataactcattaatatctactccaccagatgatgtctgcgaaataatttgattcaaatgccttgaactcctaccaaataagtacatggctaacggcttttcatgagagttaataaaagcgatggcttcatcaagtgaatcatacgtaaaaatcgataaaataggtccaaaaatttcatttctggcaatctgtaaatctcgatcaggattaatcgccaacgttaatggaattagccgtcttttcacgtccggaaccaattcattatttggattaatcgttatcagcctagttccccgttgccgagcttcagtaagcattctcaaaatccgatcgtaagaacgatcgttgataatggcagaatattcagaattattaatgtaagttggaaatgcttgcgcaagttgtgcagtgattaagcgcacgtattcatccaactggtcagtgggaagtaacacataatcggtgtccaaacaaatctgaccactattaccagaacgactacgcgcaatcttggcagctgtcatttgcttgttagcatctggtaaaacaacggctggatttttaccacccagttctaaaacaaccggtgttaaattaggagccgccgccgataataccttcttaccagtttcagagccacctgtaaaaactagtttgtcccaatccagtgctgaaaactgagccgcaatatcagcttctcctgtcactactgcaaagttcttttcatttaaatactgttgtgacaatttctggaccagtgccgctgtcttaggggtatactcagagatctttaccatcactcgattccccgctgcaatcgcttctaccgctggatctagcgcaagatcgattggtgcattaaacggcgacatgataccaactacacccaatggttcattataaacatactgtttagttccagttaatgccatcaaacccgaccgttgcttagctggtagtatccatttacgaagatgcttcttaatatatgcaatcgtcgctagtggtccggttaaatcagcacttacaatttgtagcggatcacgctgcccaaaatctgcttgaagtgccgtgattaattctgaaatattatcccgaatcaatgcctcaatctgatttaaaacagtcacacgctcttcataggtcattggttgcgcacggtcatactgtgtcttttgcaagttaaaaatttggtgcatctcattaattgtagtcatcatagctctcctttttaatcgaacaatcgtttaattatagacaaaaaaatatcatgttctgatattttattttttcaatagtgcattcatacacatcacaaccacttgatcgatcataattgtcttattatcaatttgacgtgtttttaaggctttaacaaacaaaacaattggtgcataaacaaaacctaaaataactgctggtgaagaaatgacaaattcaggtgtatgtttgactgcttcaaaaagttgctcgaaaccttgataggattcctcctttttgatttttaagctatcaagaatgggcgaattattgaattgttcaataatcattaatgcttcgtaatattgcatgccgaaatcgtataacgcatacataaactgttggacaaacttaactgagttattgggtttggtattgatattttgacttaaaaatgctgccaactgtcgctttttagcaaggtagacctgttttagaagatcctctttatctgaaaaataaacgtaaatagttgacgaagaaataccactcgctttggcaattttggacatcgaaacatccgcaattccctcttttagaataatacgacttacttcatcgataatactcttctctttgtctaaatctttttcccgcatatttggcaccctcttttaatcgattgaacgttcgattaataatataaaactatccctaataaatgtcaattaaaattattagaaattttatggatgtggcacctgtacgcaaaaaatcactagctatatatacctgagaatctacaatcagcatcttggggattgggtatactcaaaaacggcaagcctttttgaggagcacctgccgcttactttgctattatcaatcaattgagtatagtgataaccaggctatttcaatctagccttaatatcagcatctgaaaaatcgttgctaccgtccttttttatttcgccattatttaatggtaattgcatatctatatactgcttacactttagtaaggtaactgtaattctttgcagccttatctaaactgttataaatacgaccatcaaaaacagattagaattcctattcacctaataaatccgtaactattgaaaaacaaattttagcatcacttatggtacggacttcccacattaatcataaacgcccgataaacctgctccgacagcactaaccgcattaattggtgaggtaacgtgaaacgcccaaacgaaatctgagtatccgcgcgcttcagcacttccggtgataatcccagcgaaccaccgattacgaaatcaatatcactgtgaccatacgtcgttagtttatcaatttccgccgcaaattcttcactcgagcgttctttgcccaaaattgctagcgcgtatacgtaatcgcgatccttgatcttttctaggatccgttggccctctttggccttcacattttccatctctgcgttacttaatgactctggagccttttcatctggcacttcaacaatctggaattttgcaaatttactcattcttttcgcatattccgcaatcccctgtttgaagtatttctcttttaatttcccgacacagataattttgatgttcataattgaccgcctttacacaagttattaacatagttatccacaggtgcataactcaataatcaatatattgtgttgaacaccagttcgccacaatatttatttagcctcgttttgtcaagacctttccgacttatccacagttttgcacagcaacacttgttcgtggattccggttacaaatcctattatatcaagaaccgaggcctattaaaataactttttaaaattaaatccacaggacagtccggcgcctgtggataacttttaaacaagcttcaaccccatggttccggctgttcataaatttcgactaacgcgactaaaatttatcaccaaagttgtccacacttttgcacaccatcaaattcgacaataaatgctttctgctatttcaaccagtttgttcggcttttgtcgcaaccattgccagctttcgcaaatttagtcgattattgaaaatcgattcttcgttttttcataatttcggctactaacctaaaaaaacgcccccgactgctttatccagtcagggacgtttatgaaattctcatttattagttactttgtttagttaacgttttggtagtttccgtcaacttcatgttggctgtcttgagttttccgttatggtagtatttcaccgtcacggtatcattaaccgaatgggcatacagggcactccgtaacgtggctaagctggtcactttcttgccacctagctccgtaatcacatcgtacttcgttaacccagcagctttagccggtgaacctgagtacgtcttcatgatgacgacacccttcgtcacactggttggtaacttaagaacagacttctgatcactagaagaaatattggataggtcataggttgcaacccctaaagccggccgaacgacttcacccttttgaaccaattcattgatgatcttcacaacttcattacttggaattgcaaagcccatcccttcgacactagtcccagaattatctgaggccaacttcatcgagttgattccgataacttgtccagcaatgttgaacaacggaccaccagagtttccagagttaattgccgtatctgtttggataaccgtcgcgtaccccgtcgtttgaccagatgtattcgtcgttgccacggtccgcttcttcgctgaaatgattccttgcgtcaaggtcgttgcgtaattagagcccatcggtgacccaatggctaaggccgtttcaccaaccttgatattatctgagttaccaaagctagccgtcttcgttactttagaagaattgattttcagaacggccaagtcagtcacagaatcggttccgacaattttagctgacaacttagtcccatcactcataatcactcgaatggcacttgaaccactcaccacgtgattattcgttacaatataagccgcgtcaccgctcttcttatagatcaacccagaaccttcactgtactcttccagcttactagagctagaatctgaactggatgaactatcactgccagacgagtcatcgccacccaaaataccactccaactgcttgaagagctcttcttttggagattaatgaccgatacaacggccgccttgttattttcaaacaccttggtcgcctgtgaactgacattgaccttaacgttcgtcgttgacgttgaccccgatttattagaaccagttggtacactggtcgatgacgttgcgatgttattgttttggaaataattaataccgccgtaagcaacaccaccaccgattaaaccagctactagtgcggttactgcgactttgattaatgatttattagccataattgcgcgtcgaaacgcgatccctccctactaatgcttattttaagtttattttagcgaaaaagtgtgatttttttatgactgaagcgttgtgaaacattaaagctaacctataacgtaattaacttagtcgcttgttctggctccgtatcgtacaattgaaaatcatgctcaacgccaaaatctcgttccgtcatcatggaagcaaccgttaaatgcgccaaggacttcaagttattatcctgactacgatgccctaagtaaatccgcttggtatgccggccaatcacatccatcaaggcgttcgcaccatcttcattcgataaatggccctcatcaccaataattcgctgctttaatggccatggataccgacccatccgcaacatttctaagtcatgattacattcaaataaatagccgtcagcgtctttgattacaccttcaacgtgctctgaaacgtagcccgtatccgtaatgatgacaaacgattttccggcatgatgtagttcataaaattgtggctcggccgcatcatgtgacacactaaatgattccacgtcgagatcacctagtccaagcgtcgtgttcgggtcaaagacatgacataattcggcaggaacgttgccgattttatgcgccattgcgtcccaggtcccctgattagcataaacatccataccatacttccgcgctaaaatccccgcagaatggcagtgatcagtgtgttcatggctaataaataaactatcgacttcattaatatcacgatcgatcgacgccattaaattagcaatttttttgccacttagccccgcatcaaccaatactttgtgctctggcgtttcgatgtatgtcacgttacccgtactacccgatgccagaatgcttactttcatatcatccgttgctaattttaataccattatttaggctcttcctatctctgaaatccattactatcttcatatgatacacgcttttagcggggttgaaaagcaagccacctgcaagtgctcaaacttaacgtccacgactatcgccatcacgcggttagtctagtttactgtcgtgtatgcgcacactagtttaccggccattaaactcacacgaaaccgcgaacatcaacgctgagcaatccacgctacgtcatgccacctcgacattggcgtatcacaactagtcaaaaatctagtcaccaaaaaacgggcctgttaggaaaaacacccttcttcacagcacccgttattcgacaacgacacctagtcgttaaactggttttcactaatcaattgcattccacatcattccgaccgtcgcatctaaactactcgtatcactagccgtactaccgttcttcattgaagaaccagtaaaggcattgatacggtgcagtgtaacgttagaactattcttaccccggaccgcaaagatccacgttgggacgtaaacactactatccttcaatttcaataaccgagaatacccaagctttgcccaaacgatccgggaactacttgccacctgattatattgatacaacgcaaccagggcctttttttcactgatcgtaacagccttttcgcgtaaagttttgacgtgattgacgtacgtctgagtataacttgtcagctgcttgtttttattaacaaataggtggacttgcccagcgccagtcatgatctcgccatccgcaaccttttgaacaaaaacgtaatcgccgttagacgacaaatccgcatcatagacgtactcggttccatggattacattggtccgctgactcataaacgtcgtcaagtccgctttaggattgcgggtatcgatagtggtggttgcccgtagtgtgctcacgagcttaccgccgctttgcacccgggctgtctgttcagttaactgactcaacaattgtttgagaccactctcgttactgcccgcaatatagtaacccgtcccttcgctcgtgtccgggtttttaaagctaatattatctgcgcgcatttcacgaattatcgtggtcgccgtatcaccagtcgtttgtgtcgacttagagctcgtttgcacgaacataaaacccaagaagatatctagaacaacaaatgctagtaggaaaatccactcaattctccgaaaattcatgcggccacctcctaagatccacttaacatcgacgtatatgtccgccaagtgccattatagtagacataatacgtcggcgtcaggtcgatcacgagtttggacgacttgttctgtgaccattcgtagccaagttcaatactgccaattttactgtctttataaccagcggccttcagacgttttaacacacttgtcgaactcggtaaggtcaccgcttgcttctgaccagtagttggtactggcacctgcaaactgtacagtgagaagtagtaacggtctaacccgttagaagtgagctgaatccggacatcgccattttcggtctgattaaagatcgggaacccttcaacatagcttcggtaaatgacactattactcgttgcgtcaaaaccgtagtagcggatattatccattgggacaccgagactagttaacaaattgaagctcttctttagctgattagtcagtgataggttccgcgtggttcctgaatcactataatcttcgaaatacactgttcctagcttagaatccaccgtcatgcgcttgtaactacccgttgtatactcctgtttaccactgcgattatgcactgaaacggtcgaattaccatccgcatctagtaatcggttggcaatctcactcgcagccgctttactcatcaagtagctataatgttgcatcgtaacttgctttggataatcaatatacgttgtattatcctcataggtcatcttgacagcaatccgtttgaccttgtcgactgccaaaacttttttcaacgacgacagagattttttcttcaaccgaacactataaatctcatgatggtcatcattcaaaaagtagatgtgattcgtatcattgactggaatcacgatccgactaaattccgaggagcgaaaattactgagatgttgcttgaagaccgtattaaacatactgacagtaatactgtcaggaaagttcaatacgtacgaatcagttccatttaagagcgcacggtagctttttgccgacgtaatgcgaactttagagatactccgcgcatcccatttgcgtaactgctcactaaattgactgactaagctgacatttttattaatcagcagggattggccaccctgactgttagtgtgaattaattgtgtcggtaaataaatatcatcgattgtccgagttgtcaacgaagagttcgatgacgtcgtactaaccttgctttcatgctcatagcgtgacggattcaaccagatatacatggataaaaccacgctcaataagatcagaatcgtcaataaaatgggtaagataaagcgtctaagcttgtgagtcgtcatcccaaaggtcctcctcctcataaggttcgtatggcagggagatatagaacgtagaccccttaccttcaacactatcaacccaaatacgaccgccgagcatctgaacaacttcttttgaaatcgccaaaccgaggcccgtcccaccttgggcccgtgaccgcgccttgtcgactcggaagaatcggtcaaagacgtgtcctaagtcggcccgtgggatacccaagccctgatcactaatactaatgatcacttggttatgcgtctctaacaggcgacaagtcacgacaccgccatcaggtgaatacttgatcgcattattcataatgttatccaatacttgagtgaatttatcggtatcaatttcaacccacagatcacgcttggtaaactcgcgcttaatagtgtaatacttagctggattatcatccttctttaagatcatatcaaaccgatcaagcacgtaattgaacatctcattaatattgaccaattccatatcgacccgggtggtccctgagtccatccgtgatagacttaagagttcattgatcattcgaatcatacgatcggtttcttcttgagtgaccttcaaaaatcctggggccacttcaggatccttccacgctccatcactcagtgcttcaatataactccgcaaactagtcagtggtgtccgtaattcatgagacacgttcgaaacaaattgtttccggtcattatcaatcttttgttgttccgtgacatcgtggagcacacagactaacccactaataaacccagactcccgttgaattaacgagaagtaggcattcaagattaggtcacgctcgttcgaagaaaaatcaagcatcaattcatcttgattttcaatcaaatcacgcaatgaataatcatcacggattttcaaaatatctaaaatcgagttaccgattgccttttcggccgtaacatccataaagtccgaggctgtttcattgatgatggtaatattaccccggcgatcagtggcaatcacgccatcactcatgtgtgagagcacactatccaaccggcgccgctcagcttctgtcgactcttgcgattcttccactcgaatcgacaagttattaatggctttagccaactggcccaactcatcatcgctataaactcggacttgccccgcataatcaccacgggcaattcgttgcgtctgctgcttcatttcttcgattggacgagttattgcccgggcaataatgattgcaattcccagtcccaagaccatcgcagcaagtgacgcaatcacaaagattcccataatgttgttaatcgtactgtagacagacttcatatttgcccgtacatacagtaccccaactaactgactgctattacccgctgaattggagctatatagcggcacgattgaaacgtagtagcgtccattattctgagtgtcataggtacttttagtgtaagttcgattattatagatcgcattcttgacgtttcgatcggtcgttttttgtccaactactgactgatcattaacatcactcgtcccacgaattgttcctttgctgtcaacaacttggatttcatcaacattcgtattgttgtagttcgacaaaatcgtcttgatttggccgttggccttgcgcgtactgctgacggtcaattgttcggacaacgaattatcaatataagttggaatttgcaccgactgtttaaaatcctggatgttctttgattccaactgtttcacaaagattgcacccacgatttccaacgtaatcaataatagaagggcaaacacgagcgcaattttgaaattaattgttttaaaaaaatttttccgtttaaatctcaacacggtttagcaacctctactcattttcaggattgcggagatagtaacccacgccccgccgcgtcaccagccattttggatgactcgggttatcttcaactttttcacgtaaccgccgcacggtcacatcaactgtccggacatcaccaaagtaatcatagccccagaccgtctgcaacaagtgttcccgcgtcatgacttggccgatatgttgggctaagtaatgtaacagttcaaattcacggtgcgttaattcgatgttttcaccgcgtttggaaaccatataagcttctggatgaatcaccagatcgccaatttcaatgtctgaattttcttcaacttcagctggttgagcacttggtgcaccttgccgccgtagatttgctttgactcgagccacgagttcccggtttgagaacggtttggtcacatagtcgtccgcgcccagttccaagcccaacaccttgtctaattcagagtcctttgccgttaccatgataattggcatatcatagttcttccgtacttgtcgagcaacttccaagccatccatcttaggcaacatcaaatctaacaaaatcaaatcagggtggacttcatccactttttgtaaggcttcctctccgtcagctgcaacgtgaacttcatagccttctttggtcagattaaatttcatgatatcagagatgggcttttcatcatcaactactaagatttttttcataacgattcttcctccttaggggaaaacaggtttacatttcaatttttagggtaattcgcgatatattacgagaaaacaggtcctttctcgtgtcagggttggttgaaactaaattcaacactggttttagtatatcacaaatgtagttggctttctttgattgctaatccgcgtggccgtagtatttcccgggaaatcatttgccagttcaagcaatcgttttcaccaattaattactcaaaaaaacacttttttcgaaaaaactttcgaaatagtgttgtcagaactcaaaattcatgatattatattttttgttgagttatgggcagttagctcagctggcagagcaacggactcttaatccgtgggtccagggttcgatcccctgactgcccatcatataaccacactaatcagttttcacgccgtgataatccaccgtgaaagctgatttttttattcctacaaaaaagcctcaggaagcacaacgcaaagtgcgtgtgacgtccctggggctttttctaacgatctaatgtttaccatcagcgtagctaagtaactcaattgctagggttattcttgatcaatatggaaataaccttcaggagctgcactcggctgtgcttgatgccaatgttggctactacttccatatttagttggttgtggatccggtcccattgcaacaaaacgccggcccaatgcgtccataaaaataacgacccgctgatattcacgcgcaggtgcaactaacgtacaattctcatgcttaatgccgtaaacatctacaaaatccattccgaccacttagctttcttgtttagctgacaacccgtcacttcaaataaaaaccgaaccagttaatgataatggttcggcccaacagttactattgtggttgaacgttcgttgcttgggggccacgatcgccctgttcttcatcataagttactttttgaccttcatctaaggttttaaagccatcagtttgaatcgctgaaaaatgaacaaagacatcggtaccgtcttcacccgtaataaaaccaaaccctttatccgcattgaaccattttactgtaccattcttcattattagataagtcctctcagaactgactgcagtaacaacatcgttaaccttgggagcgccaatcaatcataacgttccacgcgttaagtggcttaagtatatcacatccctagtttttaatcgctgaaaacggtgtgcataacgtatgactttcccccatgattcctgcatactgaggtgtaaaggggtgactaagtatgcaacacacgactcgtcaggcagccctacatatgatccaaaccgcccccgtcttcacgttagcaactgttgatgcggacggctttccgaccatggtagcgctcagtcccttacctatcaaacggagcctagaagaactttacttctatactagtcgtcaaacttcaacaacgcagaacattcaaaactggcgtcaagcgagtttattctattaccaactgtcagactatgcgtcaattatgcttcggggaaaactctcattagtcggtaccaacgtttttgaacaagattggcgggctgaactaacggactttcagcagcaactaaattacaaagaccccgtcattctcaggtttcagacaagttcaatcaagattcgccagatgatgacgatcgaccatctcgaactcgttgatcagcccactgacggccccgctcacttagattagccgttacaaattgggccttctcagaaagacacaaccgaagcgccacgactagattctacgcaaattctagttgtggcgcttcgtgctttggtcacccaacaactagcatggctcgaagcgtgatatcactttcaaaccagttattaatgcaagcacgtccgactattccggacgtgcatcaaagaccaagtatcatcagcacaagccagaacactttgttcattcaccttcgaaaacaacgccactttcaacctcgtcagcccctactttcatcaccaatatttgcgagtcttgtaaaaagagactaggctgtagttatggttaatatttttatatttaggattacttattgcaatttttaatgaccgaactaaggagtgtggacttatgaaacttattagattgcgaattgaaaatgacgcgatggatatcgcttatcatccagtatcggggcaagccgcaacggcccattacctgattgcctataattctgaccaaacaattggtgaaaatctagagaacatcaaggttcgcttagccggacttcaattcgatgctgctattcttgaaaacggactgtcctatccattctcagacacaatcgtcggtgtcaactatgatcgcattgatgtcgggctagctttgactaatttgcttaatatcccagtcgttagccaagctgccgttgatcaacttggactagtagtcgcagttaaagctaaaagtgcctatttaaaatggcatttggattactacggccaataccacggtgtccgtaataatggtcaagaagccatgttgaccattggtaacggttattttggtctacggggcgcctttttggaaagtcacgccgacaaggacaattatcctgggacatacgttgccggggtctatgatcaaaccaccacgactgttcatgactttcggtattgatcatcagactccctttacactcaacaaacatgatttacaagatgcttatcggagccttgatttgaaaacgggactcttgacgaccactaaattgattcagctcgcttccggacatcaactcagaatccggtcgcagaaagtcgccaacatgcgtgattggcaccgttacagcattcgttaccaagtcaccccactcaactttgcgggtagtctacaaatctataccgaaatcgacggtagcgtcgtgaatagcaacgttagccgctataacgtcttcgatcagcatcatctgaagactatgggcatcgaaacggctgctaataccgtctacctttctggtcagaccaaatcatcacatatcaattacacgattggggccaaactaactagcccagacgttcctgcaattgagaactttaatagcacgcaacaacctcagggcgttcagcaaaccgtttcactggcggtagaagctggtaaaacgtataccttcgataagaacgtcgtcattgcaactagtaatgaccatagtgatccccagttgacccacgtccaagccgagctcgaccagtccagttttgacaatacggtaaccactagcaaggactattgggaagcgacttggcgagccacagatattaagatccgtggcgatattacaagccaacgcttactgcgcgtcaatatttaccacagtttcgtttctgctgccgcaattgaaagcggccaattagacgcttccgttggtgctcgggggctccacggagaagcttaccggggacacgtcttttgggacgaaatgttcattttaccattctacacgttgcaccgaccggaactagccaaacaactcttagcttatcgttaccggcgactaccaatggcgcgtaaaaatgccgaagcagaaggctacgcgggagccatgtacccctggcaatcagcatccaagggtgatgaacaatctcaattcactcacttaaatcccattactaaaacctgggatccagataatagccggctccagcgacacgtctcgttagatattgcctacaacgtctggttttactaccacgttactcaggaccgtgatttcttaactcattacggtatggaaatgttgctatcgatcgcagccttttggatcagtaaagcagattatgaccaagctaatggccgttataacattagtggggtcatgggaccagatgaattccatgaaaactatccaaacagcacgaccgctggattgaagaataacgcctataccaatatcatggttgcgtggctctttgacacgattaccacgcttcgggcgcagatgccccaagctgcttttcaagcggcagctcaggccgcacaatttgactcaacggctgagcaagcgttaacgacgatcagtcatcaattaacacttgaaatcaaccgtcggggaatcattgctcaatttgaggggtacttcaacctaccgacgcttgactttcaagcttaccggcaaaagtacggtgacatcgcccggatggaccggatcttgaaagcagagtctaagacacccgatgcttaccaagtggccaaacaagcagacgccttgatggccttttataacttcgatgtcacaactgttcagaagattattgaaaaaatgggatatcaacttcctaaagagtatctgacccataacattcaatactatttagcgcgcacaacgcatggttccactctctcgcggatcgtttacgccgttttgaatcagcttgacgataatgacgatgacgcctggaagcttttctcagaggccctcgcatccgactattacgacattcaaggtgggacgaccgctgaagggattcacctcggcgtcatgtgtgcgaccttaaacctgacgacacggaactttggcggggtcaatccactaggtgcccacttacaggtgaacccacggctacctgaacactggcaaacattgaaattcaagcatctctttcggggtgttcactatgttttcgttatcgatcatcaacgggtaaccgtcactgcggaccaacccagcacgattatgattggaaaacagcattaccaattacaagctaagaaaccactttccgtcacttataccgattaatctaggaggcaatcaacatggttaaatttgcagcaatcaagggatttgtctttgacctcgatggcgttatcacggacacatctacttttcatagccaagcttggcaccagatcgccgataaagtcggggtcagttggaatgatcaattagctgacgcgctcaaaggtatcagtcggatggattcactcaacctcattctagctcaagggcaccgagaaaatgacttcacaccggcccaaaaacaagcgctagctacggaaaagaacaccaattatttgcagctcgttaaccaaatgaccccagccaacattctaccaggcatcaccgcctttttgactgaattaacaacggctggctacgcattgtcactcgcttcagcatcaaaaaatgctccgcttgtgctacgtaaactcggtcttagtgactactttacgaaggccgtcgaccccgctagtctcaaacacggtaaacctgatcccgagatttttcggcgcggtgctgagattttaggccttaatccagctgactgtattggtgtcgaggacgcggcggctggcgtacaatcgatcaaaggcgctggcgaaactgccatcggtattggtgacccgaccgttttagcggcggcagatatcaattttaccgatacgactcagctcacactcgccaatattaaggcacaactaaactaacgtatttccattaaactcatcacaaaacaaaccggatttggcgaccacgtcatggttaccaaatccggtttgttttgtttaagccagtcgctaatctcaccagttggactgctcactggaagcttataattatcagactagctgtcaattctcaaatcaaatcaaaatgttgcaatccttgggcaatcccgccgtgcatgttgtcagcggtcacgtaccgcgcgagttgtttgacctgcggatgaccattgcccattgcaatcggtgtctggatcattcggaacatctcaatatcatttaattgatcaccaaacgcataggtcggtaccttagttaaatgcgccttggttaagatatcctgaattccaaccgccttggagacgccccattgcatagtgtccagcgcacgcggattattacgaacaaaatgtagtcggcctcgatatcgctgccgatattgcgccgcattcaacggatcaaacgtcagtaagaaattaatatgttgatgttcataaaagtgcggtgcgacccgggccgtctgtctgagtgcccgataattactggttgtcaatgcatcacgatggcttaacgcaaaaccggcgttattataataagctagcgcattctgttggcgattggcaaaatgagtaatatcggtcaaaagctccttatccagttcgtgcgcactcaaaaactgcccttgatacgcgacgtaactcccattcgcactgacgattgaatcgatccccgtcgttgtcatcacgtcttgaacttcgaatacattgcgacccgtggcaatgacgggtaggacgtggttagctcgtaattgctggattgcccgcacactactggccgcaaccgtcttatcgtcctgcattaacgttccatccaaatcaaaaaacactactgcttggtacaaccaattaccccctaattaatcagtcactggccaataaccagcgccaccaatacactaattaccttcgtgatgacgtctatttaaaaccatccgaaaaggtgctttagtgtttacctttattataagcacctcgtctgaacaacgcagacattctgcttataagcgcacaaaaatgcgtggccaatcaaggaaagccacgcactaatgtgcctacgtctcattaaggatcgatgagtacttcgtaatacataatcaatagcggggtgctattaaaaagtacaattatactatacggctgaaccgtactaacaatcatcaagttcctgtaaaatttaggtaaagttttcaataaggcgcaactgttcaccacccagcgtctgcgtcacaaggcagcgttgaatcgcttgtgctaattttatgggcacaccactcaactttaaatcgtgactcgtcatggttcgcggttcagtagtcacattgacaatcaccatcacggtttgatcagcctgccaataaaggtagccaatgccataatctgccaagtaaaacggcacaaagtgggctgtgtttaaccacgggtgccgttgacgccaattcgcccagtcagcgacaaactgaacttgcgcctgatctgcgtcctgccacggataaaacgcacggttatcagggtctttcccccccatcatcaacgcctcatcaccgtaatacaggcacggtacacctggaagcgtcaagagtagttggacggccaaacgtaggcgttggcgatcttcggctaacatagtcaggattctgggcgtatcatggctaccgatgttattgaagttaaagcgaaacgtcgtagcgggataattttccttgagggtcattagttcacgccaccattcggccggtgttagcgtgccgtttaaaacgtgaataatcaagcggcggagcggataattcatgacagcctgtaagccgccgccctctaagtagtgccggcgcatcccatacgctaatttatgagaggcatcctcccaaacttcaccgatcaaaaccttatccggataacggtcaagggtccgtcgaattccagcaatgaaatcgtctggcaactcatccgcgacatctaggcgccagccatccacaccgcgttgcgtccaataatcaatgaccgaatcgggtttaccaaagataaaatcgcggtatgttggatcgtctttatcaactgtcggcagatcacggatgccccaccagctatcgtaatcgtggggataatgaatgaatgtgaaccacgggtagtacggactcgtggtcgactgagttgccccaaccgtcgggtaatggcccgcctgattgaaatacttagaatccacaccaacatggttaaaaacaccgtctaagatcagtcgcataccggcccggtgtacggccgcgaccaggttatcaaagtccgtcaaatcgccgacgaccggatcaatcttcagatagtcacccgtatcataccgatgattactgctggcctcaaagatcggcgtcagataaataattgtcacaccgagtcgctgtaaatatggaatcttagcactaataccgcgcaaattaccaccgtaaaaatcccagcgtaaaatcgcccggtgttcatcacgcacgtatagtgggcgatccgttagttgaccataaataaagctatttggcttgggcgcattaacgtggccatccgcgttgccattattgaagcggtcaacaaagatctgataagcaaccccttcacgataccattgtggcaatgtttctactgctttcaagattgtcaattgatacatttgaacatgctcgcgcaagacgtattgaacgcccgggccaccataaccaccatcaacgcaaccataataagcggtcatggtcgccgtttcaatccgaaaatagtagaagtacaggccaacctgggtcggtataaacgtggccgtatacattgtgggactgattggatgtaacggtaaggcctgttcatcatcccactgaccatcatgagccacgcataaatcaatctgcttaaccggcgttactgtctgaacactgattgtgaattgaacgggtgtctggcgggtcacggcaccaaagggcgtcttatacgtgggtaaaaatgagttatacgttacctgcatccgtcacccttcctttcttaattcagtcgttcgtggggcacttgccaaatatcgtcagcataccgcgccactgctaagtccgcggcaaagtgtccagaagcggcaatgttggctaacgagcgctgttgccaagtgggttgattttgaaaatcacgactgatctgctgttgttgggtgacataagcccggtaatcggctaagacaaagaattcatcgttataccgcagtaatgaatcatagatttcccgaccaaccgttggaattcccggaatcgtgccatcaatcaaactatctaagagccgttttaattcaggatcagcatcgtaaaagtcagcggcgtgatagttgccgcgatggtaatagtcgtacacttcattgaccttaagtccaaacggatattcattttcagcacccgccgcttgcataatgtcaatattcgcgccgtcatacgttgccaatgataatgcaccgttggccatcagtttcatgttactagtccccgacgcttctttggaggccgttgaaacctgctcgctaacgtcggcggcgggaatgatcagttcggcaatggagaccccgtagttcggaataaagacgatctttaaccgatcaccaatcgccgggtcctgattcaccatgtcagcgacgacattaataagtttgataatcgccttggcatagtgataactaggagccgccttggcaccgaaaatgtgtactcgcggcacgactggctgttgcggatgatccttaatggcaaaatactcgcgcaagatttcaaagacgtgtaggagttgccgcttataagcatgcaaccgtttgatttgaacatcgtaaatcgcgtcggtgcgaatcttgatccccatagtacgctgaacgtacgcggctaaagcttgcttgttagtcagtttaacttgacctaactgatacaaaaagtggtcatcttgttgatacggcagtagcgtctgtaataaatctggttgccgccgccagtccgaaccaatcgtctgatcaatcagttgcgctagtggttggttcgccaattgaacccaccgccgggttgcaatgccattcgtcttattattaaaccgctccggataaacttgatacaggccccgtaacacatccgttttcagtaattccgtatgcagtggcgcgacaccgttcacactgtgactcccaatcacagctaggtaggccatccgtacttgtccgttgcctaaaggcgccgtctgatcaacgagcgctttgccaaaaatcggcgtttgttgttcccggtagcgccggtcgatttccgcaataatctgataaatccgaggtagcaggtttttaaacatatcgattggccaagtctcgagggcctcttgtaaaatcgtatggttcgtgtaactcatgacttgcgtcgttaacgtccacgcaacttcccatgaacagtgatgttcatccattaatagccgcatcatctcagggatcaccagcgtcgggtgcgtatcgttaatgtgaatcgcgacctttttgcctaacaatttgatgccatggtgcgtcgcacaaaaatcacgcacgatactttgaacacccgcagaagagaaaaagtattcttggcgtaaacgcagttgttgcccggccgagttagaatcgtcaggatacaagaccttggtaatctcactgattcgatcacgctgatcctgcgaagaataggtcgcactgggtggtaactccgcggaccacaaacgcaaggtgttcgtaatatcgttgtgatacccgacgataccaacgtcgtaaggaaccgctagcacgtcttccgtattttcagattgcggttgtaaccacacattgccgccgaactggacaatgcagctcttgttatcgcgccgggtctcccacacgttgccatgatggagccaatcatcgggtaattctacttgatagccatccatgaaaacttgtttgaacaagccgtaacgatagcggatgccgttaccgttgccggcaattttcaaactagccatcgcgtccatataacaggctgccaaccgacctaatcctccgttaccaagcgccggatcaggttcagcctgactgattgtctcaaagtctaagcctaattccgttagccctttttttaccgtcgtcaataagttgagattcaacaaattagaagcgagtaagcgtcccggcaagaactcgatggaaaaataatagacttgtttctgatgatgatcgcggtaaaatttagctgttcgtgtccaactctgactgttatagcgccgaactagctgtcccagtgcaataaattgcccaatcgtcgaggtgtcactcagcgatgttgaatacaaggtctcaatttcacttagaaagtcctttttaaattgcgcacacgttaatttcaaattcacacccccatcaaacctaacgcattagcttctgataagtcgcacggtactgctgtgcagaatgttcccagccaaaatcacaagtcattgcttggtgctgcagctgccgccaaaccagtggatgctgccgatataaggtcacggctagaaccataattttacgtagaaccgctggctggtagtcgtcaaagctaaagccggttccctgatcggtatagcgattgtacggaatgaccgtgtcccgcaacccaccgaccgcgtgcacgatcggtaacgtcccgtaatgcatcgccatcatctgcgacaagccacacggttcaaaggcagaaggcataagaaagatatcactggccgcatagatttgctgagctagctgcgtatcaaattgaatcgcggcgaccaccttttgcggatacgccgactgataggtgcgtaacgcgcgttccaatgctgggtcacccgttcccaaaacaatgagttgcacatcttgttgctgcaagaatggattcaatgcatccagcaagaggtcgatacccttttgcttcgttaaccgagaaacgactgccaataccggcacgtttttgacaggcaaccctaatcggcgctgtaaagcacgtttattctgacgcttaggtttcaaattcttagccgaataattcgccgttagtgccaggtcggttgcgggatcgtataattgcatatcaatgccattaagaatcccactcagtttgtaccgattggcccgcagtaccccgtcgagacgttccccaaaagctggtgtttgaatctcttgtgcgtaggtcggtgacaccgtattaacggcatctgcaaagttaataccgcccttcagccagttcacttgatcgtaaaacgccacgccggcttcggtgtaggtctcagttccgattcgaaagagactatccaaaataattggatcgtagacaccttgaaactgtaagttatgaatcgtcagcgccgttttaatatcacgatacgcttcgatccaatagtacttttcagctagcaagacaggaataaacgctgtatgccaatcattgagttgtaaaatatcagggatataatcgatccgctccatcatttcacaaacggccatttgaaagaaggcaaagcgttcaccatcatcccaataaccatataatccttcacggccaaaataatctaaattatcaattagataatactgaacgtgcgcgactgtcagagttttaataccgcaatacatcgcatgttcacccacttgaacagtaaaatgcgtcactggcactaactgctgctgatattcggtcggcatctggtgagggtaatacggaatcactacacgcgtctcaattccttccgcttgcaaggcgcgcggtaacgccatactaacatcgcctaagccaccagtcttataaaaaggggccgcttctgccgccgcgaataataccctagtcatgcacagccacctccgcttgttgaaagacgtgctgccctttgctgatgactaacggtgtcgttgaagttcctttaagcactaggttgggcccgattacggcgtctttatcgataatgacgttttctaacttacaaccggcaccgatccgggccccctgcataatgatggcatttttaacttggctatcacgattaatcagtacatcccgaaagatgacggagtggtcaagttgcccttcaatatagcccccagtaccacataaactatcacgacactgtgaaccagtcgcaaagaacgtcgagatttcatttttgaccttggtgtaaatacggcgcgaactgtagaataacgctcggaaattagcttcatccaaaacggccatattggccgcaaagtagctgttgatatcatgaatattcgcctgaaagcccgtatattcaaaagcattagcgttatgttggatgactgcttgccgcatcaattcctctaggctgatcatgtcaccccgttgattggccgactgcaataattcgattaaatcgaccgtactcatcaagtaaatagccatgctcttggcaacttgtttcgtcttcgggctaatcttggccttgctcatcggaacgaccgccgttgcttctcccttagcagtcaattgtaagattgtattttcgggaatcaaactagctggatcaacgcgcttataaaccgccgtcacgggactgttacgttcctcgtgataccgtagtagcgcctttaaatcaatattaccaacattgcgagtactcatcactaccgagtactcactctggctgcatttcagaaactgaatcgaattatcatagtaatggtgcagtaatgcggccttcttttctggcgccactaatttcaagtcattgtatggggacaagaataggccgccgcgaattgtgttcaggctccagtcacgcccactacgcaaatgatcagccacggaacgccctgaccgcgggaccgtcaccatcacattttgaatccccgcattgatgacactcgataattgaaaatcaaccaaccgataacgaccaccaaagggtaacattccaactggccgaactgcagtcaatggttgtaacgcgtcacttggttccagtaaattaataatggcactcacttgttcacgtctcatggttgttccacccccatcgtttcgtgatacccaacaactgcaatcttatcagtcgtaccaataatctgggcatcatcaccaatcactgcatcttcgccaatcaatgcgtggtcaatcaccacattttttccaatcgttgcaccgggcataatcatactgtcaaccacgcgactacccatcccaactgacacgcgttgcgataagattgaatgatcaatttcgcccgcaacgtaacaactatcaacgaccatggcattattgacctggctcgtttccgtcaaaaacatcggtggtagcacctctgctttagagtaaatccgccagtaacgatcgccgatatttaaccggttatggggcgataggaattccatattggcttgccacagactcttaatcgttccaacatctcgccagtaacccttaaaagcataagcgtaaacggattcattattggctaagtatgatggaatgacatttttaccaaagtcttcaagtgacttatcggtagcataactcttaactaagtaatcccgcaaagtcggccaattgaagatataaatgcccatcgaggctttatcactcttaggatgttccggtttttcctcaaactcaatgattcgatccgtcgcatccgtattcatcatgccaaagcgtttggcttcttcgttagtcacgtggatcaccccaacggtcaacgaagccttcttctcctgatgatatttcagcatagcgtcataatccatcttataaatatgatcgccagataagacgagcaggtacttggggtcttgttgatcaatatattcgatattttgataaatggcgtgcgccgtcccttgaaagaacttctcaccttcactagacgagtatggttgtaaaaccgtcaccccaccatttaagctatcaaagccccagctcgcaccgctaccaatatgtgcattcagttctaggggttgatattgcgtgataaccccaacggtattcacacccgagttagcacagttgctgagtgtaaaatcaataattcgataacgaccgccgaatggcacggcgggcttagccgtatccttcgtcaacttaccaagccgggtgccctgaccgcccgctaaaataatacctaacatttcatcttgcatgcttaactccccctatcactttaactggtcgaatcaacaatgcacccatcgccggcaaggtcacggtaaaactagctggttgcccccgatacggcttatcgaccgccgtaaacgttgtttctagctttgtccacgtgccgccaaaagcctgcgcttcagtgttgagtaacaactcataacggccacgatacggtacgccgatacggtaatcttgacgttcaacaggaacaaaattgaaagcaacgaccacaaaactgtatttccgtttggcctgccggataaaccccatggtcgaactgtcaggatcatcggtatgtgtataaataatccccgcaggatcatcgtcctgctcccacaacggccgattgtgccgatagaccgcgttcagttgcgttgtgaactgttgcatccgatggttgagatcatcctttaagtcgacccattccaacgcactccagtcccgccactctaggaactgcccccactctgagcccataaaattcagttgttttcctgggaaggcagccatataagttagcatcgtccgcaaatttgcaaactgattatagcggtcccccggcattttatgcattaatgatttcttgccgtgcacgacttcatcatgtgaaaacggtagaataaaccgttcatcgaacatgtacacgaatgcaaatgtcagtagattaaagtggtcgtgccgatataacggatccatcatgaagaaatccagggtatcgtgcatccaccccatgttccacttatagttaaatcccaatccgccattggccaccgaacccgtaacctgcggataggcggacgactcttccgcaatcatcaagatatcgggatggtgggttaagaccgtggtgttcaacttttgtaaaaaggcgatgccttctaaattacgattatccccatactgattaacctgcccttcgcgcccttcatcatagtcgcaatacaacatgttagagacagcatccactcgcaagccatctagatgacactggtcgagccaatattcggcgcttgaaatcagaaaactctgaacctgtgttttaccgagatcaaaattccatgccccccaacgacggttattcgcgcgctcaggatcagcgtattcaaatgtcggcgtaccatcatactggtacaacgcatcataattgcgaataaagtgacccggtacccaatcaacgaataccccgatattcgcttggtgacactggtcaacaaagctgagaaaactgtcacgcttgccaaaacgactggttggcgcaaaataccctaattgctgataaccccaagacgcatctaacaaatgttccatcacgggcattaattcaatgtgggtatagccccgttgttttacatagggaatcagttcagcggctaattccgcataagtgtagtagctaccatcaagatgacggcgccacgaacctaagtgcacctcataaatgttaattggccgattggcagcgcgcgacttcttccggcgagctagccacaaactatcgtgccaacgcatcgtcatcggctcaacaactacggccgcatcccccggttttcgttcgaactgttgtgcaaacgggtcaatctttagttgcacttggccagttggtgttgtgatctgaaacttgtataactgacccgcatgaacgttcggaacttgtccttgccaaatccccgtcgcccctaataactttagtgcgcttggttgccagtcattaaaatcgccaacaaccccgacagccttagcatgcggcgcccagacgcgaaataccgcccgaccagatgcgcccaaatgacagcctaagtaatcctgactattaaatcctgcgccggtattaaataagtaacttgcatcattcatttccgtagtttgtttaaccaaagcatcacaccccctatgtgattaactgagcagattataaaattaatcttattataagaaggtgacagggtgtttgcctatccttgataaggtcgccttacttagtgatcaaacagggcacaaacccctaaaagataacgattattatgactagtcacccagaccgctgcaaactgattcaggacaactattcacagttaagcccgtggttatccgttttattgcgccgtttgccaaaacatcaaaaaaagcccgaaaaaacgcgttttttcgggctagttgatttattcaattacatttctatcaaattaataatatttatctgactgattacttccagtaggcatagcgataaagggcgtctcgcaacaatgtgaagtgaaccccaccaaccttgttactgatcaagtgagcagcagcagtttgataaatcggtgtgaccccctgttgctgagcgactagcttagccgcttgctgcatcgtctgatatcgggccttagttgactgcttatcggccgtaatcgtcgagattaattgctcatatttcgcattgttaaacttcccaaagttgacagaattagttatcgaagccttattcaagaaatcaactggatcttggaaatcactcgaccacgacaacgtggcaaagtcaaaatcacccttgcttaaagttgaaatctcatttgtcagtggtactgacttgacattgaccgtgacaccactaagatttttctcaattgcagcttgaatatattctgccaccgacttattaatatcattatcgttcgtcaataattgcagtgttaacttttgctttcctaagctcgcctgagccttctgccaatactgtttagcctttgctggactgtatggatacaaatttccggtatccgtattaaaatctttccctgttgtcgggttcttggtattgccagcaggaactaatgacgtcgccgctactgagccgtctttgagaacgttcttaaccaatgactggcgattcaaagcgtaactcacagcacgccgcaagtcagtattctgcaatgctgagcgcttctggttccacaacatgaagtagagttgatttaacttcgtaaccttcatctgactttttagtgacccttgctcagctgccgatacttgggtgcccgtaatctgggtgacttggacctcattgctttggaagaggttctcggccgtactgttatttttgaccgtctgcaccttaatattcttgattcggacctgtttacggtcataataatacgggttcttcacatatttccacgtgtcattcgtcccattccaactcttcaagacatagggaccattagagagcgttcgctgtgccgatgtcccatacttattcccgtatttctcagtaaattgtttgtttaacggatagatctctgtggctagccgataattaaaatacggcacgcgctgttgcaatgtaatttgtaacttatacttacccaacgctttaacgcctaaggtcttcaccgccttcttaccagccgtgattgctgttgcattcttgatttcagcaacgtgtccgacttcctgtgacttggtattcggatcgacctggcgttgcacggaataaacaaagtcagcggccgtgaccttttttccattcgaccacttggcattgtgccgcaaattaaaggtataagtcttcccattattagtcggtttgacgactttcttggcaattgccggcacgactttccccttttgattagttgtatacaagccttccataaactgagcaatagcggcctgactagcgatatcgtcggccttattaggatcagcggtcgcaatcgactgggtcgccgttacgttcaacgtcttctgctgactactctgctggctaccgcagccagttaagactaatcctagggctacaataccaatactgctgatccatattctttttttcatgaatgatgactcctaacttaacgatgatgtcggttactggcaacgatacttcgattggcgccgacaacaacacatcaacggtaagcctccgttatccgtggtaaaccggtaattaccggttttcacgactacaataacgttttgcaatcctgcgttcatcatcatgattcctccccttagattaaaaactaattaagataagattagcttttaagtttacatctgtcaactaaaagtttcgctcaacattctaagtcaccatggtattgtgccttcactattcaggccgaaaccagcttgctgcttttgaaccaaacgtatggtacgcgagcttaaaactagaccggctatgttgggttatcaaatcaagaagtcaaaaatcggataaacacttgtccccccaatcggcaataaaaaaatcgctattagccgatataatgactaataacgatacttgctcatcaatggcgaatctgaccattgccatcaatgacatatttataagatgttaattccgctaatcccatcggaccgcgagcatgtaacttctgcgttgaaatcccgatttcagcgccaaacccaaattcaaagccatccgtaaaccgggtggaagcattgatataaacacacgctgcgttgacccgttgctggaagagcttcccagcttgataattatccgtcacaatagcttcggaatgttgggtattgtaacgattgatgtgcgtaatggctgctgcttctgaatcaacaactttcactgcaataattaaatcattatattccgttccccagtccgcatccgttgctggaaccacatcaggaacaatggcttgagttgcggcatccccgcgtacttctacgccttgttcacgaagtgcctgaatcatgctaggtaaataatcggccgcaacctcacgatgaattagaagcttttcagtggcgttgcaaaccgatggtcgctgaactttcccattgatcacgatatcggttgccatttgcaattgcgcgtctttgtccacatatacgtgacaattaccggctcctgtttcaataacgggtaccgttgctttagccaacaccgtttgaatcaaacgggcgctcccgcgtggaattaagacgtccacgtaatcagtgagctgcatgaacttagccgcagtcgcatgcgacgtatccgtaatcagttgaatcgcattctcatcgaccgcttcggcccgtaatgcaccacgtaagacttggacaagtgcttgattagagtgaagggcttccttaccaccacgtaagattacagcgtttccggttttaaaacacagtgctgatgcatccaccgtcacattggggcgcgcttcaaaaatcatgccgataacacctagtggtacccgttccttggcaatcatcaacccggcctcgttgcgccacgcgcggtccacatttccaattggatctggcaaactcacgacctgtttgagtccggtcgccatatcctggatgcggtctgctgttagccggagccggtcaacaaacttaactggtacttgcgggttctctaaatcctgcgcattagctgccaatatctcatcttgatggctcgttaacgccgttgccattgcggtcaacacttgatttttttgcgccgttgaaagtaaccccagcgtatagctagcttgttgagcctgctgacccaactgttctaaatctaccattttgataacctccccaacttaaccgaatagcgttccgactggttcgcctgctaaaatttgaaaaataattgtgggatccgcaccattggctaaaatcatttgaccattcgcatcgatcatccgttctgccgcttttagcttagtgaccatcccaccagtaccaaaccgactgccactaccgccagctagcttataagtatgttgatcaaccttctcaatgtgccctaataactgggctcgggcatccgcattgggattaccatcataaaagccatcgatgtcggatagcatgattaacaaatccgccccgatattcgtggccacgattgcggatagttgatcgttatcaccgaactttgtttcatgatccaattcatcgaccgcgaccgtatcattttcattaacaattgggaccacgttttgttttaatagcgcctcaaatgtattcaacacattatggtgactcttaggataaacaaagatatcacgtgttaataacaactggccaattttttgttcataaatggcgaaacgttctttgtaaatcgaaatcaattcagtttgcccaatcgccgcaatcgcctgttgttcaggaattgcttttggacgttgcttgagtcccatataattcaagccaacaccaatagcccctgacgaaaccaagacaacttcacgcccacggtgtcgcattgcgctaataacaaaggctaattgatcgattgcccgtaagttgatcgatccatctggataaactagcgtgcttgtcccgactttaatcacgactcgtttagcctttagttttcgtatcactttcactactgccaccaacttctctaattattttgtttcacgtgaaacatcggtctgaacgtccgtcttcatataattaacggccttgcgtaaattaaagtgaacgacaccgatattaactgccaacacgatcaataaaaccacaaatgccaacaaaaacagcaccttataagaccaattatcgataatcacaccaccaaataacggccctagcgagcgccctaacgcacaaaaggcttgtactagtccttggtaacgccccttagcactaactggtgataactgactcactagtgttggcatggctggtgaccaagttgcttcaccaatcgtcaataaaatcatggcaaagataaagtgtgggtaatcatgcgcaatcacaagtgatagaaatgataagcccacgaatagcatgccgaagaaaaattgattatataaatttttaatccgattccccagcaaacttaaaatactctgaataaggactagtaagcccgcgttgattgtccatagaaaactgtaattccgcagcggcatccccaaattcgtcatgtagacggataaattgctgacccactgttcgtatagcaaccagataatgaataaactaataaagaaggtccagacaatgtgaaaattggcccgtggcaagtgcacatcttgtccttggcgcggatcaaccccggtcacgttcgacgaatccacattgtattcaaataatgcaataatcaagaaaatcacgaagaggctcgtggtcatcgagaatagcaaggccatccccatgctatacacgataccaaccagcatcgtgccgaagacaactccgagattggcagcgagatacatcaacgtaaacgttcgccgcactttatcgcgggggacactggcagccaaagcattaaacatcgtatttagccagccactagcaaacccggtcacgactaacaacatcggataccacggccatccatgaaaaaagatcagagcaaagttcgcgaggccattcaacgtgattcccatcagtaacaggtgataaggattacctcgatcaaatatacgcccaccaatcgtacttgccaaaacgttggcaactgaattgagcatcaggacaattccagtctccgtcaacgacttacctaacacattgtgcatgtagatcgtcgttaacggccaaatgaaactcataccaatgttattcataaactgcccggcaattagccacggcgttttaatgagttgcttttgtgccacgccatcaccaccattattaaatctgtctacttttcatcatagcaaagtttatttaaaataacagggacatttatctcactaactcattattatcacggccaaattggtgcatcagcccaaccaattggcggaaaacaagtagcctcggcacgtgataaacaaaaaattcctcttaattagtttaagaggaatttgataacaaatttattgaccgactgcaattaagcttggggatcctgcgcataagagactgaggagaacttattaaatggtttcacaaataatagtttgaccgttccccgtgccccagcacggttcttttcgataatcacttcaacttcaccaacatcctcagaagcatcttcgtcccgcggatcgccgccattaaagtcaccaccgccaccaaaattaccgccatcatcatcgtcgccgccttcgcgatcataataatcttcccggtataggaaggcaacgatgtcagcatcttgttcaattgaacccgattcacgaatatcggaaagcactggccgcttatcttgacgctgttcaacaccacgagatagctgtgataaggcaatgactggaacacctagttccttagccagtttcttcatttgccgcgaaatttcggaaacttcctgttgccgactttctgtgttactaccttcgatcagttgcaaataatcgaccacaatcaagccgaggttaccttgctctttcgctaagcggcgacttttggcccggatttctgacatcttgattccgggggtatcgtcaataaaaatactagctttagacaaactccccatggcaaccaccaagtgttcccactcttcttcgttcagttgccccgtccgtaaatgcccagcgtcaatactaccttctgcacacagcatccggttgactaaggattcggcacccatttccaaactgaaaatggccactgtcgtatccgttttagtcgccacattttgggcaatattcaggacaaaggctgtcttaccaacggctggccgggcagccaaaataatcagattatccggttgtaagccggcggtcattttatccagctccgcaaaaccagtcggtaaaccggtaatgtcatcatcattttgatacaagcggtcaatttcttcaatcgacgcgttcaacacatctgaaatcgacttaaacccactctgattacgctgttcagacacgttcataatgtcgcgttccgcgtcatctaataacgtggtcacgtcatcattttccgtataggccttttgcgtaatctccgtggccgtcttgatcaaccgccgcaccgtcgccttttgcgccacaatcttagcatagtagccagcgttagccgcagtcggtacggacccagctaattcagcaatgtaactcatcccaccaacatcatccaattgattttgggccgttaataaatcactaacggtcaccgcatcaatagcctcgtcacggtcatttaaagtcaccatgctggcaaaaatgatctgatgtgcgcgccgatagaaatcttgcgcttcgacaaactccatcgcttccacgagggcatcactgtttaagaaaatagcccccaagactgccttttcagcttcaatattttgtggtggggtttgatccagcacatcgttgttcatttgtgatccgtccttttacttttcgacaacgtgcacgcgaattttcgccgttacttctggatgtaacttaacaggcacgtttgtgtaacctaatacccgaattggttctggtaattcgatcttacgtttatcaagcttaacttggtattggtcagctaacgccgttgcaatttgtttgctaggaattgacccaaacaaccgaccatcagtaccagctttggccttcaattcaacaaccgtttcatcagcttccaaaactgtcttgacttgcttagcttcggctaattcctcagcggcacgtgctgcttcagacttctgttcagccttcaacgtattgattgccgctttagtggcttccttggccaatccctttttaattaaaaagttctgtgcgtaaccatccgggacattcttgatttggccccgcttgcccttaccacggacatcattcaaaaaaataacttgcatttagactcactcctaattagattctgtggtcggctcatcagttgccgttaacaaatcaatcaacgattgtttgacggcttcaactgactgcccttcaatctgggttgcagcattcgataaatgaccgccaccacccaatttttccatataaacttgtacgttgatctcgccaagtgatcgtgccgaaattccgacccgtccatcttcacgacgtgtaatcacgaatgatgcgtcgacaccagacatagataatagtgaatcagcagcttgagccgccgttactgggtcatagacctgatcatcttcaccaacacataatgccatatcctggttaacaaattcaacggtttcaatcagatgattgcgttgtagataactatcaacgttctccttcataaattgttgaacgagtaacgagtccgcaccggctgatcgtagataactagcagcatcaaacgtccgcgatcctgatcgtaatgaaaatgacttcgtatcgataacgattccggtcaacattgcggtcgcctcaatcttattgattggttcggcatcgtgcgattgatattcaaacatctcggtaatcagctcacaagtcgacgaagcatacggttcaatataaaccaaaactgggttttctggaaattcttcgccccgtcgatgatgatcaataatcataacgcgattttcgagccgctcataaagggcctgtgacattgaaatacttggcttagaatggtcagccataatcaataaactttggtcagtggccttctcaagtgcttcttccggcgagataatcgctgactcgatgttctcatcagacttcaactggtccagtaaacgctgaatgtctgaatgcacattttgctcatccaagacgatccaacactgtttaccattcatttcagcaattcggcgaatcccgagacaggccccaacggcatccatatctggttggcggtgcccctgaacaaagatctggtcagattgattcattaactcttgtaacgtctgactgatcatccgggcccgtacccgcgtccgtttttccatcgggttggttttaccaccgtagaaacgagcaggttcgtcctcagacttcaccacaacttggtcaccaccccgccccaaggcaaggtccatgttactctgcgctaaatcggccaaattgttcatgttccgttcaccataagcaatcccaatactcaatgttagtgggaaattttgcttagaagtcgactcccgaattcgatctaaaatgcgaaacttattctcttcaacacgtcgtaaactactagcatagcccaacaagaagaagtgatcatcatccaagcgcttcaggtacatcccaaacatctgggtccacttagacaattcattggtcacgtaattgttcaggttggaaatatccgtatcagtcatcgactgggtgatttcatcgtaattatccaaaaagatttgtccaatcacgagtttttcatcttcgaattgatccgtcagctcagcatacttggtcacatccatcatatagaccgtattagtgctctgctggacacgtacatcaaactggtagtcttgccaacgaatcgtcgcgggctcgtccagatgagcgttcagcgtcgctgccagtgttggctcaatatcttccaagcggtatcctaagacgtccttatcaccgaaatagcgctgaagataaggattgatccattcgatggtctggtcggaattaaaaatcattactccgataggcatctgaatcagtgcctcttgttcgccgcgcttaatacgatacgacaagtctgagatatattcatttgcactcgaactgagctcaatcaacgtattataagatatcaccacagccatcacaatcaagatgaggacaacggtcccaaaaatccagttcattaaataaccagtgacgagcataattaacgacaagctaaaaataaccaacgctaagagtcgtaactgctgattttgtaggaaaaatggaattttttcacgcgaaaagatctttttcatattaaaaatccctcaagccttctcagtaatgactatattttatcacaaaccaccgtccgcttcagcgtttcgtgtcaatcaccgtaaacgcttcattgaacggccaccaccctatctagtcaagttaagggtaaataaaaaccacagagccgaagtctgtggtttttgaatgactaaaaattagtcttcagatacaaaggctaataagcccatgatccgtgcacgcttgatggcgatagttaaagaacgttggttcttagcactagtccccgttacacgacgtggcaaaatcttcccacgttctgaaataaagcgacgtaataagtcagtatctttataatcgatgtattcgatatggtttgcggcgatgaagtcgactttacgacgacgacggccacctcttctttgttgtgccattgatatttccctcctcgttatctgtctaagcaattagactagaatggtaaatcatcatccgagatatcaatttgatcgccattattagcgaatgggtcagcctgattattgttgttagcactgcttgatggtgccgcactgctagcattaccagtattaccattaccaaatgggttattgttattcgctgatgattgttgaggagccgcattttggccttgattactatacccattattattgttgttgtaattgttattaccactaccaccattggcagactgatgacgttcagactctgcccgtgattctaataatgagaagttttcaacgacaacttctgtaacgtaaacacgtaccccttgttggttttcgtagttccgggtttgaatccggccatcgataccaacaagtgaacctttatgagtaaagttcgcaaaattttcagcagctttacgccaaatgacgcaactaatgaaatctgcttcacgttccccattttgattcgtgaattgacggtttacggcaatagtgaacgtcgcgacggcggcaccaccattcgtgtaacgtaattccggatctcttgtcagtcggccaacaagaattgtacggttaatcatgcagaagcgctcctctcttaaaattaattttgtctattagtcttcgcgtttaacgatcatgtgacgtaaaatgtcatcattgatctttgaaagacggtcgaattcgtttaaagcagcatcgtcagttgctgttaagttaacgatatggtaagtaccttcgttaaagccaccgatttcgtatgcgaaacgacgctttgaccagtcttttgaatcaattacttgcgcaccgttatcagttaagattttgtcgaaacgatcaactaaggctgtcttggcagcatcgtcgatgtcgggacgtacgatgtaagtaatttcatatttctttgattcactcatgaaatttgcacctccttatggacttcaggcccttctttttgaagagcaaggaaagtaatctagctaatgctagatactcacgaatttaaagtatagcatctaaatcagtttgttgcaagggttgaagcggccgactgttacaaaaagatcctgaatccgttacaccaatcaattacgtcaattgagcgatatttcattttatttcccgggaaatatttcttttttctgaaatcctccccttcgcttacatttccccacacccacacagcattaatttaaaccaagtcgacgtcagaataacacgcactgctgtaatcctctcaatcgcacaagccagttttgaccgcgtaaatctaaaattgcttacttcatgttgtcctctcccaatttatcggcatttctgccaatcactggaagatggcaggactaagtgatgagcctccagcagtcaaattattcttcgcaggaagattgtttctaccggttcaaaacaagactttggaggccagaataggaccgatgaccggtaaatcacacacgacccgttgccataataattcttgactcacataaaaaacaagcgtggtcgacaatcttgtcgaccacgcttgttttatcaatttattcgtttgaatcgtttgaatcagttgttggttctgtcgtagtggcatcggcattgacggtttgatcgtcaactggtgcctcagtcgttgcatccgttgcgacagtctcatcaacttctggctctggatcaaccttggccatcgttgcgacttgaccatcatcgcctaaccgcatgagacgaacacctaaggttgcccgaccagtctgagaaacggttgcgatattgaagcgaatcatgaccccttggttcgtcattaccatgatatcttcttgaccatcaaccgtcgtcaaaccagctaaatgaccattcttctcagtcacgttagcggtcttgattcctttgccaccacgccccttaattgggtaatcggcagctggcgtttgtttcccataacccttttccgtgatgatgaagacgttgctgtcgggcttcaaaacgtcaaagccaatcacaaagtcatcatcgcgtaagcgaatcccgcgaaccccagaagccgtccggcccatggaccgcactgtggtttcgtcgaaactgacggcataaccgtcgtgcgtcccgatgattacattttggtgaccatccgtgattgtaaccccgattaattcatcatcatccttaagcgtaatggccttcaaaccattgctacggatattggcaaattcttgaactggtgtccgtttgacaacccctttaacggttgtaaagaacaggtagttatcagaagcgctcgcatcgcccgtgacattaacgaccgcctgaattttttcaccagaattgactcccagtaaattgatgaccgggattcctttggccgtacgaccgtattcaggaatctcgtaagccttcatccggtaaactttacccgcattagtgaaaaagagtaggacatcatgggtcgacgtcgtcaggagatgttcaataaagtcatcatcatggacgtccatcccttgaatcccacgaccaccacggtgttgcgacttaaattcagtcgttggtaaccgtttgatgtagccattgtgagttaaggtaacagccacttcttcttcttcgatcaagtcttcatcttcaatactgaggacttcaccgaccatcaattcggtccgacgcttatcaccaaacttacgttgaatttccattaattcttcgtaaataatttggttgatacgatccttgctagctaagatttctttgtagtcagcaatggctttcaataagtcctggtattcactctcgatcttttcacgttccaaaccagttaaccggactaaccgcatatcaagaatggcttgtgcctgcttatcagacaagccgtaattatccatcaattggttcttcgcaatttcactcgtttgtgattgacgaataatcgcaatgatttcatcaatgtgatcaagggcaatccgtaagccttcaagaatatgggcccgtgcttgggctttcttcaagtcaaactcagtccgacgccgaatcacgtcttcctggtgttccaggtaatagattaagatttgctttaagcttaagacttttggagcacccttaacgatggctaacatgttaaagccaaagttagtctgcatcaatgtcatcttgtaaaggttattcaagataaccgaggcgctggcatcccgccgaacatcaatgacgatccgcatcccttcacggtcactttcatcattgatatcagtgataccttcaatttccttgtctcgagctaaaccagcaatccgttcgatcaatttagctttattgaccatatatggtaattcggtcacgataattcgttgcttaccattcttttggtcttgaatatcgaccttcgcacgaacaataatgttcccacgaccagtctggtaagccttacgaataccggactttcccattacgatcccgccagttggaaaatctggtccaggtaagacttccatcaagtcagcaactgttgcatcaggattatccatcaacaggtggattgctgaaatgacttccgctaagttatgtggcggaatgtttgttgtcatcccaacagcaatcccagtggcaccgttaacgagtaagttcgggaaacgtgctggtaagactgctggttcccgttctgtatcatcatagtttggttgccaatcaacggtatccttgttaatatcgcggagcatttcaaccgcaatcttactcatccgggcttcggtataccgcatcgcggcagccccgtcaccatcgacagaaccgaagttcccgtgaccatccactaacatgtagcgatagctaaagtcttgggccatccgcaccattgactcataaattgcggagtcaccatggggatgatacttccccataacatccccaacaatccgggccgacttcttatacggcttatccggcgtcacacctaattcactcataccgtaaagaatccgccggtgcactggctttaacccatcacgtacgtccggcagtgcccgtgccacgataacactcatggcatagcttaagaatgacgttcgcatggtcttcgaaaggttcacatccgaaatacgattgttcgataaatctgaatcagccaaaatattcgtcctccttcatccgttttgccgctattaaagcttgattaagctttacatgtctcaagtaaaagtcgccattaagacaaccgtcgtgccattacgaccctaagtctgattaacagcttgcgcctcagttcttaggtcaaaatgactaaactgacacactaaacatccagatcctggacgaacttggcattatcttcaataaattctcgccgtggtttgacttggtcccccatcaacatcgagaagaccccatcggcatccgcagcgtcttcatcacgaacccgtaataggcgccgcttgtctggatccatggtcgtttcccataattgttccgcgtccatttcaccaagccccttgtaccgttgaacaactggtttcggtgatggtgccaattgccccatgacctcactcaattcttcatctgaatcaatatacttcacaaatttaccttgccggacttggtacaacggtggttgagcgatgtacacaaagccagcgtcaactaatggccgcatgtaccggtaaaacaacgtcaataacaaggtccgaatatgggccccatcgacatcggcatcagtcatgataattaatttgtgataattggctttgctcaagtcgaagtcaccaccgaagccagttcccattgccgtaaacaatgaccggatttcttcattggctaaaatcttatcaatgctggccttttcaacgttcaaaattttaccccgaatcggtaaaatcgcttgcgtcaaccgggaacgtccctgcttagccgacccaccggcagaatccccttcgacaatgaacaactcactaatttcagggtctttactactgttgtccgccaacttacctggtaaattactaatttccaagccactcttttttcgcgtaacttcccgcgcacgcttagcagcgacccgggccttggaagcaagtaaccctttatcgaccactttacgggcaacacttgggttttccatcaagtacttgctaaagtgttctgagaataaccggtcaactgctgcccgagcatcggaattaccaagtttcgtcttcgtttgaccttcaaattgaggatccggatgcttgacgctgacaacagccgtcatcccttcacgaacatcttcgccagataggttcgcatcgctttccttcaacaagttattcttacgagcatagtcgttgatgacccgcgtcaaagcacgtttgaaaccttcttcatgcgtcccaccttcgtacgtatgaatattgttggtgaaggtcatcaaattactgtggtagtcgtcagtatattgcaacgcaacttctaccgtaatcccattctgttccccttccacataaatcggttctggaaatagaacggtcttattcttatctagatattcaacatagtgacgaatcccaccttcgtagagaaagtcatcttcagtgggttcatcagggcgattatcccgaatcgtgatccgtaatcccttatttaagaaagcgagttcgcgaatccgagtcgtcaaaatattaatgtcataggtggtcgtttcccggaaaatatcaggatccggaacaaaatgaaccgccgtaccatgagcatcatcaggcgcatcaccaatgatcttcatcggtgttttaacctttccacgttcaaagtccatgtaataaacatgaccattccgagttactttgacgtccagggtcgatgataaggcgttaacaacggaagccccgaccccgtgaagaccaccagagactttataaccgccaccaccgaatttaccaccggcatgtaaaatcgtataaaccgtttcaagcgctggtttacccgttttttcttgaatatcaacaggaatcccacgaccgttatcagtaaccgtaatactattatccttttcaacggtcacgtggatcacgtttgcaaaccctgctagggcttcatcaattccgttatcaacaatttcccaaactaagtggtggagtccttggctactcgtcgtaccgatatacattccgggacgtttccggacagcttctaaaccttccaaaacttgaatttgactagcatcatattcgcgagcctgttcaagtttggtttctttttcgttttcggtcaatgcggttcctcctcatgtaaagtgccatggctaacttcaaatacttttggcgcattaattaatttgcgggccaccccgtcaagacttggcgtggttaaaaaggtctgcactttatcttggatcgctgtcagcagatgagtctgccgtgcagcgtctaattctgataagacatcgtctaataataagaccgggtactcgcccgtctcagctttcatcagatcaatttcagcaagcttaacggacaaagcagttgtacgttgttggccttgggagccaaaagtctgcacatttttgccgttaacaccaaattgtaaatcatcgcgatgaggacctaataaagtcgttccttgaaaaatttctttggcttgttgttgctgatataaggcctgtagcgtttgataaatgtgatcgaccgacgtctggtcggcagttggcacttgagtgacatagtgaaacgttaattgttcctgttcttgcgtaatctcgctgtgaacagcttgcgcccatttctcaagttgctgcaacagttgtagtcgtttatggatgatttccgcaccaaatgcagccaattgatccgacaagacacccaaataaaccttatccttggcctgctgccgatttaattgccgtaagtattgattacgttgttttaaaatcgtgcgatactgacttaggttatagaggtatttagggctcatctgaccaaattccatatccataaaccgacggcgaaccgcgggtgcccctttaacgatggataaatcttcaggtgcaaacacgatcacgttcaaatttccgacgtactgggataatttggcttgctcaagatgattgactttcgctcgcttgccccgccgccccaattcaagttccagggggacagcaccggtacttttatgtaaccggccttgcaacgttgccgtggtggtttgccaccgaattaattccttatcgttagcggtgcggtgactacgcgttaacgccaacacataaatggcttccaacaggttcgtctttccctgcgcattttcacctaatagaacattaacgccctgactaaaattaatggtcaaatccgcgtagttccgaaaatcatgcaagactaagttttctaagtacatctaatcagtcgtttcttgatttgagcgaataaaaaatgacccgttgtcttcaacttcaatcgtatcgcctggataaagtttccgaccccgccgatcatctggttcaccattaactaacacggttgtttcttttaagaaccacttcgcctgaccacccgatccaatgatggccgtttcttttaagagttgccccaacgtcatatatggggttttaatatctattggctgtttcacaatgtcacctgcctatctgattacaagctattaaacgactgtctggcgtgctacacacactcctaacaggttatattatacttgttttttgatgaaaattcaatttataaccgcactcagagccattttaagacgatttagggctttttaatatcgggatactagcctaggggtaaatttgctgaaattccctaattttgcggattttaataaaatatcttgttttttacctataaaaattggctaaagccagcattcattatctgaaagcgagcgtttgtagcgaacgagtgcaaggactggggttcatcagatggtgggattttagtagggcaacatcgatagttagcgtgacaattcaccagcagctaatataatatgcataagttaaaacttcaaaagttacatcatcgctattgcctattcattgccccatctttagctagttttagccgtcataaaaggcccgcatttcacggtgaaatgcgggccttttatttagaattgtatatttattcagctaattaaaacgttcgaactggtgtaatcaactgaataaagttttcgccttcttcagttggcactaaagtgaatgggcgcaatgccatcgtgaatgagattttgatcatagcttgcccaaacgaacgtaacgcttctttcatgtagtctgggttaaacgaaatttcaagttcgtcacctgacaaatcagtgggctgtagttgttccgttacttccccgacatctggtgagttaccgaaaatcgtaatcgttttgtccgttgggttaacggagaagcgaaccacattattgcgactttcgtgtgataacagggatgcccgttcaattgctgctgaaagtgcgggtgctgaaatttcaacagtcgtattagattctttaggaatcagccgtgacgtgtcgggataatttccttcgagtaagcgagaatagaaggacgtattccccagcacaaataggacttggttttctgataaccgcatctgcacgtcaggattattgtcgccgatcatccgagataattctgtcaaacttttaccaggaatgattacatcataattggcattattggcttctggcaacttgatccggcgttgacttaggcggtgtgaatcggttgcgaccgctaagaactcaccgttagctaagataaaatgaaccccggtcaggattggccgactttcctgattggaaacagcaataacggtctgaccaatcaactctttaagtacatccccagctaacgtgatggtattagtcgtatcaatttcaggtaagtgtgggtagttttcagggtctaagccgttgattgtaaaggaagcggctcctgaagtaatttgtgtttgaaaaccgtcgaccacgttaacagtcatggtgtcttctggtaatttttttacgatttcactaaagaaacgggcaggtaaaacgattgaaccggcatcttcaacgactaacgtattgttgtcatcacttgctggaatggtggtttcaatagaaatatcagcatcactaccagttaaggtaatagcgtcagtattaacgtcaagtttaagaccagtcaaaattggaatggtcgtttttgaagaaatggcccgttggacgttatttaattctttgatgaaggcagatcgattgatcgtgaatttcataagttaatcccctctttattctagcgacgggcactagatatatattaataataaaagttcgtagtaatagtagagcagtgggtactgtggaaaaccgagtaaagactcggcgttatcaagttttccacatgtgtataagttgtggaaaactttttgagttatccttttttatccacactaagatttgagctggcctgtcaaatcacccacggctttttgtaattcagcatcagttttgagtgccttagtgattttatcatgcgcatggatcacagtcgtatggtccttaccaccaaactcgttaccgatgcgcggaagtgaactttcagtcagttcgcgtgataaatacatggcaatttgacgtggaatcacgatttgtttattgcgtttctttcccttaaggtcagccattgttacatggaagtacttggcgactttttcctgaatgacgggaatcgaaacctctgatagtttactgctaaggtgcaaactcttcaatgcatccgccactaaactggtggtaatcggtgaattattcagtcgtgagtatgcctgcactcgtgctaaggcaccttcgagttctcgcacgtttgagtcgatctgaccggcgatataacttaacgtatcgtcagggatttcgatcccttcaagatcggctttattgcgcaaaatagcaatccgcgtctcgagatcaggtggggtaatatcaacggataatccccacttaaacctagaaactaggcgatcttggagttgcggaatttcgttcggtaagcgatcggatgtaagcacgatttgcttatcatcttcatataaagcattaaatgtatggaagaactcttcttgggttgcttccttattggcaaaaaattgaatgtcgtcgactaataacaggtcaacgttccgatattcttcgcggaacgcctcctgttttttagtttgaatggcattaattaattcattcgtaaaagattcgctagtcacatatttaatgttactagtcggatcggtttctaacaatttgttaccgatagcgtgcattaggtgggtttttcccagaccaacgcccccgtagaaaaacaacggattatacatggtgccgggttcttccgacacaactaacgcagcggcatgggccatttgattgcctttaccgatcacgaaagtatcaaaagtgtatttcgggttgagtttcgtttcccgcataaatgtgggggtagttgcggttgttggttgttgtcccgcaacgttaccggtagtcacttgcgagtccttgtctctcgtaagttgctgacgttcttcttccgttatcatgaccggccgaatctgctcgttagtcgcttgcatcgcaatgtccgtgaactttgcggccaagtttttctcccaatagtcacgatgaagttgtgttgggacttcgatcgtcatttgggctttatcgagttggagtggttttgccggttcgacaaacgtttgaaacgtgatcttggacagatcttgttccatagagaacttaatgagattccataagtcattacgttccagcacgtggataccccttttcttaaaaaacgtaattctattttagcatgaacatatagagttttccacaagtggacaagttaaagttaagagaattcacaggctgggatttgaatatacacagcttgtcgaaaactaggaattaattttataaaacagcacttatccacaaaagcgagttcaaaactaaagccgcaataaaagcgtttattggagttatacacacaacaaatacgccctgtggataactaaataacaacccgttaatttgtcgaaaaacttgtgggtaaattgcgaataacggaaagtcactttgctataatccacaaataaattcgcaattaaataattttttgacctcgaattactacggagaaatttaatttactggttttcaaacaaataaaaatatgctatagtagtcaggaaatgcgtttagatgtaaactgcgttttgaaaataacgacttaatcgaattgattcatgtcattatggagaaggaggtgtcatgatgaagagaacttaccaaccaaagaagcgccatcgtcaacgtgtacatggtttccgcaaacggatgagcaccagcaatggccgtaaagtgttagcccgtcgacgccaacgaggcagaaaagtattgtctgcataggccactgataatcagtggctttttctttacagtcctagaccaggtgtttagggctgtaaagttgtgtagcaattcgctcaagagcttgagcgcacacatggagatggattatgcgaaaatcatatcgggtaaaaaaagaaactgagttccaacaagtttttgagacccgcaactcgtatgccaatcgtcaatttgtcatttacgttttggaaaaaccggggcaaccccatttccgcgtcggtatttcggtcggtaagaagatcgggaacgccgttgcgcgtaactgggtcaaacgccggattcggcaatcaatcaccgagctaaagccgcagcttaagcaagatgcagactttctcgtcattgcccgaccaaccgttgctggtaagtcgcaagccgaaaccaaagcttatctaagccatgcgctaaagctagcgcacctgctggacaatgattaaagtgaggacattcgtttgaaaaagtacagaaaaatactggcaatgctggccgtactagcgatcgtactagttttgagtgggtgtagtaataccccaatcacggataagagcaccgggttttgggatggcttaatcatcttgaacttctcacgggcgattatttggttatcaaacttgtttggtcatagttatggtctcgggatcatcgtctttacgttgatcatccggatcattatcttgccattgatgatcttccaaacccgcaacatggtagccatgcaagaagtccaaccgcagatgaaggctttgcaaaagaagtattcgtcacgcgatatggaaactcagcaaaagctccaagcggaaatgaagaagttgtatgccaagcatggtgtgcatccaatggccagcatgttgccattactagttcagttgcctattttgattgcgttgtaccaagcaatctggcggacacaagccttgaagaccggttcgttcttatggttgcaattaggtagcaaggatccgtactacgttttgccaattctagcggcgatctttacgtttgctagttcctggttagcgatgaagtcgcagccagaacaaaacgggatgacaacgtcaatgacgtatttgatgcctgtgattattttgattacggccattaacgtgccatcagcgttgtccttgtactgggtgatttccaacgcgttccaagttggtcaaaccttgttattacaaaacccattcaagattaatcgcgaacgggaagctaagaagcaagctgaacgtgatcgtaagcgaacgcttgaaaaagctagaaagcgcgcgattcgtaatcataaacgttaaatacaagtagacctgccatgtgtggtgggtcttttttgttggctctgtatcatctttaccaatcggtcaatatgatttggactgtgatggcaggatgctaatgtgcgtttatgtaaggcccctggacggtccgtgatgaggaaattgtaatgaacgatcaaatactggtaatagtaatcatccggggatcaaggtgcctataaaaataattgtctgcaccattttatcacatgtttttaatagcgtgccgcggtttgagagagctactttgtcagtcgtaattagaacgggcgattaaaaacgtaatgacccggcgcatgaaaaagttccaaaaaaagatttgacaaattgaaaaatgaccgctaagatgtgaatcacattaaaaaataattagattaagcgaacggcagtcgaggagtcggttatcagtcagttacagcgagtcgcggatgatgaaaagcgatctgaactggtagctaaaagtcgattactagtgagaagttgcgtgaagcaatttccgggtgtacccgataacgtaccaacatatcgtcaataaatttggccgtatgtaagtggtgagtctgactggctcgcaaatgaggtggtaccgcgtgaagacgtccttttaagcataacagcttagtagggcgtctttttgttttgcgggatgccggttgatctgattaaaatcaaaacataatggagggattagagatgcaagcaaagtatacatatagcattataggggtggtgagcgccttattattaaccggctgcttgggggcggtctctaattcttcgaaaacgaccagtacggctgatcaaaataggacgttaggcatcacgattcctggcgaaccgatgacgactgatccaacgacttcgatcgaaaccaacggcggtgccgtaattacacagactggtgaagggatttaccgcaaaaacgcgaataataagattgttgcgggggtagtcgagaagaaggtcaagcctactgaaaacaagacccggtatacgtttacgattcgcaaaaatgcacgctggcaaaatggaaccaagatcacttcacaagatttcgtgacggcgttgcggcggcaagctaatccaacaacgaagtctcaaaacttggatgccattagttacatcaagaactttgatgccgttaataaaggaaaaatggccgttaataaattaggtgtgacggctattaataagcgaacgttttccatcaagttgagcaagccggtgccttatatgaattatgagtttacgagcttttacccactcaatacggcggcagtccagaaatacgggtttaagttagggagtaactcagcgacgacggtagcaaacggtgcctacgttattaagggctggaaaggctctaatgatagttggtattacgttaagaataagtactactggaatgccaagaacgttaagatcaagcgcatcaaagtcacggtcactaaggatgataatacggcgcagaacctcttcaacgccggaacggtccaagtgaccaacatttcggggcagtacgtgaagaataatgccaataatagtcaaatgacggtcactaaaactggccggaataattacatttatttcaatagtaagaagtccgtaactgccaatgagaatttccggcacgcgctaagcctggtcattaatcaaaaaacactagcaaaagatgtcttgcaagacggctcgcaagccgcgacgaacattgttccgaaaaactacgcgagtgatccgactactggtgaggattttgttaaggaagttgggaacttatcaccgactaatatcaagcaagctaagcagtattggcagaaggcccaaaaggaactcggcaagcaaaatgtgactttgaattttctatgcgacgatacggatactgagaagaaactcgctgaatacgtccagggcgtggccgaaaagtatttgaaaggcgtgacgatcaagatcgttgcggttccacacgcgacccacgtatcacgtgattttacggggaactttgacctcgtcacagtcggttgggggccggattatccggatgcccaaaactttttggatgggatgcagagctcgaatagcatcaactttactcagtggaaagatgcgaagtacgatgcgttgatggccaaggtatctaatacggcgaaatacacggccgcgcaacggtggacttatgaaaagcaagctgatcgccggttgatgaaactcgatgccgtgattcccacttaccaagcctcttctgcatttttggtcagcaaggatgttggtggcttacaatgggatgaattttctggaacgtccagtcaacttcaatatgcttattggaaataaaaacttgtcatgaaaggtggtgaggcgtggtgaatagtcagttagagaaccaacaatgcagtgatgaaaatgatggtccgttaccgttaatgaacggtgtgcgacctgccaaaatgaaaggaagtcattattatgaccaaaaccaactatatcaatgcctcaatctacagttcagaaaagcaaacttttatcgataatcaattcatgactgttgacgacgcaaccggaaaaatcatcgcggtcggtacaggaaccccggatacgattgctgaacaaacgacagacatgcaaggaaagtatgttatgccgggcatcatgaatgcccatacacatattaccagtattccaacttactggtggcatgacggccaggaagaccgccatccggagtcacgtgagtataataccatgtatgcgattcacaatatgcaagatatggtaaaccatggggtaacctatattcgcaatgttggcgcccagtatgatattgacgttgcgatttcaaagatgcaacgagaaggaaagattgcgggccctcgcgtgatgacatctggccaggccttttcaattacgggtggtcatggtgcggatggcggccaagaagtcgatggtgtggatgcggtcgttcaaggtgttcgccaggcccttaaaatgggcgtcgataatatcaagatgatggttaccggtggggtacttcgaaacggcgagaccccagatgatattcagtttaattttgaagaagttcaagcagccgttgctgaggcccatcataaaggcaagacggtggcggctcacgcgcaggggaatgccggggtaaaagaggcggttcaagccggcgtcgatactgtcgaacacgcctttgatattgatgatgaaacaattgagatgatgcggcaacatggcactgtgatcgtaccaacgatgaacgcgatgtatgctatttataaatatggcgagaagaccgttccagcatgggcgcgtgaaaaggtaatcgtcaacatcaagaagcattttgcaagtatcactaaagccgcggcggctggcattcccatcgcgatggggacggatgctggaacgccttataatggctttgaggatgaatcagcatacgaaatgcagctctatgtcgataaggcgggcatgactcccgcacaagccatcgatacggccacaatcaactgtgcccgtgcgatgcatgttgcggatgaatacgggacgatttctgctggtaaatttgcagattttattgcaatgaccgccaatccaatcgaagatattcgggttattcagcaagataaggatgttttccaacatggcattcaagttcatcaagcggctaaaacggccggtgttgatgagcaagttcctgtacggcaggtcgggtagtccgtcttattgagaatcagggctaagtgtgggtagtcttgattcgtcatatgaccagttagtgtactgacaggtgagctggttctggcttgaatttgatagtggtttgatttagtggccaatcagtaggtcagatgccgtgaattagtcggctaaaaatactagcattataaaccgattttctagtcattacggacgggaaaatcggttttattgagtttagagcagctttgatacggctcgcgagtggcaattagtaaatacggcaaagggaggctgtgggccgcgtctctgaaacgcgccatgaacaggttggttattgacataataagcactagattttgctagtctgagttttcaggagtagtagaacggccgaagtcctaatcgttgtaagggttcattaagtgttcatactcaggtgttcgcatggcgaatggtaatgctataatgaaagcaggatttttaacgaggaggattcaagcatgacagtatttgaaggtaataccgtcgcggctgcaatcgcggctggtctaaaacaactgcaccgaacacgcgatcaagttgaagttgaagtgatcgctgaagcaaaaaaaggatttctggggctaggcaaacaccccgcccaagtacggctaacggtggtgccagcctccgcagcacctgcaacgacgccaacttccgctacggcgacagcgcaacagtcagtagctactgaatcaacgacagcaccgaccatgccgcggcctaccgtgcggacaccaaagtcaacgccgaccagacaagctaaaactagtcaggccacgaccagtgccacaaaaccagcgactagcaaggcggaagcagtagctaaacccgcttcaatggcggttaccaccggcccggttatcgctggtaccgaccaatctaaaccagtgaccactagtaagaccaaatcagcgactgctgaccagagtcagacgccgcggacacccgctgaaattgcagcgcgccaagcagctaacgagaccgcggtgcgggcgttgtgcgattacttgcttgcggtggtcaaagaactaggtgtcacggcggatcttgacgtcgacttcggcaaccgctatgcgacattgaatttcgatacaactaagcagggtttgctgattggcaaacacggtcgaacgatcaatgcactgcaagatttggcgcaagtttatatgaatcatcatggcgcgtcacacgttaacgtggtgctagatgtggatgattatcgggagcgccgggctgcgacacttaagcggttagccgagagtacggctcgagaagtgattgcaacgggcaaacaagttttcttggacccgatgccatcgtttgaacggaaattaattcacgctgaactagcgaataatcaccatgtaaccacattctcagaaggccgcgatccgcaccgggccgtggttgtggcgattcgcaaatagtttattcaaagtaacgcaaacaggcgtttgacaaactccgggtgagctattatagtaggtgttaatcattcttatcttttagataaagtagtcaaagtgctttatccacgctttaaggtggcgtggactaggcgctttttttctgcattttaggacatattattaactaattgtaagtaaatttggtatggtattaggcgatgaaacgctgacaagaaaggacatgatggtatgccaacgaccacagaatttgacacgatcgcggcaatttcaacgccgcctggtgagggtggtatttcaattattcggattagtggggaccaaacgtttaacgtggtgacccagatttttaagggtaaagatctcagtcgagtgcaatcacacacaatcaactatggacatattgttgatcctgatacccatcaggaagtcgacgaagtcatggcgaccgtaatgcgcgcgcctaaaacctatacgcgtgaagacgtggttgaaatcaactgtcacgggggactcgtggcaactaatgaaattttacaattgatcttgagtcacggtgcgcgaatggcggaacccggtgaatttaccaagcgggcattcttgaatggtcggctggacttgtcacaggcggaagcagttatggatctgattcgtgctaagacggataagtccatgaaggtcgcgttaaaccaattagatggtgatctatctaagctgattcgacatttacggcaagatattttggacgtgttagcccaagtagaggtcaatattgattatccagagtatgacgcggttgaaacaatgaccaccaagatgctgaaggagaaggctaccgaggtcgcccaaagcattaatcaactgttagcgacggctaagcaaggtaaggtcttacgcgaaggtttggcaacggcgatcattgggcgtcccaatgtcggtaaatctagtctgcttaaccaccttttgcatgaagacaaagctattgtgacggatgttgccgggacgacccgcgatgtgatcgaagaatacgtcaatgttcgtggagtgccattgaaactcgtcgatacggcaggaattcgggacactgaagataaggtcgaaaagattggggtcgagcgaagtcgcaaagcaatcggggccgccgatttagtcttattagtgttggataatagccaaccgttgacggctgaagaccgagagttgttgcaagagactgaccagtcaaaacgaatcgttatcttgaataagactgatctaccagcccgtcttgatcaagctgaattggcgcaactagtcgatttgagtgacgttttaagtatgtcagtcttggaacaaagtggcgtcacgcaacttgaacaacggattgccaagatgttcttcaatgaaggtatcgaaagtagtcaaaataacgtgatggtgaccaatgcgcgtcacatcggtttgttgaatcaagccaaacaagcgttgcaagatgttcaaacgggacttgcggctggtatgccagttgatttggttcaaatcgatatgacccgttgctgggaatttctcggtcaaattaccggggatagctatgaagatgaattattagaccagctatttagtcagttctgtctgggtaagtagtggtaggaggaaattggaatgacagaagtaaagcagtacccaggccgcgactatgatgttatcgtcgttggtgctggtcatgccggttctgaagcagcattggccgctgcccgaatgggtaaccggacactcttaatgacgatcaacctagacatggtggcctttatgccatgtaatccatcggttggtggtccggctaaaggaattgtcgtccgtgagattgatgctttgggcggtgaaatgggccgtaacattgataagacttacgttcagatgcggatgcttaatacgggtaaaggcccagctgttcgagctttacgggctcaagctgataagcatgcttaccatgcggaaatgaaacacacgattgaacgggaacctaatctgacgttacggcaaggaattgtcgatggcttaattgttgaagatggggtctgcaagggcgttatcacgaatacgggagcgcgctatagtgccaagagtgtcgttttgacgactgggacggcggctcgtggcaagattatcattggtgaactaatgtattcttcgggtccaaataattcgcaaccagcgatgaagttatctggtgatctggaacgacttggatttaacttggaacggtttaagaccggtacaccaccacgagtcgatggtaatacgatcgactacagtgttacggaagaacaacctggtgatcctgaaccacatcattttagttttgaaacgaaggatgctgactacattgatctaaagcatcaattatcttgctggttaacttatacgaatgagacgactcataagatcattcgtgaaaatcttgatcgagcaccaatgtttacaggcgtgattgaaggggtcggaccacggtactgcccatcgatcgaagataagatcgtgcgattcgctgataagaagcggcaccaattattcttggaaccagaaggccgtaatacggatgaatggtatgttcagggcctttcaacgtcgatgccggaagaagttcaacagcggattttacattccattaagggtcttgaagacgctgaaatgatgcgcccaggttatgccatcgaatacgacgtggtggcgccttaccagttaaaggcaaccttggaaacaaagttggtcaagaatctctatactgctggtcaaacgaatgggacttctgggtatgaagaagccgctgggcaaggattaattgccggtatcaacgctggtttgcgtgcccttgatcgtggccaattcactttgaagcgtagtgatgcttatattggagtcatgattgatgacttagttactaagggcaccaatgaaccctatcggttactaacgagtcgggctgaataccggttgatcttacggcatgataatgctgatttgcggttaacggataagggccgcgagttaggattgattgatgatgaacggtatgcggcatttgaggcgaaacgccaagcaattaagaatgaacttgaccgtttaggcaaaatcagaatcaagcctaatgatgaggtcaatgctttcttacgtgctcataattctggtgagcttaaggatggtgtgttggcggcagatttcttaaagcggccagaagtacaatatgctgatttaatgaaatttatcccggcagcacccgaaccactagaacggcatattattgagcaagttgaaattcagatcaagtatgccggttatattcaaaaagcagaggaacgtgttgatcggttgaaaaagatggaagctaaaaagattccggatcggatcgattatgatgcgatcgacggattagcgactgaggctcatcagaagctaaagaagattcagccgacaacgattgcacaagcttcacggatcagtggagttaatcccgcggatattgcaattctgagtgtttatattcaacaggggcgaatcgctaaagttcaataatcatcagtagtaggttatgactggtgtgttcagttgatattaacgaatgatgaaagaaaaaattaatatttttaacgataaagcacaattccaacttggaattgtgcttttttagtgagcttactttttaattagtacacgtttcattaaaaaaacaacaacactttaattaatgatgactaaattaaattaaggtattatacttcagaactagtaaacattgtttacagtgtttacaaaataaagggggagttattgttggtaagagttagtaagttagtcagtggtattttagtggcaagtagtttattagtgagttcgggtgtcatcgctcaggcagatacgcccgctgctcccaacgcagatagtacggccaatacgactggtacgactgatattcaggcgatgtttaaaggtaatagtagtccggtatcaccagttaatccggataatcccaataagcctgataatagcggtgatagtggtaacggtgctaaagccggtggcggcttatcgctgatctacgtttctaataaattagattttggaagccatgagatcgatgttttaaatccagaaacgtacactgccgcagaaactgattcggatttatcaggtttatggaacaaaaaagcagtcacagaagtatctgatgtccgaggaagtaatgctggttggacactggccgttgccgggagtagtttgactggtacagacggttctgtaatgaaaggggcaacgcttcagctaccaaaaggtacggtaactaattctggtgcaactaataatggcgtgcagtccactgaggctcttaacgtgttagatggtaattcggcgacagtattatcggcagcgaaagatcatgatgctggtgtaactgttgatcaaattgatccaagtaatgttaagttaacggtgccggcaaacacggctaaagcgcaggggtaccaaacaactttgaactggagtttgagtgatacaccagcaagttagttagaatataaccaagaggggaagctaaagcagatggcgatggctaacggttattatggataaagtaatcgttgatgtaatcgcgagcagtggcttcccttttattaaatgatagttttaaaagatgcgtcataatatggggtgtgttgagattgaaagtggttatccaattcataagactaatgggtgtgagtcttggatttagtattttaatcggacagacaggagtgtcggctaatcggcaacaatcggtccacaacaacaatgtcggttttagtgttgccgctgagataccaaaaaatcagattcataaacaaaattctttttttgatttgaaaatggcaatcggtcaacagcagacgttacggacagacatttacaatgtcactaataaggatattaaggttcgaacggctattcataccgcgtatacgaatactaatgggacgattgaatatattaatccggccaaatcgtacgatcagtcgttaaaataccgagtcagtgatttagccacaattcagggtgagcggacaataacgattccggctgaaggctccaaaacggtcgcaatcaaggtgaagttacctaagcagccagtaaatggcgtcttgttgggtggatggtattttaaacgggttgatgacaaggtaacaggagtaacggagaaaagtatcaacgttaagaatgagtattcgtatgttattgggttgaaattatcttcaggaaaattgccaattcctaatttgtgtctagggccggtgaaagctggcttgaataattatcatcgaagcattattgttgcgctacgtaatcctgtcgcaagaatcattccgaatttaaaaatccgaacagtgattattaataagcggcatcaaaaggtcattattaagaatacgaaaacgggtgtcatgatggcgccaaacacagtttttaaagcaccaatgccattaggatcacaacaattacaaccgggtgattatcagttacaaatgacggttaataatcagcgtcatcattggcgatttaaacgagattttcatattagtatgacagcagctcaaaaatataatcatgagtcaattgataataagggggttagtatgtggatgctaattggaattggcgcaatttcaatgctagtactggggttagggttaggcgtaatcgtctggctatggcggcgacaacggcggtcgaaggattaggttaattaatgggggtaggatggtgcaacggtttagcgtgtgtgtagcaaccattttaatcagtttaataatgttaacaataacgggagttgcggccgttggggggcggtcaacagtcaccgttagcttttatgctggtcagagaactcagcaacagatagataatcgcaacgttaagattcctaatgggaccaggccatatcgtgtggtgacagaaaagacgttgacaagaccaaaggggtattatcaattgccacagactgatgagcagctcttaacctggttttatgcgagtttcggtagcgtgctactgatattattgatggttatccgttggtttaataaagaaagctattgctaggtaaggagggaccgtagaagtgagaaggttacttactggcacgttggtcgtgggtgggctgttattggtagtttgcctcatggctgttaatgggcaggcaaaggttgtcgatgagccgaccagtgcgatgcaggatattacaactaatttcgaacaacgaacaattggtcgagtgccatggcccattacacacattgcggctaattatgtgcgagatggtcacatgacgcacaagactagtcgagtgaaaattactttaggtaaaggtgtagtacattcgccgaatggtaagggattatataatttatgggatctggttttgaatcgccaaggcaaagagtatggtgcaactttcctggcttataatatcaataatcgagtttggcgaccgcatcgaacagatactatcaagacgcatggaatcaaagcaggtcagccggtttggattggtaataagagcagtactaatgcgagcagtaatcccattcgaacactgcctgcttacatggtaacgaagcagtactgtcaaatggttagtcagattaaattatcaccacatattactggatttgaggctaataagcgcatcattaccgggacgggcacacaaggtggtgatctaatcacggctaaatttggtaatcagatcaaaaaaacacgagtcgatcatgaggggcgctggcagatgaaatgctttagcggtaatggtcgcttgatggtaacggaaacaaatgcgtatgatgatattccagggcacactgaaacggtgattaataacggaactccacgaacggatgcgacgattaagctcaacttgtttttaactaatggtcataccttttcaaccgctaagggacgcaaggtattagtgaccggaatgatcttggggactgatcagaatgattttgatcgcgatgttgttttaaaaaataacgcactaaccatccactttgcccatgctgatggaacgcccatcgctaattataaggctaatggttcggtgaatgagccagataaggcggggtattttcatctgaaattacccactgaatcgcttaaacaagggcctaatgatgtgaaagtgtgggtgtcagatcaacacggccaacgatctaatattgatacgttaacagttaatgtaaattcaggactcatgtttggtcaaatcaatgctcaaatgcgttttcggagtaacacgattccacaaagcgagcgcttattatcgcccacaaatcagtggcaaattgaggttcatgatacgcgatcagttgcttcaaagtggtatgtgtatgccaccgcaactaaaatgaagtctgctcaacactcattaattggggatttggtctatattgatgctgctggtcaaaaacatgtgatgaccaatcaggaaacgttggtaggccatggcacacatacaaatcctaatcaacaaactactaatattgcagcaacctggcaagcgcgacaaggtatttttctcgatgttcagcccgaattgtatgcaggatcctatcatggaaagatcaattggagtttgcaagatacaccacaatcttgatgagtggaagaaagatgtcatcaagatgtgttagttagtcattaaggaaattatgaatgaccgtcaagattgttttggtggtcattttagtgtgatatcgttgcaaggttacttataaatttgtaaaaacgattcaccaataccagacaagctgagttgattggactataatgattggaagttatagcggggtaagggagaacgtttgatgaaaacttttaagagtattatgagctgggtactaccaattgtagtggggttactcgtcgccatggtgatcaggcactttatttttacgatggttcgggtggatggaccgtcaatggaacctaacttagatgacaatgagcgcgtcgccgtggtcaagacagctaagattcagcacctcagtgtcatcgtttttaacgcctatcaagttgatccagacgcacgctccaagacggtcaaatatgtcaaacgagtgatcggaatgcccggtgatacagttaaatctgaagacggccgactctatgtcaatggcaagcttgtcccgcagaagttcatcagtcagtatgagcggacgcagggaacgacaaattgggatttgagtacgctggagaaccgttacagttggaatctgaaaacaactaaggtccctaagcattcgtactttgtgttaggtgatcatcggtcagtgtcaaatgatagtcgttactggggatttgtcccagccaataaggtgttgggcgtggtcaaagtgccattttgggactcgaataagactaagcgccataatattaattcaattagttactgaatagcagccagcgcgactcgttagtgagcgcgcttttttttgtatgctcaccaactgaatggtagggggggaaactaggttacttagtcattctttacagggagaacaatgtgggatggttaaagtgactaatcttgttcagaaaagcaaacaaaaggtagcatctaaattgaatttaatggtcaataagcctagaataatggcaagtatcacgatggaggctggtaaatatggcaactgaactaacaccggatgcacttgccgctttacggacaacgcatgcgcaggatcgaatggcaccagtattgacgcgagcgattacgaagaatgggattgaggctgcaagttttgataatcaagctgcgagtcgcttagcgcggactttttctgttgaagtaccaacgggtaaggtcagtaatcagaagcacagcggtcgttgctgggagttttcattattaaacacgctccggcataagtttgcgacccggtatcacgtcaaagactttgagttatcacaaaactatttgtttttctgggataagattgaaagggctaatattttttatcggaatgttgaacaaacggcgcgtcagccgattgatgaccggcttgttcagttcttatttgctaatccgggcgaagatggtggtcagtgggcgatggcggccagcttggttcaaaagtatggcgtcgttccagctagtgtgatgccagagtccttcaacactgataatacgacggcatttcaagccagtttatcacggcagcttcgtaaagatgggttaaaacttcggcaactcgtgatggatggtgcaagcgaggccgagctacaatcactggagaaatcaatgttgcaaacggtctatcggatgacggcgtactcatttggtgaaccaccaactagctttgatttagaatatcgtgatgatgagcaacagtaccatcgtacggctaatttaacgcctcagcaattctatcaggactactttgaaactgatctggatgattacgtggtcgttactaattcaccagataagccgtttaatcgactttatagcttgccagacgaggataacgtgattggtggtaagcctatcgaatttttgaaccttgatatgggtgtgctgacggacgttgctgtgcaacagttacaggctggcgaaacggtttggtttggcaacgatgtgttgcgacagatggaccggaagacgggatacttggatgctcatttatttgaaactggcaagttatttggaaccaacgatcatctgactaaggcgcaacggctgttaacaggtgaaggtgaagttagccatgccatgacgttaaccggcgttgacttagtggctgatacgccaactaagtggaaggtcgaaaatagttggggtgagcaagtaggtgatcaaggctacttcgtaatgagccaagattggtttaatgagtacgtctatgaagtagttgttcacaagcatttcttggcaccggaatttcaggcgctgcttaacgaacgtgcacagcggctacccgcatgggatccgttgcactaggagggtaatgtgatgggaatattttcagaacgattaaaagaagcgatgcaacaagcgaacataacctctgctcagttatctaaacaaacgggaattggtcgttcatcaatcagccagtggttaagtaataaatacgtggctaaacatgataaggttacggcgttagcggcggtactgaatgtgtcgccagattggctgctaggtacgactgatgttgcaacagcggtggccccggaagcggtaccgattccagtgtcggtcacgccaacccctgccgttgaccccgaattaataacattgtgggaacagctggataccaaacaacgatctaagttgatcaaaaaggcacggaagttgttgactaagtcggccgaacagcccaacacaaagcggaaaaagaacaagaaaaagaaaaaaggcaagaaacggaaataaggcaatgcaaaaaacaacttttgctcctcagctcgtcgtgaggaacaaaagttgtttttgactgtcatgatgaattatcaggggttgataatggtgaactaaatggtccatttttcccagtcacgcgcccaaatcagtcccatgacgccttctccaacgtgaaccccaacgacgggaccgatctcgccttcatcgatggtgagatcaggaaagctagccttcaagtcagctgtccattcggcttggagtttcggattgttgccgttttcgattgtgacgcgaagtgaatagtcaacggcagcaatctcggcagccagcttggctttgatggctgcgtatgcccgccgcatcgttcgttctttttgaatagcgacgatcttgccatcttgaaaggtcagaacgggtttaatgcgtaagaggttgccaacgagtccagaagcgtttgagagccgaccagtccgaaccaagtgactgagattatcgacaacaaaatatacgccggttgtttcacggatttttttgagctgagcaataacttgttcgggtgagtatccttcagtgactaatttagcagctaacaagaccatgtaagcttctccaccagccgtaattagtgaatcaaacagataaaccttgatgttggttacgtttggcaggtaactttcgagattagtaataaagctggtgataccagaagaaagatggatactaatgacagcatcatagcccgcctttgccagctgatcataagtcgtttgcatctgaccaagggtaatctgagtggtcgttggtaactcaggcgcggtacgcattcgttcataaaattctttggacgttatttcgacgttttctaagtaggtttggtgaccaaaaataacagtaattgggacgacgtgaatatgatacttttcaacatcggccgctgagaggtagcttgcgctatccgttacaattgcggttttcatttttcccccgctttcatttggtgaaagtattgcctaacattataacgcttgtcagtagttgaaagctagctttgatgaatagattaaggcgattaatgtttgaaattctcaacaactaacgtcataatgagaatcattaaatgggggagggcgcaggatgaccaaacgaattgagataaaaccggcaacagctgcggatcaagcagcgctggctgaaatatatttagtggaccgtcagcaagattttccatgggtcactgatccacaactgcaagattttaacgaagacagccgtggtgaattcgtgctggtcgcgtggattgatggtcagcgggctggcttttgttcgttgtaccggctggccaacttcattcatctgctttttgtggccccagatttccgccacttgaaagttggtgaacggctactgacagaaatgcgccagtatgcaaccgaaccactcacgttgaagtgtgtgatggccaacgaaaatgccctgcgattttatgcgcaagtagggtttcgaattgtcaaagcagatgcggacgcgctcccaccaaattatacgttgcgtgatacgcatactgagcagtacgtggcattagtggatgttatggccaatgagcgcaaacttaattaatctaatttatttttaattttaaggttgacattgtgataatctggcgctagaatctaatcattaattaaatttagattaaaagccgtgataaggaacggtgctaagctggttagttagcgagctgcggattggtgtaaggcagtcaataccacttaacatagatcaccttggagttgcgcctcgaaattcgtggagatggtgctggatggtacccattaatgtaccggcgtatcgcaattgctgtacgtactaaggtgactattgtgaagtagtcgcgaataaaggtggtaacccgttctggacgtcctttaattaactcataggagttagttaaaggacgtttttttatgatttaaaggtggtgaggagtatggaatcggacattcaggtggctagttaccaacaaatgtgggcaatggtaactagtcgcacgaggacttgctcctcgagtaacacataggtcaacaaggaatcaaaaacacatagtataactgagtactccgggtagatcacatacgataccacgtgtatcgattaacacatagttttagcaacgtgcaatttatacgtttaggcacacatagttttaacatgaacgatatttatgacccgtagtcttaataattcgtatttaagacgcccgtacgattaagttagcgcactgaatgaatacatccaaataatgaagtgacaactagattaattgtaatgagttaacgtattagcaatgattagacggcctcattacgaacacatattaggataacagtaaccacaaacacataatggaggttttataatgacaactaccaccacagaaacagaaactcaagttgcacaacagctatttacggcctatcagacacagcatgcgttaacaatggctgattttacaagtagtgtcgctgacgaagacgctgcgtatcgagttcaagccgcgttaacggccttaaaacagcagccggttggcggatacaaggtctcgttgacgagtgcggaaactcaaaagatgtttgatgctcatacgccgctgtacggtgcccaggttgcagatcactttttggcggcaccaaccacggttcgacgcgggcaactaatggacccactcgtcgaagttgagttggtctttaaggctaaagaagccctgtcaaccaccgattcattgaccgatttatggcaaaaaacgactgtcgcgccgggacttgaattgccagattcacgttttgctgactggtttcccgatttgcctaaaaatttggtggtcgcggatgccgcagtcggtgggctagtggtatatggaactgaacgggagactgccgagttgttcgcttcagctgatgcagtagcaacgccaaagtgtacgctagtccatgatggggagacggttaaaactggtcaagcgagtgaagtgttgggtaacccgcttgagtcattgaagtggttagtcggcaagcttgcagagcaaggtaagacattaacggctggtcaacgagtttcgtcggggacgtttgtcctaccaccacatttgaccgcggggcactggcaagccgacttcgatgccgggctgggacaggtcgcactggatgtaacggaagcctaagtaaaataattacgaaaaaggccttcataaatgtcatgacatttatgaaggtctttttgaagtgttgctaaatgaatgtttttcagatgattagtaattttcaaagattggacagactgctaattatccaatttgtagaccagaatgtttcacgtgaaacattacttatttaaacgatggtagttttgatcaaagtacttgccgctgcgaatatcattcggcatttctttgtaaggtgcttcattgattacatcttcattgttttggccggcgtcgtccatgtaagtaatattggcaaattcgggtacaactagttttggataagtggcatacttttcacgagactgttccattaaatcgatgtgttcgttttggtaagtgaccgtaatttcagggtgttcttcaacccactttgggaagaaaatcgtaccgtgtagtttcttctcattgggcatgaagtctagtgcaacgtcagtcccagttggttcagtccaagaaattttgtaaatgccttcggtcaacatgacgatgtggtagattgcaaatttaa

SEQ ID NO: 6 - DNA, 74240 bp, Lactobacillus plantarum
gtgaaaggccagtatttaagacgtgggcttcggcttaaatctgttcccaccacgttccggcaattgacagaaatgcctggaagtcggcataggacacactaactaagcaagtttacgctaacctgaactttttccagcgggtctaagctggttgcttttgaacttaaaaacttggcacgttttaatcatgaaaagcaacaaacacagtgcggattatcggatagatgagaatggcagtgatggactcaaggaaaatagtgctgaactaaaaacgtcgtgactgacttcagtcgcgacgtttttgattagaaatttagtttagttggtacttgattgggcgtcgattgggatgtgcttgaatagttgggctgctttgacggcggcttgccagccttggtaaaggttcgcacgttggggcgcggccattcggggttggaagacattgccggtttggtggattgatttgagttcgtccaaatcttgccagtatcccacggctaggccggctaagaatgcagcaccgagtgcggtcgtttcgaggtcagcggcccggatgatcttgacgtttgagatgtcggcttgaaattgcatcagccagttgttgcgggctgccccgccgtcgaccatgagtgtgggcatggtgatgttggcatcgtttttcatcgtatcaatgacgtcgcgggactggtaggccagtgactgtagcgtggctttaacaaaatcagcccgggtggtcccgcgggttaagccaaagacggctccacgggtctcggaatcccagtaaggtgcgcccaatccggtaaaggcgggaactacgtaaacttcgttgtgattatgggactgttgagcaagactttcggattctggtgctgattcgatcagttgcatgccatcgcgtaaccattgcagggccgaacccgctacgaagatggagccttcaagcgcgtaattgatgttgccatcaagcccgtaagcgatggtcgttaaaaggttgtggtcggataattgcggttgctcgcccagattcatgacggtaaaggcaccggttccataagtatttttgaccatgccaggttcaaaggccatctgaccaaatagtgcggcttgttggtcgccggccatcccgctgattggaatttggctaccataaagcaagtagtccttagtcgtgccatagatctcagagttggaccgtacttctgggagcatcgcagcaggaatgttcagtaggttcagaatcgtttggtcccattgtaagtcgtgaatgttgaataacatggtgcgactggcgttggtgtagtcggtgacgtgggtctcgccaccagtcaatttccagacgagccaagtatcaatagtcccgaaaagaagttcgccgcgttccgcgcgcttttgggcaccatcaacgtggtctaagatccagcgaattttcgttgctgagaagtaggcgtcggtcactaggccggtgtgccggtgaatcagatcgcccatacaatcagcgatgagttgctcagctaacggtgcagtttgccgggactgccaaacaatggcgttataaatgggtagaccggtttgcttgtcccagacaacggtagtctcacgttgattggtgatcccgatggcttcgatttgattaggtttaatattagcgtcaattaagacgttagcgatcgttgaggaaactgcgttccagatttcagtagcgtcgtgttcgacccaccccggttgcggaaagtattgtggaaactccttttgggcgtcggcaactttttgaccggcgtgattaaaaataatggtgcgggtactcgtggtcccctcgtcaatggccatgatatatttggctgacataacttgttcctccgaagattgtaatcaataacatcatctttgatgctagcatggatgagtggatttgtgaataaatatcaaaaacttaatatataaactggcgtcccacgaagtatctagaattaatcatcacacccataccaatccgctggaatgaagaaagggttaccatgcttgttttgataatattacttttgtacaacggttagtaacggtgttgaactaagattaatgaatatttgaaatgtagaccaatcggcatataatggggactcaaatcggtgtgaaatggaggattcctagtatgcaaaaacgacgcttttttcttaaaggctctgctgccgaggttgcttggctcaatcggcaggcggcgcggggctatcaattgacggcgattcacggtctgagttatcagtttaaagaagtctcacaagcacgtcagttgattgccgaatacatgccacagacgacgttacaagctatgacgacggtcttccaaccacttactagttatacgtttcatgatgatatgacggtggtttattcaactgtggcccctaaacaacgagtggtcaacaatgatcaacaataccgcttagcagtgtatcgacatgctcgcgatgtcgccttgaactggctcaatggctgggtgttggtagtctggctcatgatgagtgcgacgattgtgattagctcgcaattacaagcaacgccactattaacccggttgttattacttgggttggcacttggtgctggggtgatggtggcaggtattatcgttggtgttcggacagcgattcgttgtcaccgggaagtgtgtcgcttgatccgtatcacaggagacgatcacgagacgcggaagccgacttttcacgtgttgtttaagcatcaacaggccgctcccgatacgacttgctgggatgatttaggcaactggcaactggcactgcataatcagcgtggggattactactatgagttaaaaacaacattgagtgaattagaaatcactaatacactggcacaacgcttttcaaaacaggacttttccgtggtatcgtggttaggtttgtacgttgtttgaggcggatatcatattaattatgtgaatttagtgtgactttttttaaaaaggacttgttttttatcataaaagcgtgtataaatacagacataatcattgcccggtagttcagcggtagaataattgactgttaatcaagaggtcgctggttcgatcccagcccgggcagttggtcatgtttagttaagtagcggtatctcgtgaggtaccgcttttgtcggcacaagtacagaatagcgctggcatttgatgggtaattggctggcagaactttagaaataattaactaaaaaagttctgacaaaccttgactattcttgactaaaaccgtatacttactatattaaagtaagtggtgtaaagtcacttgctgaaacttaggaggaattcatcgtgacagtaaacttatattattcaacgtccagcaagtctagtcgtagtgcacgagcatggttagttgagaataacattccatttaatgaacgcgacattattgctaatcctctggatcgcgatgaattgaaacaaatcctccggctcactgaaaatggcttcgaggacatcgtttcaacgcgttctaaggctttcaaagcattacacattgatttgtcggacttaggcttcaatcagttattggacctattagttgaaaaaccacaattactcaagcggccaatcatttatgatggtcggcggttacaaatcggttataacgaagaggacattcgggcatttttgccacgttcggtacgtaagtctgaattacgtgaaattcaacaaaaactttatgacgatgatcaacaagcagttggttaatcggatttagcgtttgagacgaaagcggcccatcaagaattgtgttgatattcttgatggggcgtttttttgtcgaaagaacaataccagccagccaccagggcgcgttaggttgcgtgtcttcttaacagcgtatcgcgttgtagggcgttattttacttgccgattaccgcccgttacctttgctgagtaagcagattccttggtataatcagttggtttgtgtacaatgtaaaaaggcttaaaggaaacggagattttaacataatgagtgaacaagaccaggctgcctgggcgatccaggcactcgccgctttgaagacggctgataatcaagttgttgtggagagtatcattaaggtcatcgatgaccaacaggctgagattgagagtctacggggttcaatggaaggccaattatggagtccaactagctggcatcaagatcagcaagcgcaacgtgccgcgcatgaggacaagtccacaactaaccattaaaattgagaagacgccacaaaagacggttgttagactattattggtctaacaaccgtctttttgtcactgcgtttgtgaatttaagttgagcgccatgctgtgatttacggcgcagtcgagcattaagctgccagcaagggggtgcaagcttcaggatacagttgtgatcagtaatccgtgacgcttgtcttgcggtgctgggccacaaattggaaggtagctgccacgagtccgccaatcaggatacccgttgcgttggcaatgacgtcgttgatatcgctactgcgattgatcagccaatgttgtgacatgaaatattgcagactttcaatgctggcacccactaacaagcccgttaatccgaggcccaatagtgggtagtgatgaaagtggcgtttaattccccagcctaagggaatcgtcagaatgatattttcgataaagcccagcccgtgaagatacaaccgtgataggttcacttggccgacaccagctggcatcacgtagatggcagttccgtcgaatgacagcggggtaaacaaaatcacactaaggccaaataagtaacctaagccgagtagctgccgcgtccgggcttgtggctggcgaacgtgggcaagaatcaccaaacaacttagtgttgcaactattaaaataattctgaacggttcccaacgcatgcacaccactcctcggtttggattaactgtatcttaccgtaaactcagtggtcagaagtaaagaagacgtgaagcttaatgaagcctttaacggcttaaccaaatcccaagtaaatcagtggttagatgaccgtgattgatgttggtcgtcagccatattcgcaattggtttcgtagtcagcgctaaagcagctacaatcataatgataattagactgaaccagagtgcgatctgggtgccgagggtggtttgcatcgtactcgaagcactcggtgccatgcgggtgcccaatgtaatcaagacggccataatggcggtaccgagcgaaccagaatactgttgtagggtgttgaaaagcgcgttgccatcgcccattagttggggcggcaattgttgtaaaccatacgtcagggcattgttaaataagcaactgaacccaatttgaaagccaacaaataagccaatgatcaagccgaccgagagatgctgggctaaccctgcgagacttagtgttgccaacagtaaaaagccactaccaatttggaatggtcgccgaatgccgcgacggtccatcaatttaccagccaaaggtgatagtattgctgaacataagcttcctgctaataacattaagcccgacactaacgcatttttacccaaagcgagttgtgcaaaattagggagcagaaaggtcagtccaatctgaatgaattgaatgaagaagtaaatgagaagcgctcgggtaaagttaccctgttggaagacggccaggttgattagtgggtgcgtggttcgggttgccgaacgggtaaaagtcagtacggcgagtaccgctaataacagtggtaaccagacgaatactaagcttaagccatgtgtactaaggttattgacgctaaaaatcagcaggatgagtgccgcgacgactagcccgaattggcataaggggaacggacgtgaccgtggtgcctgcgtttggcgaatagttttggccgttatcagccaagcaatcagaccaaacggtagggtaatgccgaaaattaagcgccaggataatagttgtgtcactaagccgccatatgttggtccgagtgaaggggccaatgcgatcaacattccagcggtccccgtaaaacgaccctgagcagtgaaaggaacctgggtcatgatttgcgcaaatactaatggtaatgccaatccagttccgatggcttgaatgattcgaccgaatagtagtaaccagagctgtggcgcgactgtacataataaaccgccaagaacgaaaccagccccgccaacgttaataattgtccgccaacggaagcgttgttgaataaacgccgtaataaccatggtagcggctacggcgagtaaataggcagtggtgacccattgaaccgttgctagagtggtgtggaattggtgcatcaaggtcggaaaggtaacgttcattgatgtttcaactaaaataccgcaaaaagccagactggcggtgccaaaaattgcaaccttcgtttgggttgggatgacaggtgttgttgtagataaaataaaacctccattgatcaaggccagctcgtttcgtatgtgaaacgacgcttttcttgaccaacggagattccgttgtaaagatatacaagcatcaaagacgaccttgatgaatttattaatgatttaatcctagcataatactgataaaaatgtcagtccgctttttttattcgctgactttagcgctttgttcagctaaagcagtcaggtgctcgaataggatgccttcacgcagtccattttgagagaaaatcatccggtcagaatctaaaaagcgcatcagactaatggcaggaatcatcccaccaacaataatatcagcccggtcctttgctaatccaggaatagccgcgcgaccagctgcatcctggctaatgacagtattgaatgtgtcatagatggcgttgtcacgtagccgataaccgtgaatatcttcaaagttgaggatattgcatttgcgccggttaattttggctaacgttcggttgctaccacccaaacagacgagtggtaagttgagaccgtttcgcaaccaccagacgctattaaaaattttatcaacgaaagtcatcgttttaaataattgactagcggtaacttggtcgttgaggccgaacttttcggataaactgaccgcgccgattggcagactgattaggtccttggcttggccgtttacgataaggacgagttcgcagctaccgccaccagtatcgaccatgacgcagttagtcgttggaagcgtattgactacccctaagtaatcgtaataggcctcggttgttccaggaatcacttcgatatctaggccaacatcatttttaacgcgtttgagaaatttcttttggttgctggcctttcgcgttgcggcggtcgccacggccttgatagttaagttaggtaagtctttgtagacggcagcaaacgactttagcgctgcaatcgtgcggtcaatggcctcggcttgaagggtcggcgtatccgtggcgttttcattctcggataaacgcaccatttccttgagtcggtgagtgactgcataactaccgtcttcctgaatctgtgtaattgtcattcgacatgaattggaacctaagtcaatgaccgcaaagttttccatcgctaatcatcctctctatcaagatctgaagcatccggctcattcttgggactcatcatcggaatgaactggtgcgcgttgctagtgggcgtagtatcgccgtgatcagccttgactgcttgctcggcttcgcgaatgaattcggcctgggagtccaaaacctctaagccgcgcccatccacacgggcgtacgtattatctggttgcaaaatgcgcgttttgaccgtgtcagcccacatcgtttcaaaaattgtcatcgcacggtgactgatttcaggttggagcagtgggaacaataattcgacccggcgatttaggttacgggtcatcatatccgcactggataagtaaatttgtggttcaccgtcgttgctaaagtagtatatacgactgtgctccagaaggcgaccaatgatcgagtggacctcgatgttatccgagatgcctttgatgcctgttcgtaaacaacaaattccccgaatgatcagttggatcttaacaccggcgtgagaagcttcgtagagtttgctaataatctgcggatcggataatgagttcatcttcattttgacaactgcgggctgaccagctttggcaatggcaatctcatcgtctagcttttcgttgataaagtcgcggatgccatctggtgagatgtgcaatttgtggaaatacggtggttcagaatagccagataacatgttaaagatgttggaagcatcgattcccatgtctgtatcagcggtgaagagccccatgtccgtgtagaaatgggcggtgacatcgttataattcccagttcccatgtgcatgtagcgcttgataccttcattttctcgccgaacaacgagggcaagcttacagtgtgtcttaagcccgatcaggccgtagatcacgtgacaacccatttcttcaagttttttcgcccagtgaacgttattttcttcatcaaaacgggccttaacttcaacgagaacggttacttgtttgccgttttgggcagcctgcccgagatacttgataatcggtgaatcagctgatacgcgatacagcgtcatcttaatggctaacacgtcctcatcttccgcagcttcatggataaagtccacaacgggtttgaaatcatcgtacggatattgcattaaaatgtcgtgatccttgataagatcaaagatggatcgttcgcggtacttcgcgggatagtaggcgtggtattttggataattcaagtcttcgtggccctgcacagcttttaccagcttggataagaaggtcaagttgaggggaccgttgatgacgtataacgcactttcgttaatcccaagggctttagcgagtcgcgtgcgttgatgcttgctcatactcttttcgacttctaagcgcatgaccttaccgcgttcacgcatctttaattgtttttgaacttcctttaataagtccgaggtatcctcttcggcgacatctaagtccaaatcccgcatgacgcggtaacagctcgtttccttgaccgtatagttgataaatagtgagccgacaaaggctttgataatttcctcaatcagaataaactggttcggtgcgcctggcaaaacgaccacgcgaggaaagacgtccggcacttgaacggtggcaaacttgcggtctttcttatccccatttttataaatccgtaaggcgatgttgagtgtattattcccaatgaacgggaatgggcgtgaagagtcgtctgccatcggtgttaaagccgggtacagctcatcgtcaaagtagttcttaacaaaggcgtgttgttcctcgtttagatcagccatcgacaagagatgaatcgcgtgctgttccagcaatggcaaaagcgagcggtttaatgtattgtattgacgcttgaccatctcgtgggctttatcactgattgcactgacttgatcagcagcggtcagtcccgcgggatccggtttagtgtaattgactgacatcaatttacgtaatgatgcgacccggaccgtgaagaattcgtcaagattactctgtgtgatcccgagaaaacggacacgttctagcaaggggttatccttatcacgtgcttcatcaaggacacgatagttaaaatcaagccagctgagttcgcggtttgtataataactttctttataataattcatttaacgtaccccccgtagtttaatcactggtgttaaaccaaagacttctttaaagaattccgctttttgtgcgaatacccaattttctaagaagaggtcatcatgagcaaagcaagtaatgatgacccgtggattgcgaattgaaacggaaattttatcaattttttgtttgcgaccgtcatccaaagcgtccgcaattctcaagatggcggatagtttggagactaataagcgttgttcgacttgtaagtgtccaaaatggcgaatgtcttttgatggtgtttgcgcgctatggtagcgtgaaatcagggcgaccattcgtttttcggtatcggttaatcccatgagttcagtggcctgcaagatatagtccgaatgtaagtaatgttggtgcgggtcaatgtagctcccaacgtcgtgcacgatggcggcgacttgtaagagtaagcgctcgcgtttgcctaagtggtgtagcggtttaagctggtcgaacaggtgcagtgagaatttggtgaccaagtcgcgatgcttaggttcaacgttgtacctgtccgcaatgttcttagctgctgttacgatttgatcattaaagttatatttcttatagcccaacttaatggcttcttgaataattaacccatccagcacggtcacgttgccaagccagattttctcagcattagtgagttgtagtaactcgttaataagtagtaattcgggcacgattaggcgcacgtcttcttcatcaacttcgtatttatccattaaatactggtcagaagcgttcaacacgtcctcatataaagcttgaaaatctgctttgctgagttcctccacgccagcttttgattgttgttggcgaaagagggtggcaaacggcgcgacgccgagcatgacgacgttactaggctgatctcttcgcccaggcaagaagcgaccaaagtcaacgatttgactcgaaatataatcatccaaaacttcaacatagttaggcacgctcgattgcaaatcttcaagaacttccgcgattcgaactggtcctaaacggaggctacgggagaagacaaagttactctgatcgtagtgcgaaataccgacactaccagagttgattcctaataagtaggtcggcttcgtgatcatttgcttgaatcgtggaaagtgtaccgcaactgcgactgaacgcaggtaggtttcctgactactagataaccagtcgatcttgagcccagtccggacaagtaattggtcttgaatatagtcggcattgttagcggatgacaaggaccacgacccccataaatggtagtccttaacgccgtaatcattcatgatctgaacaaaaccactcagtgcctgcgcggcttgttccactgaatcataatcgatcgtatgctgatcataaatatcctcaccaagtgaaacgtcggaacgaactcgttctacttggcgtaatgtgcgtaaattgacaatcgacaattcaatactctgaacgttaatcatcataattccaaataattttgttgccatggcgatcccccatttttatgatttcctgacccccaataaggttaaagtcatgtatttaatttaagtttaacacaggttggggttagttaaattagtattttagtagtgaaacagttagcgattacttttagtttttatacgaaagttaagcgtaattaaggccatcattaactttgtatgaatcttactagttaggtggttgatgtggtgcttaccccggtttcagcggtagcgaacgctaacctaacttggcacgtttgatccaagataccaaaaaggcgtggttcagccgtaacgagtatgcctgaaccacgctagttgatattataagatttcgtgattatcgataattagtttgttcagatgtttttcaactcgtttatcagctggtggcagctgcatgtaatcaccatacatccgggtcaaaatggtgtcatacgcactgggaatcttaacttggatatcttcgaatggaacggtcgttagctcggtcaattcctgataggtcataatttccttttcgtaatcgtattgagacgccagatttttgtaagttcgggagtctgactgctcgtataggcgcatgtattcctcacgttccagcttatagcgattgacttcagctaattgctgaggtgtgtgtttcgtaatcaagttgcgcagtggtgttttgacaaagcggtaattcaatttgagcaggatcgcagcgtctgctaatttgtaatgtaacatctgtgaacgacgtaaggcttcgtcatctggaatcttatcaaacggaaagatgtcaacgaacacgcctttaaacgcattattgacgttgttgcgttcttcaatgtaagtatttacgtctaatagcttcatataactgagtgcatagtccggatctgaggcaccggtttgtaggaaaaacttgtttggatcaagatagtggttggcgacggcgataaagcgctggtagtcatgacggcgcattccaatgtcgatgtcatcgtcccacggaataaatccgtgatgacgaatagcaccgagtaaagaaccaccgatcaaaaagtaatcgatattttcagcctcacagattgcgatgacggtacgcatcaagcgcaattcaacttggtgtaagggtgtcaggggcatggtctcgtctcctttttacgtaagcgtttcaactactttcatcatacactttgttgcacaaaattgttagggaggatgcttaacgttggaatttacgggtaatttcatgcaaaacagttaaaggcgtgttatatttggtcaaaagttaatgaagtgatggtggtcgcgatgaacagtgacgaattaagcaaacttctcaatgattattttgaagcatatcaaaatacaaccaaaattatgatggacttagtggcttggcctttaagtcaaaataaactgtcatttgaacaatttttaatattgcggcgcattgccacgactgatgaagtgacactcaatgatattgcaattcagcgacaagtaacgcgaagcgcgatttcacggcaagtcaaatcattgttaatgcaacactatgtttttcaggtgccagatccgcgtgatcggcggcggctctacttacatttaacagaacggggacaacaagtcgaacggattgtcgaccaagccattacccagcactttgatcactgggtcaaccagttgggcgcaccacagattgatcaagtgctcaagatgatggggacctttagccagcaggtcacggacctcggtgagccacagtcacaccccgttctacactaggatgtacatgggactaactactaaattagtattgatgagcaactattttggtcgctagtcaaaaacagacttcttaggaattgtcacaattcttaagaagtctgttttgttacgaatacccattgaataaaaacacttgtactaaagtagggtcgtttcatagaaagtaagcactcaaatgggcgtacttgcttcactgtgatacgtgtagcgctcaatgcttgaagaagttatggtaaaccccttcgcaagcttcaagaaacatcccaatagccattaagtacatggctaacatgttctgcattgtgaagaccaagtagagtaggacagcgtagaggattaaaaagaagattgccgtaattttggaaccagccatttaaatcacacctttgtatggagaatcgtgacgcgttatttgcctgagggtcgtgaggaccaagagcggttttaaggcaatgaacacgctttatcaatttcattctaccgcaggctcattaaaattgaaaatcgcaattaaacagattcaaaattatttagcgttcggttattgcttttaaataaacaaaatgatacgattaaatacgttaaaagaacgctaaaacacgaacgtttacaattgtgcaattataatttagacgaatatttggagggaatcatgaataaaattgcggcatattttaatttttcagaattgaaaacgtcaatgcgaaccgaagtgctggctggcttgaccacgtttgtttcgatggcatacatcctatttgttaatccgagcgtcctcggggcttcggggatggataagggcgccgtcttcaccgcgacggccttagcgtcagcgttaggctgtttattgatggggttagttgctaagtacccgatagcaattgcaccaggattaggcgttaacgcgttctttacttattccgtagttatcggaatgggcattaaatggcaaactgctctggctggggtgttcgttgcagccgtgatttttatcttgattacgatttttaagctccgggaaatgattattgatgcgattccgcgggatatgaagttagcaatttcggcggggatcgggttcttcattgcttttattggtcttcatggtggtggcttaattgttgccaacaaatcaacggttgttggtctgggatcattgacagttggaacgacctggttaactatttttggattgatcgtcacgttgattttgatgagtcgcaaagttcccggtgggatttttatcgggatggttttaacctctattttagggctagcaactggcttgattaagatgccatccacaattgtttcggcagcaccttcgttgaaaccaacgtttggtgtggcgcttggtcatattggtgatattaattcgttacaattgattattgttgttttgacgttcttattagtgacattcttcgatacggccggaacgctagttggattggcagaacaggctggattcatgaaaaataataaaatgccgcgggttggtaaagcgttgatggccgattcaacttcgatgttagttgggtcagtgttgggaacctcaccaacctcagcttatgttgaatcttcggccggaattgcggtcggtggtcgctctgggatgagtgcggttgttactggtgcgctattcattcttggattatttttctcaccgttattaaacgtcgtgacggatcaagttactgcacctgcactgattattgtgggtgtgttgatggcagaatctttaaaacagatcagttgggaacggtttgaaattgccgtacccgcatttctaactgttatcgggatgccgttgacttatagtatttctgatgggattgccttaggcttcattgcatacgtcattacgatggtcgcaactaagcatgccaaggaagttcatccattaatgtacgtgctgttcttcatcttcattatcttcttgtggatattaaatgtctgacagttaaaggtggtcagctcgacgttattggctagttacagataatttaaatgacttaattctaaacggactactgacgcacatgacgttggtagtcttttttgacgtgaaataggctaaaacttgatgagcgtcaagttggtttgctctggaggtgactatactagagtcattcaagtgatagaagggggaggcgaaataatcagaaagttaggataaacattgaaatgtaagcgtcatcatcaagatctatttcgaaactagctcgtgagcagtcaattggccgagatttgctaagcggggcaagcgtgacgagtggggatgtacccgtaccaattcgatttaataagacaaatacacaattagtacggtggttaaggtggtataccggtgtcgaaaataatacaaaatataaaaatacaaaaaaatacgttttttttaaaaaaattaaaaacgctccaaagcccgtcgttaacgcttgtaaaccatagaaagtttcgcaaaatttctaatgatagataaaatctattgataaaagcgtttacattttaaaaaatcgtgattacaataaagtcgtaaagttgataattaaaatatatcagaggaggacattactaatggctaaaattagtggttcagatgccgtattaaaagtaattcagaagtggggcgtaaaacatatttatggtttgcccggtgggtcgttcgattcaacgatgaacgccatctataatcaacgggaaacgttgaagtacatccaagtacgtcacgaagaagctggtgcgattgccgcttccgctgattataagctaactggaaagatcggcgtctgctttggttccgctggccctggtgctgtccacttactgaacggattgtacgatgctaaggaagatggtattccaatgttagcaatcgttgcacaagttcctactaagcggatgaacatggacttcttccaagcaatgaatgaagaaccgatttttgacgatgtggctgtttggaatcggactgcgatgactgctgagagtttaccgatgatgactgatgaagccattcgtcaagcgtatgcccacaatggtgtagctgtcttaacgatccctaaggactttggttgggctgaaattgaagacaactttgaaacgaacgctagcgtgcacactgttaactatcctgcaccaaccgctgaatcagttgctgatgcggttaaattaatcaaagctgctaagtcaccaatgatttactttggcgttggcgctaaggacgcggctgaagaattaaaagctgcttctgaaaagtttaagatgccacttgtctcttcagtattagcgaaggggatcattgaagacgattatcccgcttacttaggttccacgggacgagtcgcacctaagccgggtgccgagattggctttagtacggatctaatcctctgggtcggtaacaatgtcccatttagtatcttcttatttaataagaaggctaaggtcattcaaatcgatattgatagtgaaaaatttggtaagcgccaccatacaaacgttgctattcaggcggatgcgaagaaagccttagcggcgattaatgcagctggtgaagcgcgcgatgattcagccttttatgacgctgcggttgctgataaaaagaactgggacaaatggcaagccagcttcaacgatagcactgaatcaccagttcgccccgaaccaatctttgatgtcttgaaccaagaagctagtgacaaagctgtttgggccatcgatgtcggcaatgttaatattaactttgaacgcttgatccggatgcacgataaccagaaatgggcaacttctgggatttatgcaacaatgggctttggggttcctgccgcgctggctgctaaagtcaactacccagatcgggacgtctacagtttgagtggtgacggcgctttcgcaatgctgtcagaagaaatcttggcacaagttaagtataacttgcacatcatcaacattgtcttcagtaatgagaccttaggctttattgaagctgaacagactgatgatagccatcaaccactctctggtgtcgatttgccagatactgattgggccaaggttggcgaaggctatggtgccgttggttataccgttcggaccaaggctgaattcaagcaagcccttgaagacgctaagaagacggataagccagttgtcattgatgtgaagttaacgcatgcaatgccatttacaacggaacatatgtatctcgatgacgcatggcaagataaagacaagattgctgaatttgtcaagaagtatgatgctcaagcgttgaagccgttcagctacttcttaaaacaagctcaaacaaactaatttggatagataattaacgaaagaggacgcgattatcgcggctcttttggtacatagtattaagtgtcgcttgccattgtggcggtgacaacataccaagctgtagagaacactacgtgaacgttcgggaggtcgcacagatgcaagtaatcaatttagatgcccatcgattaaagatgctggcaccacaaccgccactggtattagctttaggtttctttgatggtgtgcatcagggccaccaacgcgtgattcaaacagcgaaacgaattgcgaagcagcgtgatttaccactcgctgtgatgacgttcaatcgacacgcgtcacaactgtttaagtcccagaccacttttcggtatctgaataccgtcgcgcaaaaaagccaacatatggcggcgctacaggtggaccgactatatattacggattttaaccaccaatttgctggcttgacaccgactgcgtttattaaggattaccttgtcgggttgaatgcgcaagtcgttgtggcggggtttgactatacgttcgggcagggtggcgcaaatgggatgcgcgaactcgcggaattgggcgccccgtactttgaaacggtcacggtggatcgcttggctaatcagcagcttaaagtcagttctactcggatccgggggctgattgctcgggggcagattgaacaagctaatgatttattggggtacacttacgcgacacaggcgacattcgatccgttgactagaacgatccaacttgcaaatcggcaacagcagttaccagcggccggtgattatcgttgttggttagttagcgctaattatcgacaggcagtcattctgcgagtcaccacgacattaaaaattatttcgccataccagttgccaccggaaaccacggtattagatgtggacgttcagtggcagcagcgtgctttgcaagtggtcagttctgtctcagcccagcatcaacaatcacaatatagtaaagcttaatgtagaccaccctgatctgtttgatggggtggtttttgattgtcgtcacgtcggtaagttgttcgtgctagatcgttagcgatatttgataaaactgagtatcgggtgtgtgcttgatcctatttttctagtccatagatagtttcacatgaaataatcggataaacacaaaattggcgctgaatggtgccccgttttgtgtacttgtaatttcacttacgaaaagtaagcatattaattgcatttataattgaaagcgatttataatacgtttgttaaatgaattgaaccaagcagacaaattggttctaagtcgaagggatgaatagtgatgacaaagatgattgcaggacaagctttagttaaggttttagaggcgtggggtgtggaccacatctacgggattcccggcggttcaatcaatcataccgttgaaggtttgtaccttgaaaaggccgatattgattatattcaagtacggcatgaagaagtgggggccttagcagcctcggcagatgccaagtttacaggcaaaatcggtgtttcatttggttctgcgggtcctggtgcaacgcacttattcaacggtttgtatgatgccaagatggatcacgttcctgtattagcacttgtcggacaggtgccacaagcgacgatgaacacgaattacttccaagaaatggatgagactccaatgtttagtgacgtggcggtgtataaccgcactgtcacgacggccggacaattaccatatgtcattaaccaagcgattcgtgaagcataccggcaaaagggaccggcagtcgttatcattcctgaaaatctctcagcggaagaaatcgattatcagccggtatcgacgcctaacaccgtttcagatacgtttgaacaacgggtcgatcctcaggccattacggcaacgttaaagatgctaaaagcagctaagcatccattagtttacgctggtcggggtcttcttggtgctaaggcagacctggtcaagtttagtgaacaatttaatatcccagtcatgaacaccgtcccagcgacgggggttattccaacgaaccacccgaatgcaattggtacgtttggccggttgggttccaaatcggggttcgaagcactccaacacgctgatttgattttgttccttggatctgaatttccatttgctagtttttggcctaaggggattaagattattcaggtcaacaataacagttttgatatcggcaagatggtcccaatcgattacgccgtcatcagtgacgcccaagcttatttgcaagcgatgattgcaactggcgaaacgttacctgaaacagtgtggttaacgactaaccggcaaaataaacgtaattgggataagtggctccaacaattggctgctgacgaccatgatggactagcgccggaagcggtcatgcacaaagttgctagtatggtcggccctcgtgatacctacggggtcgacaccggtaacgtctccgaatgggctgtccgggggctcccaatggatcaggagcaacgctttgccttatctggcctcttcgcaaccatgggatttggactacctgctgggatggctggtgccttaagtgttccagacagccaagcgtggagtttctcaggcgatggtggctttgcgatggtagcgccagatattatcacggaagcacgttacggcttgcctgttattaacgtgattttcagtaatcaacggtttggtttcatctatcgtgagcaagttgatacgaagcaacacttgtatggtgttgatctcacggatgccgactgggccaaagttgcagatggccttggtgggattggttttactgttcaaaataatcaagaggtcgaaaccgtctttgaccaaatcaaggcgctccaagcgaagggcaacaagcggccaatcgttgtgaacgcggtcatcaagaatgatgatccaattggcacagcttacatgccactagatcctgaattatatggtcaagcagaagttgacgcttatgccaaagccaaccacattgatattaaggaacagccatcattaggcgccttactacgagcacagggtgatcagctatagttaaagcctgaagggctagttagaccactgggcaaagattcagttaacctaatattattaaaaagccgccagtatcgggtatgacctgatactggcggcttattagttgttcagttaggatttatttttgattaaagctgccatcttccacgtcacgaatgaattgtttcaaatggtcaaagtagacgggggcgttgtcgatcatgtggtgatgaccaccatttggcgtcgttactaagcgtgagttaggaatatcacgagccatgcggcgggccgaagctaatggcattgtttcgtgttcaccgaaagttaacagggtcggcactttaatgttgtgaatctgatcgcgaatatcccattcctttaacttcccagtgataacgaattcattatcaccttgaaaggcgttgtatacaggagtggcagtggtgttgatcaaatggcgaattgaagtgggttgtttgcggtcaacatagccagcgttcagaacgtccacgtacttctgatactggggatcattccagttgccttccgcttccttttgcttcatataagcaacagcgtcagccggtagggcttcttcacgacacttgttaacgttgacaacgtattcctcaatgttatcgaccatacttgaaataatggcgccttttaagtgttgaccatacttgagcgcgtacatcattgtgagggcgccgccccaagactgaccaatcaagtagaagttatcgagtcctagtttttgtcggacttcttcaacttcatctaagaagtagtcgtaggtgagatatttcttagcaatttcaggatctgagtagtcgggttgatccgaataccaggatcctaattggtcgtacattgaaacttggacgcctaaatctgccagttcctcaccaaagttttcccagtattcgtgattgccaccagggccaccgtgtagacataataattgaatgtcgcctttgccctgagtattcgtccataaatggtagccattatccagcgtgatgattgtcgttccttgtttcaaatgatcacctaatttcttcatattttaattgttatcttaccactgttaactaagcagggtcaaagagactaggcaatcataaagaattgcattaagtagataattggtaaggtcgtgttcgctaattaactgaatcagtacgttaacgtcatagtagctgagtatgggaggggacttcggtcgaaacgatataaaaataataattagaacgggccgtttagtctgaatttggtttatactagttattatgctggtcggtacgactgatagaccaagtttcagtcgtattgtgaccgattgtacacaattgatttgacaagcggttacattttcagcgataataagtaaactgctcagcacagaaagatgtaatattacattctttaaattcaattgcggttagttaaccaatatgaaataatgggttaactaattagagatgggtgagattgatatggcaaatcaagtcgcagttttacgcttgttaatccaagcggcgcccgcgtactgttcgggtgactggttggcacaacgacttgcaatcagtcgaacggctatttggaaattagtgcaaggattgcaagcggcgggccatactattgagagccggcatgggcgaggttatcggtatgtggccaataataaattgagtgcgccggtgattgaatacgcgcttacagcgttaccaccgtttgatttgaccgtgctaccaacggttgattcaacgaatgcctatttacggcggttagtcacgcagacgcctttagcacttccgaaaatcgtggttgcggatacgcaaactgctggttacggtcggtcggggcgggcattttattcgccagcacagactggaatttacatgagcattgggttaccactcagtgaccagaaggcgttagacgctggtttgttgacaacgagtactgcggtagtcgttgcccagacgctgcaacagctgtttgcggttgacgtttcattaaagtgggtcaatgatgtgttagtcaatcatcacaaggtggttggtatcttatcagaaggcatcactagtcttgaaacggggcaaatttcagcagtcattattggaattggcattaacttaacaacgacagcttttccagcgctactagcgcacaaagcgggcgcagtcgttgccaatccaaatggtgtgacgcgcaatcaagtgatttgtgagctactgcggcgctttttcaatagctatgggacttatcgtagtgggactttcatggacgcttatcggaaactctccatggtgatcgatcaacaggtcgagttgaagagcggaacgcaaaagtatcgtggagtcgtcacggatattgatgcacacggggcgttagtcgtcaaattagagactggtcagagtcgtcattttagttctggtgagattactaaggtgaacctcttgtccggtggttatcatggctagcaagtttgtaaaatcaatttatcaagttaccgaacgaatcgcgtcaatcttttaaaatgatttctgattcaatgttttactggttcatactgttgtatagtagaagttagtcacaagtagtgctaatcaatttcaatttgattaattgagctgtttggtacgtcgaatcaaccttaaattgttgataacataggaatgataacggatggattaatagactcacgtttgatttatttatattgtaattaagttcggggttatatgtgtttaatcagcataatgaataaagtggttaataaaaataattaatgaagtttaaataatgctggtcaatgcggtcatttacatattatagtaaaggtaccgaagcactggtgggttagttaatatttgtagagacaattcaaggggtaataggaatatgaatgaaaatttgcggagcgtaaatatgagccgaacaatgagtcggatgaatcgacaccggatgaatccaagacgttatatcaccggatttgatggtatccggacattggcggtgctgggtgtcatcatctatcacttgatgccggcctcactacaaggaggttacttgggagttccgatcttcttcgtcgtttcaggttatttgattacggatattttattacaagatattttgagtcgggggcatgtccggatatggcggtttctcggacaccggatgcggcggctatatccagcattcgtgacgatgttgttagggacaacagcctacattacgctgtttcaacggtcattattgacgaacattcgggctaccgtattaacgaatttagtctacgtctataattggtttgaaatcaatcacggtcaaagttattttgaccgtttcaatggtgaatcaccgttcactcatttgtggtcgctctcaattgaaggacaatattacttattctggccattagtgattggtatcttgatggtcatcttcaagaagcgttcacgggtcttctggtttatgatgattgctgcgggtatttcagcgataaccatggcaatgttgtatgatccagcgaatacgaatcgggtgtactacggaactgatacgcggatgtttgcaatcttgttaggttctggccttgcgtttatctggccatcacgggaattatcggcggacattgctaatgttaatcgagtgacactggatatcttaggcggtgcttcgctaattgcaattatttggatgtttttccagatgtccggtcaatctgatttcacttatcgtggcggtatgttactattcacagtcctatcaacagtgttagttgcaacggtggcccacccggctagtcatctcaatcgcgtcttgacgaatccgttgtttaagtacgttgggcaacgtagttatgggatctatctctaccagttcccagtgatgattttctacgaaactaaagttaaaaacattggtgatcatttactcctcaatagtttgattgaagttgccttaattttgatcgtgacggaattgagttatcggtttattgaaaatccaatgcggcactatgattacagtcggttattggtcgacttcaaagatttcctccgcaaaccgaagtttaaccgcgtgaccactgcgattgtcgctttgaccacggtcttattcgttattacggcggttggtttcgttcaacagccaagtaaagcggaagctaacaagaagactgaattacaaaagacgattgcagctaactctaaagcggctgataagaagaatgcggcggcgctcaaacggcaaaaagctgcccaggcagcggctgcttcaagcaagaaggttgcgactgaaaagatgcagaccaagcaggctgaagcgaagttgaactcgaagcagaagcaggtggaaaaggaatacgatttgaagccacaagttgttctagcgatggccaatacggatctgacagccattggggattcggtgttactggatgtttcttctgatcttcaagatgttatcccgggtacggtggttcaaggtcgcgttggtcgtcaagtgacggaagttcctggaatcattaattcgctgaagtcgcaagggcaattagcccataacgtcctattgaacattgggactaacgggacaattacggatgatcaagctgaacaagtcgttaagctgattggtaaggatcgtcagattttctgggtaacggcccacgtcccaacacagagttggcaaaatcaggtcaatgctcaaattgccaagactgctaagaagcatgcgaacgtgcatgttatcgattggcatggtcgtgcgcagaatcaaagtggttggtttgcagatgacaatgttcatccaagtacgactggtaatcgccagttaacgaatttgattgcgaaccgcattgccgaagttaataacaattaaagatgagttccagcttacgttgatggtaagctggaactttttttggctagttccggacgggtgggggtgtccgacctggtcatgataagtggctatttaagttgaaggtacacaaaaggcccaccagttaacggttgtgtggttagctggtaggccataattagttagtccgttatttttttcattgggacgtgtaagcgaatatcgttcaagttaagtgagtactgtaggtcttgattgccgcgaatcgtcatcttcatatcagttgcgtaaatgactagtccgagttgatgccccttcagtaagtggtggaacagcggttggagatccacagaaaagtcataaaagacatttggctgaatcgcttctgcgtgccatgggtggtgacggttctgcaagttaagatgccccttagtaatcatcttgaacggcgtctcacccgctaacttgaagtccttcaaatcatcttcgcgccagtggtaacctagatcaagcgcttttgcagccagcatttgtgggctgacagtcaaacggcgcgcggccccgaagtcaatcagcataaagctcaacatgccgaaattcttattaacggcgacagagcccgcaacgtgcggaatacccactaataattgatcctcaggcgactgccaagacttgaacaagaggcggtgatcatagagcggatttaacttatcctcttgcaagaggtcgcgctgccaactatccaaatgatgcttatagtggtcgaataatttgtcaggcaatttatcagtaaaatgagcggcgcgttggtcaactgtatggtcagcaggaactaattctttgtactgaaccttaaaatctaaagcgtcggttgtgtcttgccaccaattgtcatagccgtgccaagtttgggcttgcgtgttgtcttgtaccaagacgttaggcaagagtgtctccgcatgattatctaaaccatataatttatggcttagccacaagttcatcatgtcggtgaaatcgagcgattgtaagttattgatataaatatgttgtccctggtgcaaaatgagctttttagtaacgggaactgcctgtgatttatcccataaattagctacgttgcggggcttaacgttccagtcattgagcccgtgaaccatgatgatgtccgccttaattttgtcaacgttcttgagataattgcgttcatcccagaaacggttatagttaccgcttgctcggtcttggtcggcagtcagttctgccagtttctgatcaaacgcgggttggatttggtgagcgtcaccggcttttaagcttcgtgagaagacctcagcggcgagaacatcggtgtcttcgccttggaacgtatcgggagcgacgaccaggccattatctcgataatagtcgtaccagcttgagatggcggcctcggaaataatcgtcttaaggccagccacgcccgtcgtagcagcggcagttgcgagggtaccgaggtaagaccggccagtcatagcaacggcgccgttgcaccaccaagctttgatagcgatattgccatcacgattggtgaaggcttggcgtttgccagtcaaccattcaataattgcaactgttgaggtcgtttcatcaacgtcaccggtaggggctagcccatccgagtcgattgaaccaattccagctgcatagacgacagcaaaaccgcgcgctagaaagtaatcattgagcgtgtaggacttttctcggctgaaagtctcctctgctgtatcggtcgtcgtggtcgcggttcgagcggctggtagttgcgccgttgttggctggaactcaacatccgcataggtattttcgtccggttcctttgcagtcaggggaacgtctacgttgtgcatttgagcatcaccagcttggtcgttgatgccctgattataaggactagcggtatagagaacgggaacttttaagccggtttcggtctcagttggccgaaggatttcaactttgagcaggtcccgttggccgtcgtggtcagtatctaaaggcgcttcaacgtagacgacgtcacgaatgagcgcgttggtatcaaagacggcttgggccttaccattgaagaagagtggcttttggtcgttaggtaattggtaaaatggtacaaagtaaccccgggtcgtgagtgattcaatcaaggtttgtccattattcccacgtgtatttaataataggtaccaagcataatagagggattcacgatcaaaggcgctatcaccgactattggcaagtgaatatcgcgcatcgccagcaatggatcggccaattcaaaatcttgaccaggtagaaaacccagtagctgaagtcccacgttataaaagacttgattgtttacgatagttgcatcggcgagccattctgataaagtgtgctggctggttgccatgatgttattaaacttgtgggtcaagccgcttgccgtgtgaacttctggtaagcttttagccagcaatgcctggtagacggctggaacagtcgtcagggcgtccatatcaggcgtaataaaatgaatttttgtaagttcggcaatcgcggtttccgaatcagtcgggacgattgcaaattgattatttttcataagtaaattccccattaagtattattagaaatattataccgctaattagtcgagaaccaatgcttcttactgacaagtttataatgttgtggtaggttaattgcaaagtgaactatcgaatggaggaactaagattgagtgattttccaattttatatacgacccaagcagttaatgaagacggcatcgaaggacacgcctatattcccaatggtcttgaggtggccgtatctagtccacttaaggcggtgccgggctcgaatccggaacaattaatcggattggcgctcagtacatgccttaacgcgacgctggaggcaatcgaaaaggagcacggccagacacatcagagcaaagtcgtgactacggtgaagatgtcgcgtgaccgttttgggtaccaatttttcctagatgctcgggtcacgattccggaagtggatgctgaaacggcagcacggtggctcgcgattgtggaaacgcgttgtcccgttgccaagctcgttgggccatcagccaacgtgacgattcaattggcttaaccgttgtgatatggccgcagtaatcattaatcgtagtttgtaaaaatgtcaggggattgattaaaacgtggttcgagttggcagcgattaaaactgccaattcgaaccacgttggtgttaatgatgactgcgaatttgcttgaaaagttggcgtaaacttgggtgctgacagtgatgactagtaactgctgactgaactttatcgacctgttgtagggcaagttgcttcgttttttcgcgttcgattttgagctgcttgcttagtgctcgcgatttccaaaagccgttgatgccgacgacaactggaataatgtgtaataaggttgtggcgggaatgagccagggatgcttactgaatagttgaacgacctgggtatgatgctcatgaaggtcgtcatggatcgttttgggtgttaacatgattaaaccacgctccttaattaagtatcattatcataccttaaaatgtaatcgttgtcatcgttagctggctgacaatagttaaagcgcccatctcaagttgattgatcacttgagatgggcgcttttagttagtacaaatctagattgttactcatcagctttattcatgcgactatgccgaatgccatagccaaagtaaatgatgagaccaaggaggaaccagactagggatgccagccaagtttccatggatagctgggtcatcatgaacaggcacagcaagccagaaataattgggagaaccgggtaaagtggcacgcggaagcccttgatcgcgttgagcttgggattacgccgtagtagcaaaattccaaaagaaacgaaggcgaaggcaattaatgtcccgatattaaccaagtttgccaattggtctaacggaatgagaccagcaagaattgaaatcacgattgtaaccgtcaacatggcgtttttaggggcgtggtgcttatcgattttacctaagaaacgtgggagtaagccgtcacggccgattgaatataatagccgtgagctactgtagatcatcgtaaccatcattgtgaacatgccggcgagggcaccaatcgagataataccggcaacgaagttttgatggacgagttgtaaagcgaacgccactgcatcgtcaacgttcaactgtttgtacgaaaccatcccggtcagcactcctgaaacgagaatgtagaagatggtacagatgactagggtcccaatgattccaattggcatgttgcgcttggcatttttaacttcggctgccgacgaagacacagcatcaaaccctaagtaagcgaagaagacgaccgcggcgcccttgagaattcccgtcccaccaaatggggcaaagggtgtccagttacttggtttaacataaaatgaaccgactaataagaacaatacaatgattgctaattttacgaccacaataatattgtttaatcgaatcgacgtttttaggccggtatcgataatccaagcaatcagacagacaatcagaattgcgaccacgttgatataggtcccgtgggcggggtcaaacgaaccggtgatggctttcggtaacttgaggccaaaaccagcaatgaatgaattaaagtacgcggcccacccaacggcaacggtcgcaacggctaggacgtattcgagtaccagagcccaaccaatgatccaaccaatcatttcgccatagacaatgtttccgtatgaatacgcggaaccggcgattgggagcaccgaagcaaactcggcgtaacacattgcggcgacggcacacacaatggcagccaaaacgaaagataaaataatcccgggtcccgcttttgttgcggcaaccgttccgggtaggatgaaaatcccggtcccaatgacggcaccaatcccaagtgcaatcagatcgactgcggagagggttcgttcaaaatgactatctttttgtaaatagcgctccaaatcttctttttggaaaatgcgctggaaaatccccataacatggaccacctttttggttatttgtaacagttagttgtcattatcgacaaatcgtcatgtcaatatgataccgtggttgattattaaaagtcaattagaatcagccttttattattaataactcaatgggatacggagcaagatagctggttaatcatcatagaagctggtgacattgcgactgtcgaggcaatgttcgtgctgacaatagatttgatgacgataacgcgtaaccagtcatggtggggatttaaaaagcgttgtgatggccgaattactagtcatcacttaagccggcggtaacggtgctaagctgaagagaaacgggtctgaatatgcggttgggtagctgttactattgttatttataagttgatactttgttataacgaacggtagtcaaagaatacacacggataatacattaaactgttaattggattcgccaaagcttataatattgttatcaatagaaatttaattttagaatggtgggattaggatgggagcggcgattgatattaccggtcagcacttcggacgcttaatagctgttcaccgagcgggccgggccaagaatggtaatgcgctctggttttgtcagtgtcagtgtggccggacgtgcgtggtggattcctacgttttgcggcacggcaagacgcgtagttgtggctgtctagccgtggaacagagtcggcaaaatatttttaataatccgcaagcagtttcgcatatgggggacccgcgtaatttgaagattcgtgatcaccatacagatgtaagttcaatcaagaagtcgaagcgtaacacgagtggggtcgtgggcgtgagctatgacaaacagtcaggttcctgggttgcgcacttctactacaaaggaacgtacatattaaacaaacattttgcgcattttgaagatgcggttcgggcccggcacgctatggaacagcaatatttaacgtcatctgataactgaaactgtcggatgcccacgttaggattcactagcaaattgtaggctagctaatattgtggataatatttgaaggaactgaagtcggttaagtgtcgaagggcttcgacgtaatgtgtgcttagtctgatgaggatggatgataaattttaatgagttgaacaacgggactggcaatccgctgctcaactttttgagtcggcactaatcaagcttaatgatgacaataccgttgcggtttgcagtgatgagtaatcaatgcccatttgagtggttgatttaacctttcttttgaagcgaagaggttacagtcagtcggagttctgatagaataagcattacacgagataagagggggtagcaagattgtcaacaatgttagtggcggaagatttatccgcagtcggtggaatctcacttagttcagcgttgcccgtattaacggcgatgcagtatgacgtggcagcactgccgaccagcttattatcgacacatactagcgggtacgggacaccagccgttgtcgacttatcgacgtggctgccgcaggtctttgcgcattggacccgtgcacaactgcattttgatcaagccctgatcggctacgttggttcggtcgcactgtgccaacaaataactacttacttagaacaacaaacgctgtcgctattagttgttgacccagtactcggcgatctcggtcaactctatcaaggctttgatcaggactatgttgcggcaatgtgtcagcttattcaacaggcggatgtgattttgccaaacacgacggaggccgcattgctaacgggagcgccctatcaagtgacgccagatttagaagttattttgccagcactgcaagcacagttgaaaactggtgcccacgcagtcattacggatgtccaacgtgctgatcagattggctgtgcctggttggatgaagctgggcacgtgcaatactgtggtgcgcgacgtttgccggggcattataatggtaccggtgatactttagctgctgtaatcgcgggactgttgggccggggttacgcgttagcaccaacgctggcgcgcgctaatcagtggttgaatatggcggtagcagaaacgattgcacaaaatcgaacggatgaccggcaaggggtcgcactgggggacttgctccaggcaattttagccctcaattgatgatggaacatgttatactagagcataattcataattaggaaggtgcgacttcatgagtacagaagtagctagtggtgcggtcgtctatcaacaaaaagatggtcatcccgcttatttattattacagagtgcgaccagtgatttttggggctttccgaaggggcacgttgaaggcaatgaaacgttagctgaggcggcgcgacgtgaaatccgtgaggaaactcaaattgaagcgacactcgataccaattttaaggcgtataccgaatatgacttaccgaatggtaatttgaagcaagtcacactgtttgtcagtgaagtcccaagtggtgtcgtagtgacgcggcagcaagctgaaatcagtgcaattggctggtttgattatgctgctgcccgtgaacgattgacttacgataatttaaagcaaatgttagatcaggctaacacctacattgagcagcatctacaataatactgactgtaaaaaaattactggtgccgtcgcataaacggtaccagtaatttttaaacaatatttttagattggcttaggcctgggtttgtaagtttgcaactgcatcttcgattgttacgccttcagcgaacaattctggatgaagtttgtcagttgcgacaaacatttggcgttgcgtatctaagacaatgctgaaccagctatttgttttttgaaattgcatatgacaaaactcccttctgaaaattgttggtttgctacgagatgcgtgaatcatctatttgaaccttataggtacgctactatactcggtttaccgagctaacgcaaatgaaaagctttacatgaattaaaaaatggaggtttatcaactttgacaacgaaacggatctttgtaatcacgggaccaacggggagtggtaagaccactgtcagtcattacttgcggtcacaataccaaattcctcaggtgattactcatacgacccgggctccccgggaaggtgaggtcagtgggcgcgactattattttgaaactccgacgagttttgccacgaaacattatttagaacacgtgacctatagtggtaatcaatacggttcttcacgagaaggactagcggcagcctgggaacggtcaccactgattagtatcgtcttagatacggcgggggctattacctatgcgcgggagttgggcgaacaagcggtggtgatttatctcgaggttgctgatcaagaggcgctaattcagcgtttgaccaagcgaggagatcttcctagccggataaaaaagcgagttgctagtgatgagtatttgcgggaccaggctttgccagtaggattagtggggcatgcacatgttatcgtgaatgatgattggcaggcgacgcggcgccaactagatgagctggtcactgaatattgtcagcatgatgttgtgacgaaagattagcgctgacgtatggacggtcaacgtaattcacttttacacttgagtatgctaaactaaatagtaatgattatgatttagtgaagtcctggtcagtaggaggcagcaacattatggaaacaccaattgaacaagccgtcgcaattttacgtcgcaatcagtttaaaattacgaagcaacggcaggcattattagattatctggtgacctatcaggaccactatgtggcaatttcggccgttgatgagcacatgcggaccttatttgcaggaatgagtcacaataccatttatcgcaatattaaagagtttgaaacgttaggattattggaattgaaggcccaggctaatcaaaccctggttaaatatcaatgtgatttcaagcatcaacaccatcaccattttgtttgttcaaactgtggtaaggtgacggaactgcaagcgtgtccgttagacgagtatgaagcacaattaccgggttgtacgattacgggtcaccgcatcgagatttacggtttatgtgccaattgcacgaaaaagcaggcaattaatagctgacggggagtcggcttttttgttggccttgtttgagtaaagagtttcttaatttgtgatagaattagtgcattccgaacacgagcatggtttaattatagattagaaagaataacggcaaagcctcagaagggaatgacatcgatggcttatcgaacaccaccatttatttcaccatttgcaattgtttcaattgtccttgcactgggggcaactaacgtggtcgttaataagacaacccatactgtcaatggcgccaaggccactagcagtgtggtcaaaagttcatcagctagttccgcaagtctgaaaaagaaagcggctgatgatagtagcgatgagaataaatccaaagacaaatccagttcagatacatctaatgatgaacagaatagtagttccagtagtagtactgacgagaatgatacggacagcagcagtgctaataagaccagtagttcatcaagttcagctgatgatacgagttctagtgccactaatagtagtacgactgataacaatagttcaacgactgatacgagtgacgatgatgaaagctctgctgctgagtcatcaagtacgaccgcgtcaagctcgacaacgacaacgtcacagtcgacaacggataccactactagcgacgggggcgaataacgaatgtttagtattttagatatgatcaaccacgccttgggttacgttaatgtcaatgtgaagattaagaaccaaatctatatcggcattggaattgcgggtaatttatacctcggttatgtggcaattcgcttgatgcagaatggcgcgtggttacggggcatcttatatatgctcgttttcttggcgctgatttatttcattacgttaaacgtcatttattattttactaataaaactgcgaagtatgacttatcaccacgtattgaaaaattgttgggtggtaagcctaaagaagcgttagcagctgaaaaacaagcacaacaaagtcagcaacaaccatacattcctgcgaacggtatttttgatgggcaggaattgttgcccgccacggtgaagacttcacgtgctgaacaagagaatgtgcatcaaattgttgatcaactacaagcggcgaacattgtccgattagattacggtggcttaactgatgatgccatcattcagcaggcgcaggcaacgggtgaacccgtttatgcgattgggcaaggcattcaaattcctttctcacagttaaagttggagaatcaccggctagttatttacgccggaattaatcagatggaccaatccccggttgggcatattactaaggtcggcttgaccgatgttcatgatgcgcatgaggattataagttgtatttggcctccacggtaatcacagggggtatgagcaagattgcgggccgaacgtcagctatcgagcaaccgggcgattaccaggtaaccgcgcaggttgcgtatgagggaagagaagattaagagtgcttccaagggcggttagtttgtgagcatcaccgttttattgttaagcggagcaaactgcctttggaagcacgtttcggtagccaaattgaatctaaacacaaaacaaccgttttgagcagtggctcgaaacggttgttttgtcggtatggctatttaaaaagcgctaaaatgtctaatggtttttggaagcggtgggccactttttgatggtcggcgttagggtccattccccagactgccagtccaaaatcaacgttagcggcctgggcagtttgttcgtcactgacggaatccccgatgaagagtgcgttttgtggcgcaacgttgactttttcgagggctgtgagtagggggaggggatctggtttgcgcttaggcgtatcgtccgcactgattgtgacagccatccgcatcatgaatggatacgagcgcatcccactttctaattcgtttcgtcgttgggaagtcacgattccaagtcttagttcagacggcaactgttcaaagaggctggtaatgcctggataaagttcaatctgatcataatggctggccatgacatcttcgtattgggcctgaaagtggtcaaactcactggctgcaatccccaattcagtcattgcttgttcagcggccatgggaaaagtcttctgcgcttgggcaggactaaatggtttgccataagtagcaagtacctcacgcataaccgtcgtgtaagctggttggctattagtcagcgtgccgtcaatatcaaacattaatgcttggtaagtcatataatcgttccttccaaagtagatttaactccagtatagcaaattcgtccttgacagtggttaggacaaccattatagttagattaacaattgatgaggagctaatgatatgtcattaccgttaaattcattaaaatctagaactagcttttacttttggtattttcgctagtgtttgtgccggctgcagaggtgcaaacacgaatccgatgtttgcatcgatgcggttgccaagagtattttgtgatttgacggcgcccatggatgtttgaaaattccaagggtggctaataagtttgtttctgcgtggtggcgcaccctttggaatttcaaggggtgcgcttttttgaccctagtccagtccgcttccaccaacaagatcagccaaacttgggaggaatctttatgtcaattaattcagaaacacttgttaaccatatgaatcatgaaattgcggcgattcagccgtctgatattttggcgttcaacgctgaaatcgcaaatattccgggtatcgtgcgtttgaccctcggtgaaccggattttaatacacctgagcacgtgaaacaagctgcaatcgaaagcattgaagcggatgaaagccactatgcaccctcgaacggaacgttggccttgcggacggctgccgctgaattcttggccgctaagtatgatgtccattatgatcctgctagcgaagtgattatcacagctggtgcgaccgggggcatttatacagcgttgacttcaatccttaatcctggggatgaggtcctgattccaaccccaatttttccactgtacatcgcaatcgttaaattatctggggcaacaccagtcttcatggatacctcggacaatggcttcgtgttatcgcctgaccagttacaaacgacgttagcagcccaccccaagacgaaagcggtggtccttaactttccttcaaatccaaccggtgtgacttaccggcatgatgatctgaaagccctggccgcagtgttagctgatcaaccaatttttgttttgtctgatgaaatttatagcgaattgacgtatggtgagcctcatgaatcgattgcaaattacttaccaacacaaactattttgcttaacggcgtctcaaagtcgcacgcgatgacgggctggcgaatcggcatcatgtgtgcgccgaaagctatcacagcacaactgggtaagattcaccaattcacagtgacttcaacgacgaccaatgctcaagcagctgcgacggaagcattgaaaaatgggttagatgatgcccaagtaatgaaacgtgagtaccaagaacggcgcgattatttgtatgatgcacttaatgaccttgggttccaatcagctaagccagaaggggccttctatctcttcagtaagattccagccgggttgccacaaaatagtatggctttttgccgtgaactagcccatgaagcacgtgtcgctctgattccaggtagctcattcggcccgggtggtgaaggctatgttcgaattagttatgccgcttcaatggccgatcttaagacggcggtcacgcggctcaggacgtacgttgccagcaagaagcagggggcttaaagatgaaaattttaatgtatagtgttcgcgatgatgaacaggatgcgattcaagcgtgggctgcggctcatcaaattcaagtagatacgaatgatctggaattccatccagaaactgccgacctggtcaagggttatgacggcttggtcattcagcaacgcagtccaattggtggtgatgctagcttataccaatcattagctgcggccgggttaaaacaactaacgagtcgtacggctggtgtggatacaatcgatattccggcagccaaggcggctggtcttgtggtcacgaacgtcccagcctattcgcctaattcagttgctgagatgtcggtggcacaaaccatgcgcttgattcgcaacttggaaatgtttgatcaacgaatcagccaacagaattttcagtgggcgggactgcaagcacgagaaattcgatcattaaccgttggtattattggtgcgggtcgtattggtggcacggccgctcgacttttccacgggttaggtgccaaggtgattgcctatgacgtggtacgccatcctgaactcgaagacgttttaacctacgttgacactaaggaagacctattgcggcaggcggatgtcgttgatttacacgtggatttgaatgagacctctgcggggttgatcgatgcggcagccttgaagttaatgaagacggatgcctaccttatcaacgcctcacgcggaccagtgattgtcaccgatgatcttttggcagcgctaaaggccggtgaaatcgccggttgtgcactcgatacggttgagggtgaaaatgcgttatttaaccaaaatcatcagggtgaggtgcttcaagataccaacgtggcacaattaatgcagatgcccaacgtcattatcacgccacacgtgggtttctatacgaatttagcggtcaaaaacatggtcgatattagcctggatgacgtcttagcaattctaaatggtgaaacgacggccaacgccttttaatgatggcgtcagccgctactaccagtatggctgtaggagacggtggctggtcaaagtgccccaccggttaacttgttcggcgactcgctgttcgataactagcttatagcgggactaatttggtggtgcgtccgcgactgggcttcaggtgtactggcaatgaaataagccttccaagcatattgcttggagggcttatttgtctcttgagtcggctgactggtcgtgactaactagctagtagattcggctaaccagccattatctaataactggtgatagtgcttaccgattggcacccacagtttagcttgcagaatgctacggagctcatcccagaagagtggatcgcgttgttcattggtggataaattcaattttaagtaggcccccgtctcagtcttggcaatcacaaagggataaaagactttgataatctgggccgctataatgttagtcatgttagctgcttggtcaagtaacatattatcgtctcccgttacaatgcagatgattaatttcttaatagttctaggttagcagtgattattaaagaaatgattgcggaagcgttaacaatttttaaagttcagttagttaaaaccactaattgtgaaaattatgcgccggacgcttcggtggctttcagtagtggtatgattaaaagcgggttaagtttagttgttagaataatataaattttattgaaatcattgtctaaaaattattcggccgtggcagttccaaaaagaaaagcgaattattattggcttttcacgaataatgttcaatattggagctgttattcagctattttaactgaaaacagtgtagctgtttctcactattttatggatatcgaacaatatttagctactttttgacaaaattactaattatgtattaaactatttaaatagcattaacgaagaataaggatttcttaactctaattattaatgcaataattctagaccgtcagtcaacaggctgatagagaaagcgaaggtgactgcaatgtcaatgatcgaatttcacgacgtcgaaaagtattatggtgattttcacgccctcaaaaatattaatttaacgattaatgaaggtgaaaaagttgttttgatcggaccatctggctcaggtaagagtaccttgattcgaaccgttaacggtttggaacgtgtccagtcaggtcaattgttagtcaatgggtttgatttagccgaccgcaaaacggatatgaataaaattcgcaaaaacgttgggatggtgttccaacactttaatttgtacgctaacaagacggtgcttgaaaatatcatgattgctccccggttagtcttgaaacggccggaagatgagaataaaaaattagcgatggacttattagatagtgtcggtctggctgacaaggccaatagcttaccgagccaattatctggtgggcaatcacaacgaatcgcgattgcacgttctttagctatgaagccgaagtgtctcttgtttgatgaacccacctcagcactagatcccgaaatgatcgatgatgtgttgaacgtgatgaagagtgttgccgaagactccagtatgaccatgttagttgtgacccacgaaatgggctttgctcgtgaagtggccgatcgggttattttcatggctgatggggaaatcttagaagatgatgctaaagaaaagttctttgatggtcagccgtctaatgaacgggcccgtcaattcttgagtaaaattattacacactaatttgtaggggaggaccacgaatgaagaagctgaaacgactaattggcgcactcggcatgcttgccatgctagtggtggtcttaactgcttgcggttcacggcaatcattagcaaaacaggatgttttgaccaatgataaagctagtaagacgattacgtggggtgttaaagctgatacgaaattatttgggttgatggacgttaaagataatcaaatcaaggggtttgacgccgacattgcgacggcattaacaaagcgggtgctcggtaagaatgctaccgccaagtttgtccaagtaacgagtcaaacgcggattccattgttgaagaatgggaacattgatgccattatcgccacgatgactatcacgccggaacgtgaaaaacaggttgattttacgaattcatactttgatgcggggcaatcactgttggttaaaaagggcagtgccattaaatcagttaaggatttgaataagtcgggcaccaaggtccttggtgtgaccggtgcaaactccgttgagaacattaagaaagcagcgcctaaggctaaggtgttggaattatccgactatgctcaggcaatgacggcgttgaaatctggtcagggggtcgcgttgactactgataacgggattctttacgggatggcgtcgcaaaacccagggtacgaagtggttgggggtaccttcacgaaagaaccatacgggatcgctgttaataagggtcaggaaccgttaaaaaaggctctgaataaagcgctcaaagaaattgaagcggacgggacgtacaaccgcatcttgaagaagtggtttggtaacgtggccggcttcgactataaggaggcgtcacgctaatgggatacattctaacgcactattggtcagagctgattcaaggactcggatatacgttgttatccagtgtgattgctttggtattcagtacgatcatcggaacaatgtttgctatctttgaagttttgccaagtcgtacgatgcgcatcattggtcgagtttatattgaaattttccggaacattccattgttagttattgcgatgttcttctacgtgatcattccaatgtatgttgccaagattgatggttttaccgcggggacaattgggctaacaatctatacctcgtcattcattgcggaaacggttcgggccggaattcaatctgttgatcctggacaaatggaaggcgcccgtgctaatgggatgacgtactggcaggcaatgagtaaaattgtcttaccacaggcatttaaaatcatcattccaccgttgggcaaccagtttattaatctggtgaagaactcttctgtcctagctttcgtggctgggttcgacttgatgtaccaagcaaattcaattgcgtcactatcgcttgatacgatcaatagctacgtggtcgtaggggtcttttacttaatcattacgttgccactgagttattacatgcggcacttagagaaaaaattagcaaactagaagggggcgacgattcatgcaaaactttattcaagcgtattcgtggataaatatccggttcttgctcgaaggactctgggtaacggtggaagtgtccgtcgtttccatcattgccagttttattatcggttcagtcctaggggtgcttcggtacgtcaagattaaatatttatcggcagtggttgggtttgttgttgacattattcgaaacttgccattgatcttaattatcttctttacttactttggcttgccacacttgggattcaagcctgggatcattttcgcagccatcctcgctatgacgatttttgaatcggccatgttagccgaaatcattcgttcagggattttggcggttgattacggtcagatggaaggcgcccgggctaacgggatgagctatgtacaagcgttatggcacattgtctttccacaagcaatcaagaagacgatcccaacgattgtgagtcaatttatctcactgattaaggatacgtcgctggcaaccattattgttttacctgaattattaaaccatgcgcaaattatttatggtcagaactcagcgtatattttaccgatgttcttaatgatcgcagtcatgtacttcattatttgttacgccttgtcaattctgtcacgtgtgttggataagaagttagcgtaattaaactggtgggatgatggctgaaattccttaatgaaaagaccaaacaagcaataatgctttgtttggccttttttataaaaaatatttaaatgtcttgcaaaaaatagaaggcgtgataatatagttactgaaaacgttttctataaaactgaaattaaggattgtaactcatactctttgaggcattaccttttacttgttgaaatatacgggtgaagtgggtgcctcaaggagtttttttgtattgaaggaggttcagtgatgtttggaattaaaagaaagaaagttgatgtcttcgaggtggttacaccaattgaaggtatttgtataccgatcacggccgttatggatgaagtgtttgcaaagaaaatgatgggtgatggatttgctattaggccgagtgaggacactaatcaagttgtggcaccgattagtgggaaaatcgttgcattacctgaaagtaaacacgctattggcatcatggatgagactaggggcgtgtctgtattggttcacattggcctagatacagttggcttaaatggtagaggctttacggcacacgttaaattaaatcaagaagttaaagcaggggccctattagtgacgcttgatcgccaaacgatggcgatcgcgggattagatatgaccaccatagtcgtctttacagaaggttatacgggcgaagtgccacttggcagtaagtttcatcaacaattagcagccggaacaccagttttaaagcaagcataaactatgtaaaggagtgcgaattaaaatgcgggtggtgaagaaaattaataacaacgtggtcgtttgtcttgatcaacatggtgaagaattggtcgcctttggtaagggattaggatttcaaaaagtcccgtatgagcttactgatatgactaaagtgacgatgacattttataaattaaactatcaatattatcaattactaaaagaaatacctactgaaatctttgatttgagtgcggcaattgttgagcgagcgcaggcactaattccaagaattttgaatccaaatatgatttttagcttagctgatcatattaactttgcaataacgcgactaacccattataaaagcgcccagttaccattttcatatgatgtggagcaattatacccacaagaaacggatgttgggtattacgccgtcaggttaattaatcgacggctaaatattcaattaccagtttccgaggtcacagcaattgccatgcattttgtcaattctcagactaatgatttagcgaccaattcaagtgtaaatagcgacgatgaaatgataaaaatcatcacaaaaattattgaacaagaatatgagcttagaatcaatcaaaccgaattcacatacaaccggtttgtcatgcatttacggtattacattaaacggatgaagaaacatgagcaaatttctgaaaatgataattctaaattattcaatacgatgaggcatgatgagcctgaaatttacttggtagcaaagcgaattgcagactgcgttgatagtcaacttgatactaatagtaatgatgatgaacttttctacctaatgatatatgttaaaagaatcgttaataaaataaatactcaagcgtaaccgttaattaatggaggtgtatgcgacatgaaaaataaggataaacagtatgaaaaagtggcgaatggtgtactggaagcagttggtggtagtgcgaatatttcttcggtgacacattgtatgacccgattacgttttaatttgaaggatgaaagtattcctaatgatggtgaggtacagaatattccaggtgtgattggtgtcaatcgcgctggtggccagtatcaaatcattattggacaagcagttagcaaagtttatgatgcgttacttacggtggggaatttaactagaaacgcgccaattccaattaatgaagatttagataatcgacctaaagaaaagttaacgtttaagtctgcgggaaatatgattctaaataaattggctggatgtttaacaccattgattccgatgttgattgctgcatcaatgtttaaaatgtttgcggccattttaggaccaagtatgttcaatattcttggtactaaaacatcgttgtatcagttatttacgttggttggtgatgctggattctacttttttccaatcatcttaggatatacagctgctaagcaatttaatacgtcacggattatttcaatgtttttaggtgcaattttgattgatcctaatttaattaaaattgtgactgctggaaaggcatttaatatcttcggtatcgcaatgccattagttaattattcaagtacggtcattccaattattttgtcggtttgggtaatgtcgtatattgaacggttctttaagcgttatgtaccagagtcaattagtacgattgttatcccaacgttgacgattgcaatcatgttgccgatttctttatgtattttaggcccagcgggaaactttatcggcaattacatttgtacaggaatattagcttttgggaaattaggtggcttgccaacgatgatcgcggttggagtggttggtgccttatgggaaatcttggttatgaccgggatgcatctcttaatgcttacgacgatgatgatgatttttgcgcaatcgggccatgaaaactttgtcacacttggcgcagttgctgctagtatgtcggtcgcgggcatgtgtttaggtgcggccttacgaattaaggaccaagatcaaaagacccttgcttggggttatttaatcgctagtattatcgggggtgtgactgaaccgggattatatggactagcaattcgttataagcgaccatttattggcatgatgattggcggattttgcggtggcttatatgctggcctgacaacagttacagcttatgtcatggtacctgttgcaaactttttatctttaactgcgtatgttggcgggcaaacatctaatgtgattaacggtgtggttagtggcgtgattgcgtttgtagcagctgctattgcaacttatgcgattggtgttgaagccaatacaaacaaacaggggactaaagaatttaaactagtggaggcttaaaagctaatggaaagaaaagtaatcgttcgagctgatgatttaggttattccgatgcagttaatgttgggattgcacgaacagttcacaacgggttaattaataatgtgggtgttatggtcaatatgccaacgacgatgtcaggattagccatgattaaagatgcaggggtttgcttaggtttgcatactgttatatctgctggccggccattaacaaatccaaaattgattccgagcatcactaatccagatggtacctttcgtcattcctcggattatcgggcggctatggcggctattcatgattttgtcgatcttaatgaagttgttttggaaatcgaagcgcaatatcaaaaatttgtagcgttagttggtcgccagcctgattattttgagggtcatgcggtagttagtgataactttgttaagggattggaaattgtgggtgaacgtcatcacttaaatattttacgctttgcagcaggcccagatagtccgagtgtgctatttaagggaaaggtattacatgtttttatggaaagtatgggcaaaaactataacccttatgaaacgttgaaacgtgcggcactagcccaatataatgacggctatgctatgatggtttgtcatcctggctatttggatgactacttattacaacattcaagcctgacagttccccggacgcaagaagtcgcaatgttaacagatcctcaaatgcaggaatggttagaacgacagcagatcaaattaatcaaatatagtgaggtttaattactaagcgttaaggtaatcggtaagcagattaaattacttattcaatgcgcgttgcaaagcataaaaagagcgttgctactgaaaatatcttcagtaacaacgctcttttacaagttatcaagaatttaaattaagcattttgattttgctgctgcttccaataatagattgggaacccaacggccacgataaccaaggaaatcagtacaccagataagtctgagccaatttcactgataatcacgaacagtgcgcccagaatcgcaatcagcggtgtgatcggaaatccgggtgtcgagaatggtcgctcagaagctgggcgtcgttttcttaaaataaagacaccaacgaaggttgccacgtagaagcagtagaccgtgaagatacagaggtccgataagcgatctggattaaagaacaggatcataatactagcataaacgagaatggcaatggttgcggcgatcggctcgtgtgattttttgtgcaagtaactgagttgtttagcgaatggcagctgattctgagcagccatggcgtacacgatgcgggggaaggtcataatcttgccgtttaaacagcccaccatcgagatgataatcccaatgttcagtaggcgcccgccaattgtgccaaacgccgcttgggcaaagtacagcgtcgtttgttgcccgagtttgtggatcgttgccgcgggtacgaagtggagaatcccatagctgactaaggtatacgcaatcaagaccattgaaatccctaaaataatggcttgtggtaataacttctgcgggttcttgatttcgccacccaagttagcgactaagatccagccatcataggcaaaaagtgttgcgaggacggcaaccccgaaactacccgttgattgggtaattgtatgtaaagactgtcccagcgcattctgattaccatagaagagtccaaaaataataatagccgcaatcggtaataatttgcccaacgtggtcgcaatttgaaatgcggcgccccaacggttttcgaacatgttgaggattccaatcaggacgatgacgccaatcgagagtggcgcctgccaacccgcctgcaggttgaagaaaccaactagtaatataccaaggtaagcgctaattgaagcgatgatagcgggaccgtagacggcgatttgcatccaaccagagagaaagccccacaatttaccatagatttgttccatgtagacatagagcccgcccgtatgcggcatttgggcaccgacctcggcgattgttaagcccgcggtcaacgtaatcagtccacctagtaaccaggcgagtaacgcagcgctcggtgagcccgcactatcaaggactgatgattgcttgaagaagattcctgacccaataaccgtaccaacgacgagtgaaagtgctgaccaaaaaccgagtgaacggttcagggtcgttgcttgctttgtttcctgcattaacctgaaatcctcccttgaaacaaccaaattctaaatgattgcacttagcataccagagattaatggtgatgacaatcaaatatcgttggttgtggccggtttttcgcctaaaatccgaactaataacgatattttaataataaagttcgacaagactcaaaataatcagtgttattcggttggtgattcgagtttcgacaaaataggattgggcggcgtggtggctttaaattaatttatttatcttcctaatattagcagggttatttaacgggtcaggttagtcattaacttagtcattaattgagttagttgtgcccactcggattgattgagaccacccttagcagtcaataaatccggcaaatcatttaaagcaattcgtgttgcggttccctgaggtgtcagagtgagcaagatgctccgttcatcttggggattccgatgacgtgtaattaaaccagcttgggtcatccgctgtagcacgggcgtcagcgttcccgtacttaaatttagctgggtgctcaacgttttgaccgtgacagcgtgcggcggtgtcgcatagagtgcgactagaaccaagtattgtggataagtgagtcggtgtgctgtcaaagttggttggtagaggcgttgaatggcatggactgttgtgtaggttgaaaaacagacgtggtcttcaagggggcgaattgtggttgtcttcatgataattaccgcctttcatgcgatgagtattaagtgcggagacgttctaataatgattgtgcacaatcgattgattggattatagcacattctgacaatctgtgggcctagttgccctagtgccggtgggatcttatggtctggtggtcacgttcagtatgcaaactgatgattgtgggtaccacttgcagtgacgtcatggtaataatttttggttccttcctaaaaatacagtataatgctacgagtaggtaagagagtggggttagattgatggtaattgcaattgtggtgttgttgatgctgctcagcatcggcttatttgggttgctgttagccggtgccagacggcaagcagcgccattttttgaccacagttttggtttcggcatggttatcggggccgtgacggattttcttgacacacttggtatcggaagtttcgtcgtgtccacggcaatttttcaagcgagccattatttaaaggatgaacgtaagctacctggaactttgaacacgatgcatgcgattccgaccgcgtttgaggcgtttttctttgttacagcagttgcggtcgagccagtgacactgattagtttagttttagcagcaacgctcggcgcattactgggtagtgaagtcatgacgaagcttaatcagcggtggattcagttaatcatggccggtgcgttagtcatcactgctttactgatggcagcgaagttattaggttggatcagtttgctgggagttgctaatcaggcgacggggctatccggttggaaattattggtcggcattggtggcaactttatcctagggttactgatgtcagccggagtcggactgtacgcaccgtgtatggtaatggtgtattttctgggattgaccccgattgccgccttcccaattatgatgctgtcgtgcgcattgttgatgccgatttcggcagtgaattttattcgccatgaccgcgtcgattatcgcggcttattcggcattattttaggcggtattattggcgtggtggtggcagcgaccttagttaagtcactgtccttaacagccctgagttggttgatcgtcttagtgagctgttggacggccttttcgttatggcgtgccgcgcaacgccggaaaaatgtgttatagtcaacggtatgagtggttaggctaaccaagcctagccacttttttgtcgttgtttaaaatgatcgtcaggctgctagaaaaaataacggtcgctggttgacaatttatacagctggctgtataaatgaaagggcaggtgattaagatgaatcatgatgaaatggtggcgcggcaagttctgattttagctcgtcaaatcaagcggcgtcgcaaccaacatttgcggacggtggggttaacgactcagcaagcggatgcactgaccttttttacggatcagccaggtcgcacggtaaccgcgtttaagacgtatcaggaaattacccatcagacggccaggatgatcgtgcaacgcttgcagatgcgcggatatgtacaattagtggtcagtccaacggatgcgcgtgccaagcaagtggtagtgaccccgagtgggcgtgctaaacgcgagcagctccgtcaacatggctggcagacgagtgcgcaaatgtttgcccatttggatgccgaacaacaacaggtatttttagatttgttacggcaagttaatcagaatttagaaagtgatgagaattgatgaagacgcgtttatatacgccggatgtaaagttagtgttaatggctagtttcttctttttaatgagtccaatgttaatcaatcccgtgattgcaggatttgcgcacggtattggcgctagtagtgtgcttgccggtacgattgccgggttaacgaatttgacatcgctagtgctccggccacttgctgggaatttaaccgaccgggtctctaagtaccgtttgaccttcgtggggggctgtttgttgctactagctagtttaggttatagtttgacaaccaacgtgacgttaatcatgttattgcgaattttgaatgggttgggatataccttgtgttcagtttgcatggcaacctggatggctagtttattgccacccgatcgaattggctctggaatgggcatttatgggctagcgaatgcgcttggaatggcgtgcgggccggcaatcagtgtcttcttgtatcaacattacagttaccagagtgttttttggttagcagcgggctgtagtttactgctcatcatcatgattcaattcgtcggtgatcatggtgaaccaattgtgacgcctcaaacggctacgactaagcaccatattcgcatcgtacaaccacgagtaatccccgtggccttgattttgcttttattttcattaccatattttgccacccaaacctatattgtcagctacgtcgctgcacggcattttcatgtggcagcgggggtatttttcccggtgtacgcgggtattttattagtattgcgaattattctccgcgattggttcgaccgggtgccatttaaacggttcatctggttatgcttaatttttaatctattaggattgattggcttaactgacatgaacaattgggcgatgctactgctgggtgcagcaggactggccgccggatacggtttgatgttttcaatttgccaagctaaagcattgatgctcgtgccgaaagctgatcatgggctagccaatagtacgttttatattggtgttgatctcgggatgtcacttggccccatcattggcgggctgattagcagtcaattaccaatggcgtggttttatcccgtgatgatggtgacgctgccattgattatcgttgtttacctagtcagtcgtcggcagttagcttagccaccaacatgctggagaaggttgttcttggtatacacatgattatgaattttttcagtaggggatatcaaaaagtcacttcaagtttacgactgcctgaagtgactttttatctgcctttatataaacattttgatgccaaaataaataataataagaccaagaaatggcgttaatacgcggttgaccttatctaaatttaaatggcgaatcacgagtggtgtaatgattgcgccgataattgcgccaatcatgaggaccaatcctgattgccaagcaaaagtactagtaaagagatggccgattaaactgattgtggacataacagttaacacataggtggcagtaccagcggcttcaacggccgttagcccaagaattgctaacccggcagccgtggtcgcaccaccgcttaagccgccaatgccgaccatcaatccacttaaaaggccaaagaaggcagcttgccaaggttggtgaccggctgtagtttgtttagaatggtgaacatacttgattagtaccatcgcacccataatcaaaaaaattgtcccgacaatccagttatacagttgttggggaataaattgtgcgctgaatgtcccgacgatgataccgggaacggccgcaatgatcatttgattgccaatcttgaaattgacatttttgattttcaactgtgttagaaaaccaaagaataaggctggtaaggcgacgattagggaggttggtacggctaccgcggttgcaaggcctacttgactggttaagacacctaggtatagggcagcacctccgccaccaatcagactaacgaagatgccgattagtaatccggataaaaagacaaacgtagtgaattcccccttaaattgtataattataccttaaacggagtacactccgtttgtcaagtgatgcgtaaaagtgtatggtgaacttaagtaaataggagggtgtgtcgaatgcgaaaggatgcacaaattaaccaacagaaaattttgactgctgcgcgacaactctttgccgcgcgttcaatcgaaaccgttagtatgaaagatattgcgacggccgctggtatcggtcccggaacgttgtatcgtcactatgcccataaaagtacactatgtttggcattggtaacggaccgagtcgcaacttttattaaaaccaatcaagtctacttgaccacgacctcggtaggtgcagcggcacgttttgatcatgttattggggaatatttagcgattcgtgagcacaacatggcgttattaatgaatgtcgaggccggtgaacctggtcgccgtcaattttatcagagcgaactttatcaacaattatgtgacctattaacgcaactggttcgtgatttgaagccaacgctttcgaaaccggcatgtgagtttcaagctgatatgttaattgccatgctgaaggggactagttatgcttttcaacgtcaatggcgaggacggtcgcagtccgaactattggcgcaattgcacgcgttaatggtgactgaatgatgttcactattggcactagtggtttggcgattaacagagtgggttgattgttaaatcaaaaaagatggttctaggcggttaatcctagagccatctttttgaatgagtcgtttaagcaggtgtcaccacgtatttttcataacgttgggcatcgacagtgttgagttcgactgttaattgggtgccatcagctaagtaatccgttttgagaatgttggcgtggtcattcaagtaagccactacttcaccatcattgaacgggattaataacgttgttgtcacgtaattcttaaagactttggctttgatcatactggtcaaagcttgtagtgaggcctcatcacgcgccgtatagatgagttgatcatcttgctggttcgggtagtcggcttcggttaaatcagctttattgaaggcataaatcataggaacatcgtgcacaccgatttctttgagcgtcttttcagtggtcgccatcatttccttgtaatggggatcggcgtagtcgatgacttgaatgagtaagtcagcattggcagcttcggctagcgttgaacggaaggcgttgatcaagttatgcggcaagtcgctgacaaacccgactgtatcactgagcagtaactgcttattgtcagggaaggttaactgacgaatacttgtatctaacgttgcgaaaagcatgtctttttcgaagacttgcttatcttcacccttaccgaacagtttcactaaaccattcatagtcgttgatttaccagcgttggtataaccgactaaagcgacgttggggagcccagctttatcgcgttgtgaacgtcgcactacttcgtctttattgagttccttaagttcgtgcttcgcgtgactgatccggtcttgaattgtccggcgatttaattccagttgcgtttcaccagcaccacggttggtaaagcccccgccaccaccagcagcggccccagcctgttggtcaaggcgattggagatactcgttcgtaatcggggaagttggtattgtaattgggcaatcttaacttgcaatttggcttccttgctccgcgcacggttaccaaaaatttctaagatcagaccagtacggtcgatgatctgaatgtccgtttgttcctctaagttacgcacctgactaggggtcagatccgcgttgatgaccataatgtgcaaatcgttggcggctgcgacttctttgatttcgacaactttacctttgccgaagaaggtggccgggttgggtttttccaatccttggtcaattcgcagggccgcgtgcatattattggctgcaacgagcgcttctagctcggacatggcgtagtcgtaattggcgaccgttttagacatgccggcaatgatgacttcttgtactttttgagcgttggtttcagacatacactcactcctaacgtgttatgattgcattaagtataacatgtctaatcaaaatattacgacttcgggtattagggaggaatcaaaaatgggttacgtgcttgatttgcggcggcgagttggtcaccaaccgctagtagtggccggtgcggctttaatggcccaaaattcgattggcaaaattgtcttgatttatcgaaccgataaccactgttggggcttgccagctggatcgactgaaccgggagagacggtccagcaaacggcgcgacgggaattgaaagaagagactgggctgacggtgggtgagttaacgctgatcgatgtctatagtgggcccaagatgcactatcagtatcctaacggggacattattgacagtgtcaccacgttatatcgcgccaatacaacgggtggtgaattgattcaagccaccgatgagacgagtactgcggctttctttgctttagatgctttgccgacaccgttgaccccactgacaaagtggatgctttgcggtgagtaagcttgaccatgccgatgaggtttgctatagtggactgaaatattaagatgaactgtcaccggacaacgttaacccaacttccttaggtcattgtggaagttgggtggacgttgtcctttttattttgaggaggaattgataatgacgtggatttatttaattattgctggattatttgaagtggtatgggctacgatgatgaaattaagtaatgggttcagtcactttggctatgctgcggccacagtagttggcatggtcttgagttttggcttcttagcattagcaaccaaacacttaccgttgagtattgcatatccaatttggaccggtatcggtgcggtcggtgcgataattgttggcctggttttcttcaaagatacaattgcacccatcacgtggatcttcattgcaatgctggtcattggcattattggtatcaaagtcacgagttaggattgggggggtgttagtgggtttgtgattcatcagtgaagccccaacagcttttcaatatttttataaaagaatgaccacaagcatgaaagcggtgttataataactttagaagttaaatgaatatttgggttattcttagacttcttccgacctgagatagacgcactgttgccaagactttacaaaattttcttgttacacccggtcaacgcactacctctcggaggggtttcttaatttcgtcagtaattctgtgtatagtcttggttgagtacaacaaatagtgaaagaagtgacgtctgatgatgatgtatccgtatctgaatttaggccccagagatggcgtcttgataattgcagctgctattatgttagctttaacggtagtttttaattggtcagtctgggaacttttgtttgctgttgtggcagtcgtaattgcgttcttagcaggaagcatgaaaccgtctaagaagaacgtgcttgcttttttgaaaaaatagtttgaattggggtagcatacctgaattcttcaaacacgtctttaaccagcaaagtttaaggacatcattgataagatagccgagttggttctctgtcaattgatgttgcgaatagtgctacgggtgcttagtcaaacaatggcgagcacctttttcaattcgaattgttcaatagcccatgattaaaatacaaataaagatatctgtcgccagtaatcacgtatttagttaattaccaacaacagttatttcagagccaatataaaaacactcgcgaccagtcagtggttgcgagcgttttgtttgatgagcaaaattataagtgttgattgactttcacgtcagctaagtcttgcgcataatcgacgacgcgaatttgatcgccattgatgtcgatgcgagtgacgctcccgtttttggggccgttcgtgatgtcgatttcaggagcaaaatgtgcgaccatactgcggattgtcgtgccgtgggtaaccacgaggactttttgatggtgatcgtggtgagctttcaagtagtcaaagccctggttgatccgttcccagtacatcgagttgtcttcagcttcatgccaagggtcgatttcacgcatcaggtcgcgagtctgatcgataggcacgtgttcaagaagttcgtgcatgctggtgaccccgtattggcggccaactagtgaccaggtccgacttgaatcgtcaccttcgaaataaccatagaaaacttcacgaaagttcatcagtgttttaaagggctgggcggtggcacccgccgcttgtcgaatgagctgagcggtgtcgattgcccgcttagaatcactgctgtagtagtagtcaaaagccgtgttcgctagtgcttgaccgaccttggttgcggtggcttgtccgtattcagttaacggcgagtcagaccagccttgcatgcgattatataagttgaaaaaagtctgtccgtgtcgaacaaagtaaattgaaaattgagccatgtgtttctccttatttagtcgagatggtctttgcggccaaagtagtctaacgtcacatcgttgtcgctaattgtgaatttcgtgacgctcccattttggggccgtgctggtgaggtcagtgcggcaaaacgagcagcaatactgtaaatcgtattgccgtggctgacgaccaaaactttgtccccgtcgtgatggtgagcacgtaacgtatcgagaccgccattgacccgttgccagaattcggcgttattttcggcgcgatggaacgggtcagcttctttacagaaatctttggctttttcgatgccgtattgttcaataattgcggacaaactaggtgcttgatggggcgcaccaaccatgaaccaggtctgcgacgtatcatcaccttcaaaatagccataaaaggcttcacggaaggcagccattggttgaaccgtcaaatcggtattgccactggcaggaagaattaattctgcggtgcgcattgcccgcgtcatgtcactggcgtaaacggcatcgaaatcaataccgttgagcattttacctgcattgcgagcgtcctgttcgccgacagctgtgaggggggaatcacaccagccctgcattcggcggtacttgttaaagtaagtttgaccatgacgaatcatgtaaacggaaaaagttgccattatttactcctctacttggtgttcaaaactaagccataatgtatttagtttaccataaaatgcactgcgattaattagcagttgctaaggcttgtcgaatctgagcggccgtttgcttattcccggtaaagattaagcggtcaccgtacataatcgtcgtatttccattgggcgcgatcagtttccgattacggatgacttgactaatggtaatatcctgagcaaactgtaagttcttaatttgaacatcagtatagagatggttgaggacccggacttcgtagatgctgttttcagtatcattgagcaatagcaaggttgacggtgattcaattaaggcgcgcagtaaagtaatgttggcctctggtgtattgtagacttcgacgcctagctctcggagttcatcttcatgttcgttgagcacattgcggtcttcaaaccgaacgatgatccgccgtacaccgtatgctttggcggctttagcaagctcgtagttacgttcggcatcaatatggccgagtaccaaaatatccgtgtcaaagacgccgtgatcctgtaagtcctgggctgtgaagttttccattaaggtcactggcacttgcgcgtggtaggtttgataattctcaggatgattcgtgtacattgacacgtcgtaccagccttttcgtagctgttgtgcaacgggtacggtgcttaagttagcgccgataaagtggaccgctgttttgaccaggtcttctttttcagctgaataaaacttgttaaaaatcaggggtgagatgacacaagtgagtagcgctgcgagtaagaaagcgccggactggtcactagtaattgtcttcattgacttggcaactcgaagaacggctaataccattgtcattgtcgttgcagtcagcgcggtaccggctaaagcattggcttgcttgaaccgtaactttaggacccagtagccgccaatcttggcaaccatgtatgctaagaaaaatagtggaattaatagtaaggttttgccacttgttaataaggtccgtaagttcaaatcgacgccagtcgtaatgaagaaaatcgggatgaagaagccgtaaccaatagcatccaagcgttcgcgggtcgtttcactagggttcaagagtttcaagacgattccggccacaaaagcgcccaggatgttttcagcaccgacggattcggccaccgtgaccatcgttacaatcaagaagaaggctaaccgaatatctagttgtgtcgtcgatttgttaatattttgatagaagcggaagaatggtttgaaccgtaagagtaatagtgcggcaacggctaaaatgagtaatagtaaccagagactttgtgagttactgccgtagacggatgcatagagcgtcagtcccatcatcggtacaagttcaccaaagaccgagatgagcagaatcgtttgtccgaaagccttactaagcaattcctgttcttttaaagctgcaattacaataccaagtgaaatcgtgccaaataaaatcgcggcaagccagaaatcactgaagaggccgctgactttaaaagcagcggcgagtaacagcgatagaacaataattgtgctgtaggcgtacaccgaaagtcgaactggcgaatatttcggtgtgttgaccgcgtttttttgttctaaaggtgttaacgccgtgcgccgcttcttaaataggctaaagtcaatttcaagtccacttaagaacagcaggacgatggcgccaatcgttgagagttgtgagataaggtcagaggtgttcacaaagttaaacacgctggggccaattacgataccgacaatgatttccatgacggccgttggcaaactgttgattttgaatttagccatgataagcggaattaataatgcggctaataaaataatgactaaggaaacttgatccatgaataaatacctcgattcgttttagtacacacggagctgatcatcatcaaagccccagaaagcttcgctagcatgtgcatcggtgaaaactttcaggatttggtcgacaccaggggctaatttgtcaggcgtcagttggctcaatggttgccaactaatggccccctcgtatgagccggctagcaaatcaccgtgatagtgactagtggtgtataaggtaccaagcgacacgtcgccgtccgcattttcgacccacgttacggtgccaactaattttaattgatcgacgtgcaagccggtttcttctaatacttcacgcttcatcgcggttacttgtgattcaccgcgatcaacatggccgccaggaaaagttaaccccgaccactgtgcgtcaatcttattttcaaccaggacatcgccggtcgctggattggtgataaggcacatgttgacgagttctgcacggacggtccggtcgtggtgttcatgctgatccttagtggctaaccagtcttgggccttgtcattgatgcttgccatgaatgctgctttcatttgtaggtaggctgcgagatcggcttgtccattgcgcacacctttttcgcgaatggcagtatacttgcggccgtctgtccggtgcgcattgagataatcccggaaagtgagcaattgctgataatgctgttcatcagttgtaatgatcacgtggatgtcgttagcagctaattgcgtcgcgtaagtatgcgtcgttccagcgaccggtcgtgcgtgtaacgtagctacggcagccgcctgatctttaacaagcaacgccaagtcaattgttggacgcgctaataattggggcatggccgtactacccacgtgactactttttaatagattcgcctgtaattgctggcgtaacaaggtttgatactcggttgcttgcttttgccagtcagattgataggcagttaattgaattggttgcatagaatccctccactcgaataagtcattgaaaggatacactttttgagtggttttgaaaaggaaagacatgcctttcaaagcgagaagcaataaaaaaacacgattgcagatcaaccgtgttgtgtgtggcgcttatttgagattgagtgttgtccgttgtcgccaggtcttaatcagcgcaaccactgtggctggaatgagcgcggcggccataattcctagaaaacaaagcgagaggtggttttgtacgaagctgatcgagccaaagaagtaaccgagtgaacagccgacactgacccagataccaacgccaactaagttccagatagcgaaggtcggttgcggcattttagcggccccggcactcagcgggacaaaggtccgcacgagtggaacaaagcggccaaacatgacagctttcgcgccatacttagtaaaaaattgttgtgcgcgttgttgcttggattgggggaggtggcattgcaaccacggtaagcgaatcagatggcggccaatttcgaaattgacagtgtcgccaattacagcagccacaaagaatactggcaccagaatctgaatactgagggcgtcgctgtgagttgcagccatcgtgctggtgagaaagatcaatgattcgccgggaagaaatgggaaaacaaccatgcccgtttcaagaaagataacggcgaataataagatgtaagaccaactaccaagcgtagttaatagtgggacgatactttgttctaaatgggttaaaatggctattaaattgaccaacggcgccacctccaatttaagttgcatttattataagcgtctgcgggttgaaaaacagatgtaaccgattacatttcttccagtttaacacaatcgtaactttgatagaccaatgttcaaacaaatttacataaaaaatcaaaaactggcggctgccatgggttattaattgagtcgggccgccgatagtgataaaattattgttcgatatttaggaatggagggcgttcaatggctaagtcaattaaagctgcagaacaggaacacttagatcatgtggttgcgaaaattaaggtggctgaagagcaacaaagccaaaccattacgcgctcggaaaaagatcaggccgatattaaacgtgacttgctgaataacatcaatataaaaacggatagttacgaaggcatgatggagaccggattatccgtgcggcagcaacaacagatgatggatgagcggcagaatagttggaagcacgcgactaagcaattatcgacgttaaaaaagttggaaaagaatgcttattttgcgcggatcgattttcatgagactggtgagcctaagcctgagacgatttatatcggactcagttcattttctgacacgccggatcactttttgatctacgactggcgagcgcctatttccagtatttattatgacggtgggttagggcacgtgacgtaccagactccggatggtgaacagaccgttaatgtgaagttgaagcggcagttgatggttgagaatggccagatcgtgacagtctacgatactgatgaagccgttggtgactcgatgttactagaagtgttggatgaaaagtccgatgtgaagatgaagagtatcgtgacgacgattcaaaaggaacaaaataccattattcgggatacgagttctgacctcctgtttgtgcagggggcggccggttccgggaagacctcgtccgttttacaacgggtcgcatacttgttgtatcgttaccggggtaatttgacggccggacaagtcatcttgttctcaccaaatcaactctttaatgattatattaaccaagtattgcccgaactgggtgaacaaaacatggttcagatgacttatttccaatacgcatcgtaccggttaccacacatgcaagttgaaactttacagcagcggtttgaaactgaaaatacaccgcagatggcaaagattacgaagttggaaggtagcctcgcatttttcaacgcggttacaacgtatggccgacatttggaacaagcggacatgcgtttccgtaacattacgttgaacgatgaagtgattatttcccgggaaaagattaaatcgatttactactctttcaacgaaaactaccacttagcgaaccggttatcagcaactaaggaagaattaatcaagattttgaatcgcaaggttgaatcggagatgcgttccaagtgggtcgaagaagcggttcaagacttatcacgcgaagagatcaatcaattatatggcaatcagccgcgggaatttaagaatggcgataaagagtttaaattcttagcacgtaaaattgtgatgcaacgcttaggaaaagcccggacgcaaatcgtgcgtaaccgtttcttgagcatcaacatgcagtacgcgcatttcttacgcgaagtaccgaagatcatcaagttggctgatcacggtatctcagctgctgactgggatgctacggttgaacggaaactagccgagattaaggaacgtcatatctcgttaacaacggtctcagcttacatgtacctgcatgacttaatgaccggaaagcacgggcagcgtgacatccggtttgtcttcttggatgagattcaagattacaacgcctttcagctagcgttcctgaagtttagcttccctcaagcccgcttcacaatgctcggtgacttgaaccaggcgatttttaccaaggaaaacagccattcgctgatcaatgaattggccacattatttgaccctgaaaagacgcgggtcgtgcaattgactaaatcgtaccggtcaacgcaacagattactgatttcaccaaggaaattttagtcaatggtgaagccgtcacggcttttgatcgtcagggcgacttgccaaatgtcgttgtgacgcctaactttgaagcaggggttgatcaagtcgttgatcagctagcgatgaacgattctgaacgtgatacgacggcaattatcgggaaatccttagcagaatgcgaggcgctcacgaaggccctgaaagctcgtggtgagcaggtcacgttgattcaaactgaaaatcaacgcttggctcctggtgtcattgtagtcccgtctttcttagcaaaagggttggagtttgacgcggtcatcgtgtggaacgctaatcaggaaaattaccaacgtgaagatgaacggcaactattatatacaatctgttcacgggccatgcacgagctaacgctagtcgcggtgggtagcttgtcaccgttactagcgcgggtgaaccacgccttgtatacattaaatgaagcaaaagtttaagtcagtttaagacagtgagtaccgctccattcacctggagtggtactttttttagttttacttgtgaaggaaatcttaaggtgcgtcaggatgatcagtagtggaacagttgggacttgtgtcggaataactaagaaaacgctatcataacgatggaataagcgttaaaattaactcatcaagtgcagtagtcggtgagagacaatgaccttaatactgactaggcacataatatcgtgaaaatactaacaactagttagaacggttgttagtgacctgaggaggaaacgacgatgtcaatcactgaaatgttaggtattcaatatcccattttttctggtgccatgatgcgaattgcgacccatgaattagtcggggcggtttcggaagctgggggactcggtgttttaggttcagcggggttatctgccgaacagttgcgagcagagatccaagcgacccgcaagctgacggataagccgtttggtgtcaatttaatgttacagatgaagaactgtccagaactggcccaagtcatcattgatgagggggtcaaggtcgtgacgactggtgcgggtaacccgacttcatatattccgccgctacacgcggccggtattaaagtgattccagtgattgcttcggttcaccatgcccataagatggtggcggccggtgcggatgcggtggttgctgaaggtcaagaatcaggcggacatatcggtcaaacgtcaacgatggcattattacctcaagtcgtggacgctgttgatattccggtgattggtgctggcggtgtcggtgatggccgctcgattgcggcgatgtttgcgctgggcgcccagggtgtgcagtgcggtacgatctttctgacagctgaggagtgcccagttccagctagttataagcaacgggtattggctgccagtgacacggatacaatcgtgactggccgcagccagcgcgatccggtacgggcgctagttaacccgatgttggcacaatacttgcgattggagcaaactaacgcgccggtagcggaattacacgcgttagcggacggttcatttgcgaaagccgttgaagatggcgatatggaacatggtacgcctatggccggtgaagtggcagggatgatgacgacaattcggccagtcaaggaaattattacgacgttgtttggtcaggctcgtgaggtcgcggcacaactgaaaatcgaataagatacagtagcatagctcggtactaggtcagcgttaactagtatcgagctattaatggttattggctaccaattaggaatccggttaatttgaattttaatcagcgtttgataagggtttcatgttataatcaacccattaatttagtaatggtggcagacagaaatcatggaagatcagatgaactattatcgcttctcacgtgaacagtggaagcaattttatcgtaacaatcagcatcaagtaccattgaccgcagccaatttgcacgaaattgaggcgtttaatgaccggattagtctcgacgatgtccgtgatatttatatgccgtttgcgcatttgttgcaggccaagtatgaacactacttgtcatggcgggaaacggagtccgtttttttacaccgtcagaaccgccaatcaccctttattattggagtgtctggaagtgtggcagttggcaagaccaccacagcacggttattagagattctatttaaatatttatatccagaccggcggacgcaattgattacgacggatggtttcttatacccgaatgccgagctcaaaaagatgcaattgatggaacgcaaagggtttccggaaagctatgatatgacgcggctgatccaattcttgaacgatgtgaagagcggaaagccgttagcgaaggccccggtatactctcatcagacttatgatattgtgccaaaccgttttgacgtgatcacgcatcctgatattttgattattgaaggaatcaacgtgttgcaattgccaagcaatcaggcgatctacattagtgattttacggacttctcagtgtatgtggatgcggatgccgatttaattgaagattggtacttagaacgcttcaaggccctgatgaaaacggctttccaggatccgacgaattatttctatccttgggcgatcggtgatccgaaggacgcaatggcgatggccgagcgtgtttgggaagaggttaacttgaaaaacttgaatgattatatcttgccaacccgtaatcgtgcggatttaattttgcacaaagttgcgcatcatgtgattgatgccgtgtatttccgcaaatattagcacctaagaaatttctcatactggttgaccgaacgtttagaaatcagtatgatagacctattgagcattaattaatccaaaggagtgaacaacttggcaaaaacggataccgcgtctttcgattccattttggtattggatttcggtagtcagtataatcaattgattacccggcgcattcgtgatttcggcgtttattcggaactacttccgaacacgatcaccgctgaagaaatcaaggcccgtcacccgaaaggtattatcttttctggtggccccaacagtgtttacgatgatggcgcctttcgggttgacccggagatttttaagttgggcttaccaatcttggggatttgttacggcatgcaactgatgacctacacgcttgcgggcgggaaggtcgaatcagctgataaccgtgaatacggcaaggcgaacattgacgtgacgagtgactcggcgaccctatttaagaacacgccagctgagcagtcagtgtggatgagtcatggtgacttggttactcaggcacctgatggttttgacgtggtggccacttctaagaactgcccgattgcggcaattcaagatgttgaccggaagttatatgggattcaattccatgctgaagttcggaatacggactacggtaatgatattctacggcactttgcatttgacgtttgccaagctgaagctaactggtcaatggatgatttcattgatatgcagattgaaaagatccgcgctgaagttggcgacaaaaaggtcttactgggactttccggtggggttgattccagtgtcgtcggtgtgttattgcacaaggccattggcacgcaattaaccagtattttcgttgaccatggtttgttacggaagggcgaagctgatcaagttatggcgagcctagaaggtaagttcggcttgaacatcatcaaagttgatgctaaggaccgcttcttaagcaagttggctggtgtcagtgatcctgaacggaaacgtaagattattggtaacgaatttatccaagtgtttgatgaagaagccacgaagttaaacgggatggaattcctcgcacaggggaccctctacaccgatgtgattgaaagtgggacttcaacggcccaaacaatcaagtcacatcataatgttggtggtttgccagaagacatgcagttcaagttgattgaaccgctacggacgttatttaaggacgaagcacgggaactcggtgaaaagctaggaatgccgtctgaccttgtttggcgtcaaccattccccggccctggtctcggaattcgggttattggtgagattacggaagataagttagaaattgtgcgcgatagtgactttatcttacgtgatgaaatcaaaaaagccggcttggaccgtgaaatctggcaatacttcaccgtattaccaggcatcaagtcagtcggtgtcatgggtgacggccggacctacgattacaccgttggtattcgggccgtgacatcaatcgacggtatgaccgccgactttgcacgtattccatgggatgtcttacaaaagatctcagtgcggatcgtcaatgaagtcgatcacgttaaccgcatcgtgtacgatgttacgagtaagccaccttcgacaattgaatgggaatagaaaatcatataaaaatgaaatcgtaatattgatttaacagtatttgtgagcttataaaatggatgaattggtggcgaatctgaaagatttcctatcaacagtctcactaagaatcgtggaggtctttagtcacttaggagtgattaaggatttgcacgattctttttttattggattcttgtttgttcacaaaacattgcggataatgtaagtaagtagagatatatcatatagagtgtggaagaactgttatggcaattacagaagtttaagactaaatctaattgataattgatgaaccaaatcacaaagagtttgttagcacttttgaagagtgaatcaaagagaacccagaaaataatttctaagttatgaaagtggtaatgatttttacaaagaattgaatgaagcttattaaaaaacaaacttttatttaagcgtactaattcagatttaatgcaggcgtaatatcgatggtgtaataggattatgaatggtttgttttcagaagttagtgcaatcaaggttaaattctgagtgataattttattttttatcattagtaggacattttttagtaggacattttttgacatttgtgactagtgatattgcagtgcacgatacaaaggtgatagtgtagttagtatagaatagtgagtgaaaaggagtgaggaggggtcatgagtaattatctagtgggtcctgataagaaaaatctgtttggtcggcggtcaacgtgggattttgatcaggcaattgaagcgtccagtgatggagatgtcattgagattgaggcgggatttgatccgttcaacggtcaaaataaccaatctatagttattactaaaagtattacaattcagggtcacgttgaaaatagagagaatgaacatatctataccaatacaatcgatggtattgtagtgaaggatggagctacagtaacgttgcaaaatatttgtattcagaaaaatactgataagagtaatgcaattactgtgcgtatgggttcaactgtaattgctgaagatgtttacttaattaacaaatcaacgactggaacaaactatccaattgtgtatattagtggaaattcacatgtacaattaaagaatgtaacagtcggagctagcaaaatttcagatggaaagcatcgtatttacgtcgagaattctgagctgactattcgtaattcatggatttgtgcaaaggtgtatttgaagcatgctcaatttttatgtcataaaagtcaactagaatacacggacggttgtgtgcttaacggaaatgaacaaagtactatccaattaatatcgtcaactttaacgggtggaaaaattctgtctaaagaagtgtatccatgcgttcatatatgtgattccaaattaacctgtcaagattgttctattaatcagcccaagtttgacatggctctattggtgttaaacagtcaaatgacacttaaaggtggtcaagtggattcagttagtttagatcacaccacggctaatattaacgaaacactgattcgggaaagctttgcaatcgaaaatggaacacaagtcactggaaatcgcttttttattctagggcgtgacaacggcaaagtaaatttgtatattgcgggccgctctaatattcaggtctgccatattatttttggacaaatctcaaatccaaatttgaaacttgaacggaatgtagatatcggtaagacagcattagattactaccaatataatttaaacaatgggacgtttgtggtggatcaaacaaatcattacatttccgcggacaagcagggtcaagtgagttattttggtaaaaagcctgcgttggatcgtctcaatgaaatgatagggattagtggagttaaatcggagattaatgaatttattgctatagcccaaatgaataagcagcgtaaggagcaagggataagtagtgatgccatgacactacattcactattcctaggtaatccggggacaggaaaaacaaccgttgcacgtattttaggtgaaattttatttgacaaaggaatcattaacgatcagaaatttgtcgaggtttcacgttcggacattgtaggacgttatattggcgaaactgcgataaaaactcgtaaagttctagagtctgctcttggcggagtcctatttattgatgaggcatatacgctagctaacggggatgagaaagactttggacgggaagccatcgatgagattttaaaattcatagaggatcatcgtgcggatgttgttgttattttcgctgggtataccgatcgtatggaaaagttcttaaaaatgaatgagggactgcgaagccggattcctaatcactttatgtttgaagattatacaccccaggaattaattgaaattggctggaatgacttaaaggctaaaaattatattgtggataaaactgcatacacggacttagttatgcataattttaatgtctctcacgatcatagtaatggccgctgggttcgtaatcttaatgaaaggttaatcaggaaatttgctgttcgtgtcgccggccagcaaggagaagacctttctgcaattaagcagcaggatattgatgctgcaatgttatagtgacaacagaggagtagtgaagaatgacagaaaagaaacagtatgttcggccgcccaagccagtaaagataaagcctacggtatctaggaaaaaacttagccataaattagacgcatataattatttacatcccgattattggaagcgaaagttagctcacttattactagtaataccagttgtgtggaccatttatggtatgattctactggccatcttttatccaggtatgcaatcaggaattggagttactgttagcttattaggagtaacgatgagtgtattgcatattgttctgacggcaataagtgcttatttctatccatttagtttgtactggtatcgtgaaagtttgataggacgcattttaaatggcatgtggtactttggtggcttctgggctgttattggaaaaattattgtcacactgattggtggcattttgattgcaggtcttttgacaccgattgctggaccaataacattacgtcgttgccgacgaaaaaatataatcattggtgacgcaaaagattttgaatagaatattattaataataagtaagtggatctagaacctgttgcagtgctatgatccctttatggttgtcagatgaaataatataattcatctgacaaccatggagggattttttatatgccaaggtctagacatacaccggccgaaaaattggctttaattactgattttcagagctctggcctttctattagcgcatttagcaagcaacatgaattgagttgttattccattagataatgggatgttatgctatcaacgtgacggtattgatggactagcagaggccactaagaatcagcactacagtcagactttcaagcagaagatcattcgagcatatttgaatggagagggaacaattcaaggattaactaataaatatggattacgttcaacttcacagctaagaaactggccaatcaagtataatagggacaaactgtgacggcttcaccgtctagaaagcaggtcctaaaatgagccgtaaaacgacttttaatgagcgagtaacgattttggaatggattaataaaggtaatcattcatacagtgaggccgccgaacatttcaacgtttcttatcagcaagcccgttattgggccttaaaggaccaagctaaaggttttgaagttttggtcgataaccgaggacatcgtaaacccgaatcagaattaaccgatttggacaaagccaatctgtggattagacaattagaatcacaaagcaaggatcagcagttattagaggctttcataaaaaaatatcaggaactttagcgcaagggtgaattcacaacgtcgactggcttaccacgcaatcaaggaagttagtcaaaataatcacggtacggtcactaagttattatcaatactcaaagttagccgccaggcatatataaggggctccatcgtgacgtaacgacttgggaaattcgagataacttcttaactgaacgggttcaatactggtataaccaacatcatcaaagtattggcagctatctaatctcagaaaagacccgaccgttaccgaacaggtgacgttaaagcaagttaagcgaattatgatcaagcttggaattcgttgccaggttcgtcagaaaaagcattcacggatcaaacaacaggagcaatacttacaagataatgttttaaatcagcattttagcgttaaccaaccaaatcaggtctggttggccgattcaactgaattaatttatggtgttaatggtcagtataaagtacgcctgagtggctactgggtctttgcggtcggcatctaattgcccataaactaagtgaaactgaaactacgaatgcggaagttcaggtttttcaacgggcctttaattttgcgggtgacgtccaccctgtagtgcatactgaccgaggttcggcatacatatcaggagtattcaataatttttggcgcaacatgaggtactcgtagcatgtcacgaccaggaacgccatatgataacgcaccaatggaacgatttcaaattacgttggatggaccgacatgccaaaccagctacctataaagaattagtggccttggttgaagaaggcagcaactactttaatcagctagaccgttcatcagcaagaaacgacctcaccccagcggaatactggaatgaggccgtttaagtagagcaaaacttatattatttcaaatgacaacttgacagatactcgtacagtaggaactccaatgaaagaggttttcgtcttggtgtttttattttgtaaaaatactagtggctaacttgattttaaaactcaccatcaatgttccgtctcatttcaatgaattttttatatctaggatattgaatgtgatgaaaatctagctcaggcataatattgattagggaactgtcgtgaaaatgcgtgttattcaatagccattctatctttctgtaacattcagcaactacttcatcattactacattccataaaaatcactgaagtgacaaaaatatcgtcaatattatcttcagtttttttcaaattaaagaaataacgctttaatgaattagcaagatcatctagattgagttttttgggattttcaatatagctgaggtaaatatttgcccaggtgattccagtttcgtttcctattgaggattctaaagtatcaaacgtaacctgtttgaaggtctcaggttccttcataaacttctgtattgtcttaatgggaggcttcaagagtgctttagaaacttctgtatagtcagagttccaagtacttatttcaaaaaagtttccaatcaatctttttactagagaacgtagcacgtcaaattcagatacgttttgagaaatgttaaaaaatggagtcagcggccaccggaatattggctgaaataaaaatctgccgtgtgcaatcgcatttctaagtttaattactgattcaacgaaatacatatcattttctgaatctataccattttttgatagtaaatggtagattgcaaattt

SEQ ID NO: 7 - DNA, 63321 bp, Lactobacillus plantarum
agattctaaacacgttctaagttaatgcgactacatcgccacatgccccggcttaaagcgcctgctaagtggccgtgggtaaccatcattgtaccggtttataattctgaagatacgttatttgactgcattcgttccatcgatcatcaaacgtatgataaaaaagcatgcaaattattttggcgaataatcagagtaccgatgatagttttggggcgtatgctcgcgcccaaaatgcgtttcctaatttatttttacggtatgtcaatactgacaaggggaaagctcgcgcgcttaacgcggccatttacgagagtattggtagttatgtcattaatattgatagtgatggtttattggaacccaacgcgattaaaaatatggtactacggttcgagaacgatgagcagattgcggccatgaccggggcagtgctcccacaaagaaacttggttaagcaagttcatggttggtggcatcggctgttggctaaaaatgagtattacgaatatgcacaggcttttctttctggccgtaccatcgagtcgttccgcgaccagttgtttaccatgtcaggagctttctcggcatttcgacgggaagtgttaatggaaactttcttgtatgacaccgatacaatcggtgaggacacggacatgacgtttcagattcggacacgtttaggcaaaaaggtcgttatttgtgcagatgctattttttatgtagcgccaatttcaggcttttccgagttatatacgcaacgccagcgctggcaacgtggtgaactggaagttgcacaacattatatgtcacaaacagctagcatcaagggctttttcaaagaatttttggtgcggcgaattatgattgatcacacgtttacgtttccacgaatgatttggacttttgcgacgattgttttgattgcttttggctattcaactgtggtcgtggggctctcatatctcttgatctatagtttatacgtcatggtaggggttattaactttattagtgttggtattttattaaagccgtatcctgaagaacgccatttctacaagcatttatggtggctaacattaacgctgccactttatatgtttttgacagcttggattcgattgattggtgttatcaatgcgatgacgacccagacaacttggaaaatgcgggggttcaccgaagaatggcaacgattgttggccgtcttacgtgatgataggcgtacaattcacaatcactatcgacgccggaaaggaaaatgagttgaagcggcacgtgttggctgactacaagatatcacgcgaagttggcggaatatcttgattgtttagttcaggtgcaagaattcaaacgaagtagattaatgatgagatgttatttttatcaatttagtcagaagatgattacgagcgtttggtggttactatttgcaccaatgttgttatttgcagtaatgtcgccgaatattattttaggggataacgagacgtttgggacgagtacgaccttattgacgacggggttgattattgtgattgtcgccgtgttgattatgaactatgcgtatccgcgcgttcatcgggtgctatatcgactattaatcacaaatcagctctggacggctggtgtcttgttagcactcgtttttattggtcagctcgtattcgtgacatttgtccatcccgtcagtggttttgacgctgggatgctccactatgcggctaccagtgcgaaacacgtccaggaggtgggcgtgacggcgtattacagtcttaatcaaaacaacatgccaatcatgctttttatgcactggctatcggaagtgactggtcaaacttcatggcaattttttgattacgtgacgctgttttttgtcgatctttcagcagctttcaatttaatgagcgtatttgtggtacgacgctcggcgttaggaatcgctatgtatctgcacgctggttggttagcggtttttccaagtattattatgccgtatacggatgcttggggactgccgctggtttcgtttttcatgctgtgctattttgtgatgagtcaaacgaagcgaccgccgttactgcgtgtggccgccgccgttgggtttggcgtgagcgtgacattaacgtacttcatgaaaccctcatccattattccggtaatcgccattgccatcatcagctttttagcacgtttgcggtcgcggcagggttcacaaacgacgatgatttttgtgacggtcgccatggcaatcttgatgctcgaaagtgccggcctcacttatcattatacgaatcaggccatccagaaccagacgtatatcaaaatcgataaatcaaggtcgattccggcgattcattttatggccatgggcgtttacggctccggcgggtatagtgaaaagcaggcgatacagatggccgttttgcccaccaaggcacaaaaaacggcttactcaatcaagatgctgaagcgtcagctcaagaaactgggaccgtggggttaccttgaattcttggtaaaaaagcaacgcaataatactgctgacgggacctttggctggttgaaggaaggcaatttctttcgcgaaaatcaaaaaccaagcaaccagggctttagtaattggttaaaaaactttatttatttatacggtcgccatattgcagattttcggtttgtggcgcaactgtggtggttagtactactcgtaattatcgcgttgggttttggcccgcgctggcaattgattcaattgctccggttggcgatgattggtgggtttatcttcctcctcttgttcgaaggtggtcggagtcggtacttaattcagtacttaccgtgcctgctattactgggcgcattctcatttgaacgggcagttgcgaatatccagcgtgttagggattggtatcagcgtaagttgcgagccgcgattgcggcagatgaggccgagtgagcgtgcaatcgtcccagtgcgtgacacgaaattgatcgttaacgagcggttagcaatccaaaatagctgtggtgggtcctaaatggggcttaccacggctattttatcgttcacgttgtcgattgttggctcttgcgggggcgcttatcgcgttatgggtggcaatgcgcgataaattcattccgacgtcaagtgccggaacggcgcgggttgttcaaatcgtctaggtacgtttattaagggaaatacactgatttggaggcgttggccagccggttactaatgaggctaaacgcactagtttgtaaatcagtaatccaaacttgattaaaaaacaacaaattaatatgtgaaaatgctgtgttaaaatcgacttatgctataattgttgcaagcaaacagttcgcgttattgtgggggataacccgaattgagatattaattagggtgggatttaagctcatgtggaaaaagttacactatatggactatgtgctgtttatcccgtatttgattctcagcgggatcggcgttgtcatggtctattcatcgagttcatacgtagccgcacaaaacggttcgacacccaccggttatttagttaaacaactgatctgggtcgtcttaggcttagtgatcaccttggtttgtatgaatttgaagatcgactattttaagcaaaccaagttacttggtatgttagggtttgcgatgttatttgttctggttctcctccgattggttggtcaatcaattaatggggcggctggctggatcattttgggaccagtctcgatccaaccagctgaattttgcaagttttacctgatcatttacttggcatcaattatttctcaacgggaggcacattttggggtggctcgaatccgtgaattgggtgctcagtttgtgatgttgttcgcgatgattttactgatttttgtgcaacccgaccttggtggggccacgattaatttagccatcgcggcggttattttgtttgcgagtggcatttcatactttgtaggtgttggtgtctttgctggggcggtcgctgcctttgaatggattttagtgcctttagtgagtcgcatgccccaaagtgcttttgcaaattcttatcagttacggcggtttctcggtttcctgaatccgtttaaaacggcttcaggagcggggacgcagttagtcaactcttactatgccatctcaaacggtggtttgacaggcgttgggattgggaatagtttgcaaaaacgtggttatttacccgaaccgaacactgattttattatgtcaatcactgccgaagaactcggactaattggcattttaatcgtaatgggcttactacttgtcatcgtgatgcgcacgatctatatcggggttcgtgcgactaatacgttcaacgcgttggtctgttacggtgtcgcagcctacatgaccattcaagcatttattaatgtgggtgggatcgttggtctgattccgattactggggtgaccttcccattcatgagttatggtggttctagcatgatggtattgacgctttcactaggattggtattaaacattagtgcacttgaaaaaatggcgcgccttaatacagttcgacaggcaggctaagacgattttatttggaaatgagggattttggtgaagaaagtattaattgctaaccgtggtgaaattgcgacccgggtcattcgtgcttgccacgaattaggccttcagactgttgcgatttacgccaaagaagatgagttttcagttcaccgttttaaagctgatgaagcgtacttagtaggtgagggtaaggcgccgattgcggcttacctggatattgaagatattattcgcattgctaaagaaaatcatgtggatgcgattcacccaggttacggctttttatctgaaaatgctacttttgctcggcggattgctgaagaaggcatgaccttcgttggtcctaagccagagcacctcgagatgtttggtgataagattacggccaaacgtgtggctcgcgatgccggcgtgcagacgattccgagtaccttgcacccggttactagcctgaacgaggcgttacaatttactcagcaatacggttatccaattatgatcaaagctgccatgggtggtggcggtcggggaatgcgcatcgttcacgaagcttctgaattacaagaagcttttgaccgtgcccgttcagaggccatgcaatcctttggcgatgacgagatttacttggaaaaattcatcgcgaatcccaaacacattgaagtccagattttagcggatgctcacggcaatgtcatgcatttatttgaacgtgactgttctgttcagcgccgtaatcaaaaggtgattgaatttgcaccggccgtggccctgccaatcgagttgcgtcaaaagatctgtaacgccgcagtcgacttgatgaagagtgtacactatttaaacgccgcaacggttgaattcttggttgaaggggaccaattctacttcatggaagttaatccgcgggttcaagttgaacatacggtgacagaaatgattaccgaaatcgatattgtccatgctcagctcaaaattgcgatgggtggtgacctattcgaggatttacggttaccacatcaagacgcattgacatataagggtgcggcaattcagtgtcgaattacgacggaagatcccgcaaatgattttatgccagatactggtcgcatcgagacgtaccggtcaccaggtggtaatggggttcgtttggatgctggtaatacctattccggcgcaatcgtaacgccttattttgattcactgcttgtaaaggcttgtgttgcggcgcggaacttcagagcggccgttcataaaatgcgacgcgtcctagttgaattcgatattcgcggcgtgaagacgaacattccgtttatgctgaatgtgattgacaacccaacgttccaagcaggtgaagcggggacccggtttattgatcagaccccaacgctcttcaaattccctgacgatacgcaacgtgaagataagatgttgaagtatattggaaatgtgacggtcaatggtttcgctgacgttgcccaacattcgaagaagtactatccggacgttgagtttaaggatgattttcaaccgatcgcacccgacatcgtcacggcaaaagacgtgttggatcaacaaggtgtccagggattacaacagtggttgttagcccagaagcaagtattattaacagatacgaccatgcgggatgcgcatcagagtttatttgcaacgcggatgcggacgaaggatatgttagccgttgccgcggcttcacaaaaagcgttgccacagttattctcctatgagatgtggggtggtgcgacgttcgatgtggcctatcgttttctaaatgaaaatccctggaatcggctgaaagaacttcggcaggcaatgccccggacactcttccaaatgttgttccgtggttccaatgcggtgggttaccagaactatccagataatgtgattcgcgaatttatcttagaagcagctaagagtggcattgatgttttccgcatttttgacagtttgaattggattcctcaaatggaaaagagtattcaggccgtcaaggaaaccgggaagattgcggaagccacgatttgttatacgggcgacattatggaccctgatcggcaaaaatacaatcttgattattaccgtcagctggccttggatctacaatcaactggtgccgatattattgccatcaaggatatggcgggtgtgttaaagccagaggccgcctatgaattagtatcgacgttgaaagacgcgctgtccgtgccagttcatctgcatacgcatgatacgactggtaatggaatctttacctatgcccgagcagtggaagctggtgttgacgtggtcgatgttgctgcgagtgcgctatcaggcacgaccagccaaccatcaatgagttcgttgtattacgcattagcccacaatgatcgtcaacctgatgttgatattaacaacgttgaagccatcaatcggtattggcaaggcgtacggccatactaccaagacttctcgaacggtatgaccggaccacagacagatatttatcagacgcagatgccgggtggacaatattctaacttgcagcaacaagctaaggctgttggtctcggggatcgttgggaagaagttaagacgatgtatgcgacggtcaatgatatgtttggtgatattatcaaagttacgcccagctctaaagttgttggtgacatggccctgttcatgatggaaaatcacttgacaccgggcgatgtttataatcagggtaccaagctcgatttcccagcatcggtcatcaacttctttgctggcaatcttggtcaaccagtcggaggctttccaaagaagctccagcagatcgtcttgaaaggccagccagcgttgactgtgcggcccggtagtttagccaaaccagctgactttgctgcggtcaaagcagagctatcggctaagcttgaccatgaagcgagccatcaggaagtgctcagctacatcctgtatccgaaagtattcatggattacgacgctagccataagcgctacgggcacgtatcactgttagacacaccgacctttttccaaggcatgcggctcggtgagacggtcaatattgagttagccaaaggtaagacgatgatcgtcaagcttaatcagattagtgatcccgatgtcgatggtgtccggacactttactttagtatcaatggtcaaaatcaagagattatggtcaaggacaatgccattcaccaatcggcaaccagcacgcgcaaggcggaaccaactaatgaagatgaagttggcgcaacgatgagtggttcagttctgaaactgttagttaagaagggccaaacggttaagaagggtgagccattacttgtgacggaagcaatgaagatggagacaaccattcaggcaccggaagatggggtcatcgaacatatttatgttaatgcgggtgacgtcattcagacggatgacttgctgctcgagattgcaccacaataaggatatttcaagcaaaaacactagtggcttaggttactagtgttttttagcttcagcgcttcgccaataaaaaccactgcgtagttaagaacttagttgacgaaatgctgaatctagcctaacatttaaacagcaacgctagtagaagaggtgaggttcgatggattttacagttaaaccgcgccggtcgctcatcgtttatatgcattcgatgaagcaggtgcgtcaattgaaacgttttggattaattcaataccaatcgcgtaaagagcattatgtggtcttgtacatggatgaaagtcaaattccggccgcgaccacgaaaatcaaaaaattaaattttgtccgcagggttgaaccgtcataccgcccggacgttgcaatgaactttggcgaacgtgtggatcaaggcttttttaagccaaccacgactggtgcgcctgatgacgatgatgaggattaagttggtgaagatgaaatgcgaattgtagcaggagactttggtggtcggcggctcaaagccgtgccaggcatgcaaactcggccgacgacggacaaggttaaagaagctgtttttaatattattggcccctatttcgatggtgggcagtccctagacttatttgctgggagcggtggcttgagtatcgaagctgtatcacgcggagtggctcgggccgtcttgattgatcggcagtatcaagccatcaagacgatcaaggataacattgccgttacaaaagcccccgaacgatttgaagttatcaaaggcgatgctgagcgtattttggaccgattagcatcccaagatgaacactttgattgggtgtttttagacccaccctatgccaagcaacagattgtgaaggatattcagcattgtgatgcactaggattgctgaatccgggttgccggatcatttgtgagacggatacgaatgcgaacttgccaacggtcttacccggatttgagttgatcagacaacaagattacggtattacggtcattaccatttaccaaaaagtaacggaggtcgggtaagttatggtgacagcagtttttccggggagtttcgacccaatcacacggggccacttggatatgattcaacgtgccagtcgattagttgaccggttgattgtggccgtcatggtcaatacgagtaagcaaccgttatttacgatgacggaaaaagtcgcgatgatcagtgatgagctgacggatttagccaacgttgaagttcaggccgcaactggtttgaccgttgactttatggcgagtgtccatgcgacagttttggtacgaggtttgcggaatgaacaggacttcggatatgaacgtgatatcgcttggatgaacaagtcattagacgagacaatcgaaacgatttgcttgattgcacggcccccgtacgcttacttttcttccagcttaattaaggaagttgccaagatgggagcggacgtttccaagtacgtcccgaccgcggtggcgcaaaaactccatcagcggttaggaactgatcagcatgactaagggccgggagttgttaaaacgttactggggcttgctggtcgtgatactggtggtacttgcactatttctaattcctttaccgtactatattgaaggacccggaagtgcaaacaatttgaagacttttgtgaccgtcaagcggcatccggatcatcaccggggtaagtttatgttgacctcggtcgcagaagctcgggcgacgccgctgatgtggctttacgcacaattgaatccgcactatgacgtggtcagtgctcaggatatgactggcggtcaggatgacgcgacttataatcgggttcagaagttttatatgcgaagtgcaatcaacgaagctatcgcgacggcgtattcggctgcgcatcagcaataccgcaaggtttatcagggtatctacgttttaacggttcagtctaattcgaaatttagaaaccagttaaaagttggcgatacgattacgaaagtcgatggccaccattttaatacagccagtgcgtatcagcattatattggtaagcagggcgtcggacatcgagtgacgatcacgtatcggcgaaagggccacttgaagcaagcaagtgcgcccctaatcaagctgagcacgcaccgcgccgggattggtatcggcctaactgataatattaaagtgacgacgactattccggttaaggttgatcccggacaaatcgggggtccctcggccggattgatgtttagcttgcaaatctatcagcaattgactaatcagaatttgcgacacggacggaagattgcggggaccggcaccatcgatcaaaatggacaagttggtgaaattggtggtatcgacaagaaagtgattgctgctaagcgggcaggggcgacaattttctttgcaccgtatgtgaaaccaaccaaagcgcttttggcggttgaagaaaagggtcaaactaactatcaacttgctaaagcgaccgcgaaaaagtacgcgcctaatatgaaagttgttccagtgacctcatttaaacaggccgttcattatttgcagacacaccaatagtaaaattgaaatgcaagttagcaaagtttggggtaaaacccaaacttttttcatgggcagccgctccttttgcgtaactattcgctgaaggggtgaaaacaaatgatagattgtattaagctgctcaaaatgcactggcggattgttggtggtgttactgccgtgatcattattttgataacgggatgggcactgagtcaacttaagcagcctgaacccgccggtacggataatttgttggcacattcgttcaattccacatcaatgggaggcgcgagttgaacgtctgccaatgctgaccagcccgcaacgagtacccaaccgtcgaacgctacaccgagcccagcccgaccaacaggtgctagttcacccgggtatgtcgatattaagggtgcggttaataaaccagggttgtatcaggttactgctagtatgcgggtcgcggatgtcatccaactggcacaaggcatgcagccacaggcagatgctcggcagatcaacttggctgccaaagtaaccgatcagcaagtgatctacgtgccagctaagggcgaacaggccccggctgttgcgccaccagtcgtccagtcaacggggcctactggcggaacaccaactagtgatcatgcggcaacggataaggtcaatctcaacacggctgatgtggccgcgttgcaaacgttgagcggaatcgggcagaagaaagctgaaaaaatcattgattatcgccagcaacatggtaattttaaaacaattgatgatttgaaaaacgtcagtggctttggagaaaagactgtggccaaatacaaagaccagctcaccgtctagtttcaaagcgcacattttggtatactactgtcattgaaagtgaggcataaaatgatgaaagatcaacgaattccatgggatcagtattttatgatgcaggcggtcttattggcgagtcgaagcacgtgtgagcggctttcggttggtgccacgattgttcgcgacaaacgcattattgcgggtggttacaatggttcagtatccggcgatgttcattgtatcgatgaggggtgttaccttgttgatgggcactgtgttcgcactattcacgcggaaatgaatgcgattttgcagtgtgcgaaattcggtgcagctacggatggtgctgaaatctatgtcactgactttccatgtttacaatgcacgaaaatgttattacaagctggaattcaaaaaattcattatttacgtaattatcataacgatgcgtatgccatgtccttaattgaacgaaaacacgtggctttacaacaagttcagttcgaccaatcagatttggataagctgaatcttgatcaaatcttgttagatcgtgactaattgcgtgcactattttttgctgccattgcgtgcggcttacttagtagttggttagttgaccaacaatggctggcagccggattattattaatttggttattgcgagtcatccgattacgagatcgacagtgtttgatggtgacgattggctgtgttttatctttggcaatctggctgaactggcaaaaccaccgtttcgcctccattgttcagcggcccagtcaggtggtcacaagccatttggctgtccaacccgctgcgattacggtgcgcggtggtcagtatcagctgattgccactagtccaatgggcaaagtacttgttagaggacagctgaaaagtgccactgaaaaacagtatctgacccagtttactcaccggacgatctggcacgttcagggggaagtcgccgccatcgcacctcctaccaacccggggcagtttaatgcgcctaggtattatcgcagtcaaggcatcgcccgccaagtaacggtcacagcggttcaacgaatagaaattgcgtcgcggcgtggttggctggggctacttgatcgattacaccaatggcgtcagcaattctttctagcctgtcaaagattgccaccaacgcttagtcgttatgcgacgagtctactggttgggatacgccccacagattttcagacgacaatgggggccgttcaacagctgggactattgcatttgttcagtttgtcgggtatgcatgttattttattagttaaattcttgcaatgggtcttgttacgactgcatctaagtcagcaagcaatcgatatttggttattagggctcttgccagcataccttgtcttgggcggcggtgccgatagcttgcggcgggcagttgtaaccgcggctttaccaattatttggcagttgctaacacatcagtcaagtggggcgttgggtggttggagccttgccctgataatggggattgcccataatcctttggtattgagccaattaggtggtcagctcagttatggactagccttgctgctgatcttaatgcctggtttgccgccgtggcgattagcaatttggattcaggttatcagtttaccggttttgcttgtagctacggcgcagtggcatctgtggtccttagcagtcaatttggtggttgcgcctatttttagttgggtattattaccggtgacggtcgtgggggcgagcattggctttggttctaccaatgtcaccagcgtgtgtgaatgggtgttggttaattttcagaattggcttgagtgggtcagccattggccaggcctactcattatcggtcaaccgagtacactgtgggcatggacgctcagtctattgagtttgtggttgttacggacaccgcggcgtcggtattactggcgactgttactggcatatgcttgttttagtcttagtctacgttttccacttcacggtgccgttcaatttatcgatgtcggtcagggcgattcgatcttgattcgccaaccatttaaccgccaagtgagtttgatcgatactggggggcaactacacttttcccggccacgttggcaggcagagcaggtacaaccgcgatcgcgtgcggaaacgattacggtcaattatttgcaccggctagggatcactcacttggatacagtttatttatcacacaaggatgttgaccatattggtgatttgggtgaactattacgcttgatgccggtcaatcaagtggttgaagcattggccggccatacgtttgcagatggattggttgcggtgcatccgtttaaaccgggacgggctgaaaatgaagattcgttggtgctaacgggggtttttggtcagcaacgtttcatgtttacgggtgatcttgaccgagcgggggagcgtgcaatcgttgcccgatatccacaattacgcgtggacgttttaaagctagggcatcatggcagtaaaacagcctcggatccgttagctttgcgccaattaggtgtgcaccacggtattttatcggtgggtcggcacaatcgctatgggcatccgaatcaagaaacactaataactctagctgaacagcatattgtcacttattcaacggctttgcaggggatgataacctatcgtttcgttaatcatcgccagggacgttggcaaacatttttaaaggaaggtgatcgccatcaacgcacaacaggcgttaaaatcgattcgcaacggtgacttggcatcgatctatgttatcttgggaacggtcgactatttggccgatcagctcaaacaggcttttacgcagcaaattcccagtgaagaacaaacgatgaacgtcggcagttatgatatggaaacgacgccagtagctgtggctttagatgatgcaatgtcggcaccgttttttggtgaacggcgattagtctttattaatcacccgtactttttgacggttgaaaataagaagaccaaggttgaccatgatctggcctcactacagcactattttgaacaaccggaaccaagtacgattctggtgtttatggcaccctatgagaaattagatgcgcgtaaaaagctcgttaaaacgttaaaaaaacaggcgatgacggttgaagtcaaccaagtctcggaggctgaaacgcaacgctatgtgcaagcggcgttagatgagaaacagattcgcattgatgcggacgcactacaggaactggttaatcgaactgacgggcagttgggactgattatgggacaattaccgaagttgatgatttacgcagcccaatcccaacgaattgatttagcggcagttcaggctttggtgactaaatcactgacgcaaaatgtttttgatttagtcaacgatgtacttcgttatcagacgcagtcagcggtcgaactttaccatgaactggtggcagctcaggaagccccactaaagatcaatgcaatcttattaggacaattccgattgttgctacaggtcaaaattatggcgcgtgcaggctatagtcagggcagcctagctagcacgcttaaagtgcacccatatcgggtcaaactagccatgcaaacggtccgccattttgatcaagctgcgttacgggcggcgtacttaggactgctccaaacagaagtacaaatgaaaacgacacaacgcgacccggagttgctctttgagttatttatggttcaatttgttaatgagcgacagtcagcggtcggaacgcggctgtcccgttaggcattggcttgttggacaagcgagaacgactattcacgaaggcaaaagtaatagtgcttagatatggagcccaaaaaaagatggtcgaccggaattctcagaattcggtcgaccatcttttgagtcattaaaggcgataaaaaaacgccgtcgcaatgctcgggcgtaaaattagcttatttagcgtaacgtgcagccatccgtgacttgtcacgggcagctttgttgcgcttgataagacctttagaagcagccttgtcaacggcgctagttgctgctaagtataaatcgtcgacgttgtcggcaccagcagttttagcagcttcaaattttttaacagcagtccgcatcgcactcatttgggcggtgttacggacgtttgctttattgtttgttttcacgcgttcaatagcggatttgataattggcatcagattcacctccatcattttttcaacaaatgctattatacataagccccggcttgaatgcaaccgttatgtgtaaagtaatttatcttgatatgtattgaaacttgctttttactccttagtttgctagactatatcaagtgttcagcaaccctttacttagtttttcgtgcaccaccaacgatttactcagtttagggcaattattggaaaggtggttgaaacacatggcaatttcacgcgaaaagaagacggagcttattaacaagtatgctcgtcacgaaggcgatactggttctgttgaagtccaagttgcagttttaacggaagacatcaacgaattaaacgaacatttacgagttcacaagaaggattttcattcacaacgtgggttgatgaagaaaattggtcaccgtcgtaacttgttagcttaccttcgtaaagaagacgttaaccgttaccgtgacttaatccaaagtcttggtcttcgtcgttaatattgagattacgagaactgcctgcgggtggttctttttttgtgtggcgaattgtcaaactaagtgcaacggtttgtcaaaaaatacttcatatggggtttcatagtttaacactttgcgaggacgttgatttaactgcttttggcagtgttcaacgtcctgttctgtataattatcaatatctgttcgcttgggaaaatattcccggattaatccatttgtattctcatttgttccacgctgttcaggcgaatatggatcgggccaatagacagtaacacctaacctttcgctgatttcatcaagatgaagaaattcggtcccatgatctggtgtaatagaatgaacaaattctttaggaatggcccctaacagttcaactaagccgatcgacaaccgttaaaaggatggagtgacccgttcgaccaatcacagtatcaatttcccagtcacctatacgttgacgctggttgataaaaccagggcgctcatggatcgagatatagtcggtctgtacttctcgatgtcgtctagtattctttgaatgccgagtccgatgtttatgtctgagatggcgctgaataccggtatcaccacgtgaggagtacttctcacctaaattgtgttgatagatatgacggtaaattgtgttgtagctaacacaccattgatgttccttattaaagcgagcggtaatctgctctggtgaccagtgcagatctaagatgcaatgaacaatttgacggcgtaattgtggatggctgtctaatagccgcttcttgtgacaattctgccacttttgatgatagtcattatctgctttgcttggggaataattacctgcacaacgttttaactcccgtgaaatagtgcttggatttcgccccagccgtaacgcaacagcccggatagataaccccttagctcgtaaaaacataagtatttcacgttcttttatagtaagatgtttatagctcataccggatacctcgaattgtttgatttggtcgttaaacatattctacccggtatgggtttatttttttactttgtgttgcatttcaattgtaaattcgccgtaaaaaattacagaaacgatacataaactttattaaacccaaacaaccgttcgctatacttatgtttattcaaaagtgaatgaggggatttcatggaagcaatggcaacgttgacttgtaactttcgggtcttatggtttggcagtttaatcactgatttaggtaacgcaatgacgttaccgtttattgtgctgtatattcagacattaggcgattattcaacgacccagttgaattttctaggggcagcggcgtttgccgtgacatacgcctgcaaagctttagtcgcaccattgtggggccgattggcggatcaaaaggggcgtaagctgatgtgtctacgcgcatctggcatgatgaccttaacgattctcggtgtgggactagcacctaacgtgatcgtcctcttgattttacgagccgcacagggagcgttttcaggttacatcaataatgctaacgcactgatttcgattaccgtacctgcggaacaacgtggccagtggttaagtaaactggtcactggtagcatcagtggcacattgatggggccacttttgggaagcttgctggctaataccgttggctatcggggggcgttcgtggctaccagtagtttgatggcgcttgtctttgtcatgacctggtggggtgttcaagagaaggtgacggcagttagtcgcgccacgttaccaccattgcgaccaatcttacatcaattgggtggtcgctttatttgtgccttgctgacatcgttactagttgttcaggcgacgaccaatgcgataacaccactgttaagcttgctggtcggacagttagtgccccaagcaacggcgcagacgattatcttgatgacggggattgtggcggctgcgccgggacttgccacgattctaatggctggtcgtgttgggcgcattctggatcggctgggcgctggccgttgcttagttacttttttgattttagcgattgttgacttattgttgactagtttggtacatcaggtcgcgtggctggtcgggctacggctaatactgggaattgcggatgcggcactattgcccgcgcttcaagtgatgacagtcgagcatgtcccacacgcagcgtttgggcgtgtgtttagtttaaatcagtccgcgcaagcttgtggtaacgtggtcggccccgggttagccgtgattgttgccaattggtgggggtatcagtcaatctttattgttacggctggattacagctgatggcattgatgctgtgggtcgcgtattttagtcagcaacgaccacattagattgcattgaatggtctaactattgctttactttaaaatgtggtaaactggggagagttacttaatcggaacaggtacgctggtacttgtaaattttaatagaggagtttttagatcatgaactttgcaaacgttgatttgatgaccgcaatggtgacccctttcgatgatcaccaacaattggacgaaaagcggttagcaagtttgattgaacatttattggcacacggcacccaaggtattctggtgggtgggacaactggtgaagcaccaacgctaaccgaagatgaaaaattaaccttactaaagaaagcagctgagattgtcgatggtcgggtaccaatcgtggccgggaccggctcaaacagtaccgctgctaccatcgcatttactaagaaggttagtcagattaaggggattgatgcagctttagtggtggttccctactacaacaagcctgatcaagctggtatgattgcccactttacagcggttgctgatcaaggtggcttaccagttattatttataatattccgggccgggttattgtgaagatgaccgtggccacgatcttaacattagcacaaaatcccaatattattgggattaagcagtgtgcgacgatggaagagtttggtgcgattgtcgaaaatgcaccggctgattttcttgtttatactggtgaagattctcagagtttggctgccaaggaaattggtggtgctggggttatctcagtggcaagtcatatctatggtgacgaaatgacggcgatgtttagtgccatcgaccagggtgagattgccacggccgctaagtatcaacgggacttaacacccaagatgagtgccttgtttagtgcaccatcgccatcgccagttaaagcggccttaaatcatttgggtcagccggtgggtgaaccacggttaccaatcttaccattgagtactgaacaaacggctcagctttttaaaacattaaacatttagaagaatcaaggtgaaataattgagtagtgaaattcaaattaccccatttggtggggtccgtgagaacggcaaaaacatgtatgctgtcgaagtcgatggtgatatttatattttagattgtgggttaaagtacccagaaaatgagttattaggaattgatatcgtgattccggacttcagttatttgcgagaaaatgctgatcgaatcgtcggtgtctttttgacccacggccacgctgatgccattggtgcgttaccgtactttttgaatgagttcaacgttcccgtgtttggttcagagctaaccattgagttggcaaaaattcaattgcaaaaggaccctaaagctaaaaactttaatgacttccacatcattaatgagaagacagaaattgattttggcacggtcacggtttcgtttttccgcacgacccattcgattccagattcaatgggaatcgtgttgcaaaccagtgccggtgaggtcgtttataccggtgactttaagtttgatccgacggccgcaggcgactatcagactaattttgcgcggttggcggagattggatcaaaaggcgtcttggcgttacttagtgattcagctaatgcagaaaattatgaacagccggtcagtgaacgtgaaattgcggcctatgttttagaaacgtttaaatatcatccaggacggatcattgtcgcttcagttgcatccaatatcttgcgtattcagcaagttttagatgccgctgcaaagtctaatcggaaagtcgctttaatgcctggtgacgttgagagtatcgtgaagaccgcaatcgatttaggaaagttacacatgcctgaagacgttgtcgtgccacttaaagccattgataaacttaaacctgaacaaatcgtgattttacaaacgggccgaatgggcgaacctattaaggccttacaacggatggctaataagcaggagagcaaggtcaatatcgaaaagggtgatctggtatttattactaccacaccgtcacattcgatggaaaccgtggttgccaagacccgtgatatgatctatcgtgctgatgcggacgttaaggcgattgctgatgaaatgaattcctccggccatgccgctaaacgtgacttgcaaatgatgatcaacatgatgaagccccaatatttcattccgattcaaggggagtatcgtctgttggatgctcatgcggactttgcacgtgaagttggaattccggacgaccatgtcctgatcgcagccaagggtgaccagttacgttatgacggtgataccatgcacttggccggttcaatcgaagtcggcgatacgatgatcgatggcatcggggtcggtgacattgggaacattgtgttacgtgaccgcaagattttgtctgaagacggtattttcgtggcagtggtcacgattgatcgcaaaaagaagaagattattgcgactcctaagattacttcacggggcttcgtctacgtcaagactagtaaagacttgatgcaagagagcgctgagttagtcaaaacgacggtgcaagaaaatctcgataataaagagtttgattggggccatttaaaacaggctgtccgtgagaagttgaaccattatttatgggaccagaccaagcggcacccagttattttaccggttattatggaagttaatcagcatcatcggcgtacaaagaaggctaaaccagccaaaccagtcgagactgaatctaaagcttagtattaaaaaagtcggaagctacttccgacttttttggttacaatgaagaggaggaaggttcaatgacaatagctgaaacacaattggccgccgaacaagccagtcgagctcaggattggtccaaggcggctagtttgtgggagcaagtgtatcaggcacagcaaacggcaccagttaattacgaattggtccaagcgttggttgctgatcaacaatatgtggcagcagctaattatgccagtgagtttgaagcgcagtatttagcaaccgatgcggccgcagatctgtatctgaatgcattggttgctaatcatgacttcatttctgcccacattatgatcaaggcacgcccaacgagtgcgtggactacggctgcaagcacaattttaaaagcggcggagagtacggctgagcgaacgctaggatcgacattgaccacaacaatgcgtcatttttatcatttatctgaccagcccgtccagaaacaggtggcaggtttgcaagcagcccgtcacctgccatatgagcactatctgacggcagccaagtttctattagtagatccgtttttgcatcccttaacacgagtagaagtgttatatacactgtaccaattgcaagtatcagagacggtcaagatgcagtggctactggatgagaagatgttgacactgtgtccagcaaagttagtcgcactcggtcaggacgagacgagcaaggccgtttaccatgctttgaaagtgcgacttggtaatcaagatgtctttttatatgaaagcttacgagaccttttacaattgcaattaatgtatttatatccatgcgctgcacaggttattacagattccacggcttggatcgatcttttgattagtttgcaaactgggcagacgataacgccgtctgatgaccaaactgaaaaaatgatgaaaattcagcaaaaaattcagcaatttagccttgatttacaatcataagcgtgcgtaataagaatttactaacaaaaattcaattttttgaataatatctgtttacaaatcagattaggctatatataatatttaaggattctcagtgatgggtgcgcgatttggccttttcactaggatgtagtataatactaactaaagaattgttgagaccattttggcctcgacgttattcttgcgaaaatcacaggaggtttcattaatggcaaaagaacattatgaaagaacaaaaccccatgtaaacattggtactattggccacgttgaccatgggaagactactttgaccgctgcaatcactaaggtattagcatctaagggcttggctaaagaacaagactttgcttctatcgatgctgctccggaagaacgtgaacgtggtattactatcaacactgcccacgttgaatacgaaactgaaaagcgtcactacgctcatatcgatgccccaggacatgctgactacgttaagaacatgattactggtgccgctcaaatggacggtgcgatcttagttgttgccgcaactgatggtcctatgccacaaacgcgtgaacacatcctcttggctcgccaagttggtgttgactatatcgttgtcttcttaaacaagactgatcttgttgacgatgacgaattagttgacttggttgaaatggaagtacgtgaattactttcagaatacgatttccctggtgacgatattcctgttatccgtggttcagcgcttaaagcacttgaaggcgacccagaacaagaaaaggttatcatgcacttaatggatgttgttgatgaatacatcccaactccagttcgtgatactgaaaagcctttcttgatgcctgttgaagacgtcttctcaatcactggtcgtgggactgttgcttctggtcgtatcgatcgtgggactgttaaggtcggcgacgaagttgaaatcgttggtttacacgaagatgttcttaagtcaactgttacgggtcttgaaatgttccgtaagacacttgacttaggtgaagccggggataacgttggtgcgttattacgtggtgttaaccgtgaacaagttgttcgtggccaagttttggctaagccaggttcgatccaaactcacaagaagttcaagggtgaagtttatatcttgagcaaagaagaaggtggccgtcatacgccattcttctcaaactatcgtccacaattctacttccacaccactgatatcactggtgttattgaattgccagacggcgttgaaatggttatgcctggtgacaacgtaacgttcactgttgaattgattcaaccagctgccatcgaaaagggtaccaagttcacggttcgtgaaggtggtcatactgttggtgccggtgttgtttcagaaattgatgactaatctctaactgattttcattgattgatctaagcgacttggaagtcttcttccaagtcgctttttttaagaaaaacgaacaataaatcgcgagcttacgcgcttttttagccaatttggtttactttacggtgtcgataggttaaacttaacaagtatgcaattgactagaattgtagaaattataatgtttcggagggaatacaatggctgcaaagtgggaaaagaaagaaggcaaccaaggcgaattaacattcgaaattggtgctgataaaattagtgaaggtatcgacaaggccttccaacggactaaaaagaacttaaatgttcctggtttccgtaagggtaaggttccacgtcaaatcttcaatcaaatgtatggtgaagaagcactttatcaagatgctttaaacatcgtgctcccagaggcatatgaagaagcaatcaaggaaactgaaatcgaaccagttgatcaacctcaaatcgatgttgatagcatggaaaaaggtaagccttgggtattaaaggccgttgtaacggttaaaccagaagttaagcttggtcaatacaaggaacttagtgtaacgcgtcaaaatactcgcgtttatgctaaggatgttgatgccgaattagaatcacggcgtgaaaaacaagctgaattagttctgaaggaagaccaaccagccgctaagggcgatacggtggttattgatttcaaaggattcgttgatggcgaaccatttgaaggtggcgaatcagaaaactactcacttgaattaggttctaactcattcatccctggttttgaagaccaattagttggtgtcaaggctggcgacgaaactgaagttaaggtaacgttccctaaggattaccaagctgaagacttacaagacaaagaagccactttcaaagtgacagttcatgaagtcaagactaaggaactccctgaattagatgacgaatttgccaaggatgttgacgaagatgttgacacacttgaagaattaaaagctaagatcaaggacgaacttaaggaacaaaaggaatccgctgcgcatgatgcaattgaagacgaagctttaaaccaagcggttgacaatgctgaaattcaagcaattcctgatgccatgaaagaagacgatattcatcgtcaaatggatcaatacttggctaatatgcaacaacaaggtatcgatccaaagacttactacaagttgactggtactactgaagacgacttgcacaagcaatttgctgctgatgctgaacgccgggttaagactaacttggtcttagaagcggttgttgaagctgaaaacatcaagccatctcaggatgaaattgcggccgaagttaaggatttagctagtcaatacaacatggaagaaagtgctgttcgtggtgctttaacggatgacatgttgtcacatgacattgcgattcgccaagccgttgacttgattgcggattctgctaagcaaaatgccaaagcagaagacaaaaaagacgacagcgacaagaactaattaattcaattagatacaagtcgagggtcttggaagaataattcttccgagacccttttacatagcgtcagctaatcgtaagattaatttaatagctatttggctgacgcctgtgatttactgcgagaatcattcggttttcaaagtggttagccggatgattgaacagataatttcgggtttaggttcgtccatgttatagtagtggacgtagaagacagtgcctaagctggttttagctcagtttttctgttatgattaatccatgtaaatacatcgatgaggtgagaatgaatgtttgaaaataccgagacaaacggccctgtgaactgctcattttgtggtaaatcacaagatcaagttaaaaagatcgtggctggccccggcgtttatatctgtaatgaatgtatcgatttatgtaaagaaattatcgatgaagagtttagcgaagaacaaacccatgaattaacagatatcccaacgccaaaggaaattgtagacgagttagaccaatacgtgatcggccaaaatgaagctaagcggaccctatcagttgcggtttataaccactacaagagggttaaggccatggctgataatgatgaagagaccgaagatggtcctgaattacaaaagagtaatattagcttagtgggaccaaccggttctggtaagactttcttagctcagagtttagcgcgaattttggatgtgccatttgctattgcggatgccacgacgttaaccgaagccggctatgttggtgaagacgttgaaaatattttgctgaaattactgcaaaatgcggattacgacgttgaacgtgccgaaaaagggatcatttatattgatgaaatcgataagatcgccaagaagagtgaaaatgtctcaattacacgggatgtttccggtgaaggggttcaacaagccctcttgaagattttggaaggtacgattgccaatgtgccaccgcagggcgggcgtaagcatccccaacaagagtttattcaaattgacacgaccaacattttattcatcgttggtggggcctttgatggaatcgaagacatcgtcaaacgtcgcctaggcgataaaacgattggtttcggtacggacaccgatggtaagaatgccgttctagacgattccaagagtctcatgcaacaagttgtgccagaagacctcttacaattcggtttaattcctgaatttattgggcgccttccaatcttgactgcgctagaacgtttaacggaagatgatttggtccggatcttaacggaaccaaagaatgcgcttgtcaagcaatatcaacgcctaattgctctagacggtgcagaattagactttaacgatgacgctttacgtgccatcgcgcaagaagccttagcacgtaatactggtgctcggggtctacgctcgattattgaagacacgatgcgggacattatgtatgatattccaagtcgtgaagatgttaaaaaggtgattattactcgcgagacggttgctgatcacgctgaaccagaactggttttagctgatcaaaaagcttcctaacgtttcgttcagaagatcaatagacattactcaggaccgcgatgagttttcattcgcggtcctgagtgctgtttaaagcgaatttgagcgcggatgacaacccgctgcaaaaattatggtaaaatgaatgcaatacgattgcagaaggagttaattcgatggaagtgcataacgttgaacttgtcatgagcgcggtagcgccgagccagtacccgactactgggtttccagaaattgggttagcggggcgctctaacgtcggaaaatcatccctgattaatgtgttgattaaccgcaatagctatgcgcggacgtctagtcaacctgggaagacccaaacactgaacttttataaagttgaagatcaattatacttcgtcgatgttccgggatacggttatgctaaggtatctaagaaggaacgtgagaagtggggacaaatgattgagacgtatctaacaagccgagagacactgcgaggtgtcgttattctagtcgatgcacgtcatgcgccaactaaagacgatgtcgcaatgtacgagtggatgcgttactatgagatgccattactggtcgtggcaactaaaagtgataaaattccgcgtggtaagtggaacaaacaggaaagtttaattaaaaagacgcttaacttccaagctgaagacgattttatcgccttttcagctaagaccaaagaaggcaaggatgctgtttggcaatggatcgaagcgcacactgtgggaggcaactaacttggaatttaatgagtatcagtcgttagcaaatcggacattatatggtaatgagcaggtgctgacgaacttatcgctgggattagcttcagagactggtcaagtcgttgacttagtcaaaaagtatacgtttcatggtgaacgtttgaataaagatcagctgacgaaacagatgggcgatgtgttatggtacttatcacaagttgctgaatgggcggatattccgttcgaagaagttgcgcaacaaaatattgttaaactcaacgataagtacccgaatggtaaaccagttaaatagtcggtgaagagtggtctaacctgaagagttgggctgtcagcaggtaaggctggcagcccaactcttttttattgcgacgaacgaccacatatcatttgcaaaaattgtgtcattattgagttcggctgtttattttcacttttctaggtaaattaattgcatttgcagctgaaatagcgtaaattaaagactgtaaaagagttgtgcacaacttaaatgtttttgaaacggaaaggatgcttaactatgaagattaatatcaaagacgatgctcaagcctaccttgcagataagattccggcagggagtcaagtaattttaacaactgacgatggttctaacaaatattcgagtttaggcggtagctgtgccattggtaataagtttcagttagttattcttaaagccgctgatcccgactataccacgccattagaaaataatgctggttatgtgatgcacgttgcaccggctgatgaagcctacttggggaacggcctcaacatttctcgctggcataatgctttagcgctcaaggatgatagcgggatgctcgacggtgctttggctgttgttgattggcgcgatgtttcaccagaaacggaagcagagcggcgcgaaaagatgcaaacaatcgggactaaaatttgctaaatagttattcaaataaaaacgcgatggctaactgccatcgcgttttttttgactgctatttatgggcgtcctttttatcagctgccttattttctttgcgtttagcatgttcgtcaatagtatcctgaaccgctttagtggtgagtttatccttatcgtcaggaccaatggcaaacttgtcgaatagcttatcaaggttatcttgacgctgtacttttaaactcataaaatcattcctttcgattaacgcctatcatagcaaatttccgacaatttgtcagttattcgtcgtttatgcataatcaatgggctaaaacgtgtataaacgacttatttatgcataaaataaagaaattttcaaaaatacttgcataaataatcatatgcggttatactttattcttgtaaattacaaaacgaggagaatacctatgaaaaaaagatttgggtggtttttagccattattgtggccctgatcatgaccgtcgtcccactcggacagacgcaacatgcgcaagcggccgataattcattagaacaaattcagaaaaagggcgtcttagtaatggggacgtcgcctgattatccaccgtatgagtttcaagcaacggtcaacggtaagagtaagatcgttgggatggatgttcagattgggaaacaagttgctaaggatctgggcgtgaagctgaagatcaaatccatgtcatttgactcattgctagtggcactccaaactggcaaggttgatatgattatctctgggatgaacccaaccccttcacggcggaaaaatgttgattttacccacgtttattatcaaggtggctacgatattgtcatcaataagactgataagggcaagtacaagaataagaattcattcaagaatggcacgttgggtgcccaaactggaacgactcaatataatgccgtcaaaaaccaaacgactgccaaggctaaagggatgacttcacaatctgatctgattttggcacttcagagtcacaaagttgatggggttgctatggaaaagccttctgcagaagcctatgttgcaaacaataagagtttggttgctattcctagtgacttcaacatgagctctagtgcaacgagttcggcgatcgcatttcggaaaggttcaactagtcttgttaacaaagtcaataagaccgttgatcggattaagaaacagaacctcgttaaaaagcaatacttaccggcagccggcaagtatttgaagaccaataccgttaatacgtcaatgggacattactggaaggcttttgcaaccgggatcgaatatacgttaatcattacggtttgctccgttttcttcggttttatcatcggtattttattggcattagcacggatggctaaaggaaatccacttaagactgccattcggtggttagcaactgcgtatgttgaatttattcgtgggacgccaatgatggtccaagtgatgtttgtgtacttcggacttgggttattcgtcaatttaccagcactgacttctgggattattgcgatttccttaaactctggtgcgtacgttgctgaatatattcgtggcgggattaattccgtcgatgttgggcagacggaagctgctcggagtttaggaatgtccaacggtgaaacgatgcgttacgtggtcttgccacaagcattgaaaaatatttggccatcacttgggaacgaatttattacgctgatcaaggatagttccatcgtttcgattattggggtcactgaattaatttatcaaagtaacattgttcgttcagatacgtaccggggggttgcaccgatcgttgttattatggtgctatacttcatcttaacctttaccgcttcacggatcttgaactacttcgaaaggagaatgcaacatgactaaaccagtaattgaagttaaagaccttgcgaagagcttcggtgaaaatgacgttttaaaggatattacagaaaaagttgaacccggtcaggtgatcgtggtgattggtccttctggtggtgggaagagtaccttcttacgttgtttaaacttactcgagacgcccacaagtggtcaagtcgctttcgaaggtcaagatctcacaactttggatacgaagagtgttaacgcgctacgtgaaaaaatgggaatggttttccaagggtttaatctatttcccaacatgactgtattggaaaacattaaattggcgccgatgaaggtcaagcatgtcgatgatgccgcggcgactaagcaagcgcacgaattattgcaacgcgttgggttggacgatcatgcggatgcctttccaagtagtctttcaggtggtcaggctcaacgggtggcgattgctcgtgcgttggcgatgaaccctgaagtgatgctgtttgacgaaccaacgtctgccttggacccggaaatggttggggaagtgttaaacgtgatgcaagaacttgctaaggatgggatgaccatggttgtggtcactcacgaaatgggttttgctaagtcagtagcggatcgaatctggttcatggctgatggctatattcaggagaataatacgcctgaggaattctttgcgaacccgcaaacagagcgggcccaagattttctttctaaaattttgatgtaaacaacacatacccggtaatcagctcagttgctgattaccgggtatgtgctacactgtgatcagtagcgacagtgatgaatagtcggtcataataaaaatcatatttccgggctgtttggttgagccccatgctagcaggcggtatactaataatgctaatctaaatgaagggaaggtgtgttatggcatccgcgcatattgaacataagttatccttgttaccagacttaccaggatgttatctgatgaagaacttaaacagtcagatcatttatgtgggtaaggccaagaacttgaaaaatcgagtgcgttcatatttcaaaagcagccatactggtaagaccgcgcggttagtatcagaaattgcggattttgagtttattgtgacctcaacagataaggaagccttcctgctagaaattacgttaattcaaaaacatcaaccgtattttaatattaaattaaaaaagggaaccggttatccgtacattaagattaccaatgaacgagacccccagattctgatcgtcagtgatgttcgtaaagacggtggctactactttgggccatatcccaacgtttacgcggcccaggaaacggtcaattttatccagaaggtctatccgttgcggcgttgccatggtttccagaagcggccgtgcctctattatcatatgggccaatgcttgggagcttgctttaaaacggtgccggtggcagaatatgacgctcagatcaagcggattaaatcctttttgaatggtcacgttgaaacggtcaagaagcagttaactaaacgaatggatcaagcggccgctgacctagaatttgaacgagccgctgaattacgtgatcaactgaattatattgaaatgacggttgaaaagcagaaaattatttcaaacgataatacgccccgcgacctgtttaatttctatcttgataaaggctggctttcgattcaggtcttctttattcggcaagcgcggttgatgaagcgcgagaaacgcttgtttccagtagtgtcaactgcacctgaagaaatgacgagctttatcttgcaattttataatcgtaaaaataacgttttaccacgcgaagttttagtccccaacggtcttgataagcaggtcctgagtgacattctcggaattccggtaaggacgcctcaacgcggccagaaaaaggatttgctagacatggcacaaaaaaatgctcggatcgtcttagaagagaagttccggttgttggaattggatgagcgcaagacgacgggggcgatgcaagaaatcacggatgctttaggtattcccgctggtcataaaattgaggcttttgaccactctcatattcaaggggccgacttggtttctgccatggtcgtcttcacggacgggcaaccgaataaaaaattgtatcggaaatataagttgcggacggtcgatcatgctgatgaagctgcatcgacccgtgaagtgattcggcggcgctatacacggctactgaaggagcatgcagcattgcctgacctaattttgatggatggtggcgagatccagctggaagctgctaaggacgtcttagagaacgaattagggattgcaacgccagtcgcggcgatggtcaaaaatgaccaccataagacggcggatttactcgcttcggccggggatcagcatctacatctagatccgaagagtcaaggattctatttgttacaacggattcaagatgaagtgcaccgctttgcgattacgttccaccgacaagtgcataccaaacattcattgagttcgcgattggatgagattcctggtgttgggccgaagacgcgtaataaattattacgtaaatttggatcgatgagtaaaattgctggtgcctcactggaagagattcagtccctgggaattgctaaaaacgttgcacaaactgtcaaattttcattagccggtggtggtgtaacaccgaagcattatcaaaagggcgccacatagttgtcatctggctaactaatgtaattaatgttaagaagaccatctagttttcacgaactaggtggtcttttttgatgcttgaaagcatcattgatttgtaaaaatgtcgattttgtgattagttgaaaagcacattggttgctggagtaaccgatgatttaatcgaaataattgtgggtaaatacgagctaaaataaagtcaaataattatacgatttatattattttgattagtaactatcaataaatataacattattgtctataatgtcaatttaaatttagagattgtcgaatattcgcttgtatttatatgagtttcatgaaaattcgtgaaaactattgcgtcgtttgcaactggttttctacaataatgtcaatcgtttaataaaagtcagtcaagaaatattggagcgtgtggaatggagcaagtaataacctttgattttattgttaaactcattcgtcagtattggaaggtattattgagtttaatgattttgggcgggacgattgcaacagtggtgactttgtgggtcattcagcccgaatatcaagccaatgttcaaatattagttaaccgcaaacacagtagtgcgggcgcggatttgacgggccagcaagccgatgtgcagatgattacgacttataaggaattaattacaaaaccagtcgtgttgaagccggcacggcagactttaatggcagaaactgacattcgacgctcacttgagtcgcttaagcaaacggtcagcgtgaccagtacggccaattcgcaggtgttttcaatcgttgttcgtgataaaaatgcgaaagctagtgcaatgattgcgaaccaaattgctgcaacgtttaaagatcaggtccagcatattattagggtcaataatgtaacgatcgttgcacccgcagagacgccggatcagccggtagcgcctaaaaaaatcatcaatatcctaattggtttcgtgggggggctgattttgggattggtgtatgcaagtgtccgaatcttgtccaatcggcgggtgcagacactcgaatacctagcagatgaattaatgctgacaagtctaggaatcattaatcatcagcagccggtcacagcgactcacgaccaaccggcgattaaaccacagccggtgacgtcagttgttaaagcggcagtcaaacgagtttaacataggggggaacggttatgaaattgaggcgaagagtagcgaatatgcataccggcatacagttaacaactttgacggcaccgatgtcagtcgtaactgagcaagtcaaaacgatccgaacaaatcttaactatgcgatggtcggtaaaccgttgaaaacactaatgatcacgtcagcgattcagggcgagggaaaatcaacggtcggcagcaacttagccgtggaatacgccaagaaaggcctgcaagtcttacttgtcgatgctgatttgcggcggccgacgattcatcagacgtttgcgatcagtaaccaacggggagtgagttcatggttaagcgggcaactgacggacgtgaacgaagccatttatcccgtacttgatcatttgtttgtcatgccgagtggacctaaaccacccaatccagctgagttattagccagcgatagaatgaccaagtttttaacggtcgcaacacgtaagttagatttagtgattgttgatgcgccgccgatactgcccgtgaccgacgctcggattttagctggtcaagtggatggcactgtcctagtcgttcgccaaaactttgtcgaaaaagttgcggtgcgccaggcagtgagtgccttgaagaatgctcgcgcacaattactcgggactattttaaatgacgtggacattaaaactcacggttatgggtacggctattatgggactgagaccaactgagtatattgacctgcactgtcacttattaccgggattggatgacggcccccagcagcttgctcaggcagtcgaaatggcgcgacaagcggtggctgatggcattcattacgtcttggcaacgccacatcatctagatcggcgttatcagaataccggcctggtagtcgagcgtgccgttgccgagctccaggccgaacttaagcggcaacaaattccactgaccgtttttgccggtcaggaggtccatttgcgagatgatttggcgacagctctgccgcacttgctaggaattgatgttggtcggcgctatttgttactagagttgccacacgagcaggtacctaattacgtggcgcaagtaatctttgagctcttacagcaagggacgactccggtgattgcccatccagagcgaaatgctcagattatggcacaaccagagcggctctatgatttagtgcagcagggctgtttggcacagctaacagcggggagtctcgttgggcaatttgggcgagcggttaaaagtacagcgctggaattagttgaatgcgggctggtccaagtgattgcttcagatgcgcatttgatggcacgacgaggatttatgatgcgggcaggttatcaggcattagcacggttagatagtaccaatcctgcatcttttgcagtgaatgcaagactgctactgaacggggatccagtagtgttaggggaagtcttgcgaccaaatcaacgacgaaaattttggcttttttgagaggggtaaatagttatgaaggcattggtaacgggaggtgcggggttcattggctcgcacttggttgatcatttagttgaatctggctttgaggtggtggtggtagacgatctgtcaatgggggccatcagcaatatcaagcattgggaacagattacgatatacgtcgcggatgtctgtgacgataaattcatgcaacaattgttagcagacgaacggccagactatatttattttctggcagcgattgcaagtgtggcggattcgattgagcggccggcagaaacgcatgctgtcaatcataccgcggtatttaacttgctcgaacatattcgccaaattcgcttgcctattaagcaatttctattcacttcttcggcggcggtttatggcaatctacctgaattaccaaaacgcgaggattcgcgcgtcgcacccgtgtcaccgtatgctattgataagtatgcgactgaacgttttgtattggcatacggtgagttgtacgatttgccgaccgtttgtgtgcggttcttcaacgtttatggaccgcgtcagaatccaagctcaccgtattcgggggttttgtcgattttgacggattgtttgaaaacacagcgaccatttacattattcggtgatggaacgcagacccgtgattttgtatatgtaagtgatgttatcaaggcattatggttgattacagaacatcaagtgcaacatgaagtgatcaatattgccaatggcttagaaactagtttaaatggcattattcagatgtatcaagagattgctggtcaacaacttgaaatcaaacgggccgagcagcggggtggtgaagttgatcattcagttgcaagtattggcaagttgacacgcttaaattatgaatcagagtggccgttgagaagaggattaaccaagtactgggaaggggaatgtgagcatgcacgaagttgagattaatgaatcaatcgtggctgacgaacaacactgtgaatttattagcaaaattggtgttccggtcaccggctggaagatggatctaaagcggtgtttcgatctagcagtcggcttattgggcacactgctcagcgttcccatcgtaattgtgtttgccatacttatcaagttgacttctgacggtcccgttttctacaagcaggcgcgagtcggttggatggggacgacctttgacgtgattaagctgctatcaatgtatcaggacgctgaggcgcagacgggtgcgatctgggcacaaaaaaatgatcctcgggtgacgccggttggacgctggatgcgcaaaactcggatcgatgagttaccacaattttggaatgttttgaagggcgatatgagtttggtcggacctcgcccggaacggccagaactaaccgaacaattcagtgaacgctatcctgattttccgaaacggctacgaatcattcctggcattaccggctatgcgcagatcaatggtggctatgatattacaccgggtgccaagtgtcagtacgataactattacattgagtacttttcgatttggtttgatatcaagatgctgatgggaacggttagggtgattatttccggggatggtgcgcggtagtgaagattgtttacatcattactcaagcgacttggggtggggcccaggcgcatctatatagtttgatcaaagcgcaagtgatgcgtggcaatgccgtttccttagtatacggcgttgaaggacgcctgagtgcaagcgtcgcgaaagaatttcaagacgtgcaagttgtcagagttgccagcctggtacatccgattgcaccgctgagtgatttgaaagcaatctacacgttaaggaaattagtaaaaaattggcagccagatattattcatttgcattcttcgaaggctggtatgattgggaggctcgccacgattagattgccaatgaaagtcatttttacggtccatggctggggctttactcctggtgtcgggaagaaacggcagctattgatgaaaactattgaaaaagcattaagtcgcctgacaacggcttacatctgtgtctcgcagtttgattatgatttgggtgtccaaagtggtgtgattactagtgctcatcctgctcgtgttatccataatggcgtgacagcattaacgggcgcaaacaaggcgaccagttccgaggtctttgtactatcaatggcggcacgctttgatacaccaaaacggcaggatatcctgattcaagcattgacatacttgccggaaaatctaccaatcgtgtgtcattttctgggtgacggcccttcgattgaagcctgtaaaacgctaacgcaccagttgaatctggatggtaaagtgaacttttatggggtggtggataatgtacaaaaatattattctcaatcggacgttggggtgctgatttctgattatgaagcactcccaatcagtttagtggaagccttagcccaaggtctgccgattattgcgtcgaatgttgggggcattcaggaattgattgatcataatggctttttggtcaccaatgatgcgcgcgccagattgctgaaaaaattctgacactctatcaatcgaaaaagatcgccgaggtcaagactaattcctatcaaatgtatcaacgtcactatactgagcatgagatgctcgaacaaacgcaggcgtactatttgcgttgcttggcctagaagggacgattgtcgatgacaaaaattgttcatgtcttgttttccgccaaattaggtggtgctgagcaggtggtcattaatatcagtaggggtttgagtggatcctatgatttcacctactgctcacaatcaggatcgatacaagaaagcttgcaagctgtcggaatcgcgtatcaaagtttttcgccgaaacagcttcttaaatttcggcgagctattctggcactccagccagatattattcacgcacacgatttcaaagcgagttttttggtcaacctgctttttcaccatgtgccaattatcacccatatccatcaagccccgatatggcagactagtgtgaactggaaaagtttggcgtttcaatatattggcaacaagagctcacgagtcttatatgtttcagattgggctaaagaatcgtatcgcttccacaaacatttaaccaatacggcgattattcccaatggaatcgacagttcacggatttgccaactggctactgccagtacaaccactgcatttgacctgttattcgtgggacggttggaagatgttaaagatcccgcaagatttgtgagaattgcgcataaattattagacgcaatccctgaactaaagattgggattgtcggcgatggtagcttgagcgcacacatcgctaaacagattgcagccaccccgcaaatacggtggttagggtttaaaagtaacccttacaaatacatgcggcatgcaaaagttgtgctgtcgacgtccaaatcagacgcgtttggattgaccatggtcgaggcagccttattgggttcgattccgtttgccccccgcattgggggcatctctcaaacggccgcaagggtaaatggcctggtttatgcgagtgatgctgaattattggcagtactgacacgtctcttttcggatgggaaattttatcaggaaaccaaggctaaaatagcagcggtcgattttagtgactatgaacaaaggcaattcattcagcggatccagcaagtttataaaggagtaatggaacgatgactgcagtaaatcgtcagattggtgggccattcttaagactaggactattgattgccggattttacctgatttaccaacccaacttttggagcagtagttatgtgcccctgattgttacactggggattactggtggttgcgtcttgctattgtcgccaaaggacttatcgattgctattaatcggctgcacatttttgtgattggtgtgatgctatcagtgatttactttgcgttcagagcgaaactggcaggaactgatccccgggtgtttcaaaatgttgtgattattttgaatgtccttgccttagtgttatggctagaagttcttcgtaagtattttaacgtgacaagtgaaacggtcttgacctggatgctatggatggtggttgttcaatgcttgtttgctttggtcatgctggcaagttcgggtattcgcgctgcgattttagcaaaaacagccaccggtattattcagaatcagtttatttatggtgaacgtttgtatggaatcagcagtgactacacattttttacaccaatctaccatagtctgatgggactagttgcgatatatatgggaatgaaccttggcaaaaagtattattggttcctgccattttgtgtctttattatcgtattaaacggccgaactggcttgatcacgctggcttttggttttgccttgatgctggtcaaacgaatgctgtccagtgttcgagggctgtttcaagttgtgttgattatcatattgagtgtgacctttatcatattgggtttagcgtttttgcaatccatccaacctgatacgtatacctggatcgtcagtggcttcgaagatacgtttgcactcgtctttgaaggtagtaagcagggcaattacgaacaactgacgggctcgttcttgatgtttccgagtcagcttttagactgggtgtttggttatggcgttcgcgtatatggtggcaatgccagcaatatttggttcggaacgtccgacattggctttattaatgacttatttatggggggcatcatttacatggcgctactgtacggtacgattatagcctcgttgacggcttgccacaaaaagtctggaaaggttgttcgtgatagtaaaatctttctagcctttggcgtagttctactaatcgcaaattataaaggtaaggttgcgcgcagcggcatggtactgacggcaataatattcttggggtatttactttcaactgaattgaagattgaggagaaaaaatggcaatcagcgtaattatgagtgtatataatgaacgacctgagcaagtccagcaagcggttgactcgattttgaagcaaacctatttgccgagggagtttgtgatcgtactggataatccagaacggagtgatttaaaagacttgttaatggattacgattgccgtgtggaaatgatcaaactagtgtgcaatccagaaaacctcggcctggccgctagtctcaataaggcgattgagctagcaagtaatgagttgattgcgcggatggatgcggatgatatttctgtcactaatcggctcgaagtggaattagaggcgctaaaaacgcgcgatttggatttaatttctggaaatattgcttatcttgatgagcaggatgaggttgtcggtgaaaaatcggccattcccgaggctgaaccactaattcaaaaaatcctgccctatggttcgacaattattcatcccaccgttttaatgcggaaaacggccgtccaacaagtcggtggttaccgtttattaccaacggctgaggactatgatctctggctgcggctgcttgctaatggattcaaaatcgggtcaattaaccgccgagtgttgaactatcggttacgcggtaatagtatgaccagcgacgcgtggaaaacgtatctggtatcgcgctatattcaacaattgtatgcggaacgtaaacggacgggagcagacagtttcggccgcgggatgtcggcgttaacagacaaaataaatgacgtccgtgcccaaagtacgtttaatcgtgggcaaaaatattttacgatggcgatggccagtatgcgcaaacgaaaacttggtcaggccctggctgcgttagtccgcgcaatggtgacatccccagataattgttactatgtgatcaactatttacgtttaagaacgatttggtcggtaaatgggcgccggtatcgacaacaaccaagtgattgaacgtgtgcggtgcttatgagatttgttattagtaagcacgggatgtgatgctcagttcagatctatgagaaaggaatttatgttagtcagtattagaaataaatatcggcatttgccaaagcaagttaaggcctcactttggttcttaatctgtgctttttttgaaaagagcatttcaataatcgcaacgcccatttttaccagaataatgtctacttccgagtatggtcaatttaatgtgctgtactcctggctgactatcgtcacgatcatcgtctcactaaatctgtgctacggcgtttatactcaaggtctcatcaaattcagccatgatcgacgtcgatattcggctgaattacaaggattaacggttgtgttggtattagcatggacactagtttatcttggctttcgtgatttttggaatagtgtcttttctttaacgacgacgcagatgttggcgatgcttctaatggtatggacctcgtcagtttttaatttttgggctggtgagcgccgagttgccttgcaatacaaatcattggtgatggtgaccttgctggttgcaatcgccaaaccgttagtaggcgtattgctcgttgtgtatgcgaatgataaagtgacggctcgatttttagggctagcattagtggaactggtaggctatacgggcttgttttttgtgcaaatgtatcgtggcaaaacgtttttctcgcgctatttttggcgtcacgcattaatgttcaacatcccgttggccccacattatctttcacaaatcgttctgagtagtgctgaccggattatgattgcgaacatggtaaatacgaaaagtgcgggcatttatagtttggcgtactcactttcacaaatcatgattttatttaacgttgcattgtcgcaaacgctgagtccgtggatatatcaaaaaatcaaggatcgacgggtggccgatattgcgggtgtcgcttacggtgccttagttttaattgcggttgtcaacctgctattgattgcatttgcgcccgaaatcgtttcgatattcgcaccacgagcgtatgctaaggcgacctggatcgttccaccaatcgcaatgagcgtctttttcatttttgcttttgatttatttgcaaagtttgagttctattatgaacggacatctttaatcatgattgccagtgttattggcgcagtattgaatgtggcgctaaattattggttgattccaattttaggatacgaggtggcgggatatacaacattaatttgctatgtgatgtatgcggttgttcattattggtttatgaatcgaatctgtcgcgaaaaacttggcacgcttccatatgatcgcaagatactggggctgattacgctcacttttttggcggttggctttctatttttaggaggctatcacagtgttatactccgttatctattgattttgataacggccgtcgtcggatttagcaagcgtgattatttaatgaccattgttaaccaaatgctacgtgtgcgaaaaccaatctagccgaatcgaagtagggtggtgccggtgtgactgaccagctataagtagtgactaatcaaaaagacgacagcctgaaaattcgctgtcgtctttagtttataaagtggttattgtacggacccagaccacgtcacgttgccgtgtagtttcttggtggctaacacgaagccgagcaaacttgtattgtggggcatttgttgccaagcttgaatagcggcgctatttttgactggggtgccccgaaagagcgcgatattggcggccgccatgccgcgggctagctgattaactttagcgcttgatagttgcgtttcgtcacggtcctcatataactgactcagtgctgcgttatagccagccgcatataacacgtcatgatcgtacttttgataggcgcgcatcgctttattaccacggtggtgcttgatgtaagcactcacgtttaacggggtcgcgtggtacgtggccgtcccgttactctggttgatcttaagcgtaccgtaatagtgagatcccagtatcagggcgccactggcaatatcagtcagtgactggttcttgactttggtagacttgatattttgagcatgaatatggccgctgagcgataacttgatacccgcagtggtaaaggccttacggacatcttcggcataaccgattgtatagtcctgatgaatcaccgtgtggtccattgtattgtgatgtaggacgggaatgagagtcgcatgggcttgttttgcttgcttaccgactttagtaagccattgtaaggtcccatcggtcaggccaccaccgaccgttgaattaccttgttgataattacttttataaatggcggagtttagcattaaaaaccaagtgtgtttactaggttttaccaaatatcccaatgagcttgggtcagtttcactggcttggccgtagccggcctgatgatagatcttcttgaactgggtcgggctagtcgcctcggtgctatattgatgctttcctttgaagcgacgggcgatggggttgttcaagtcgtgattaccggggacgacgtagacgcggatgtgcttagcagtcagtcggcgaagctgcttggcaacgtactcgtgactggctttttcaccgttgttagtaatatcgccactgatgagcacaacgtcaggcttggtgattaacgccttagcaataaaagcgcgaaaaatcgtcgcgctgtattttaaatccgcaccggcatcgttagccgcgtactgcgtgaaagccttaccattatcatgcagcctgggcgcaatgacatggtcatcactgatcaccatcgctgttaaggtcttgtgactgacagggggcagggtcattttagtttgtttttggcaaccggaaagcagcatcatgccgaataatacacagctgatgccaaagatagattttcgtagtttcatcaaactcgtctcgattctcgttaacataatcagtatattactttcattatacccgttttattgcggggttagacggctgattcgttaattttgaaaacaaaaaaagacgatcaatttgatcgtctttttagatatcacattatttagaagctttagctggtttccagagaccaaggataaccccagcgataacggcaccgataattgtggcaccgatgtagccccagatattcgtggcgagtaatgagacccagaggccaccatgaggagcagggacggcaacgccccaaagttgagttaagccaccggcgatggcagcaccaatcacacttgaaccgataacgtgcaaggggtcagctgtggcgaatggaatggcaccttcagtaatgaaggaaataccaagtaaccagttagagataccagctttacgttcgtcatccgtaaatttctttggccagaaggcagtggcaatcgcagttgccaatggtggaaccatcccaccagccataacagcggccattaagttcccatgtccagttgcggtaaaggcaccagttgcgaagacgtaagcggccttgttgaaaggaccacccatatcgatcgacatcataccaccgaggacaagcccgaggagaacggcattaccagtacccattgagtttaggaagtgggtaatccaggcgttgataactgagaagattgggttaacaacgaagaacattagcgcagcaataatcaataagcccagaattgggaagatcagcattggcttcatcccgtctaaggattgtggcatgttcttggtccacttcttcatccaaacagtaatataaccggctaagaaaccagcggctaaaccacctaagaaaccagcgggactcttagcattggcggtaatggaggccgtgtaaacaccaccgtaagcgccagtgtataccgtggccatgaacccaccaacgaacccgggcatcaaagcaggacgatcaccaattgattcggcgatgtaaccggctaaaacaggtaccatgaaggcgaaagccatgttaccagcttggttgaagaaggtaaaggctaagctcttactaccaacgaattgctcaataatgaaggagagggccattaagatcccaccaccgacaacgaatggcaacatgtgggaaattccgttcatgaggtctttgtaaacttcaccccaaacactaccattagcgctgccaccttcatcgtcatctgcagcaccaccatcagcatcgtgatagacaggagctttaccgctcaaggcttcttgaactaattgatcggccttgttgatcccgtcagtaacgggacggttaaccaggtgcttaccatcaaaacgggccatcttgacctttttgtcagcggcgatcacaacaccgtcggcacgagcgatttcatcggcagtcaataagtgcttaacaccttcagaaccattcgtttcgattttgatgtcaacaccggccgcttcaccggctttgatcaaggctgcttcggccatgtaagtatgggcgattccgtttggacaggcggtaaccccaactaaatagggacgtttttcgtcagtggtggtgctggcagctgcggcttctttttcggccttggcagctgcatctttggcttccttttcttccttagcagcctgggcatcaccgaagagttgttgaacttcttcaggtgactgtgcattcttaagtttagcgaccaattcaggatcaatcaataagcttgagagggcggcgagggcggctaaatgggtgttgttggcaccttcaggagcagcaatcatgaagaaaagatgaacgggttgaccatctaacgcgttgaagtcaacgccggccttactcttagcaaacatcacggttgcccggttaacagccttatctttggcatggggcatagcaatcccgtcgccaatcccggtagttgattcggcttcccgtttgatgatgtcttgcttgtagagggcctcatcattgatgataccttgttcggcatatttatgaactaactcatcaatcgcttcgtccttggtcgtggcgtgcatgtccatgatcatgacatcttttagtaataaatcgcggatatccatgtttagttaacagtcctttctttagtgagcgagtttttcaatgttaatgagtggcaaaatttcatcgatcttggcgcgggtcgcaatgtcttctgagaaggcggttgcggagccacaagctaagccgtagcggaagctttcaacagcatcgtgtgttttggcgaacgtgccgacaaagccaccaatcattgaatcaccggcaccaactgagttgattacctggccctttggtgcgggactaaagtagaccgcatccttggtgattaggaggccaccatcgccggccattgaaatcagcacgtgttgtgcaccttcagctagcatccgttggcccgctgcaatgatatcagcctggctattaaacgtcgtgtggtagtaatcagcaagttcgtggttattaggcttcacaacgagggggtggctgggtaaagttttcttcaaagcttcaccggtcgtgtcgatgacaaagttagcaccagcagcttcgaccttctgaataatatcgtagtagaagctatctggtaaactaggcgctaaactaccagacatgacgaccacgtcattcggcgttaaattggccaattcggtgtagaaggcttctgtttctttggcggtgatgtccgggccagcaccgtttaattcggtctcttcttcagcgtgaatcttcacgttgatccgggtgtcatcggcaatcggtgtgaagtgacaatctaggcccttggcttttaaagcatcactgataaacgtgccggtaaacccaccgataaagccgagggccttgttgggttggtctaggtcgttcagaatctgcgatacattgatgcctttaccgccagggagtttcgccgtgtgtgctaaccggttaacactaccgagggtcatttggggtagttgcaccacgtagtcaattgatggattgacagtaatggtataaatcatgattgaacctcctgaatcgtagttaatggttgatactgttcggcaacgcttggcgtgagttggtcagtgatgatggttgcactggataaatcaccgacgcgcgcaaacgaaacgtggtcgaacttagtgttgtcagctaagataaagctttcttcactttgtagaattgcggtttttttgacgaccgcttcatcggggtcgggcgttgtgagcccgaattttgggtggacaccgttgataccaagaaaaactttgttgaatcggtattcctctaacgatttaacggcttcgggaccaatcacggctttggtggtgcctttcaaattgccaccaagcaggtaggtttggatgcccatgtctgccaaagcggaagcatggacaacaccattagtcacgacacgtaagttgtagctcggatttaaatggtgaatcatggctagggttgaagtcccagcatccaaataaatgacgtcatcaacttgaatgttcgcaacggcttgctgcgcgatatggtccttggcgttaacgttacgggaaaccttatcattcatcgcgggttcctcttggagtgagttcatatacttcgcaccaccgtgcacgcggagtaactcgccctgttcttctagctgttggaggtcacggcgcgccgtggactcggaacaacgagtttcagaacagatgtccttgattttaataatgcccttgaaacggatcgtatttaaaatgtactgttgacgttcttctgtaagcactttcaaatccctccgcataataatatacctgtttaaacgtcaaaatgcaacaaaaaccttcaaaaaccgtcaaaataatccaaaacctgtcatcaaatcgtcattagcatccaaataaagatgatctgtctaattaggcgtggaacttttgacgaagtggccgaagatttgtatactaggtcaggtatctaatttcgcacgatcggatttcgtagataataatatagaagaaacgggagaaaagaacatgtttgttgatcaagtaaaagtagatgtaaaggccggtaacggtggtaacggcatggttgctttccgccgtgaaaagtttgttcccaatggtggtcccgctggcggtgatggtggtcgcggcggaagcgtcgtattgcaggctgacgaaggattacggacactgatggattttcgttatacgcggaagttcaaagccgcagctggtggcaatggaatgattaagcagatgacaggtcgttccgcgaaggacacaattatcaaagtaccacttgggacaacggtgacggatgctgaaactggtgagttaattggcgatatcgtcaataaagatcagcggttagtggttgccaagggtggccggggcggtcggggaaatattcattttgctagcgctaagaaccctgctcctgaaattgctgaaaatggtgagcccggcgatgaattaacgattcgaatggaattgaaagtcttggccgatgttggtctggttggttttccttcagttggcaagtcgacactgctttcagtggtcacgagtgctaagcccaagattgcggcctatcacttcacaactttagtgcctaatctcgggatggttcgtttggatgacggtcgtgactttgtcatggctgatttacctggtttgattgaaggtgcggctaacggggtcggcttagggattcaattcttgcggcatattgaacggacgcgcgttattttacatctgattgatatgagtggtgtagaagaaaacgatccgtttgaggattatcacaaaattaatcacgagctgacgagttatgatcctgacctcttgaagcggccccaaatcgtggtggcgactaagatggatatgccggatgccgaagctaatctggaagactttaaggcgaagttagcgacggatgatacgttgccaaacacgccagccgtctatccggtatcgtcgattacacaacagggactaaaagccttgttagccaagacggctgatttattggatacgacgccacaattcccaatcaagggtgttgacgacttgaagcaccgtgattacacgactgaagcggatgcagactttagcattgataatccagaaccgggcttgttcgtcttgtctggtgataagctagaacggctctttaagatgaccaatttagatcatgaagaaagtttaatgcgctttgctcgacaattacgtgggatgggtgttgatgatgccttacgtgcagctggtgccaagaatgatgatacgattcaaatcttggactactccttccagtttatggactaaacttttgtgacgacataattagttgatgattgtcgttacgacagtctgataggtagactagtgataaaataatgaacaatccaaaaacagcgccgttagaattttaactaacgacgctgtttttgagctgacgtgcgattagatgctcagccaaacagtaagcgctgctggcttaagcgatagccaaataatcggcgcgggcgcggtggggtttgaatacagagctgcgtttgaccatcgatttggcgcgtccgcgcattgaactggtcgagtgtcagcgggagcgcgctttttgaagctactaaaaccagctggtgatcgacgagcgtaacactttggattggccagatttgattagtcgttagttcccaatacagtggtaaagtttgctgtagatcagcggttgataagttaaagtcgatgagtcgcataacggttacctcttgttcagacgatttgtaagcaagtatacgataatcaattgggttaagcaagatggactgaggattcatttgccggcgatgacgggttgaatgaaaacggtcacaacccgtcatagtcagtttgcccggaaaagtgcattttttgattatagataacaccggtggcaggcagtcttggcacgtggaatcttgaaaccaagtgcgataattttagcctgacatgttaaaataaaatgagcagcgttgttcgtgttcttcctgttaattgtgaggagtcgcccaacgtcgcttgctttttagaattgcggtcggtgagcgcacggtgttgaccggccatgactttgcagtgctaacaattgtgtattgccgctagattcggtaaaatagttagcagactgtatagataggacgaacaaaaatatgcaattagaatttttaggtaccggtgccggctcaccgggcaaatttcggaatgtcactagcacagcattacgactattagatgagcgaaatgaagtctggttgttcgatgtcggcgaagggacgcaacaccagattttacgcacgacgttaaaaccacgcaaaattgcaaaaatatttattacccatctgcatggcgaccatatctttggcttgccggggttattgagctcgcgttcttttcaaggcggggacgaaccactcaccatttatgggccagtcggtgtccgcgacttcgttcaaacggcgttgcgggtctctggcacccatttgtcatatccattgaagtttcatgaaatcacgaaagctgagacagtttttgaagatacgacgttcaaagtaagctgcgaacctctggatcatcggatcgcttgttttggttaccgggtagaagaagcggaccacccgggtgaattacaagccgatcgactcaaagccctgaacattccgagtggtcccgtctatggtcaattaaaagccggcaaaacggtgacgttgcctgatggtcggacaattaatggtcaagattacatcgctgcgccacaaaaggggcggacggtgacgattctcggtgatactcggcggacaccgcacgcggtcagcttggcacaggatgcggatgctttagttcatgagagcacgttcggaaaagatgaaggtaagttggcacataactattaccattcaacgagtacccaagcagcccaggtggcccaacaggccggtgttaagcagctattgttgacccatatctcggctcggtacacgggtaagttgagtaaggaactacaaaaacaagcacagaaagtctttagtcactcgaaagtcgttcgtgactttgatgtaattgatattccattacctgagaaaggttaggtcaagtaaatgacgaacttagtgggtaaaactgttttggttactggcgcgtctagtggactaggcgagcaactagccctagctgtggcgagtcagggagccaatgtcgtcttagccgcccggcggcgagaacggctaacacaggttgctgatcaatgtcgtctgttatcaaaagggcaggccgtggcgattacttgtgacgtgggtcacgtggcggacgttgatcacgtctttacgaccatcgatgagctatttggtcaattggatgtggtcattaacgctgccggttttggcgatatgaccacggtgatcaccatggatgcgccggtgatggcgaaaatgttgcgcgtcaatacattgggaaccatgtatgttagccaactggctgcgcaacggatggtcaagcaacatgcaggtgaaattgtcaacatcgcctcgatggctggcaaaatcgcaacacctaaatcagccgtttatgcggctagtaaggcggccattattgcttatgataatgcgttgcgcttagaactcaaggatgctcatgtcaacgtattgacggtcaatccgggtcccattaaaacggactttttcaaaattgcggatcccacggggcactatttagaccgggtcgaccagctggcattgaaccccgttaagtttgctgaattgattgtaagcaaactcgggcatcaacggcgcgaactgaatcggccttgggtgatgtctgcagctaatttaggttatcagctggcacccaagctcggggattggctgacggggacggtttttaattttaaataggggatgaatttaatgaagaatcaatggcggttagtgagtgcactagtcattgcactagtagtgattatttttgcaattttaaacgtagaaccagttcgaatcaattttggaattacagcagttcattggccactgattttggtcattgtggtgacgttgatcttaggtgtcattaccgcagtactgatggcgacggtcaatgaatctaaggaacggacagcccatagtgaagctttagcagcggcccaggctaagattgacaagttgactgccgaaaataagcaattaacgttgcgtttgaataataaaggtaaacaaaaacgagcggtggcagaacaaccaaccacgccagcagataagtaagttgttgaaaggaaggatgccatgttagcggcaaagaaaaagtgggtgccacgtttaacaacggccgttgatgaagccgatgttgataagttagctgaggcggccagcgtgacccccttagttgcccggttattaataatgcggggcattaatacggcggaagaagccgccccattcctgcacgcggatcaacaaccattgttggacccaacgaccatgcacgatatggaaaaagccgttgaccgcatccaagaggcgattattgccggggatcaaattaccatttacggtgattatgatgcagatggtttaacaagtacgtcaattatgtatgaaacgttggaccaaattggcgctaacgtgaattactatattccagatcgtttcaaggatggttatggtcctaatcaggccgcttttgaccggctgattgcggctggaacgaagctgtttgtgacggtggacaacggtgtcgcgggaaatgcggtcatcaatcaagtgcaggaacagggcatcgatgtcgtagtgaccgatcatcatgagttaccgactgaattgccgcacgcttacgccattgtccatccacgacatccagagggcagttatccatttggtggtctttctggtgccggtgtggcgtttaaagtagcgacggcgctacttgaggaagtacccgaggaactattagatctggctgctattggaacggttgctgatttggtcagcttaactggtgaaaatcggactttggtaacgctcggcctgaaggtcttacagcagacgacccgcccaggcttggcagcactgattcaagaagccggactgattcccgataaattgaccgagaccaatatcgggtttggtattgcccctcggctaaacgcacttggccgtctgcagtcggcgcagagcggtgtagaattattgacaactttggacgatgagcgggcgaccgcgctggccaagcaggtcaatcaattgaatgaaaaacgccaaggcttggtcaagacaatcagtgccagtgcaatcgagcaagcacagacgccggaaaatgaggcccgccaaaccttagttattaccgggcatggttggcacgagggtgttttgggaatcgtcgcgagccacgtggtcgaaacgactggcaaaccaaccctagtgttaaatgaggatgatgatggccggctcaaaggtagtggtcggagcgtcgaagcgtataatttatttgccgcaatcgacccagttcgggagtcattggtggcttttggcggtcatcatatggcggttggactaactgtcatggccgaccagttagcaacgcttaaagaggcgatggaagcggcggcggttagtcagcaattagcagataatgcgcaagtcagtttaccaattgacggcacgttaccattagctgaggcaaccttggcaactctggcagatattcaagcgttggccccctttggaacggataacccggcaccgttgtttgaattagttccaacgactgttccgcaagcacgcgcgatcggtagtgatcagcaacacttgaaattacaactgggtgatggcaccaatacgattgatgctatcggtttttcgatgggtactgccttgccggctattcaggcgagtcccaccgatgtgacgttagtgggtgagttgagtgaaaatacttggaacggtcagacgaagccccaaatcatggttaaggatattgcagtgacggggacccaggtgatcgacgcccggacgcaacatctttcggcccatttgtttcaagcaccgggggtttacctctttttccaccagcgtctgttgaaaaaagttgaacagtatttaggttaccaagcgcaagccgtatgggtgggggatacgaaaacggatctgactgccgtgacggctaatcaagcggtcttcattgtcgattgtcctgacacgctggcggatatgacccaggtactcagcacaattgcgctcgatcagctgacgctctacttatatcgacaagaatcggtttatttaacgggaatgccaaatcgcgcgcagtttgcgaaacttttccagtttaccgcagcgcaccatgatgttgatattcatcatcaattaacattagtggccaagcatctgcatattgaacgaaatttgcttattttcatgattcaggtgttttttgaggtcggatttgttaaaataaatgatggtgtcatgaatggcgtttcgaatccggcaaaagcggatttacatcacgcccctagttatcagctgcgcgaacaacaaatcgttgctgaagaaacgcttttatatagtaaatctgcagcgctccaagtatgggtgaagaaccaggctgcggttaagaattgaaggagctgttaagaacaaatggcattagatttaaaaaagtatgtggctagtattccggactatcccgaacctggaatcatttttcgcgatatttcaccactgatggctgacggggaagcttaccgtgaagcgactgatcagattgtgcaatttgcgcgtgataaacatgttgatatgattgtcgggcctgaagcgcgcggctttatcgtgggttgtccagtggcctatgaattaggcgttggttttgcacctgctcgtaagaagggtaagttaccacgcgaaacggtcaaagcgacttatgatttggaatacgggcagtctgcactttatttgcataaagatgcaattaagccgggacaaaatgtgctagttactgatgatttattagcaactggtgggaccatctcagcaacgattcaaatggttgaagaattaggcggtaacgtggttgggacggctttcttggtcgaactcaaagagttgcacggccgcgataagattaaagattatgatatgttgagcttgatgcaattttaaagccaatattaaaagctccgaatgacgatttattagtcattcggagcttttttgctaacccttgttttggtcgttagttagcttggatagtcagtgattctttggtagccaagccaaaaagactaacaattgcatattctaattattgccacttttcaatgagtagtttaacctgacgcttgtccgttgactgaggatcaggatcattcttttcagcatcgccaagcaatttgatcaaatctaagcgcaactggtgctcgcctaccgctgaaaggtttaggatcgcgttactgaaaaaaatggctgacttgtcaggttgcttgcgggtcatctcttcctggtaggcttcggtaaagtcgtggttcaatagcatgatccattgtaaaacttgttggacatgggcttgagtccacgtaccggagatgtcagtcagatcagtatcgagaccatcaagatcctgtggcgtctcatgggagaggtgggcactggaatagtagttttcagttagatttttaacctgaacttgattaacgatggttaataagtcggcatcctgcattttgttgatggtgtagtacaactgattgttgggaattttagtttgggccgaaatttgcttagttgttaaaccagttttagatttggtggcctttaagatagcggccaccttgggatcggccattaactttgcaaactgagccagtgtgtttttggacatgtttttcacctcaatactagcttaaccatttgacaaatagaaatcaaacgattaaagttgctttatcatttaaatttatttaagcaataaataatattaaattggaagtggcgttatgaaaaatctaggccgtaatcgagcgtttgtcacgttaacagtagctgatctttttgagacaattggtaccagcctatttaacattattctattaacgtacgcgcgaacgtttgcacaagcaaatttgatggtttcgctagtttcggtggctactgtgcttcctggtatttttggtatgcttactggtcgattggcagactcgcaaaccaataagcgggggtggttagcaggtttgaaatttgttcaagcggcattatatctcgtgttagcgcaacttattactgaaaaacaggtcgggttgctgttgattattattgtcatcaatttgtgttcagacgtgttggggatgttgagcggcagcctccgaatgccattattacaagctaaagtcgcgtctgagttacaagaagaggccttagggatcaaccaaggtatcggagtgttaatgcagacgatgggccaagcgttgggtgtcagtctattggccgcaacgggcgattatcgtctcgcgggatatttgaatgcaatcacgttcttgattgccggtctggtgctactgtccgggtatgaaacgctaaaattaccttccgcaactgtcaccgtgacgtcgacatttcgtcaactgctacgacaagtgcgacaagcaatggaagcgggggtgcacatgaacgtcttggcgctattggggagcgtcttgttcttgaatgcggtaggtgcaagcgtcgatgcactattgaatttatacctgattcaccgggcgacgcagttaccactttcattcggagtcgcaattcttgtgatgaatactgctgacgtatttggatcggttgcagggaatttgttacatacaggttactttcagaggtggacgtttcgtggtgtcatgttaactaccgtcgtggcgtttgagggtttatttattaatctgttgttttggcaaaactattggatagtggttacaatcatgatgattgggggattttgtatggggcaagcaaatcctaaattgatggcgagtttattgaaagtggccgatcaaagtatcgttgggagtttaggcggcatcataaattcattggcgacgatttcgattccaatcggcagtgttggattggtcttgttggataatatcgtgagcccagaagcggcttatttgacggccatgggattactgttagcttgtggtggttgtctgttcattcgccggtgacgaaaattataattgtgttatacaaacagctgccaccatgctaaaaaccgcttgcccagattaccggcaggcggtttcgttagtctcgaatcagttaagcattgtcagtggtcaagtcttcggtgataaaacgaactgcggtaccatatgcggcaaccgattgcatatcctgactaatggagccggtgtcgaaccgcatcatcacaacggcatccgcacccatggcacttgcattatcgcgcaaccgattgaccgcgacatcgcgcgattcttcgagcatcttggtgtaatccttgatttcgccgccaactaggccctttaagcccgccccaatgttacggaccagattcttagattgagtggttagcccaaagacttcaccgataacttcataggggtgccccggaatattttcagtggttgtgaccagtaattgtgtcattgactgaacctccttttaaagatattgtaatcatagcataattcgtattgaaataggccagcggagactttgatgagtggtctggtttataggaaacgaaggaggcaaaatatgacagctttagaaagcagttggtttgaagaagcgcagcaatccatgcacggctgggactttagtcatctggctggccggtggcagactgcggacttaccgtgggattacgctgccctagttcgtgagcatctaagtgccgatgatcggtggttggatattgatacgggcggtggtgaattgatggggcgttttaaccatcagccagcgctgactgcggtgactgaggggtggcaaccaaatattgagttgttgaagcaaacggtggttaaaaaggggataacattatatccagatgccgccgaacagttgacggccgtaccaaattcgacatttgatattgtaacgaatagtcatggtgcgatgccagtgaagcgaattgcggaagttttaaagctggggggccgacttgtgattcagcaagttggtgcgaccaataattatgcgttgtcacgattctttgatgagcattacgaaccggcgtatcctgacaatcagttgttgacggtaatggctcaaatgcaggctgcgggatttgaaattctgcgggctgagcaagcctacgcggcactgagttttacggatattggcgcaattgtctattatgccacggtgattccatgggagtttccgaattttgacgtggcacggatgcttcccaaattacatcagttacaatccttactggccattaatggtcgcgtcacgacgtttgaagaccgatttatgattatcgctcgtaaactggctcgtcgtgattgaggttgcgagggggcatattaatcggattggcacttaacaaacgtaatcggttatgaattgtaacttaaacgtcggatttgagtattcagagcttgtacctaattgcgtactgcctataataggcgttattccaatcggttatttcattggaatcacgagttaggggggagcgtcatgcggatacgtcgaccggttcggttttatcgttcattttggttttggttaagcgtgatttttctatgggtctcaactgccggttttccgaagactttagtgacagtgggggatgtactgtgctatggcattttatttttactatcatgcgtgggtattcttggttcgttctttgtttttggtcaagccgcacgtgaacagaagtaattgggtatccgttggcaagggctgacggatattttttgtggattagtggggaatggtattacttgattgatgttgttgatcattatgattatttcaagtgccgatgtttaataaggcattgatgtgaatgaatttgaattggcattcaacaattaaagaagcagctttagaacatgttactaaaccaatagtatagaaaacctctaggtggttcaagaaagcgttgatattgagtgccaaaattttggagcaggcaagagtagctcaagtctaaaacctattttgtaatagtagtatccataccatttccaaacagtatagtaggtagcaaaccatgttgatattgacttgtttgatttgaattatataaaaaacaagaatcccgacaaatcaatgcttgttgggattcttgtttttactggctggtctctactattttaataaggagagtacaggatttgaacctgcgcgccggtattagccggttcgccggatttcgagtccggtgcattaccactctgccaactctccatatggtacttaataagtatagcataattttctgctggaataaatatttattcaaaagatttaaaggtagcgtcaaatattagattgacgctaagattttaagacgattagtcaacaacgtgcaaaatattaaccgtaataatgatcaaatgttgtatcaattaatttatcgtggctagcaagaggcttagccacgattattaagattttaatgcaatatttagaatccggttaaatcgattaattaagcataaaaaagccacttaaaatataaaatacttggatttaccgctatactaagcccggtataaattttatttatggggggtaacaaatgaataatagagaacttggtcggtggcaagagcataaacatattggcgactatggctgggggattatattatgtgtcatcatactctgttgtattggtatgtgggctgtttactatgcttgtctgcatgatttaaaagtgattgatcctgttcggacgacaatgatgcagtgtctctggtaccttgtgggtgcattgatagcgacaacgatgcttcacctaagtgaaaaacaattgatgcagtgggccccgattggctattcaattggcatgctgttattgatacttttattggtcttctatagtcgagaatattatgttcaaacaggggctaaaagttggtttgcaattggtacactgacttttcaaccagttgaagttatgaaaccgctctatattttaatgatgggccggttaatcgttcaagatcaacagtggggaccccacaataattttaatgcggattggcggttgacacgtcgcttagttatttacacttttccaattattgttgcgttgaaaatcatcaatgattttggaacgacgttagtttttctgacaatttttattggtatgctcattgtttcaccatgccggtttagttttttgtggcgtgtgttattggtggccggatccattggggttgttttaattttgttagcgacatcgagcacgggccaatctctgttatctcatatcggatttaaattgtaccagtttgatcgcatcaatacgtggcttaacccaagcaatggcgtctcggatcaaagctatcaattgtggcaaagtatgcgagcggttggggtgggtggattaactgggaatggtgtaactcataacgctgtttatgtgccagttagggaatcagatatgattttttcggttgttggtgagacaactgggctcattggctgtagtgtcttacttatcgtttacatgtacttgttttatctaatttttcgctcagcattcgctagtcgacgccgattttatgtctatgtttccactggagtagccgtaatgctagctttccatatgtttgaaaacattggcatgacgattgggctgttacctttaacgggaattccgttaccttttgttagtcagggaggttcggccataattggcgattttatgggggttggcttggttcttgcgacacagtatcctaacgtgcgctccattttttcggtaccgagaatttttcactaagtaacaggatttttgtggcaattaaagtccaaatttcaagctagacagtacgagtaatttgtttagagataaatagttaagaaaaagttacgattataaaggaaacctaaaaagtataaataatcacttgttaatgattatcattagctggtttctattgacggttaaagatcttgaaactatgatagcattgttgattacatcagcaataaaaatcagttgcaattaggtgaggttactttaagaatataggttatcgcccagaaatgtcgagagacaggaatgagtaaagcagaatttgccgaattaaggctctttcaagataactagactagttcttacgtcttaaagtgctaaaactcaatgaatgcgtcgatgcaaaaatcgttatccattttagttttttaccccattagctgcaatttgctaatggggttttatttgcctaaaaacaacttgaacatggaaaggagtcaccatgacaagtttaaaaagagggattaaagtacgttctgtggtgggaacgatgatgtggcttggactaagtattggaatattgcttatgattggctggtgcattgccaagatgaacctgccgctcagtcgattacccactcagggttatttagatactacgggaggtaaagactacttaacaatgtcacatttagtagcggctgcgttacgaacaacaacgagactattcattggaatgggctactcaatattgttttctttgatttttggcatattagcagcgcgctatcgaagtgcacgctatgttattttgccgattgttaatttattggagtcagtgccgttattgggatttttaacgtttacaactgcatggttcatgggattgtttcccaataatgtgctgggtgttgaggccgttgctattttcggcgttttcactgcacaggcctggaatattatgttggctctctatcagtcacttcgggttacgcccgaagacttgatgacagtggctaagcaatttggctgtaatagctggcaacgattctggcgcttagaatttctttatgcgacgccaagcattctatggaatattgtcatttctcaatcggccgcttggtttgccctagtcgcttgtgaacaagcgacgatcgtggttcctaaaaatgaaacattagtgctaccaggaattggatcatacatccagattgcgcttgatacagctaattttggtgctgttattaatgcagtgattgcgctagttatctgtgtgttattggtcaatgtgtttatttttcaaccgctgattaaaggaacggcacattataaatacggtacgagtaccgatagccaactaccacagcaatcgcaagtctatgatttggtggttatggctaaagtgccgctgttagttaagcgattacatcgtcatatccggtattggtggttatatggtgctccaaagcaatggcaaaaactgggcttttcacggattatacaaatattaaaaaaatatacggtatattggcgtattgcatggtggctagtaatagctgttggtctatatcgcttgggtgtattactaataaaatatcttgattggattaatttgagtgttttgtttaaatggaccttcctaacaactagggtccgtctgaaaact

SEQ ID NO: 8 - DNA, 60367 bp, Lactobacillus plantarum
gttttcagacagtccctagtgaattggccgtcttgatttactttttaaggttatttcactgtgctaagctgtcaccgatttactaaccaacacaaaaaaacttgtcagcaggcgctcacaagtcttttagattcgattaagtcacatcacagcaccatataatagtaataggacacaaacacacaaacgaccatacaaatcaaatttaacggaattccgactttaaagtagtccgtgaacttataatgtccagggccgtaaacaatcaagtttgtttggtacccgattggcgttgaaaagtctgccgtcgcagcaatcgtaatcaacatcacaaacatcatcacgggtagattttccaacttcgctgcggaaacgaccactggaaacatcagtgataacgccgccgcattggacaaaatggccgttaagaagttagtcacgaaataaatcaggaacatatagatgattggtgatgcgttcccggtaattgctactaatgactttgcgataaacttatcagcacccacattcgacatcgcaagcccaagtccataactactagccactaaaaacaacacgttcatatcgacagccttcacaatatcgctgattgaaacgcatttcgtcaagaaaagtaccacgcacgaggccgccagaccaacgaacaaatcaatcacgcccatagtcgacacgatgatcgttgcaaccaataaaacaatcggtaaaacatccttataagtatgtttccgggacttcactggttgtgaattaaagacgtgtaaatctttgagacttgccagctcgtctggttcaccagtggtaatcatgaccaagttgtccccgccttttaagcgaatacttccgagatgcccttcgaggttgacatcgttgcgtcgaattgcgacgacgacactcccaaagacattgcgaaaacgcgctgatttgaccgtttggttcaccaaactggacgtgtccggaatggagacttcgacgagccgaacccgttcattggtgatatcagtcatattgattttctgagtgcttggtattagacctttaatattcataagatcattaatacaatcaaaatttccagtgaagtaaagacggtcacctaactgtagaatcgtctcatccgtcaccggcacgatcgactgaccactccgattaatcgccactaagaaagagcgcggcaaattacgaagtttggcggcgaccaccgtttgattgaggtgttcaaactcatcgccgatcgtcatttcaatcaagtaatcattcggttcagcaacaacatcgtcaacactactcccataataggtcggtaacatgcggtacccgatcgtcagtaagtaaatcaacccaataatcgtgatgggaatcccgatgacggccaagtcaaaggtaccaaattgtgctaatttgtacttagacaataatccttgtgccactagattggtcgaagtccctagaacggtcaacaacccactcagaatcgtggcgtaggatagtgggatcaagaactttgagattgccatccctttctgcttcgtccaacgctggaccatcggtgtcaaagtggacacaatcggggtattattcataaacggtgaaatcacactcacgctcgctaacaaccgtaataaggaacgcttttcgctgtgaccatcgccgagaatccggtcaaataagtgggtaataatattacttttggcgatggcataggcaataatatacatcagggcaattgtcgctaacccgtcgttagcaaaacctgacagtgcgtccgttggcgacaagatgccgacaaacatcaagaacgctaaggcacacaagattacggcgttcggggtcgtaacttccatggccattaatataaatgatactaataacgtgattaaaacaattgcaatatttaaggtcatcgtcatcgctccgcttcaactaattttcatcttgctgagtcttgcgccactgctcataatcaacctatatccgtcgcgccgttcaacataagaaccattgtagacttggaatgtgaacataaatgcgacatggtatgaaattattctagctttgcggatgattttgcgaccaaattgtgactttttcattaacgttcagtcacaactttgaaaacgaccttttcggactagcaattggtttgtgaacaggcacggttgaggtcagattgaagtcagacggacgctccaaaactggattgtcaaggggaaaaacaatgcctgactgtctctctataatctgttaacggccgtgactgattagcgcaacacgcaaacaggcgcccccgaccagatgagccatctagtcatgagcgcccgttttacattcaattcttattcattaataccatacgtgtgcttcgtcggatacaacgagaagcgttcggcccggtagacataaccaccgcttggaaggcccgttaattcaacgttaaacacctgttgcttgctcttcaaatcgtattcaataatattagctgatttaccattattcaaccaaccaaaatcaattagccgattcgaagcactcaagtaacgattagaaccaataatattggcaaagttcttcttacctaatgacttgccgtaactgccaacttgagaaatcgtcttcgtcttttcattaatatgatattcgacaccttctgaatatttaccagaagagtccgccaacgatttcttggtcgtaccaactgccacgttattgttgaagatcatcacgttgagcgagttcttcttgcccaaggtgcttggatcaacgatggcggcatgttgcccacccggccaagcaatcttaccactagccttcagcaagtacttgcggtacgatttcggccaagctgaagtcttcttaccagacaagatccacttgatcttttcagtcttgtaatcgatcttcatcactaagttctggttgcgacttgaaataatcaagctcttatccgtcttatcataatagacggagttctgatgaaaccagtccttcttacccatatatttactggacttcgtcgcgtcgtacttcgtatagaacttcgcaggtaggatattcttcatgttgatgaccttggtgatcttacccgtcttatgcgatataacgatcatcgtgtcttcgacataggtccggccgccatcggaaacggtcgcaatcagatcaccgtttggtaattccgttacgtcatggtggacctgattatggttctgcttcttagaacccttagccttaccccaggccttatgattaaatttataagtcttataaactttacccgtataatccatttcaactaactcatcaaaatatgaattcttagcattcgatttggtccaaatcaataaatgcccattgttaagttgtttgaaaatgtgggaagttggccgcgttgtataccaccgaatattaccatccgcatccatcccgaacgataagtttttagactgcttgctcccagagatcgtcgtccgaaccataaatgtcagcttcgaattaccagtccctaagaccattttttgtttgttagccttcttaacgttgatcttaaaatcggtcaacgccgatggtaacttcgccgttttcagtcggatcgtcttggtcgtcgacgtgccatccttataagtcaccttaatcttgacctggttattcgtgttggcgtataaccccagcacggtcaaatcatgactcgttgtgtacttattgaccgtattagaaattgaagtcttactactcttgccgaccaccgtataactgaccttggccgccttgctcgtctggaaaatcaccttagcggataacggggacaccccgtatgggttaaccttcgtgtacatgttattaacggtataattcttattggcgaccgccttcttcagcgtcgccgtctcactcgactgggccttaatctcagtcttgactagccgcgtgttgatgtccttcttcgttgcactcgccgaacgtaccttactagtggtcgttgtcgttgcagttgactgatgatatttgtaatacccaaaaccaccgccaatcgcgacaatcacaacgacaattagtgcaatcaaccaatttcgctttttcatttacctttcaccgaccctatctcactattttgtctgacgccaattaattcctcacgaccgctactccaacgacatacccgttttgtcagccagaatattaggctcatacgctgatactggcggtctaaccttcccgtggcaacccacgtgaccgacacagaatgactaacaattgccatgtcaaaccgaatcagtgcagtttatattaaatttattatactcaatctacggccgtcgcagctaatatttgcgcctgcatttgctcaatgacttgtccaactgtcgctaggtcaggaacaaatgccccacttgctaacggatgaccgccgccattgaacgcttttgcgaccgcattgacattgattgctttcgaccgaaaatgtacgcggtattgcccctgtggggtttcaatgaagaacaaccaaactttgaccgtcgtcaggttaccgggcaacgggacaagcgcatcctcatcgccacattccagactcaagtcactaaatagccgttgcggtaagacaacgtgtgccagaccacttggctcaatagtttgttcactcaggacgtacccatacaacttgctgagtgctggcgttaagtccatttcgtggtgactaatagtggcaatatcaatgtccgttgccgcgagtgcactagcaatcttcagagttcgagtggacgtctcaggagttgaaaagcgcaccgtatcaccgataattccggcatatagcttggttgcaacggccgccgtcactgtaaagcaccccgcttgcgccaactcataaatcatctccgagcaactgctataagtttcatcgacccagttcagttgcccatagggatcgtgattcgggtgatggtcgattttaatcacaaaggcacctgttggcaactccccagctaggcgctcatggttagcacaatctacggcaatgactaagtccgttgcttggggggtcactaactgctcatcggttgtatcgatccacgccaaatggcccggaactggggccatcgccacaacgagtttctccgggtaagccgctttgagcaaggcgactagtccaaattgtgccccgattgcatcgggatccggattcgtatgacgatagaccaagattcggtccattttcacaatcgattttgtgatggcagtaatgattgcactagttttcatttgcagtagccaaacttacgtaatgatgttccgccaagtaattcaatacttgttggacggaagcggtcagtggttgtttggacgtgtcaatcgtaatctcaggatcgataggtgcttcgtatggtgcatcgatgcctgtaaagcccgtgatttcaccacgacgcgccttcgcgtacaattgtttcacatctcgttgttcgcaaacttcaagcggcgtgtcgacgaacacttcaataaactcatcgacctcaaggttcgcccgcactttatcacggtcggtccgatatggtgaaatgaaagctgtcaacgtaatcacgccagcatcgacaaatagtttggcaacttcgccgattcggcgaatattttcttcacggtcttcagctgagaagcctaaattcttattcaagccaaagcgcatattatcgccgtctaaaacgtaactaccaacttgttggtcaaataatgctttttcaacggcattcgcaatcgtcgacttaccggaaccggacaggccagtaaaccataaaaccacactcttatgatggttcagcgcttgccgttcggccttgctaacttgcgattgatgccaagtaatattatctgattttaccatgcttagacctcctgttgctgttcacgtttacgcttcaacccatcaatgagaacccgggcaacttcgggacgtgaaacttcctttggtggtacaacaccatcagccagcatcttacgcaccttcgtcccgcttaatgagatgtgatcttcggcaccgtgtggacaagtcttctgcgttgccattgaaccacactttttgcagtagaaggaattatcgaatttgaagaagtgcatgcccatctcatcttcgaccgaagtgattaattcttgggcttcataggtcccgtaatagtcacccacaccagcatggtcacgaccgacgataaagtcagtacaaccatagtttttacgaacgattgcgtgtaagatggcttccttaggaccagcataccgcatcgcggctggataaatgaccaaccgaacacggtcttctggatagtaatacttcagaattgtcttatagctttccatccgaacgtctgctggaatatcatccgccttggtctcaccaaccaatggatttaagaataacccatcgacgttttccaaagctaatttttgaatatattcatgcgcccgatgaattggattccgtgtctggaacccaacgatccgcttccagccgaggtcatggaacatcttccgagtttctaatggttccatataataatcactaaaagcaccatgatctggcttatgcaacaatttaattgcgccacccaagtagacgtcaccattggcatacaagcgtttaacacctggatgggcttcgtcggtggtcttgtagacgttttgggcttccaattgcttgtccggaacaaacttatcttcaacttgcatcgtgccataaatgacgccgtcagcgcccttcaaagcaatcttagtattcaattcaatcttatcagcatccgcttgggacacacccagcgtaattggtacactccagataacgctactcttcaagtgcatcgtgttgaccactgaatggtaatcatcactgaccatgaagccagtcagggggctaaaaccaccaatcccaattaattccaagtctgagatattccaattattgatggttaaacttggcagctgctcagcagcctgacgcgttgcttcactaaaatcttctaaattaactaacttaccaccatgagctttaattccgtacactgtttgcatattgatcacctttcacgtttaaaatttcatcataattaagacttacaaaatggttcaatgcggcttgctgttgttcatcctgactcgcacgtcgacacaacgctgttaaagttgccgccacctcatccatgtctagcggggtccgcagcttgaacgtttcgtccggctgttcatctcgtaatggcgctgccttggtcggctcagcagcaataaaagccgtcaccgcactttgcgacgcaggggttcccagttcgtcagccatcaggaccaagtatggtggctgttcaaccgcgtgcaacgtccgtattaaatgttgaatcgctaatcggcgctcacgttcatcagtgatggccgttaagtcatctgcaatcaccacgttatgcgtatccgcacctaactcggcactgaccgtcgttaacatttcaacgatttcattgtttttagcatccccaatcccccataacgtctcgcgtttcgcgtttttacggagataattgttcagggcttccttttgctcgaccactaaatagtccaaggggtacgtctgaatggcaatcgtattattattcaaccgttcgctcaaatcttcagcaacctcatgactgtcagcttctgtgccgaccatcttgacttgatcatttcgtaaagtcgtgttgacctgatcaacttgggcctgatcttcgccgaatacaaagaacgttttactattgatcttgacgttaaagtcccgatataaagcgccatacttggctaaatactcgtcagtcatctcgtcgatgcgctgttgaaattcagccgaggcaaagtaatccgggtcagccgcagcttgacggcctagtaagtaaagtgccttaacatcggttttcacgtccgttcgagcttcaaaatcagctaaattttcaccgctatcactcttttggagtgctggatcgatgaagtcatcgatttgcgcttggagtgccgcctcgtcgctcgtccacggtaagttaaattgggtcgcgattcgtttcaacgtcgtcaacgtctgaccaaacaaatcttcgtacgtgactaaaatgcggtgctcacggtcggtatcacgtaatgaaagcaacgtccggacttgccactgacgcattgcgagcgtggtatcacggtgccaggcgcgctcattcgaattgaccacgtccatcggattacgtagcaagacgatctcagccggctgaacctcaacgtcagccaaaacacgttgccacaattcgatataatcattcatccgtgggtcttttatcgccagatactgttcattctcaaaaaaatttcgtagatacgtggttaacgccgcccggtcctttttaatcttcgggctatcatagtaacccttgaaggctggccggtaccggatgcgacttccaagtgacttgtgaatattgatgacatctttattttcaaaatagcctttcggattgatccgcttactaggtgccaacaggttatcagtcccgagagaaatgcccatcaaattaacacacttagtcattaccgatgttccggaacggccactcccaagaattaatacggcctgcttcgtttgttgacggtgattaaacaatcgttgccataagctttgactcattcttcatcatcctaatcattattatttatttgatctttggtacttcgctagtgggctcaccaaatatactagcaagttaattgtgaaaataagtactcttaactcgaaaaaaatatgatgatttcatgaaatttagtgcttttagcaagtacgcacccggtaatctgctgggtgtagattaggacatttccccacagttttgatgaaatattcaaattttaggactattaaaatccctttataccagtgcattgattaccaaagcacctgatttcactcaatatcgtcagcacccttaaccaacttaatcctcaattgaatgcttggcgcaacgcccctgttatgaagacctaaaatgtcaacccaaccatgtgggagctgcgtttcaaccctattcaccagttcaagcggtcggaatccgacaacggttgctggcaaatactagtggctgttcacaccacgtttcctacttgcctggctccaaatagcgtgtgcgtcacattacgccttgaatatgttcaaaagattaaaaaataatttgactaaattagaaattggtggtattttctaatcaatcataaaacatgtaaacgtcctgaagaggaaagtaatcatcgctacccgtgcagtgagtttggaatagtgcaaaccaaaccggaagacgattgatgaaaaatggcctccaaacggcaccactgagcttttgccaggtgatgacagttagctactgttaataagcttccgtatgaaacgtacggattgaggtcaatatcgtgaggtgttgacaaattaaggtggtaccgcgaacggcaacttcgtcctttaatcaggatgaggttgccgttttttcgtttaaaataatttgctaaatataaggagtgggttttaatgacaattattaatagtaacttggggtatccacgtttaggtgaacatcgtgaatggaagcacttattggaacacttttggaaaggacaattagacaacgtgacctttcacgccactgctaaaaaattacgcctagctaacttgaaaaagcaacgcgacctgggagtggactatattccggtcgctgacaattcggattacgatcacgttttagatacactagtcgcattcaacgcgattccaagtcgctttggtcacttcgatcaccagttggacttgcccgactactatgcaattgcccgtggaactgataccgccgtggcggccgaaatgacaaagtggttcaatatcaactatcactacattgttcctgaattcgatgacgtgtcctttaagttattagataatcgctggctacgctactaccaagaagctaagcaagaactaggcattgatggtaaaccagtcattctgggtcccatctctttccttaaactgggtaaacgtcacggacagtacttggatgacgccgccgtcaacgaactattaccgcagttattaccgctttaccaacaagtgtttgaagaattagcgacagctggcgcaaaatggattcaattggatgaaccgaccctagtcaaaacaacgacggttgcggaactcgcaccttatcaaactgcacttgaacatttgcatgcggctgtcccatccttaaaaatcgaactccaaacttattttgacagccttgatcagtacgaccaaatcgtgacctggccaatccaagcacttggactggacctagtacacgaccatggtgaaaacctggcgcacttggtcgaccacggcttcccaaccgacaaaattctcgcagctggcattattgatggacataacgtctgggctagtgatctacaagcaaaacttgcattagttcagcagttacggcaaatcgtgaccgatgatcagttatggctccaacccgccaactcattattacacgttcccattaccaccaaaaatgaaaccaaggctgaccccgtcttactgggcggcctggcctttgcggaccagaaattggcagaactgcataccttaaccgtggcagccaatcagggggttgccgctgttcaagcagtgttcgaccataatcaggccaacttgactgccctcaaccagtccagtcaccgcaacaaccagtcggttcgcgccgctgaagcgcaactgagtaatcaaaaattcgaacgccaggcaccatttgcgacccggattaagttacaacacgaccggttacacctacccttcctgccaacaacaacgattgggagctttccgcaaagtgcgcaagtccgagcaaaacgagcagcatggcgcaagggtaatttaaccgatgccgattaccaggcattcctgcatgctgaaaccaaacgatggatcaagctacaagaagacctcggcctcgacgtcctggttcacggtgaatttgaacgcactgacatggtcgaatactttggtcaaaaactgactggcttctatgcgacccaaaatggttgggtccaatcatacggttcacgaggcgtccggccacccgttatctttggggatgtcgcttacacggaaccaatcaccgttgctgagtccgtttacgcgcaaagtctaaccgaccagccggttaaaggcatgttgacagcaccactgaccattatcaactggagttttgttcgcgacgatatccctagggcgcaggttcaaaatcagattgctttggccctccggcaagaagttcaaaacttggaaaaagctggtattaagattattcaagttgatgaaccagcacttagggaaggtttgccactcaagcagcgccattggcaagcctatttggatgaagcagtgtactcatttaagatcaccacgaccggcgtgcaaaacgacactcagattcatacccatatgtgctactctaactttgccgatatcatcgataccatcaaagcccttgacgcagatgtcatttcgattgaaacgtcccgtagccatggggagattatcagtgcttttgaacaaaccgggtacgatcaagaaatcggtctgggggtctatgacattcacagtccacgcgtaccgagtgttgcggaaattgaagccaacatccaacgcgcattacgcgttatcgacgcccggcaattctggatcaatcctgactgtggtctcaaaacccggcaagaatcagaaaccctagcagccttaaagaacatgattgctgcgcgcaacgcgatccaggcccaattgaccactagcatccactaaggaggtggcttgaatgaagtttaaacaagcactccagcaacgggtcctcgttgccgatggcgcaatgggcacccttttatatggtaactatggcatcaattcggcttttgaaaacctgaatttgacgcatcccgacacgatcttacgcgttcaccgatcgtacattcgggctggtgccgatattattcaaaccaacacctacgctgcgaaccgcctaaagttgacccggtatgatttacaagaccaagtcaccaccatcaatcaggccgctgtgaaaattgcagcgaccgcacgggaacacgcggatcaccccgtttacattctgggaacgatcggtggactagccggcgataccgatgcaactgttcaacgggcgacaccagcaacgattgctgccagcgtgactgaacaacttaccgcccttctagccaccaaccagttagatggcatcttgctcgaaacatattatgatttgccagaactgctcgccgcgttaaaaatcgtgaaggcccatactgacttgcccgtcatcacgaatgtttcaatgttagcccccggcgtcttacgaaacggtacgagcttcactgatgccatcgtccaactcaacgctgccggcgccgacgtaatcggcatgaactgtcgcctgggaccttactatttagctcagtcatttgaaaacttggcgattccagctaacgttaaactagccgtttacccaaacgctggcttgcctggcactgatcaggacggtgcggtggtctacgatggtgaaccaagctatttcgaagaatatgccgaacgctttcgtcagctcggtctgaacattattggtggttgttgtgggaccacacctttgcataccagcgcaaccgtccgcggactaagtaatcgcagcatcgttgctcatgaccagccggctacaaaaccacagccaccaacgctcgtcacgacaaagagtcagcaccggtttctgcaaaaagttgcgacccaaaaaacggcgttagtcgaactcgatccaccccgcgattttgatacgactaaatttttccggggtgctgaacgattaaaagccgctggtgtcgatggcattacactgtctgacaattcgttagcaacggtccggattgctaatacgacgattgcggcgcagctcaagttgaactacggcatcacgccgatcgttcacttgacgacccgcgaccacaatctaatcggcttacaatcagagatcatgggtctacacagcctgggtattgaggacatcttagctatcactggcgatccggccaaactcggtgattttccgggagccacttcggtcagcgatgtgcgctccgttgaactgatgaagttgatcaagcaattcaatagcggcatcggaccaacgggtaagtcgcttaaagaagccagtgactttcgggtcgcaggcgcctttaatcctaacgcttatcgcacttccatatcgaccaagtcaatcagtcggaagttaagttatggttgtgactacattatcacccaacccgtgtatgatcttgcaaacgttgacgctttggcggatgctctagcggctaatcacgtgaatgtgccagtgttcgttggtgttatgccactcgtctcacggcgtaatgctgaatttctacaccatgaaatccatggcattcggattccagagcctatcttgacacgcatggcagaagccgaacagaccggaaacgaacgggcagtgggcattgctattgcaaaggaattgattgatggtatctgtgcgcgcttcaacggcgttcacatcgtcacaccgtttaaccgctttaaaacggtcattgaattagtcgattacatccaacagaaaaacttaattaaagtacaataaaagaaaccgccgccaacacctactttcatgctaaaattagacatgaattgtaaatgtggaggcggttttgtcatgtacttattagggcacattattggttggctatggctcatgctgacggttgcgattggtctcagtcgtcactcagtcaaatcagccaatcgctttttgattcttagtcgcatcgggtacctgctaattatcatcactggggtggccttggcaatcagaaccttatcaggcaactggtggttgaccttgctaaaagtgatactcggtcttggcacgattggcctcattgaagtggcctttgcccgcaagcaggaaagtcatttgaactctggacttgtcaccctactcgtctgcggcaccttactaacgattatttgtggcatcggcttgcactggcaattgacgggaaacttgatttaaaccatcaatgtcgttgaaattactgcctaacgatccaaagtgatgctatcaaaaaaaacaagtcgtccgttaggggacgacttgcttgcctgatgccaattaattgttacgatcactcaaacgtttcatgatttgctggcgcattcgcattttctggttgctttccataaaaatcagccgcgacgtcccatagttaaagagtcccacgagaacctggtcgatgattttaacaagtaggggtgcccagaacaacaacgaaatgccgacgaacatgaggaaagtatcgaaaaaatatgataagcctcgtgtcaacatgaaactaatgaactcgcgacaccagtgccaaaagtcttgcgatttggactgaaagaccaccgctttgttggtaaaaaaactaaacaaagttgctagcacccatgcgattgtgttggaaaataaatagtgttccgccaagactgagtgtagcacccagaataccaagacgttcaccagcgcggccataaagccaaacagtgcgtatttccaaaaatattgatattgatggtagattttaatcaaccactgcacgccgttcgccaccgtttcttctagctcaaaaatattatacaatagcaatatcataccttgttatcggccccctgacaagctcagccgttaaattggcgcttagtgggctggtcgcttatacttaaactaatctgcaattctttttggagtgaattatttatgagaacttatttatttattgccgggctgatcttagcctgtctaattttaatcattatcttaattgcggtgttagtccatctccaccatgtcaatcaggcggcggataaacaggccgcgttgcttaaatcaattcggcagcgcctcgttcatcaaactttgaccaatcaggaacaagaccgtcaaattaccaagttgcagactcaaaataacggttttcggaatcgcttgaatcaagccgttccccatccggtggcggttcctcagacgcgccggatcaacgctaattcgcgtgcaattttccgctcatacgtcattggtttagattactaccaaaaagaatttgaagccgcgctggccgatgcgagtgcccgaggttactttaaaccttatggtggctataatgattctggtctgaaagcagattatctctatgccaagaagtaccgtgtcgacgctaacgctaacatcggtgaaattcagttagttgaagaagttgatggtgctgagcgatccgtacgggttgaactaaaagttgcggagcatggctataccatcggctatctgccgaaaaagcaggtcgacgaagccttcaacgtgatcgacatttacgctaactcggtcatgaccctctcctccaaaactaatttaactggtggtgaatggaagatggcgatcgatgctgtcgatgaaatgcagtacctgaatgatcccaacgctcaaaatcgggcccttcccgattacggtgccattgacacccccttaaaaatcaagaccggtaaaaagtcctacttcctccaattcaccttatatgaaatggaaatcagcaatgatgagattccattgtatagtttagtcgacacagtcgacggtcaacgtggctcgattgttgaagtcgatgctggtccgatctcatatgtgatcgacgtccaagctgggccacagactgggtccaagattacggtcattcctgaacaaattgaccgcgtcatttgggtccctaactggaaataggtcaatcaccgttatcaagtgaggttattttaatgaaaaaattaatcttagtgatcctgttacttctgtcaatcggtgtgatgaccatcgttgattcgaacatcatccgacaagccccttatccgagcttgtcccaagaacaaacgaaataaggaggtccgaacgtgacccgggcaattttaatcagtttctgcgccctattccttttagcaggctgcacttcccaagctgagccaagtatttccactaagcaagcgaactcagttgcagccgctaaccgcgcggagcaaactagtcgtgccaatgcagcggctgatgctagtgctaagaagcaatctggtgaccattatcaagctgctgacgaccatatcactagcgcaactagtgcagtggccgccgtcgggcaagtgctcaacgatcccaagcaacaaacctttggtgtcgtaccaactgccaatcaagatgcacacggccaccactattatcaggtcgatgcttatcagaaaacggctaatggcggccgggggcattatctgaatagttactttgtttatttagatggtagtatcacgaccaaacaagcaaattaataaaccgacaagttgtcacccattcaagcagtgtcgttgaacctgctgggatgggtgactttttggatgcattttttgccggtagtaatttcagtatttcggcgtacagttattccatgctaattaaggccagccccagtaactaagcaaccaatttgcaattacaattaatatcaactgcataaatatagaaaaaggtttatttttttgttacttttcgctataatggatattgttgttaaagcaactgccccagtggcggaactggcagacgcgcagcgttcaggtcgctgtattggaaacaatgtacaggttcgaatcctgcctggggcataattagtctatgagcaataaaagagccacggtaaacacttatttactgggctcttttattttgtgaattttaacaaagtagtgcctttgcaaagatttttacgcatttcttcaataaggatgaattcataataattttgctcaaccgataagtgctggtccacctcacctatccgttagacacactaaccacggcaaacgggccgtagctcccattgttaggggaactatggccttttactaacggttaaataattgttggtcacagtagaaccttcaccaacgcttcagaaactgaggcgattaatttctgaaaatccacaaaaagtcctatgcaacccacgattttagtgtatactagatatgttgacgaaaagttaacgtgatggcggtagtggcgaagtggttaacgcaccggattgtggctccggcacgcgtgggttcgattcccacctaccgcccttctaaaaaagcacgtgcaattgcacgtgctttttatttaatcaaattttctaatcacgccttcagccaagccttcaaagcggctccagtgcgtgaagtgggcacgtcaactgctgctcgtggggttccgctatactgaattcggccgccatactgaccagcatccggccccacatcgatcaaccaatcggcctggctaattaccgccagattatgttcgataataatcaacgagttaccagcggccactaaggcatcgaataattttaataagcgttgtgtgtcttgcaaatgcagaccggcagtcggttcatctaacaagtacaccgttccctgcttgcctagctcaaccgccagcttcaaccgttgcagttcaccacccgacaaagtggtgagcagttgcgccaatgttaggtaacccaaaccgacccggtctaaattcttcaatggctgagccactttgtccatcgtggcaaaaaaagctaacgccgctgtgactgacatctggagcacgtcggcaatcgtcttaccctggtaagcatagctgagcgccgtttcattataccgcagcccatgacacaattcacatgtctgcacaacgggatccataaaggccatattcgtgatggtcacgcctttacccttacaccgcggacaagcacccttaccattatagctgaaccaactagttgccacgccattggctttcgcgaatagttgtcggatttggtcgagcactcctaagtaagtcgccggtgttgagcgaatattcaggcccactggtgtctgggctaaatcaatataagccgtctttaattgccgttttagcgcggtaaccagcgaactcttccctgaaccggccacccccgagacgaccgtcatcacaccgaggggcatgtcgacactgacatcgtgcaggttattttcattaatatggtgtaatgccaagtgggcctggactggtcgttcttgaccccatttatgcggttgtcgcaaccaccggcccgtcaacgtatcagaagccagtaactcgtcataagtcccggtaaaggtcacgtttccaccagtgcgaccagctgcaggccccatctcgacaacatagtcggctaacgtaaacatggctggattgtgttcaacaatcagaattgtgttacccttatccttcagcttcgttaacgcttgcttgattaactgaatatcatgtgggtgcagcccaacgcttggctcgtccaaaatgtagaccatatctactaaggcgctggtcaagtatttggcaatcttaatccgttgcgcttcaccaccagataaagaactggtcccacgatccaatgtcagatagcccaggccaatatcgaccaacgattggatcttggtcgtcagctcccgcacaatatcttgggctaacggcgcatcaatcgcttgtaaaaatgccagaacatgctttaaatccatagccgtcacctgagcaatgttgaccccgttaatatgattggtcaacacgaccggtttgagtcgtgtgccatcacacgttgggcacggtttgcgcgtgacgatcgccgcaatcgcatcgcgatggtgttcggcttccttcttaccaataatcgagcgcttgatccgcggaacaacaccttcatacagggccgttctaggaaaaccttctccaggatgggctaatttctgttgcggtgcgtgcatcagtaaatcgtattccgcagcactataatccttgatgggtttatcattgtcaaacaaaccactcgtcgcataacggcgccaacgccacgtatccggtgcaaaactcacaaacgtgatggccccctcatttaatgatttctcaggatcaatcaattgctgctcatcaatatcgtcaacataacctaaaccttggcaggttgggcacatgccttggggtaagttaaacgaaaaactgtccgaatacccgataaacggttccccaacccgtgaaaacaagagccgcagtaacgaataaatcccagtataggttgccaaggttgaacgcgcattcttgccgaggcgttgttgagcaatcacaatcgcaacgggcaagtgctcgatatgcccgacgtgtggttgaccatacttcggtaaatattgttgcgtaaaactgggaaacgtttcattcagttcgcgccgtgacgccgctgcaatcgtatcaaaaacgagtgacgacttaccggaacctgacaagcccacgaacaccgtggttgcatatttaggaacgcgaagactaacgtgctttaaattgttttgggtagcgtcgtatacgtcaatggcgccatgtggaaatgaataactggtcatcaaaccttcctttctatcacttgtttgctatcaaaaaaggacctgaaaattcagatcctaagtatcagactgattcatcaacgagcttgacgaccgtcccatagccggttacgatcaaaaatcgtggtgcaacactcatctgagcgacttcagtattgaagttcacataaattaacccgtcgccaccttgatcctctgccttttgtagcagtagtggcttgacttgtttgattaaatcgtcaaaccgttcaaactgatcaacaccatcagattcaaacatcaggtgttttgtgacggagacgacgcccttaatcatatgggagcgctgtaaatcaccagttgtcataaacatttttccaaccccctatcactttaattttacttgaaaacgacgtcactcgcaaacgtaaccaattatttgaccacaagtttttaaaggactaaattaatcgtagggagtgatagtttgaaaacagcaacacaacttttacaacaatatacctttgagcccgttaaggataaaatgcgggtcgaacaacacgccttagccgtccaacatcaggatcgcgccattccattcggacacttcaagatccggttgaaaaatattgataatcaacaaacttatttattggaattaaagcaagcgttacagttgaccaccacgtctgggttccagttacgttcccgactacacggggtgcatgtcaaacatgcacaacacatgatgccgaccggttatcacgtattggcatcactgacgattaaggccgccccacgtgacgctcatgaatttgtacatgacaaaacaaaaatcgcctgcctgattccagttggtgatcacgcggccaaaacattgccagcacaagttccactttatgcgttcacggacaaccatcaacttgccatcaatcagcaggccatggcccagttattcctgacatgcattaagtcccaacaacgccaacaggtcaattaattaacccgcttttataaataaatcgttcgaaaacaatgtatttgcgcaatattaattgcatttggcgaattaattgcgtacaatgtactaaaatagatagtaaaggaggcggtttgatggcaaccccaacaaaaaacattttgctcgacgaacagctctgttttgcgctctacaccgccagcaaacgatataatcatttttattccgaagctttagcacctttcaagctgacttatccgcagtacatcactttattggcactctgggaaaagagtccgatgacggtccgggaacttggttcacacgttaaccttgatagcgggactctgaccccgttattgaaacggatgcaaacccaaggctgggtcgaacgcaagcgcgatacggacgatgaacgccaagtcaacatctcgttgtcgcaaaaagccatcgatgctaaaccagagatttttgcccacgttaattcttgcatggatttacttggtttagatgaagcaacctataaccagattcgcgaaacggttaactttgcttccgaacacatcaaaaatgccgatcctaaaaaggtcgactattctggcgaagcattctaactgactgcttaactaggtcgaggtttttctaacctcggccttttttgttgcgattaaaccaattgatttttgacactagcgtcactttgttttgagactagcccgttcaaggctaatatgaacgatcgttagctagcaccgatcaaataattatgggtgtttgcagccacattaattccgcaaaaaataaatcaaatgataaaacccagttgaatttgatagtttagaccgctaaaaataatttaagtatgtattaagggacgattttttgcaggtactgtattcggtgactttggggacgtgcaacaaaaaaatgactctaccgcttagtagcagtagggccaaagagttaggtttaagtacaatatgggggattgtacttgctcgtccatccactttgggggagtaaaatgaacaagtgtataactattaggtacaagtatatactattacataattgtgaagaaagtgtgaagatttgtccgaattatgcttttttattctttatttttatagagcatcaaccattatttctacaattattatatttttagcattcaaccagattaatatcatccgcttgtgcctggcatcgatgcctttctcagatttgcaaatccgtgtcgaaacctgaacactgcggtaaaatcaaccatgggaggtgaagtccgatggaaattattgaccgcggcttggggtggctcggacgcgtgttgctcactgctggcctaattgttggggtcgtgatcccaccaatgttacttaaattaattaaccaattatatcgccagcatcagctcacagcctggcagatcaccctggcaggtgtctatctgttaatttttgtgatcctagcactggcggcaaccgccctaatgcggcactataccggcaactatcaatcagaaaacttacaataccatgactggcaaattattggaatggcctatctcaccatcttaatttttgagggcggctttcaatttataaaccagcttctgtatcaccagaatcaaacacaaaataacgccgccattaaaaatttaatggccggcagtcctctgtcgctttggcttatggcgttgagcgccgtttttttgactccaattgttgaagagttagtttttcgtggcgttctgactaaccttttctttcaacaagaatggctcaaggtcgggctcagcgggattgttttcggtagcctccatagtagttcaaccttaccgagcttcctcatatacgtcaccatgggactcgtgctagctattgtttatcggctgacccgtaaaattcgcgcggccattgcgctccactttgtgatcaatagcctagcaattaccatcatgttactgcattgacgaccttcacgcacaacttcgtcacggcactggccaccctaacttttataactcccctgccagactaataacacgtcaaaaatcaaaaatagcacattaaaatgtaatagccaccaattcatcaggcctttctcacgcaccattcccagaattgccaagccaatgccaataacgggaatcaaacctccttgtaacaaccgataaatcggcaagtaggcccattctgatagcaggattggtcccgttaactgacccaataaaataaacaacaaaaataccccgatattcaacaatgagcaggcaaacgccgtctcggtaatggtgcccatcgcgaggcgaaagtgaaattgaaatcgtaaaaccagtgtcccgatgattccaatcaccaaaataatgccaaccactaacatacagccacgactccttttcttgtcattgttactgtacgctaaaatcaacaatgcgcctagcgcaaaactagaagcttaatgattttttagcaaccccgtaacgcgactaacaactaaataaattcgagtagttcaccgtagcttttatatggcacgctgtcctagtcattaaccatcaaaaaagagccggcaacttgcccgctcacccatctaactctttgtcccggttggtactgttagtactttggcttttagccccacgactttaattgtaatccgcttatgaactggcattttaacatagaattgaccactctgcttatttgaaataacctgacggacatgtttcccactctttaaggtgacaatgacaccgtgcttggtacggccactgattgttgcagaggtagcattttgatggtaaaccacctttgacacagtgagccgatgaattcgtcgatgataatcaccttgcaagctgtattccgaaccaaatattaacaaacaaccggccaaaatcattaagattagtgaccagaactgcttcatgacgccacctccagaccagctcccacagctggcatttaatagtctaagcatacatgcaaattaatctaaaaagccaaaaaaggtgcaaagctcataatagcctgcaccaacgtcattaaaattcacttttgattaacgattttgttacattagagtcttaagcgaagctagctaaacgtgactgccagttcggaacgcttgattaatgcgattaaatcatgcattttacgaatcgcaatatcgaccgactcgccattttcaaagtagccaagctgatgttgcttatcaattcgtactagcatttgcgggttcaccaagaaactcttatgaacccggaataactctgggtgggccacggtttcatcactaatcttaccattgtattgaacaattcgatctgttaaatggagaaccagcttattacgaactgctccagtctcgataaataacacctgatctaatggaacattgaagagctgaccacccttagagtaagaaaacatggccttgctggtgactgcttgcttggtataacgttcataagcaacccgaatatctgtctccactttggctttgaccgtttcttgacccaaatctttcacaataaagtccagtggttcgattcgtcgttcaaaggtcaaaaaggccatttcagaatgggtcgacacgaagacaatccgcgcattaacatccgcctcgcgaattcgagtcgccagtgctaggccatttaagtcttgcccaggatattcaatatctaaaaagtagagtccctcaagatcggaattggtctcgacatagtccaacaacgtttgtgcttgtccggttgctaaggtcagttccatatcaaaatcattaatcataatatgattcttaatgatttgctttaaggttgctaattgttcaggatcgtcttccacaacaaaggtctttaacacgctgctcactcactttcaatactaataataaattcgaatcgttgatgggagctcacttcataagtcacgttagctaatggatctaacaactcacgaacggttgctaacccttgcccatgaccagcacctttcgaagtatgcccagcaaccatcagctcatccaggcgctcaatcggatgattcaatgaattggcaaaaatcaactccaccatgcggggatacttaacaagtgcgaccgcaatctgaccaccactctgacccttcaccgcttcgatggcattgtctaacaagatgccactcacccgtgataacgtcactgaatcaattgcaattgccgcaatcgggtcgttggcttccaagcgtacttgaattccagcttggcgcgcaacggaaaacttactctgaataatggctttcaatggtttgtccttgatttgttctaaattgtcaaagtgtccaaaatcacgatttagactttgcttagacttggtcacaacttgacgaaaatattgttgtaattcaggatcatcagctgtctgaatatactcacccaaggacagtaagatgttttgataatcatggcgaaacttacgtaaattttgataactattttccaaatttttgacataaatatcatattgttgccgttccaaaacttgccggttattttgaacccgcaatgtataactatagaacaggtaaagaaacgttccggcgttgatcagcaagatagccactagaatcaacattagaatccccaaaaatcctgagccaatattataattatccgccgcagtcgtgatggtaaaaaacgcgaccgcaactacagccaaagcactgacaatcacgttcaacgttagcccgtctacaaattgccgcggataacgcttctttaagaccttgaaactagcggcgactgccaacatacaagctgtgacaattgtttcaccgatggcttcaaatagccagccactccagtcattcaaacccaagttaaataagtgaaaaatcgactccgtcgcataattgccaaagaaactaaaaagaatgtaggcgagtgtggccgttagactcgtcacaataaagtactttttgcgccgtacaaacgccagtaaccccatgttcacaatgaacgtgatgatatccaaatagtcgtcatacaacatgtagatcacagttagaagtacggtcataaccgcaacagtcgcatagactcgcttctgtcgaagctcacgattgattaatatctgcagtaaaaaaaccaacatgaccgagtaccaatggtcaaaagctgcaatataccaatagacgtaaacgataactgctcccctccccgcatgatgctcaatactaccattgtagcgaaatacggccagtttgtatatttgtgcgataaaaacttaacaatctttaccaaatcgctgactgaccaattaatacccgtaaccgtctccaaagcttgctatacacgcctttattgtcttaaaagacacacatgatcgacggtataaaaaaagcgacccccgttcattaacggtgccgctcacagatcattattagtgaaaatcacccggcataaaactctcgataaccgcggttgtattaaaggtttcaaaactatggaaactggcttcatcaatttcagcgtagcgaatagcaatttgtgggcgctttgcaagatcgaacatatcaacgtaattaaattcaatatatttcttatgttcactatgaataaagccagcatagctgtcaccatgttttttgattcgaccagatagctgaatcacttgatcgtggtgaaaagcttgcttcaacaatgtttttaagagcgaatgtttagtcttattctgcttcttcagcagcttattcatcaatcgttcagtgttccaaacatcataatagccccgttgcttagccagcgcaatgatcgtcgccatgctcttcaaataatcagtgtcactaattacgcgggctaacgatgccttacgaaagaccactaacccatctagttcaccatcgacattaacggcttggaccagcacaaacttctcatcctgctgaatcacatagccaacactaaattgctcattggttcccttggaatagatttcaacgaggttggtattcttaatcgctttagctaaatcgtcgcgaatcgcactcatgcgtgttcccccattcagtaatttgtaacaaataatttatttcatactaccacattttcaattatcatgataccacttgtaaaagttgaacgccaaatggcaactttcattttctaaataaaatttgtactataaaataaacttgttaataacctctgctaacgcgtcatggttgttatcagcgaccgtcacgtacttagctgcggccttgactgcatcgataccattggcgacactcacaggcaatccgaccgccttcagcatggggagatcattgctgttatcgccagctgcaataatttcatccgccgtaattcccagtagctttcctaattgaaccgctgcggtccccttgtcaacgccagccggattaaactcaacgtaacggtcggacgaataagtgacggctaatttgcttggatcaacaatagcttcaacgtctgcgcgcatttgcttgcggtcagtcatcgttggcaaggccataataatcttcatgacgttcatcgttttgaattgttcaaagtccggcgtcgtcatagttgtgaacgtcacgccccggttttgtagataatctgaatcacttggaaccggattgtaaatatataacgtatcctgcgtgtacacatgcgtcgccgcctgctgattcgcaattcccgcttcaaacacccctttagcaacctcatatggcatggcattcaccgccaatggccgattatccttattctctaaaatcaaaccaccattataagaaatcgaatattgatgtggttggtcccgcaaccccatcgtctccaaatcgttctgaaacgaggtataactacgaccagaattcggcacaaaataaacacccttagccgccgcagcttgaattgccgccgcattcttttctgacaacgtaccattgtcattcatcagggtctcatccaagtcacaaacaatcattttatacatattaaagttccctctcatccgcttgaccatctgaaacttggtcattttaggtttactattccactctagcgaaagacgtgcggaaatgcaaccgctttatttttgcgttgaaatctcaatgtttatccatacatacgcgcagtttttagcacagcgtgcaattataggtgctacagccatttgtgaaatttaacttagtcgtttgttaagacatttcaaaaatgcgacctgctaagaatcaatttctaaaactgaaacaatcaattactgtgctcaatgacccaactttcaaaaaacaatagctttatatgattacgaaaaggtaatcgcagtaccgatgttttaattggcagtatttcttcaatatgttgttaaagccagtacttttgatattattgattgcttatcattccctactgattaggcatcgtacattgacagggtttgctgggaacaggtgccgtgatatggtgaggtaaattcagtatcataattgcacccacaaccaatataataccaaccaaggcctgaggaaccaagatttggtgcaagaataacatgccaaaaagtacggaacttattggttcaaatagtccagtcatagttgccagaaatccgtctattagctttaaactttctaaataaagatcatacgcaacaacggtggctagaataacaatgataagaaccgctaaaagctgcgtttttgaaaatctaactaaatttggtaacggtgtgtgaatcaacgctatcacaccgccaataactagtgcccatcccaaaatatccactgcggcaatttggtttaacaatggaacaggtagtttggtgtataagataaccccgatagccgcaatcaggccaaaaataattgcttccggttttattaatccggtcttaaatccggattcaacaataagccagattcccatcaatgcgcttattaagctcattcctgctaataaactgggaagtcttttcgctttcagcgcggtaaatacaagcagaataaacggactagtggactgaaagacagttgcaactgctgcattactgtaattaatcgcagaaaaaaaggcaatttgtgccgtgcacaagccggcgatgccgtatatcataattcgtgttaaaattcgccaatgtgtccaaatctttttcgtgctttttctagcctgcttgaaaaacaagttacgatatagcaacaacattgccccaccgattaacagccgtaacaatacaatctgttgcggagtcagaacttgctcacttaacaaaggctgtgctagtattccacctagcccaaataaagcggcactaataataccgcacagagttccaactaaacgcttcatacaaaagtttctcctctataatagttcaccattagaaatagcaacactttgattgtggtagtcatcattaaataaggcattggctgctgccctagcaaacgtatctcgattaattgcaaattcagactccggtatcgctctaaattcaggaccgtgcgtaataatttttgtttcgggtccattctgaattagtcctggtctaaagattgtaaagggaataccactatttgcaaataacaacggtttgtctaactgatcatgggtatactgaggatgttgcgtgcgaacagccgataaatagggtaaattaccagacaaatattcaccgtaaataccgcctgccgaaatatcgactattcgtttaattgttgcctgtgtttccttaattgcacgtaacaataacttaacgtacggaccagtgctcagcccaccaacggaatcataaatataatcgacatcctcgagtgccgctacataatcagtatatttcgctgcatctcccagaaaaataacatgttctcgtttctgataggccgggacctttttgcgattacgaacaaataattttaaagtcatttctggataatcacgttccattaatttaatgaaggcctgggcagttggcgaagttgcaccaataactaaaactgtattcatcgttcatcggactccttttccatttgctgatatgttttaataaacccgttcatgaatgcgacctgtttcttaagttcagcctgttttttctctaattctttcagatgatgttcaacaatcgcttgacgcttttccgctgttgcttgcttgccttgaacaactaaatcagttagttgacgaatatccttcaacggcatttcggaatcaataaaaatcttcaaatttttcatccaaatcagattcttttccgtaaaaacacgatacccattctcagatcgtcttagattaggaattaggcccaggcgatcatagtaatggacctgagagacactcatcccaactaatactgaaatctcttgggttgtatatttggcgacttcatcatccaattttagttcctccttttttcgcatgcgattcattataaactatcaaccacacttcatagcaagcttttccaatcaaattggacttgggtgaataatacccacaataatagccgccatttttgacgtcggccaaacggtgcttataactaagatgcaactaacgatcacatcaatatcatctggttgcatttcttgttagagtagcttacgacagggtgatagaaaacaaatcataacattatgtgctaccaaagcaccgtgctaaaatcaaatcagccaaaatgcaagtacgtgctaatactcggcaaataagccagttaaggagacaccatgaaaacaaaacctgaagccttaatgcgcgacttatacaatttaatcatcaacccggcgacgcgtgactgggaacgccatttactagtccaggccaagaataatcggcaacagctatcgccgactgggcaactaaaacagctcgaagctgatttgcgaccattagctatgcggaataacttgaccccggatgttatggacttttatcttgccatcactggcaacgcacccatgccgactaaaaacaatgtatcggcttacccaccccttagttcgccttatgaagaacgggcagtctttgctggtgggtgcttttggtgcatggttgagccctttgatcagcgtcccggtattaataatgtgatttctggttataccggtggttcgtgggcccaaccgacctatgaacaagttagtggtcaatatacggggcacgttgaagccgtggaaatcagatacgattcccgtaaaatctcgtatcaaaatcttgtcgatatttattggcaactaattgatccgaccgaccgctttggacaaatcaatgatcgcggtagccaataccggccagtcattttttatgctaatcaacatcaattgaccattgcacaagcatccaaacaagcgcttgtggactcgcaacgttatcaaaaaccaattgtcgtggccattgagcccttacagcaattttggccagcagaaaattatcatcaggatttttaccgcaaacaaccccggcgctaccgacaactgaaaaaagcccatgatcactatctaaattggttgaaattcaaaaacaaattctagcttggcggttcagtcacaacttatgactttgcctgcttctggaatcaattggtcaagcactaatcgctgtgccatacttaattgttatggaggcgcataaacatgcggcaaaaatcgcaatgggccctaatcagcttgtggctgattttattaggaagtttcatccacatgggcttaacagtgatgccagtaattgcttataatcacccacagagaccgtttggttggccatttctgatattgctattattatcaattgaccaagtgttttatgaccacttgatcaatctcgttagtcattcaatcatcaaacattaattttaaaaaacaggatattgacccgccatacgaatgccggccgtccattgtcctgtttttattgcggtattttgcatcatgtcagctgtcattttgacataacggtcttaatcaggacaaaccacaactgcctacttcgatatggtatattgttactgtctacatcagatttgccaatttgtttgagtgatatggcctttttctaaccacctcactcagacactaaaaacaacgaggttctcaccatgcaaacaattcagttaagcaacatctttaaacaacaagcacaccaaacgattttaaaagatttcacactcaccattccagcgcaaagtaacatcggcattcagatgagccacgttgaggcaacgaccctctttaacctattacgccaaacgacaccccaaactagtggcgtgatgactggcctcactcccgcacgtatccaagccatctttcatgatgacggcttttatccgcaattaacagtctcgacttatttgaagacctttcaacacatcagcacctttgagacggacctggatgacattttgcagtatttcgcactcaaagacgtcgcccatactaagatcaagcacttatcctttgatcaacaacaacgtctggccttactgcgggcgttcatcctacaaccggacttgttactaattgaaagtcccctgaccaacttgaccaacgctggcattgagctgtacttagcagccttagcctatactcgcgaacacggcgtcaccgtactgctgacctcctactcattagaagaacttgtcctaaccagtacgactatcttccgctatcgaccaaaccagggcctcgagttgactgatttggcgaccgaaagcagttccgattccgcacacacttcagaagatacacctagaccaatttttaaaattgcaagtaaggttgaagataaaacagtctttttcagccccaacgagatcgattttattgaaagtgtcaacggggtcagtcaactgaacgtcagtggcgaacaattcacgtcatcgcaaacaatgagcgaattagaacaacaattgacgacgctcggcttcttccgctgtcatcgttcttacttggttaatttacaacaaatcgcggaactaatcagttactcccgaaatagttacacgttaatcttgaaaaacaaaagtaaactgcccctctctcgcggtaaactcactgatttaaaagctttgatcaatttttaggacaccattcagcctaaataatgcaccattcggccccaatatgccccattacaccttgatttaatcacattcgacgattgttccagtaaactagattttgtagaagccactacgcttccaaatcaaatttaaaggagtcagcgatcaacgatgacaataaaaaatgcaatcgaagtgattaacattgccaaatcatttcaaaatacgaccgcgctggaccaagttagttttaccgtccaaccaggtgaaatttttggctttttaggtccctcgggatcgggaaaaacaaccaccattaaaattctaaccggacaattattaccaacgaacggtgaagcctacgtcctgggtcagtctgtccaagcatacgacgaacaccgctatgaaaaaatcggcatcgtcacgcatcaaagtgggctttacgacaaattatcggtataccaaaacctactattcttcgcgaaaatgtttggtgtcccggttgcacgtgttgataagttacttgaacgagttggtctcagtcaacataagaaaaaactcgctggtaagttatctcaaggtatgcgtcaacggctagttctggcccgagcaattcttcaccaaccgcaagtcttgttcctcgatgagccaaccagtggtttagatccccgcacgacccaagcaattcacgcactgattagggaattacgcgaccagggtacagcgattctgctaacgactcatgatatgctggaagccactcgtctctgcaatcgtgtcgccttactcaacgctggccgcatcgcagaatgtgcagccccacaagcattgcaattaaaatataatcgcgaccagcagtatcgcgtccacattgcatcggcagcgcaagatttgttactccccgcatctcctgagacgacctatcagattaatcagtggatgctttctgggcaacttgagacgattcactcgtgcgagccgacccttgaagatgtctttttaaccgtaactggaaggagcctaaaatgagtttatcagtaaccaaaataaaagccttattcggtcttaaattaagactgatcatttcaaatatgagtctaatgactgccccaatcatggccattttgtacgtcgttttcattaagagtattatgcaaagtaaagcaccatcacacgtcgccctgatttccctattactgggaatgggactatgctttaatatcgttatgggtggcatcatgatgacgagttatcccttagccgaagaaaaagaacaccatacgttacgtgtcctaatgacctcttccattaccgggcccgaattttttatcggtagtttattgccaccactagctattatgactgtaaccaatttgatactggtccccctaagcggcgccagttggtcgcaaattcacttaggaaactttttattgattactattatcactagtttaacgagtctcgtgctcggatacattattggtctgattgctaatagtcaaactcaagcaggcgtctacagtattccaatgatgctgattttaagcctgataccgaatttcgaacagttcaataccacccttaaatcctttagcagttatctgtatagcagcacgcttaatcactatattaccgcctcgtataccactggtggcttttcatggacgcttcgtgaggtactgacgcaactcggatggctcgtgattacctgtggcatcttcttctatgcctaccgtcgtcacggccttgataatgactaaaatttaggaggttttcaatcatgtcaactttaaaaatcggaacgaccgtcaagttaccaaaaccatatttgggaattgtgggaacgatcattgcctactacgcagctaaagatcaatacttagttcggtttggtgttagccaacaactctacttcaaaccagatgaactaattgtctggaaatcttaactgcttatctcataccaagccccttactttgaaatatcatggtaaggggcttcttttccacgttcggacaatcccgcagccgaatcgacgttggctatgttatagcaattgccgctcaacctagaaggtgtatgtaggacgcacatttactgatgaccagtaacctaactaacacatttttatcataattgatgacagctcaattcatgctatgtatacccataatatttttaaaatcataacttacccttaattttaaaccccacttgcactcaaaatggggtttaaaccccacatgctgtcttgatgatgtggtgctatttctgaaacctgttatcctctttaatgcacacacggggtttcatacaaaatagacaattaagggagcgcaagtaaagatgattaaagcagaatgggcgtatatgcgcaaacacaaactaatgattatcgtcatggcaatcattatgttcattccatcaatttatgccgtgacatttttacgatcaatgtgggatccatacggtcggttaaataatttacctgtagccgtcgtcaatcatgatcagccagtcacgtaccaagggaagcatctcagtgttgggcgcaatttaacaacgaatttaaaaaaatctagcgctttgaagtttcaacaagtcaacgcaagtcaggcacaagctggcttgaaaaatggtcgctattatatggtgctcacgattccaaccaatttttcgcgccacgcgaccaccttactcaatcaccaaccacaagccatggtgctacattatgatacaagtgctggacataacttcgtcgctagcaagatggccgattcagcggtcacttcgattcgatcatccgtcgcccaaacgattacaacgagctatgccaaaacgatgtttgccgctatcaaacaacttgacagtggcctcaaaacagctgctactaataatcaaaagctagccaccggtggtcagcagctccaaactgccaaccaaaaaatcgccaccaacctggacacccttgcaactagttcgctgaaactaaaacaagggagtcaaacactgacggtcggtttaaaccaatatcttaatggcatttcacaactacaggtgggtaaccaaaaagtagttgccggtctaacacaactgctcgtcaaaagtaatcagttagttgctggcatggctcaactcaacactggggttcaaactttaaatcaaggtgttgatcaatacgttgctggcgcccagcgagtgaatactgggactgtcaaagtcaatactggtgcccaccaggtggccagtggcacgcaacaattcagtagtggtaccgctcaactggcgactggtacgcaacaacttagttccggtttaaacgcttatgtgaccggtgtcggcaaggtcaacactggtgccagcaagcttagtcaaggtgctaatcaactacaagcacagaccgctcagttaacggctaaaacgacggccctaacgagcgactcaagtcagctaactactggcatccagacactaggtcagaacagtcagtccctcaccatcgacttgcaaaaattgcagacgcaacttaagcaaccaaccaacaatcaagccacgattagcgcaaccgtggcagcgctgaaaaagcaggctgctggtaccgacttatcgtccgttaaaaccgcgctaagtgcgctgacatcggctattaaaactagtgcggcgcttcacgacaatgtcgccgcaaccgctaacagtcaaaatttgactgcggcacaaaaatcagccattttggcaacggttgatcaatccgctaaccgtgacgccatcaacgccgcccttgcgagtttaaccacggccatcgcccagtcgacgcaaccggctctagatacgactgctttgactagggccctcagcgccacgactcaacagcaggctgaccttgtctccacggtcacccaactcactaccggtgcgcaatcactgacgaccggtattcaatctgctggtaacgcggctaacaaactgaggactagtctaacccagctgaacacggtcctacctaatctcactaatggcattggggccgtcactactggtgcgacaaacttggctagcggaacaacaatgctcacaactaatagccagcaactcacccaaggctttaaaacactggatgctaacaccaacttgctcaatcagagaagtcaccaactggctacgggtgcgggacaagttgctgcgggttctcaacagctgaccgcgggcacgcgtcaactcagcacccagggcaaccagctaacacaaggtgccagccgcgtggctacgggtcttcaaactgcacagaccaacctacccagcttaacaactggcatctcacagttagttacgggcagtcaacaagtcaccaccggcttacatcaactcggcacaacgggtattgcactcgttaatgggagtcagcaactcactagtggcaatggccaattagccaccggggctcaacaactagccgtgggtgctaaccaagttacaaccgctggtaataagattcaaactggtaaccaagcattagcgaccaaattaggaacggccgcaagcaaggggaatctcaatccatcaaaactgacgtatcaacaagttgccaaacccgtcactacaactcaccaggaccgtgatgatgtaccaaacaacggtactggtatggcgccgtatatgttaagtgtctcgttatttgtcggcgcgctcgccctcaatatgatgtttgatatgtataccccacgcaaacacccgcaatcggcactggattggtggagtagcaaggccagcatcatgctcgtcttttcaatcatggaaagtacgattatgctcggcttgatgatgttaatcaacggactcagcccgattcatccgtttgccacttggttgttactcacgctaacggcgctactcttcatgacgatcgtcgcttggcttaaccttgtcttcggcaaagctggcgccttcttcagtatggtactactagtcttacagctcggtggttcagccggaacgtatccaattcagctgtcaggtcactttttccaaacaatccacccgtggttaccaatgagttacagcgtcaacggcttgcggcagaccttaatgactggtaattctgctcttcctgagatgggcgtcttagcactgattctaatgctgtttattgctctgacctggttgttctttatccgtcgttaccctcggctggctcaaattgactttgaagaccccgttgccgtcaaagccactcagagtaagttagccacgttggttcggcgaaaggctcaagctaaagcatctgacaataagacgaattagttatttggatttatgatctcgaaacactgccaaaacgactttctctatatcagagagagccgtttttagcagctaactaagttgacgactttacccaaatggtgctgttaattctgattcgctggtcaacaccttaacctactaccatattattagtattcgtgaaaatccctactaatattgaaacgacttccccattacttgagactgcttttcacagactcattttgaccggatgtcacacacgctaagtcatctagcttgtcagtcaacagcccaactaactaaaaccattaactagtctcaaatgcaccacaacaatcattcagaacaacattaagtcactatccaaacaaaactaatcatgataccacctcaaattagtatgggtatgctttagttagggacaagcttacggttaaattagattggtatattgattgagtcagcgtttgattttggctatactgttaacagtcaattaataaaggagtgcgagtcgcatgatcaaagaattcaaggaatttattgcccgcggtaacgtgattgatttggccgttggggttattattgggtccgcttttacggccattgttaaatcgttgacagacaacttaattaatccactgattgggattttcttaggcaaagttgatttatccaatctaaagttcagtatcggtgatgctacctttaagtacgggtcctttctaaatgccatcattaatttcttcatcgtcgccatcgttgttttcattctggtgaaaattattaataaagtggttaaaaatgaaccagaagaacccgaggaagaagaagtcgatgtttccgcgcaatatctagaagaaattcgtgatttattaaaggaacaggctaaaaaataagtgaaaatagctcccaagcaaatttttcattaaaagtctatatggtattaaaactttttttgagatacaatatattgtgcaattttttataaagaggggctatcatggtgataataacagcaggaatgattggggtcggcaaaaccacgttaacggggttaattgctgaccaccttggaactaaggcattttacgaaccggttggcgacaaccccgtattgccactttactattcggatcctaagaattacgggttcctattacaaatctatttcctcaacaaacgttttgcaatgatcaagaaggcattggccgacgataacaacgtcctcgaccgctccatctatgaagatgccctcttcaccaaagaaaacaacgctgaaggaaacatctctgatactgaattgaatgtttacttgcaattactagacaatatgatgaccgaattgactgaactgcctaagaaggcaccagacttgatggtctactctgaaactgacttcgatacgattctttaccggatcaagaagcgtggtcgcgactacgaacagttcgaccacaaccctgaactggaatcttattactataagatgtggaccgcttatcggaaatggtacgatgaatacgatgctagccctaaaatgaagattgatttacaacagtacgacttggaaaaacctgctaaccaacaagcagtgctggctcaaatcgattctgaattaggcaagattcgcaatccaaccacagtttaattaatcatgctaaaagcgccagtcccgataatggggactggcgcttttattacgcacaatctagcgagcaaacaatacagaaacttcttaatgactcgcgaccagctaactaggtagcgcgggtagtgtcgtattaccaaacgacaatctttgaatgccgcactagcacaattgcgctcgattacatggctgcccggacttgttgggctaactcaaagttattggtaatcaccgcattgaccgaggctgtgaacaattgttgcattacgatccgttggctctctgaccattcggccgtggaaaatatgtgacacctagatcatttttgagcacttgatacaactgacccgtgttcgcggacgattgcatgaagatacccaaatggcctgccaagaaagaagctgcttcatttgcagcagcattaccacccgaaccaaagttcataaagtcactatagtcaatattttctttaacccacttcatcgcattgatcgccgcgggactcgtaaagtcgaccttagtcgcattgccagtatgaccattatcatgattggcaacgggaacacctgcgttagcgaccagctgctcgaatagccacgaataggcctccattgtcattcccttgactttgccgtgggatttgtcgtggatggccttagcgactcgcgtgatatcatcgtaagtcggatccactggtggcggcgtaatcccgtactgacgcaagaccctcttattataataaagcgccgtttgcgatgcattaaacggcattgctagcaattgattgtcgcgcatcacgatcgccttggcgcccggaatgatttgatcagcatcgtaatggtcacggtcaataaatttctgcatcggtgtcgtgaaaccactgtgatacatctgactggtggaaatatccatcgattgaaatagcgctggtgacgcggccgtcccatgcgtattcaagattttttgaatgacgccattatagccaccctcaaactcggctacaacttcatacttggactgttggtgattaaacgctttaacgtaagcgtcaatcgcttgttgaccaggacctttcatctcatgccaaaacaccactttaatgcgactactatccgcatggacacgggtccgactataagcgaccccacccactaccaagaggacagccatcataccggctagccactgccacttccgcgttatcttcatcatttcaccgaaccttcattcaatccagatttaaagtagtgttgcccccagaaaaggacaatcaatgttggaatcaccacgatggcggcactcgcctgaacgagtccccaattcgtagcggtttcctccgaatgcaattgccgcaatccatcttggaccggacgtagccgatttgaaaacgtggtcagcattggccataaatattggttccagcttcctaaaaagctgtaagcagctagcgtcaataaactaatccgtgagtatggtaaggcaacgcgacagtaaaattgccagtgtgagagaccatcaacatcagcggcttcctttaagtctcgcggaatttgcaaaaaggcttgtcgtaacatgaagataccaaaggccgaagttaagaacgggataaccatcaccgcatagtgattcaacaagtgcatcgcacggaccgtgtgaaagttcgggatcacttcagcttcaaatggtagcatcatagttgccaagaccaagtagaacaacgcatcccgatacttaaattccaaaaacacaaaggcgtaggcggcaattgatgcaaaaaacagatgagcaatcatctgaatgattgagatcactaaactgttaaataagtagcgaagaatgggtgttttggtgaacgcatcctgatagttctgccaagaaagggttccgctcagtgatcctttcgcaatagtcgtcgttggtaaaaagctggtccacaaccctaaaacaaacggtaaaataatgactaacgttaatgtaattaataacaagtaccggaatccgataccgattcgatgtcgaatcaaggcttgagtagccattgtattttccattagtaatgcacccgctttgctaaaagtttgaattggattaccgtaatcgctgcaataatgattgctagtatgatcgattccgtgctagcaagcgcatagttaccatcaacgaaggcatcccgataaatacggtaaactaataagttggtggcgttcgtaggcccacccgcagtcatcaagtcaatcaatccgaaactcttgaacgctgagatcaacgtaatcaccgccgcaaagaagagtgtgggggaaatcattggcaacgtgatatggatgaactgataacgccgactggtccccgccacatcggccgcatcatataaggttttaggcacaacttgcaatgccccaaaaaagatcaggaaagtaaatccgaggtgcatccaaacgctcgtcataataatcgccaccatggcccagtgtggctccgttaaccaattaattgccggtaagtgcatccagatggccaccttattcaacaagcccacggatggattaaacatgaataaccagaaaattgcggagaccgagacagacactcccatagtcgaggtaaacatagttcgaaatagctcgataccccgaaccctttgattggcagcggccgctaacagtaaccccccaattaacgtgaacaccgtcacacccacgacatagattccagtggcttgcagactagcaagataactcttagtcgtcagcaaattaaggtaattttgcaaaccaacaaagacggttggttcaccaagactattagtcaagaaaaagcttaggtacaaggtgcgtaacattggatagaaaacaaaaacactgagggcgagtattgagggcccaagaaatagccaagaataatatttatcattacgctttaattcaaaactgccggtgtgcacagttgcttggtcatgcgcatctggcgattgtttcggcttaaggcgtcgcttaatcgacggaaacgagttgatcactagtaacaccctcctcttcagcaatcagttgttcgtgctcatcaaaaatgaagatcttaccattaacggttacattcacccgttgttcaagtggtaattggacctgaccagattgtgcaactcgcaatgccgtcccgttatcagcctgcacttcgataatcgtcatctcgcccagtgtctcgacattcgtgaccttgccattaccgcgctcatcggtaactggtactgcgtttagctgattaggtcggataccaatcgtatagctccccgcgtttaatggttggttaagcgcaatctgaaagccctccgcgacgtgtaaattacgagcggttttcgtcaccactggcagtaaattaatctgtggcgtaccgaagaattcagcgacgaaatgattagcaggatgattataaatatctaacggtgtatcaatctgttgcacgtgacgctcatttaacaccattacgtgatcggccatggtcatcgcttcagtttggtcatgggtgacataaatcaatgtcaatccgagcttacgttgcagttcgcgaatttcggtccgcattcgcacgcgtagttgcgcatcaaggtttgataacggttcgtccatcaggcaaaccttagcatcactggcaatcgcccgagccaaagctactcgttgccgttgaccaccagatagttcgcgcggcttgcggtcacgataagccgtcaaattgaccatttccaacgcggcattgatccgacgctcgacttccgcggccggcatttttcgtgcttgtaaaccaaacgcaacgttggcagccacgtccaaaaaagggtacaaggcataactttgaaaaaccattgacagttttcgatcttttggtgggactgcattcatgatctgaccattgatggccagctttccactagtaattggaataataccggcaatcatccgcagcagcgtacttttaccacaaccggatggcccaacaatcacgaataactccccgtcttgaatctcggcatttacatcgtttaaaactggctgtttcgccttatcatacgtctttgtgatgttctgcaaggtaattcccatattcatatcccctcgaccttttatttgtaatttattagattactctttaatcatgccagaccaacgtatcgggaatgttggcttaatgtaaaaataacgtatgggttatgtatttttttcataaacagcgccccaccaacaaattcggagtgaataaaaaatagttgtttcgagaatttgtacattctcgaaacaactatttagtctgtgtcctaccagttaatctgtcatggatgataacggtccaccgtgagtcggttttctctgtgtccgatatcgagcttgaaaaagccgctcaaatgtttatccggacacactatcggatgtcctaaaaatttcaattaaagccgacgagtggtatgctttggcagtttgactggctgttgatcagcatctgtgcgcaccaccaacgtgtcacaggtagcattgcgaatcacataagcagcattagagccaattaacacccgtgccacgttgttaagacctgtggccccaacaacgatcaagtcagtgccatagcggtccggtaaagtcgtcgctaacaataacttcgaattacctgaatgtaagtgaacccgcacatcgctgacacccgcggccatcgcttgttggcgagccttagcgagattcgctttaagaccggccgtcaattcgttcaatgcctgcggtgtcgttgcgccaaaacccatcggcccttgagtcacaccaataaatttctcagtattaatgaccgtcacaatatccaaagcggcattttgctcgaccgcgatcttaattgctttcgttaaagctaattgggactgaggactcgtatcgatgccgactaaaatgcgtttaaccatcgtcataaccatcaccctccattaaaggatcactatttgtcggttgctaacacggcaattgattcagcgtaaatcgccattgcagccattaattcgtcaattggttggaattcattggcttggtgcatcgtatcttcggtatctgggaagagtgccccaaaggcaaccccacgagccatcatccggccataagtcccaccaccaacaatttgtggttgtgaggccgtgtcaccagtttgacgccggtaaacgtccatcaaatccttgacgatcaggtcttcagggtcaacgtaatgtggcaccatgaagtcaccctgcgtgaccgtggcaccagctggtaactgcgcttggactttcgccgttaaatcagcaggttcgattcccttcggataacggaagttcaacgttaacgcaccacccttttgatggtcgaagctgagtaacccgacattcatcgtcaaatcacccataacgtcatccttgtaagctaagcctaactggttcgcccgtgaatcatcgtgtagcttattagccacgaagtctaagaaagcagcggcatcatcagcaaaggcatagttagtcaagaacgttgcaaggtaggttccggcattgatcccgttacgtggttccatcccatgggcggcctttccaacaacttccagcttaacgccttcaggaacgaccgttaattcaccagttactggttgctggtccaggaacgctgtgaagtcggccgccaactgctcgttgtcatccgtcgcgaccacggcttcggcatcacgcggcaccatattttcacgcaagccagaatcaaaagaaacaaggttaaagtcgccattatcttcatgaccgaagtgtaattgcagactcacatttcccttttcaccattgatcaacgggaacatggcatctggagagaagcccaaggttggcgctggttcaacttcaaagtagcgtttcattccagtccaattactttcctcatctgtcccaacgataaagcgaatcttcttattgagcttcaagccaagttctttgacaatctttaagccatagtaggccgccattcccgggcctttatcgtcggaaacgccgcgggcatacatcttgccatccttgatggttggttcgaaggggtccgtatcccagccgttaccagcaggcatttcatccacatgggctaaaattgccaaggtttcatccccctcaccaatttcagcataaccgaccaagttatcaatgttcttggtcttaaagccgtcgcgttccgcaatcgctaaaaacgtggttaacgcttgcttaggaccagggcctaagggtgcatcatccgtcgcctggctatcgtcacgaaagctcggtacgcggagcatggtggttaaatctgctaaataatcatcttgatgcttagttgcttcatttttccaatcaactgacatgttaaattcctcccacatattgttaccttaattttatcatagctgtcgtcaacttaataatcgtaagtaaccgcttttggaaaatggtatactcaaagtaaattaacttagaaagctggtcattttatgcaacctattacaactgaaattgttagccgaacgattatcaaacgaccggctgattctcacaaaggcaattacggccgaatcatgctgattgggggtaatcaaaattttggtggtgctatcatcatggccgcaacggccgcaacatatagtggtgccggtctggtgacggtcgctaccgacccgtctaatttcacgagtctacatgctcggctacccgaagccatggtcattgactatcatcaaacggacaccttattaaacctgctagcaggaatggacgttatcgtcatcggtccaggccttggaacagataccgtcgctgatcagttactgaccgccgttctcgccgcgacgcacgtcccacaacgattggtcatcgatggttcggcgctgaccttgcttgcacagcaggcccgcaccttacccgccacggacatcgtggtcacgccacaccaaatggaatggcaacgacttagcggcatcgcgatcaaagatcaaaccccaactgccaatcatgacgcgcaacaacggttaggtgttacggccgtggtcaaagctcatcgcacgaccgtctacactgacgaacgagtctggttcaaccccggcggcactccggccatggcgaccggcggcatgggtgacacgttggctggtatgattggtggcttcgtaagtcaatttcataatttcaccgatgccgttctcagcgcggtctacttgcacagtgccattgccgatgacctcgctgcaacgcggtacgtcgtcttgccgcatcaaatcagtacccgcattccgacttacatgcaccgctttagtcagattgaacgcccttagctagctggaccataatgaacacgaacaagccaacgacattatgctaaaaaagcctcaactaaccatgcttgaattcatagttagttggggcttaatgatttaatttaaaccagagtggccgaattcgtaacacgcactattcgcctacgggttggttcgcatccgccttcaacgctgttagttcgtcatcagtcagcgcacgatagttccccgctaataagccaacgggtagcgttaacgaaccaaacttgattcgccgtaacccgacgacccgttcacctaacgttccgaccatccgcttaacttggtgatacttgccttcatggatcatgattcgaatcgtggtaaaattctcgatttcatggaattgaacaatctcagcctgagccggttgcaattcagtcccgtcctttaacgtgatcccatcattaaaattagccaattgagctgcagtgatttcccccgttacttcagcctcatagaccttcgtaacatggtggttcggcgacaataggtcgtgcgatagggccccatcgttcgtaatgaccaagattccctcagtatctttatcgagacgacccacgggaaatagatcgtcacgaaaatccgtcgtattgaacaggtccatcaccgttttcgcagcggaatccgtcgttgccgtgatgaccccgactggcttattcatcacataatagaagtattgttggtaacggacctgcacgtcatctaaaaagacggtgtcactgccagggttgatctgttgtttgccagagattactggctcaccattggcagtgatatgaccatctttaatcagacgacgtacttgagtccgcgtgccaattcgcatcgcatgtaaaaatttatctactcgcataattcacctatttaatccgtaatttccgtcgtaacccagcagctttcgttccaatcatcaaatcagccatccgcgaacggagtgctaagtaaacgtaaaccgcaccaccagcgataactgctagggccacgatcaagaacgattgcgtcttactgtgctcattcaacacaaagttcagcccataaacaactaatcgtgccgtgacatacgttaaaatcgaataaactaaaattcgattgatttttggtaataacttcacgtaccgaattccaaagttgacttccaaatcatacatcgccatcagactcgcaaccatcatcccaatcgcggtcgcaaccaggggccccgccgttgataggaaatagatacatggtaactgaatcacgattttgaccagtaagccgatcaagtaatagcgaataatatcgcggttgcgtgataggccttgcatcagcgccgaaatcaccgtaaaaaagcctaaagcaatcgcggtaaatgctgagatatgcagaatcaaggtcccaatttgatcataactataaaagagcgtgttaagtggttgtgccactgcggccatccccagcgctccgggaatcatgataaataggaataaaataatcgaatcttccaactgtttacgaatattacgcatattatgactggccaatgattcagataaaatcggcacgaccgtcacggcaatcgcagacgccaatgacacaatgatcatcaccaatttgttcgcattaaatgcaaagtaagcatacaacgtatcgatctgcttagtacccaaatggtaaaccagccgcatcatcggttggaacgttgcttgatccaacaggttgaagactgtcgttgcggtatcgatcacaataaatggaatcgcctgaataataatatcgcggaacaattgccagactggaataactagtttgttctcactctgagcagctaaggcatttagctcgggccgtttgcggaaataataccaaccgagtaataagaagctggcagccgccccgacgaatgctgcgaatgtcgattgggtcacggcattcacccaatcgccgtgagcgacgcgcatgatgaaatacgtcgcacccaacatatagatgacccgaaaaacttgttccacgaactgtgagattgcggacggcgccatctgttgatacccttggaagaatccccgggtcaaagacatcgatggcagaatcaccaaggcaatagccaacgcatgcaagacgggaatcagattggcatcatagcccccaaaagctgttgaaatcaagccagcaccaaaccataaaataatggcaccaataatcccaaaggctgacgtcaacaacaagccccgcttgaataagcgctgtccaacggcatattcattcatcgcattatattcggaaagttgtttagaaattgcggacggaattcccccgatcgcaattagcaggaaaaaactataaatattatatcccttggcataaagcgcgttaccttgcgtataatcagcgcccatccagataacccacgggataatataaatcgccccgagcacccgtgaaaagagactcccagccgtcatccaagccgacccgcgcaccatcttctggtgcgcttcggcttcagaattcacgtgtgcattctggggctgattagcttttgattcctcagacatgttcgtaacccactttcttaattcaatcctaatcattttagatgaaaaacaaacaagttgcaattcaattccggccttatgcgtgagtttaaccgaactttaatgataaggtcttgacaactgcaccagctattggcgaaccgtaccgccgtccgataccctatggctgatacagaaaaaagaccaatccgtacgctttaccagcggccacgatgcggtctcaaattcgattacagcagagtgccgccatgataaccatttccgctgattaaaccacgttactgctagttttaagttaagcataggcggttgcacacactctgcccaccaaaaacacgtgtgatttgtctcccaaaccgaaccagaacgtcctcagaatctttattcacttaaccaaatcaatcgtaaccgcactaattagttctgtgagtagttaaaaaatcgtgatagcaaccaacaattgtcagtcaccatcacgattaatttaagcgatattcatttaagttgatactggtcgtggtacttagttggcaaccacgttaaccagtttaccaggaatggcaatcactttacgaactgtcttgccggccgtaaattcctggattttttcatccgccagggctagtttttcaagttcatccttgcccatatccttagcgacttcggcgtgcgagcgaaccttaccattaacttgaagcacgatttggaccgtgtcttctactaacttagattcgtcatacgttggccaagtggcgtaggtgatcgtgtcatcatggcctaataatgaccatagttcttccgacaaatgtggtgcaatcggtgacagtaacttcacaaagccttcgatataaatgattggtaaatcgtcgaccttgtatgcttcgtttacgaagaccatcatttgcgaaatcgcaatgttaaagcgcatagcttcatagtcttccgtgactttcttaacggtttcgttgtagattttcgtcaacttaccatcattgatggtcgtgattcggtcgcgaacacgattgttttcatcgatcattaagcgccaaacccgctcgatccacttattggcgccatgtaacccatcggtactccacggaatcgaagcttccaatggtcccatgaacatttcgtataaccgcaacgtatcggcaccatattggtcaacaatatcatcggggttaaccacgttcccccgcgacttagacatcttttcgtgattatcacccaaaatcatcccttggttaactaacttctggaatggttccttggttggcacaacgcctaagtcatataagaacttgtgccagaaacgtgcgtaaagcagatgtaagaccgcgtgttctgcaccgcccacgtataagtcaacgggtgaccagtacttcaacttatcataatcggccaaagcttcacggttgtgcggatcaacgtaacgcaagaagtaccatgaactcccggcccattgtggcatcgtgttggtttcacgcttccccttacgaccgttttcatcgacgacatttacccagtcgtcgatattcgctaacgggctttcaccagttcctgatggttccaggttcttagttgctggtaaccgcaatggtagttcatcttcaggaaccagcgtcgtttcgccatcttcccagtgaataactggaatcggttcgccccagtaccgttgccgtgagaagatccaatcacgtaaccgatagttgaccttcttttcaccggtatggtgttcacctaaccagtcaatcatcttatcaatagctggttgcttagctaaaccgtcaacaaaacctgagttgatgtgttccccgtcgccagtgtaagcttgttggtcataatcattatcacccgcaatgacaggtttgattggcaaatcaaatttttgtgcaaattcaaagtcccgatcatcatgagcaggcactgccatgatggccccagttccatatgaagccagaacgtaatcggcaatccagattggcagtttttcaccattaaccgggttgatgccgtagctaccagtgaagaccccggtcttgtccttattcaaatcagtccgttcaaggtctgacttgctggcgattttagctttgtatgctttgatagcgtccgcttgttcgggtgtcgtcaattgttcaactaagtcgtgttcaggtgccaagaccatgtaacttgcgccaaacagcgtgtctggccgcgttgagaacacttcaatctcggtatcgtcaggttgaccagcaaccttgaaacgaatggatgcgccaactgagcggccaatccagttacgttgttgctctttgatgttttctggccaatcaatatcgtccaggtcatcaatcaaccggtccgcataggccgtgattttgaggctccattgcttcattggcacccggtaaacatcatagccaccgcgttccgtcttaccatcaactacttcttcgttagaaacaaccgttccacccatcatatcaggagcccagttgaccaacgtttcagattcgtaagccaagcccttcttatagagctgttcaaagatccactgcgtccacttgtagtaacttggatcagtcgtattcacttcacggtcccagtcatatgaaaaacctaatgaccgaatctgacgtttgaagtttttgatgttcttggccgtaaagtccttcgggttatgccccgtcttgagcgcatattgttcagcgggtaaaccgaatgcgtcccaacccattggatgtaagacattgtacccttgcatccgcttgaaccgtgacataatatccgtggccgtatacccttcaggatgtccaacgtgtaatccttgaccagatgggtatgggaacatgtctaaggcgtaatacttcttcttatccgtcgtatctaatgttttgaaggttttgttttccttccaataatgttgccatttgcgttcaatgactttatggttgtatgccatagtagtgcccctttcttgctgccttgtatgtaaaagctagcattgcgactttccaactgactattcaagatggcattttcatgcttcaactcagtaaaagcagttaaaaaacaaaaaaatcctataagccaattaagcttataggacgaaaacaggttccgcggtaccacctatgattccacgttaccgtggcctcttgggaatcttaacgcgaaaccacgtccgtacctacaatcttgttcagccggaagactcgaaggtgagttcatgattggtgaatccccgtttgcaactaccacggagtttctgcaaaacaccagccactactattccttctcagagtcgtaaagttattgttttcatagtagcaaaccagcacgtttttttcaagggtccaagccccgctggcgataaattttatcatcggcattaatcggacccctgataaaaaatgctataataatgtcaataatttatttatcggaggaatcagtattgaagcaacgatcctggcaacgttcggacagtttgattctacttatatttataggctggttaggctggacggccgcggtatggcaacgggcgccttggttaacacactttgataccacggttgctaatttttggcatcatagtccccagtggtttcaacacgcgatggtcacgtatacgcagcttggcaatccccacaccatcaccataatcacgttgattatcggcctggcactctggctgggccataacccacgcggcgcagtcttcttttgggtcaccacctggctgattgccggctacggtaattatctcatcaaacaggtcatcatgcggccacggccaaccgcttggcgacttgtccaaattggggggtatagttaccccagcgggcactcgacaacaacgaccgtccttatcggtagtctgctcgtgttggcatttgactactggcaccgcaatgccttgactggctggctcactgccctcggcataacggccatcttgttaatgatgatcagccgggtcatcgtgggcgtccactatcccagcgatacaatcggtggccttttacttggaagtgttttactatatataagtgcgcgttttagtacgcgttatcggcacggaccgcttcgattgcggccctaattcatgaattcaacaagggggtaacattcattcaactcagttcggcattagcttatagccacgcgctaatgaaccaagtcgtcaatcccggtgaccatgtgattgacgcgacggttggcaacggccatgataccgtctacctcgccaagctggtcgggactactggtcacgtcgacgggttcgacattcaatcagcggccattgaagcgacgacaactgccttagataaagcagcgctcacccatcaagtcactctgtggcaaacgggccatgaacacatcgcagataagattgccgctgatcaacctatcaagtgtgccgtctttaacctgggctatttaccaggtggcgataaacaaatcattacgaaaccaacgacaacgttaacggccataaaagccattcaggaacgcctcgtcaccaacggactcattatcctgctagtctatgctggtcatcccggtggtgcgacagaagcacaagccgttttggattacgtaacaaatttagaccagcatcaattccaagtcctacaatatcagtttattaatcaagtccatgtgccgccatatttgttggccattcagaaacgttaatttaacgataaattagccgaaaagacctgtcagacgattagcttcgtctgacaggtcttttcaattagatacttaacttaaaaaccaatggtaccttacttctcccacggatacttaccgttctcatccttgggggtattacgcatgatccgcttagttccctcgtccatctcgttacgccgcttcttacgattatggtgacgaacaattaggacaagaccaccgatgccacagtacacgatcattcgggtaaacatcttaacggtcccataaatggtcataatcattaacattttgcgtcctcccttgccgtcaaatctacttaagccgtgaccttagcaggcttaaagtaatctaacaatgcttgccactgtttgaaaacggcttcttctgaataacgcttggcattttcataggcctgagcactgtattgtgccagctgcccttgattcttcaacaattctaaaatcgttttggtcaattgttgcacatcgccgtctgtcgttaggattccactcttatgatcctgaataatatcactcgggccgtacttcacgtcattggcaaccattggtaacccatgggcttgagcttctagcaacatcaatgagaatccttcagctcgacttggcaaaagtcctaattgggcccggttgtaaacggcattgacatccgtggtataccccttgaacaataccacatcttccaagtgcgctgcagcaacttgtgcatgtagttgcttttcaatatccccgttcgcataaccccataattccaacttggcatcaggaaaatgcttgtgaacttcaacaaaggcttcgattgaatgattctgttgcttttcaggtgccagccgcgcaacttgcacgacgaggtctttttgtcgttggtcaaacttcaccggcgcggcttttaacgtagcattatcaacatagccaaccggaatagtgaacgctggaatatccttaccaaagcgggcttccacgtccttagtttgttctggtgtcgcagaaatgaccgcgtcccaagccgcccaattattcagcgcattagcataattattgttcaaggtagaatgcataatatccttagcatcactcacatggttattatgtagatgcaagactttcttagctggtgtggtcatattgaataagccccaggcacattcgacggtccgatcacaaatgaaaacattttgttcatcattcaactggttaagttcatcatagaagtaacgggtcagttcattcatcccattaaaagtatggctctgctcgttgtagttcaagacgcgccacgtgattcgctcctgaccagcgtgatttaacaagtgtaacttctccacgtgaatcaatccatccgggccaaagtacgcttcttgggcaatcttaccgtcccagtcaaataattgttcaagacacttaaagccccgcgtatcccaccaactcatcttgagcgtacgaccattaacgtcaaagtattgcacattgctaacggcttccgtaccggcccgaaggtaaataatcatgattaacttaccacgttccatgacttgaatctgattatccttccgggtcttgatagcatcggctggcacttcaaagtcggccaaatcaaacctttgacgcttgaccgactgactaccacaaaagaagtcaaaaagattaacaaaatcagcatcggcaatgttggccccttcaagcacatcgtgcaaattcattgcgaatacgcgggtcacgattttagcggccacatggtgcttcttgaataaagtcagtcggttgatttccgcctgttcgattcctgattttgaaaattgcatgttatcgtttaagaaataatacatatgcgccctcctacttaatacccagtaattgttgccaacggtgccaaacttttaagtcagtttgtgacgtatgaagcttcttaaaggcggcttcactgaaagccgtcaacttcttcgtatccgtcattaattcgatgacccggtcacgcagcgccaattgattgccaggatcaacgatgaaaccgtcatgaccgtcctcaatccaatctttaggcccataattaaagcgataactaatcactggaatcccgtgactcatggcttccggcatactcattggaccaccatcaacaatatcggtattgagcaacagctgataatcatcataacgtgtttctaaatcaggatgataatctaataaatgcacattattcgtcaattttaattcttcaaccagcttattcagcgtcttaagatactctggatcgccgtagccgtaaaagtcacactgaatttctctgacctgttgcttaactaacgcaatggtccgaattaactgatccagttgccgatccggcgccagccgcccaacgtatagcaattgcttggggcgggccgtgattggccgtagtttactctgcgccaacggactcgtagttacagttggtaacactgtcaccttagctttagggaaccgcgtccgcagatgctgagcctgactttcagtagctgtaatgaagccatcaaagtgttgcaaattatcgaaggccggtgttaagaacccgtccaacggggaatgaattgggtcattaatatccttcgcctgataaattggaaccgtcacatacttgtgagaatcatcctgaagttccaacaacggcttcacactggtacctgggcgatcactaatgaaggtcgtcgtttgcttgtccaaatgactgagttcgaccaagaagaaatgaaataaatggttcgcgtcctggaagaagcgctccgcttgatcacgataattctttaaaatcaaacgtgacgctagcggattaccgttagtgtcaggtacatagtactgctcaataacggtctcgccttgtagattataaaaccgttccaaaaccattttaccgttctgaccaaaatattgtgtactggacttgaagcctcgccaatcccacaggtcggttgaagataagttaccttgattgtcgaagaattcttggtaaaagacgcgcccaatcgttccaggaataaagccgacgttgctaacgtgttcatcaccattaaaaattttgctaaagttggcacccacttctaccgcatattcaactggcagatgcatgtcatcagtatgcagaactttagttggcacatccgtggtttgttgaaagtaatcaaacatattcagcacttgctggtttgctaactgaaaagttcccatggtctgatgtagcaaacgatcatacatcttagtcacaatctgggctggcgctttatagtggttaaataatttcacccggttgattgccgcgtgctcaacactcgaattcttgcctaaaatatattcattaatgaagtaaaacatacagtcaccctttctgttacctagtattatgcttgtcgatatgtgtagttataatagttcactaacccggataagaaatgctcacaatcgtcaatccgtgtccggaagttgtcatgacgtgcatagaacccaccaataaacttctgcggattatagagatacattgcaatttcaggtagaaaacacccagtagtaatctcatacaacgcacggtaccgcaacacttgccgtaagcgagccaagtcataaggtgccatcaagtcttcattacctgaacgtttaatcatgtcggtcattttaacggccgcatcaactaattcaagcaatgttggatacgtggtatcacgctcttcaatgaattttagatgattgaatacatttttcaaacccagtttcatataatcgcgattgtctgggaataccagtaatgcttcattgattgcataagaaatccagtgatcatgatatttaccgtagtcattagccaccatgtaatccaagatttgcttcaccaggttcatcacattcttatcatgcgttaactcgtatagccgggaaagcgcaaatgcgacttctccctcataatagataattcgaaaagctgctttgaccgttaaatctgggttgagaacatgaattaacttgccagacggttcttggaagaaatggacgcctttaaagactttcattaaaactggcatgaaagtatcatccttggtgacgtcttgatatttacacaatgtaagcatcaataaggcctgcccacccaactttaattcgccgttatcgtcgacgaagattgcgtcctctttttcaatcgtggcattttttaagccccactgaatcgctaacttaacttttgcaaaatcttcagtgcgctttgtgaatggaatggcttccaacaaggcatataaggacgaaaaatgccggacaacattgtaattgctaagaactctttgacgagccggaaaataaccgtagacaaatttgccgttatccttcaactgattaatcaggaaagtttcaccatgttcaatagctgattgcagctcgctctgctcgccagtcaccacccgaacgcccttaccacaatcctcttgctcagatagattccagattttctgcccgtcagtaaatacaccagcggttgtaaagacccaaacattttctgtctttcgaatatcgactggtagcgttccttcacgcttgttaagatacggctctactcgatcatagtcgacccaagaacccgaacgattcttaccaattcgatgcgctttgctaggacggaaaaatgcttgtccattactttccatctccaataaggctgtcttgaaatctgcatcaaaactaataccgtatcgccaatagttcatccgaaaagtagctgccaatcgcttttcaaaagtttctcttggtaacttctgtgttgattgaactgcttctaatcgaacccaactcgcttgaggggttttggctaattgttgtgcaactgctatccaagcttgcttgaaagaatcgcaacgatagaatcgcacttgggcccgatgtcgatgatccgataccgaaagtgccaaggttacggtacttgtaccgtaatctttcaaatttccagttgcaatcagtgcttgcttaagcttggtgacagtagatttttgcatcttagtcttacctctttcaattttcttttatgtacgccaaaacgggcttcacgcccgttttggttaatagtcttattttacaacgtatatcgttagcagtactaacaaatcagctttaaattttaactatttttgattctcgtcatcttcatcatcatctttacgacgacgaccgaacaagaagaaccaccagccgagtccagcagctgcagccgcggtcaacaagccaccgaaaatcgttccggcattattacttgtatcagatgcagtcttaccattctcgtcagtattacttgagccgaccttatcatcagcactatctgtatcagctgacttcttatccttatcagaatcattactactcttcgaatctgaatcagtctgatcagaagtcgcatcaacgtcttgagcactagcagcggcataaaccactgatgtagcagcagttgctgacgttgttgcagcattcaagctagtcgtacttgtcgaagcagcaccgttgttagaagcagtcgatgaagttgtcgtaccagtgccagtacctgaattatttccagtagagcccgtcgtattgcccgaacctgatccagtatttgaactggaacttccatctgagccagaattactaccattgtcagaattggttccatcatttgaatctgaatctgtaattgcatcggagtcactgtcgctattcgaatcactgtcagagtctgagtcgttgtcggaacctgagtcgctgtctgagtcagcgtcactgtcggaatccgagtcgctgtccgaatcggaatcactgtcggaatctgaatcactatccgagtcggaatcgctgtctgagtcggaatcactatctgagtccgagtcactgtcggaatctgaatcactatctgagtccgagtcactgtcggaatccgaatcgctgtccgagtctgagtcactgtcggaatccgaatcactatccgagtcggaatcactgtcggaatccgaatcgctatccgaatccgaatcactgtcagaatctgagtcgctgtcggaatccgaatcactatcagagtcggaatcactgtccgagtcagaatcgctgtccgagtcagaatcgctgtccgagtccgaatcgctgtccgagtcagaatcactgtcgctatccgaatcgctgtccgagtccgaatcgctgtctgagtccgaatcactatccgaatc

SEQ ID NO: 9 - DNA, 58671 bp, Lactobacillus plantarum
gttttcagacagtccctagtcgtgtgttgatagctgttttactttcggcgcttatttttattccacttgccgtatgggttgctagtaatgcgcggcggttaaaactgattcaaccggttggacaagttttaggatcaattcccgcggatatttatattccaattgttgcattaatgattacgttgacagggacgacacagcattggtgggtcattccattgataatgactggaactcaatggtacttttttttaaaaattatcgcggggtatctggcaattcccagtgatatcaaagatgttgttaatatttttcacctgtcagggtggcgttggtggacacactttttaattccatcactgtttccatcgttcattaccgcaattattaatgctgctggggcagcctggaatgctgatattgcggctgaattgattagctggggtacccaccagtatgcggttactggacttggtgcttacattgcccaaaatatcaataataagcctgcagaagcaactggagtactgattatttgtgtcattgttgggttatgcgttgtgttgatttggcaaccattatatcgatttgctgaacgtcgctttcattattaatacgaggaggagtttaagttgaaaaaagcagttttattagatgttgatcacgtttcaaagtcatttatactttcaaaacaacggcagtctgaactgattttggaagcggttagtttgcaggttcaaacccaccagtttattagtattattggttcgtctggtgtcggaaaatcaacactattacgaatgattgcggggattattcggcccagctatggcgccattacttttgatggtaatttagtcacggctcctaatcgccgtatgagtatggtatttcagaactttgcgctatttccatggttgacagtacgtcaaaatatcatgtttggcctagaaagtcagcttaattctgactgtcaatatgttgacaatcaaattgacaatttaattaatttgattggtttaaaagggttgaaaaatgcgtacccctatgaactatctggagggatgaaacaacgcgttggttttgcgcgtgcacttgctgttgagccagaactgctccttttggatgaaccgttttcagcactggatgttttaacagggcagcggttagggcaagatttgatcacattatgggaacgcaggaaatttaaaatgcaagcgattgttttgataacgcataatatttctgaagcggttcgtctttcagatgtcatttatgttctaggagggaaacctgcacaaattatgaacacttatcagattaagacgcctagaaatcaacgtactgagcaacaaatttgggccaagacaatggcaattactgatcaatttaagcgcgatatgaatgaaatgcggggggactgagtttatgagaaggcggcaactacctaaatggcaaagaaaacgactaattgtattagtaacgagttgtataacctttatgttagtagctttcacaattcaaggtattcggttatttgacatgttgcactcgttccatgagtcacgagttattaagtcgcatcataatttgacccagcaaccggtcagtacttttttattgatggggttagataatagtggcaagcgcaaattatcgacaacgcgcacggatggaatgatggtagtcattgtaaaccataaaactaaaacaatgaccttatgtagtttattacgggatacttttggtaagatccattcgcagcaatatcatggttatcagcgcattgaatcggcgtatacctatggtggtgatgcagcggcgatagcgaccgttgaacattatttgaatttaccaattgattattatctaactgttaattgggatggttttattagggcaatcgatgatattggtcccgttgaagttaatgttgatcgtgattttatcggacaagattactggggaaaaccagaaaaatttaaagcaggtttgcaatcgatgtctggtgcacgtgcattagcctatgcacgcgaaagacatattgacaacgatcaacaccgtggttttcggcagcaagccgtcttttacgcaatggtcaagcgcttgaatcaggaagggctttcgtctaaaggggccaaagttgtcggtgatttgaaagatcaaatgaggactaatttgacgaatcacgatatgttaacactgtttaaaaatcgtaaaacttttaagcgatatcgagtaaaacgattgacatttcagtggcgaacgtttgatgttgctggccgtagtatggtagaggtttatccggacagtcgcgtacaggtgagtcggcaactacaagccgccgctgggctacggccagacttgccttcgcagacctttacaaccaatggacattatcggtatgccagcgatgaaagcgttgaaagtaaggctgatgaagctaaggctggtacgcattatggccaatcgcatgtgtacgtaggtcatgctggtaatactactattggtaaattaccagcagcggtgccgttgaaaaatggtttccgagtttcagataggactgaaacgatgtacacggtacattagattccgataatcgttagcaagtggacactattcagtaaccaaaacgagccagacagttttaagtgctatagtccccttaaggttgatagatgaaatgatatacttcatctatcaattttaaggagattttattatatctagaaccaattttatggtcacagaaaaattagctattattctgggtcttgaaaaaactaacctgactaaatcaacgtgttttaaagcgtgtggtatcgctcgaagtactttcatcagatgtcaaaatttttatatgcaggatggtctggaaggattaaaagaacagcacaattggattcgatatatctcagagattaagcggcaggccatatcagcgtacttgaatgatgaaagtagtttgtgggatattcaaatcagatttggccttagaagtactagacggctggaggaccggatcagtgaattgctggtccacattatgagtagaaaaataacttttgaagaacgcattagaatcgttgaatacattacggtgagtgaacatgcatattcccgagcagcgaaacattacaatgtatcttatcagcaaatccgtttctggatgctcaaaaccaccaccaatggttacatcgcacttaaagaccggcttggatggacgaaaccaattgaaaaaatgactgaggttgaacgactaaggctcaagaaacgtcaacttaagattcaaatcaaggagcaggaggtttgacttctttttaaaaaagtccaaaaaatacagcacaaagattgaatgcacaacataaattagcctatcaaggaatcaaaaccgtcggctcggatattcatggtgttcaggccaccttgtttagcaagccaggtttgtcgcgctcagtctataataagtggcttcatcatgaatcgattggttttgggttttcagttaaacacttgatgtctgtatctgtactccatctaaaatgttaaagttgtattaagcggcctcaacgcatcaaacaaactaagtaagaaattaaatcaagtaactcagtctaaccaagtaggattatccgattccaccgaagtcgtttatgggctaataacaagcacaaagcccgatttacggcgctctaaaacatctttagttaagtcagccaaccagcgaggcggtggttgatacctttaaccaggcttttaatactttaatgaaatcatacgaatagtacaaagaaacggctctaccgcatttgaataccgcgatgaagccgtttgaaaagtaattaaaaatcatattatttcattcatcaacttgacaaggactgatgcccccaaaagagcttttaaataataatttcattcataacctttaacttcatccagatgccgaaacgcacacgaccataccattttcccgatatggtcgtatgcgtctcagtttaggttgaaaagtttacttcttttcctgcacaatgtagtggggccggtgttttgattcgatataaattttaccaatataattaccgataatccccagacagaacagctggatgccgccgattaagagcaaaattgtgacggttgaagcccaaccactgacgctgttatcaaataatattttacgaataataacgacaaatatactgataattgagattagtgagagcaagccaccggtgaaggtcgcaatcttcaggggtacatctgaaaagtcgacgatagcgtccattgaataattgaacagctgccaaattgaccagtgtgtttcgccagcggagcggggctgattctcaaacttcaaataagtcgttcggaaaccgacccagttgaagatgccttttgaaaatcggttatattcgggcaattccaagatggcatcaaccatctgacgtgtcattaaccggtaatcacgggcgtttggaataatttgtacttttgaaattttgttgacaactgagtaaaacgagcgtgataagaatgaccgaatcattggttcaccgacacgattttcccgcattgttccgatacagtcatagtcaccggtttgaagcatcgccagcattttaggcaataaagttggtggatcttgtagatcaacgtccatgacggcgacgtaatcgccgatagtgtgttctaagccggctaataaaccagcttccttaccgaaatttcgcgaaaaggagacatagtgaacagtgtcaggatgggcggcgtttaaagttcgtagtacgttcaaagtgtcgtcagatgagccatcattaacgaaaacatattcagtagtgatatccttgaacgactctggattatctgccaggactttttcaacggtgttataaaagatttcaatcgttggttcctcgttatagcatggaacaacaagactcatggttttcatgataattgtatccgacctttttataatttttagattgatctattaatcagggctcctactgattaataaagaaagaaattttaaaccagtatgaatatcatagcttgaattaaggtataaagcaatcaaatatcaaaccacaaaaattgtaatgatgtcacgatagcttgtcaattacaccaccaatcaagtacgtcgacagcgatgcgtcatgttatttcaaatttcacacctggcagtgttgagtagtttgcaaaaaaacaactccaactgggcacagtagcatggcccgttgaagctgttggaaaagtgattattgtgatttatctttttgagattgggcgatgggtgtcaaggtggacttagaaatattcacaaccgtcaaatttatattttgacaaccgaaatgcccaattagcggatatgaatctatagccgtaaacagctaattatttgcgagtgaaacccaattagtggcctgaatggtatcaattcgatagacagcgatggtgacgtcttttaaggatccataaagtgtccctacaattgttaatggtgaaacggaatcgcccacgcgtacttgccaggtacagttgttgtggaagttcgtccggtcgatacgcagttcaatatgttgattgctcagcgaattgataacgagacgcgagggtgacaggctaatgatatcaccatcaatcggggcattaatcaccggactggtcggttgtatggctaatagcccgatttgttggggtgatgtggcagtgggaatcgccgtataagtaccagcgacaggtgcctgaagactatttcgtttttgatgacgtgagaaccacatgtttaccgcgctccttacttggtgcttgtcttgatcgccttatttaataacagcataaattatggaacccgtcccaggtcaagcaattgcgggcagtatttttgtcgtgaaatgctataatagttaagaaatcttaggatggttaatgaacggggtggtcaagatggactttgtagaattgacaccgatcgcattggggcatacaccacttggcacacgcggactgaatccccatattcatgattggcaactcgattggcaaaaactaagtagtttgattgctgataatcaagacgtgatgatgcaggtggacgccggacttgctgaagattggttgaatacgcacggcaccatttgggacaatgtacaaggctatcaccgctacccgaatgacaaccgggcgtttgatgacaccgttttttgggcggcgtctacttgggcgacaccggcaattgttgtgacttttcataatgaaattagtcgggctttcggctgctatcgggtcggaactgaccctgattttcattacttagggccacgcggacgtgcatattaatcccttattgtcattaacaaattggaggaaaagacgtgaaaattggaatcgacaagttgcattttgcaacttcacatttatacgtagacatggcggaactggcaacagctcgccaggcagaacctgataagtatttgattggtattggtcagtctaaaatggcggtgattccgccgagtcaggatgtagtgacgttagctgctaatgctgccgcaccgatgctgacagcgactgacattgcggctattgatttattagtcgtcggtaccgagtcggggatcgacaattccaaagcgagtgcgatttacgtcgctaagttgctcggtttgagtcagcgggttcgaacaattgaaatgaaagaagcctgctatgcggcgacggctggtgtccaactggcccaagatcacgtgcgtgttcatccagataaaaaggcgctggtcattggtagtgacgtggcacgctacggattgaacacaccgggcgagccaactcaaggtggtggggcggttgctatgttaattagtgcggatcctaaagtattagtactgggtactgagtcaagtctactgagcgaagatgtgatggacttttggcgaccgttgtatcatacagaagccctagttgacggcaaatactcgtctaatatctatattgattattttcaagatgtgtttaagaattacctgcaaacgactcaaactagtccagacacactgacggccttggtttttcatttgccatatacaaagatgggacttaaagcgcttcgaagcgtgttaccattagttgatgccgagaaacaagcccagtggttggcgcacttcgaacatgcgcgtcagctaaatcgacaagttggtaacttgtatactggttcactctatttgagcttgttatcgcagttactgactgatcctcagttacaaccagggaatcgactcggattattcagttatggctcgggtgccgagggtgaattttataccggggttattcagccggattatcagaccggtttagatcatggcctaccacaacggttggctcgtcgtcgccgagttagtgtggcggagtatgaagccttattcagtcatcaattgcaatggcgggccgatgatcagtcggtcagctatgctgatgatccccatcgattcgtattgaccggtcaaaagaacgaacaacgtcaatatttggatcaacaagtttaaacaaaaaagtcacttgttactagcaaatttgctagacaagtgacttttcctatttgaagttattggtcataatttgaccatcttggacactcaacagcgtcttgtcagtggtatctggttgtagcaactgaatcgtgtaaccagcggcaagattcttttggagcgattttgacaacgatttaaaattcgaagtaatcgtggtgattgctttttggttttgagatggatatgatttaatcgtcttcaaagatttaacgtactttttattggttggcgtaatcgtatatgttttcgttgacttggtgaatgcaacggtaccaatcgattgatagttagattgtaattgtttaaggatattttcttcattcaacttagtcgttgcggccgcgcgtttggtgctggcttcgttaaaaacgacttgtgaggaactcaagctcgttgatttggacttgctggtactagcgctagtactcgtgctagatgatgctttgcgcgccgattgctgtgactggttgtatggccagtaaggcaatttaacgaccgcgtagatggtgaccagggcgctgaggaccgtaattagtgttagaaatttccaaccaccaccggtttgacgtgcgtaaatcacggaaaataatgctaatagaaaaacaatcaagcccataatggctaggaacaacatgtaaccaactcccaatgtttaaaatagtataatcattataccattgaactattggctgttcgtcacagatttgaaatattttgaaaagagatccgactaataaccaatttgacgccagcactttttctgtcgatacatcgggagaatcaggcgccgctgattcaatagcaatggtgctaccaccaaatcacagtaacgccacagtgggatagtgttgatgcctggcgcaaggtgcctgcagcgtatctctcagcgcacggttgtttacaacaagtgggtggtatatttacgagctaccgataaataggtgcgacgagtaggtatcgcgcttcgattaggcttgaaagaggacggattgccaatttacaaacggcgatactaacgaatcggggtgatgatgacttttttattcagaaggcaatcggttgggcattgcgggattatggcaaggtgaattcggaatgggggcgtgcttttgtcgcaaataacgtgctctcgtccctggcacggcgggaagggtgtaaatatttgtgagtggaatctgtaggcatgccatcaacctgctctaaaaactggcgaacaaaaaagatgacaaattgaattgtcatcttgtgggtgatagtttactgaaacagcatgtcgcgatataaaccgacaactttgcctaatacagagacgttgttcaagataattggggccatcgtgtcgttctcaggttgtagtcggtagtgatcggcctctttgaagaatcgcttgcaagtcgcttcattttcatcggtcatggcaatgatgatatcaccattgtcagcggaactttgacgccgaacaatgacttgatcaccattcatgataccgatattgatcatactttcgccacggatggtgagcatgaaaaggtcgccaccgaatgattcaagttccttaggaattggaaaataatccgtcgcttcctgtacggcaagaattggttggccggcggttaccgttccaagtaccggaatttgatgtggcgtagtttcgacgcccagtgcttcgaaaccggctggcgttacctcaatggcacgtggcttagttgggtctttttggatgtaaccttttttttctagccgtgaaatgtggccgtgaacggtcgaagtcgaagataagtcaacggcttcaccaatctcacgaacggttggcgggtatcctttttcattgacacgttcataaataaagcgaagaacggccatttgtttgctttccgatgttttactcatcttggcacctcattttttattttcattattggttaaaccaattgtagcatagcgtttcatagctttcaaacaaatgttcggttgacaaacactattaattgatttagggtctattttcgtgtatatttcaagagtgaaaggggctgctgatttgatttcaaaagaattgcttgctcggatcaatgagttagctcataaggcgaaagccgaggggctcaccgagctagaagaagccgaacgtcaagagttgcggcaaaaatacttgaaggaatttcgcgccggttttcggcaacaagttgaaatgcttcaggtttatgataaagatggtaaagaggttacgccagaaaaggtccgtcaagtgcaacgcgatcgcggtcttcgagatgattaaccgatttcaggaaaatttgtcaactgacaaattttccttttcttttattattaatttgtgtagactagtttaatgaagactgtaataagggaggggaatgactgtgtctacaggaatttggattttaatcgtcgttatcggcgtattggttgggttaactggtggtttcttcggtgcccggcactatatgcaaaattacttgaagcaaaatccaccaattagtgaagagatgcttcgtagtatgatgatgcaaatgggtcaacgcccatccgaaaagaagttacatcagatgttgaattcgatgaaagctgcatctaaaaacgataacaagtagtaaaaagtgtcggctcgctttaaattgcgatcaccgacacttttttattatcgaacttaatgtttctgacgggttgtagcaggatcaacgtatttgaacgttgggtcgatttgacgatccaagtcgtcaaaagcgtgcaacattttagtctcaatttgtttttgaccagcttcatccaatttcagtttacgatcaatatcaatcggttgaccgaaacggacggtaacccgctgacggctaaagagttgtttgaaggtcaatgggccttggtaaacggttgggactagtggaacaccggccatcttagcgatgacggttgcaccgcccttaagttcttgtgagtggcgcgttcctgatggaaacatgattagtgaaagcttaccgctgcgcaaaaatttgacgggggtcttgattgctgaaggtcctggatgttgccgattgacaggaaaggcgttcgcatgaacgagaatgaaccgcagaacgggattcttaaatagttcttccttagccataaagctaaatttcattgggctgccagccagtgcatagtacaacgggtcaaaccacgtgcggtgtggcccaactaagatataggccccctctggtaggttttcccgtccttgatagcggggccgaccgttaataatggtgatgattagccggactagtccgcgcataaatgaataaaacatcacgatcttcctttcgtttaataactgctcacagtatgacgaaatttggcaaattctgcaagttaattgtatgatagctgtgcgacgaattgaatggagaggtggccgaatatggcagatgtcacgttacacgccgatgagcgtattgatcaattatatagtcaagatattcaaatcattcaaagttctcaagtctttgcgttctcactggatgctgttctgttgggtgactttgcccaggttgcgaagggcgttaagagccagatcgtggatctctgtgctggcaatggcgcagtaggtctattcgccagtgctaaaactcaaggccatattacggcggtcgagattcagccccggttggccgatatggctcaacgcagtgttgttttgaacgatttaacccaacaaatgacagtcctgaacgaagacttactggaaattacgcgccaactaccgaaagattcggtggatacagtcttatgtaacccaccgtattttaaagatcgaccgcagagcgttaaaaatccaaatcctcatttggcgattgcacggcatgaactgtccgctaatttagatcagatcctagcggtaactagtgatttgttaaaaatgaatggtaaagcatattttgttcatcgtcctgaacgactagatgacttgttcagtaccatggcgaccaatcggttggcacccaaacggattcggttcgtccatcccaaagcacaacgggaagcgaacatggttctgatcgaaatgatcaaggatgggaaacgcaacggtgttcgaatcatgccaccgcttgtcgtttatcgtgatgatggtgaatacagggaagaggtgcacacattactctatggcaagcacaagtaagccggctgcgtccacgacggcaaccaaaaaatattatttttatgtcctattatgtgctgatcaaacgttgtatggtggttttacggataacttgcagcgacgattagcaacgcacaatgcgggcaaaggggctaaatatacgcgggtcagctcacggcggcctttgcaattaatttaccatgaaactttcagtgacaaatcaagtgcgttaaaggctgaatatgccttcaaacaccaatcgcgagctgccaagctaaaatacttgtcagctcacgatgtaaaaatttagcgaagttttcacaatttatgattctatttctcgcatttactgttataatatttactgtatcaatatataggaggaatttttgtaatgaaaattattgcatatgctgtacgtgatgacgaacgtccattcttcgatacttggatgaaagaaaacccagatgttgaagttaaattagttccagaattacttactgaagacaacgttgacttagctaaaggcttcgacggtgccgatgtataccaacaaaaggactatactgctgaagtattgaacaagttagccgacgaaggggttaagaacatctctcttcgtaacgttggtgttgataacttggacgttcctactgttaaagcacgtggcttaaacatttctaacgtacctgcatactcaccaaatgcgattgctgaattatcagtaacgcaattgatgcaattattacgtcaaaccccattgttcaacaagaagttagctaagcaagacttccgttgggcaccagatattgccaaggaattaaacaccatgactgttggtgttatcggtactggtcggattggccgtgctgccatcgatattttcaaaggcttcggcgctaaggttatcggttacgatgtttaccggaatgctgaacttgaaaaggaaggcatgtacgttgacaccttggacgaattatacgcccaagctgatgttatcacgttacacgttcctgcattgaaggataactaccacatgttgaatgcggatgccttcagcaagatgaaagatggcgcctacatcttgaactttgctcgtgggacactcatcgattcagaagacttgatcaaagccttagacagtggcaaagttgccggtgccgctcttgatacgtatgaatacgaaactaagatcttcaacaaagaccttgaaggtcaaacgattgatgacaaggtcttcatgaacttgttcaaccgcgacaatgttttgattacaccacatacggctttctacactgaaactgccgttcacaacatggtgcacgtttcaatgaacagtaacaaacaattcatcgaaactggtaaagctgacacacaagttaagtttgattaatctcgattatcactgaaaatggcgtcactcatctgagtgacgccattttttatgctttcacctaaatggggccttttcgaagcgttaaccccaagcgtactttcaatgctgttattatccataacaaaaagcccacaatagagctggttgcacgactgtgggcttcacaagtgagcgattttgttagcgataacacaattaagtgttgctaggtaaaggtcttgctagcacgtacttaccgtggttgttaccagcataagttgctcgtagctttaacgccagtatgcgtctatgaagcgctggcggcttgaagaagtgctagcaatagttcatttagttccgctggactctggatgatttgatcaggaattacgctcggtgtcacctggtcattgcgccggtgattaaaccaaaaagtttgccacccagcgtgtttggcactggtcatgtcgagtgctgcattgtcaccaacgtaaacggcttcgttggccttgatgccaacctgatgggcccacgtcgtgaagatcgatgggtcgggtttagcaatacccaattcttctgagataaagatgttatccggatgcacgaaatgttcaatttgtaattgatgtaacttttgatgctgaatcggcgctggcccattggtaatgataccaattttaaaagcgtgactgagtttagtcagcgtcgcactcagcccatcgaaaaggcaaatctgatttagttcctgctgataggccatttcaaattggatagcccgatcagtgctgatgtggactttgctgggtgctaacgcgtgtcgaatacgggcggtttgccacgcttccagcgtcatagttgtatcagtgacctggttaaaggtacggtcattaaaatcatggaaccggttaaaaatttgtgccaattcagtgctgctcaaagcctggttaaaagttttagttaaggcagcagtgaacggtgatttttgatcatacaacgtatcgtcaaggtcaaaaatgatggcttttatcattattaagtgagccccctatgcgagattgtattttaacacactttcaggaattcacaaattcttgatgaaattgcttgcaagcactagtaattttcggtatactaattttcggcgttaaaaccaattcacacctactgcgataatcatggcggtgctcgggagagtgccatgattagttgaacggtggggaggaataaaacaaattttttggaggcacatttattatggctgttatttctatgaaacaattgcttgaagccggtgtccatttcggtcaccaaactcgtcgttggaacccaaagatgaaaccatacatctttacggaacggaacggcatctacatcattgacttacaaaagacggtcaagatgattgactcagcttacaacttcgttaaggacgctgcggctgatgatggtgttatcttgtttgttgggactaagaaacaagcccaagattcaatcgaagaagaagcaacccgtgcaggtcaatactacgttaaccatcgttggttaggtgggactttgactaactggaacaccatccaaacacggatcaagcgtcttaaagacttgaagaagatggaagctgatggcaccttcgaacggttacctaagaaggaagtttcattattaatgaagcaacgtgccaagcttgaaaagttcttgggcggtatcgaagacatgcctcggattccagatgtaatcttcatcgttgatcctcgtaaggaacaaatcgccgttaaggaagctcaaaaattgaacattccgatcgttgcgatggttgatacgaacactgatccagatgacattgacgttattattccttcaaacgatgatgcaattcgtgccgttcgtttgatcacttctaagatggctgatgctgtcattgaaggtcgtcaaggtgaagacgaagatgttactgaagattctttcaaggacaacaaggacgctaagaagtccgttgactcattggaagacatcgttgaagctgttgaaggcgacaacgacgccaagtctgacaaataattaattgaaataattaggctgcctaaaaatcgcggaccattacggcctgattttgcgggcagctttttatctaaaatcaagatactcaaaggagagtaaactatggcaaagatttctgcagcacaagttaaagaacttcgtgataaaaccggtgttggtatgatggacgctaaaaaggcgttagttgaaactgaaggcgacatggaaaaagccgttgacgttttacgtgaaaaaggggttgctaaggccgagaagaagagtggccgggttgctgccgaagggattgctgctgttgcaatcaaggacaacaaagctgccattgttgaaatcaactgtgaaactgattcagttgcttcaactgacaagttcaagaacttggtaactgaagttgccgacaagatcgctgaagaagaaccagcttccgttgacgacgccttagctttgaagacggctaacgggacggttaaagatgacgtcatcgaaacgactcaagtaactggtgaaaagatcagtcttcgtcgtttccaagttgttgaaaagggtgctgaccaaagttttggttcatacatccacaacggtggccaaattgcagccttagttgtcttagacggtgctgacagtgctactgctaaggacgttgccatgcacgtcgctgctatcaatcctgaatatgttaaccgtgaacaagttcctgctgaccggttagctcatgaaaaagacgtgcttgttaaggaagccttgaatgaaggtaaacctgaaaagattgttgaaaagatggttgaaggccgtttaaacaagtggctttcagaaattagcttggatgaccaagaattcgttaaggattctgatcaaactgttgcgcactttgtcgaatcaaagggtggcaaggttagctcattcattcgttttgaagttggcgaaggaatcgaaaagaaggctgataacttcatcgatgaagttatgaaccaaattaaagactaattactgactaagggattagctaattggggattacgacggaaagcaattttcggcgtagtccctttttgtaaagtaacgggttgaagccgctttaaaaagagaattcggttaatttttgcgccggattacggctgataccaaacgcttattgaaatatatggtaaaatgatagacagataatttcgaggaggacaaaacgatgtcggaagttaaatataagcgtgtaatcctaaaactgagtggggaagccttagctggtgagaagggctttggaatcaatccccccgtcattaaaacggtggcagaggaacttaaggacgtctatgacatgggcgtacaaattgcaatcgtcgttggcggtggcaatatgtggcgtggcgaagctggtgcccagatgggtatggaacgggcccaagctgattatattggcatgttagctacgattatgaatgccttggcactccaagataatctcgaatcaattggtgtgccgacccgggttcaaacatccattgaaatgcgacaaatcgcggaaccatacattcggcggaaggcaatgcgccatctagaaaaacgccggatcgttatttttgccggtggtaccgggagtccatatttctcaacggatacgaccgccgcattacgggccgctgaaattaacgcggatgcgattttgatggccaaaaatggcgtcgatggtgtttactcggctgatcctaacaaggatgctagtgcagttaaatttgatacgcttacccatctcgacattatcaacaaagggttacaagtgatggacactacggcaagttccttatcgatggataatgacattcctgtcgtggtctttaacttgaatgaacctggaaacattcggaaagtcgtcgccggtgaacacatcgggacaacagtcagggggaaataatatggcaattacagaaccaattttaaaagaagcacaggaacggatgaagaaggcggaagccgctttacaacgcgagctcggtaatattcgggctggccgggctaacgcatcattattgaatcggatttctgcagattattacggtgcgcaaacaccacttaatcagatggcggcaattacagtacccgaaccacgggtcttaatggtgaccccatttgataagagtgcccttaaagaaatcgaaaaggctattttagcgtcagacctcggtattagcccagctaacgacggttctgcgattcggttagttattccgcaattaacggaagaacggcgtaaagaacttgccaaggacgttaaggcggaaggtgaacgtgccaaggtcgccgttcgaaacgtgcgtcgtgatgcaatggaagccttgaagaagggccataaagatggtcaattcactgacgaccagttacatcagttagaagaccaagcccaaaagttaacggatcaagcgggtaaggacgtcgacgcgatcgttgcggacaaagaaaaagaaattttggaaggttaatgaccgaccaatttattaaggcttggagaaattcaagcctttttttgttgacgaatagttaattagtgctttttttggtaaaatagtgcatagttaagctatttttatggaggtgcgccttgttcgctttttttaataagaatgatcctgcagataacaccgacgtgcaattggatcctgaacgtattccagcccatgtcgccattattatggatggcaatgggcgttgggccaaagcacggcatttaccacgggttgctggccataaggaaggtatgaacacggtcaaaaagattacgattgccgcaagtgatttgggcgttaaagtcctgacgctttacgcgttttcaactgaaaattggaagcggccaactgatgaggttaattacctcatgcaactgccagtgagtttctttgatactttcgtaccggacttgataaaaaataatgtgcgggtgcaagtcatgggctacgttgatcacttgccagaagcaacgcaaaaagcagtccaaaatgcgattgcagataccaaagattgtgatgggatggtgctgaactttgctctcaactatggttcacgggccgaaatcgtgaccggggtgcaaaaaattgcccagcaagtgcaagatggtcaattggcggttggtgatatcgatgatgcaaccatcgacgcagcactgatgacggcaccacttgcgccatacaatgatccagatttgctgattcgcacgagtggtgaagaacgcatttcaaatttcttaatgtggcagattgcctacagtgaactggtctttactgatgtgaagtggccggatttcacagcggcgacccttcaagcctgtatcgcggattttcagagccgtgatcggcgctttggtgggttgtcggatcataaataaaagggagtttttggtatgagacaacgagtcattacggctgtcgttgcgttaattttatttatcccagtcatttttgtgggcggggtaaccttagatattgtggccatgctgttaggggccgttgcgatgagcgagttactcgtgatgcgtaaaaaattattgatttcatttgaagcaatcgtaagcatgcttgcagttatgattcaaattgcaccgaataactggttcaatggcttaccagaccaattaaacaaggagtacgtggtttacttcttagttatcttgctactgttacacactgtgtggtcgcggaatcgcttttcatttgatgatgccggaatgttgacgttaggcgtcctgtacatcgggatgggcttcaactacttcacggctgcgcggggtgtcagtgtttacatgttactcttcctgatgttcattgtctggctgacagatagtggggcttacatggtcggacgcaaactgggtcggcataaagtcacaccgatcagccccaataaaacatgggaaggttgtattgggggtagcgtgattggtgtgatcgttgccagtgcctttgcaattgggtttcacgtcggctatgctagcgtcatcagtatggtactgattactttagtcttatcagtagttggccagtttggcgatttagtagaatccgcgttgaagcgttactatggtgttaaggattctggtaagatcttgccgggacatggcggtatcctagatcgatttgatagtatgttattagtttttccaattgcacatttattcggcctcttttaagctgagtacccgaaacgcgggagaaaggagcgcttaattgatcgttacaattattacgttcattatcgttttcggaatcttggtcatcgtccatgaatttgggcacttttactttgccaaaaaggctgggattctagtgcgtgaattttctgtcgggatggggcccaaggcggtcgcgtttcgtcgtaatgcaacaacttatacgttacggtttctgccaatcggtggttacgtacggatggccggtgtggccgatgatgaagatgaagaactcaagcccggaacgccagttagtttgcaaattggtccggatgggattgttcattcaatcaatgctagtaagaagacaacgttgttcaatggaattccactgtcagtgacggcgactgatctcgaaaaagaactctggatcgaaggttatgagaacggggacgaaagtgaagttaaacactacgccgtcgatcatgacgctacgatcgttgaaagcgatggtaccgaagttcaaattgcaccggtcgacgtccaatttcaatcggccaagttatggcaacgaatgttgacgaattttgccggaccgatgaataacttcattttggccatcattacatttgcaattcttgcctttatgcagggtggtgttacgagtacaacgacccacgtagcggcgacgacagcagactcagttgcccgtacggccggtattcaaaagggcgatcaaatcgtggcggttaacggtaaaaaaatgacgagtgcccaatcgatttcgctgttgattcaagacagcccgaagcaacggttgactttgaccatcaaccgggccggtcagactaaaaaaattgcggttacccctgctgccaagacggtctctggtaatcgaatcggtcaaatcggggtccaatgggcgactaagaccgacacgagtctgggggccaagttagcatacggctttactggttcgtggggaattaccaaacagatttttcaagtgcttggtcggatggtcactcacgggttcagtttgaacgatttaggtgggccggtggcaatctttgccacgacctcgcaagccgctaagtccggggtgcgcacggtgatctatttgctcgccgtgctgtcgatcaaccttggaattgttaatttattaccgattccagcacttgatggtggtaaactattattaaacattgttgaaggcattcggggtaaaccactacgggtggaaacggaaagtgtcattaccttgattggttttggcctcctgatgttattaatgattctagtaacttggaatgatattcagcgatatttcttctaagtgatatttaatttggaacaataaggagaagatttgtagatgaaacagtcgaaattgttaatcccaacactcaaggaagtgcctaatgatgccgaagccttgagtcatcaaatgatgttacgggcgggctatatccgacaaatttcagccggaatgtacgcttatttgccattggcttaccgcgtattgacgaatattgaaaaaatcattcggcaagaaatggaaaaaattgatgcagcggaaatgctggtaccagcagtcattccagctgagttgtggaaagcaactgggcgttatgagacatacggtccagaactattcaagctgaagaaccgccatgaccgagaatttatccttggccccacgcacgaagaaacatttacgtcaattgttcgcgatgaaatcaaatcgtataaacggttgccattgactttgtatcaaatccaggctaagtatcgtgatgaagatcggccacgttatggattacttcgtgggcgtgagttcatcatgaaggatgcctattcatttcacgcggatgaggcctcattagatgacacgttccaagatatggcgcaagcttatcagaatatttttgagcgggtcggtttgaagtttcgttcaatcatcggtgatggtggggcgatgggtggaaaggattcccgtgaatattcggccatcgcaccggttggtgaagatacaattgtttattcggatgcgagtgattatgcggctaatcttgaaatggctcggagtttatacgtcccaaagaagtcacatgcttcgttaaaggatatggaaaagatcgatactcccggagtgggcacgatcgacgaactggctgagttcttaaaagttggtgctgaccaactggttaagagtattctgtttattgcagacgatcagccagtaatggcactggttcgtggcgatcatgaagtcaacgatgttaagttgaagaattaccttggtgcggatttcttggaaatgactacgccagaacaagcccaacaatatttgggcgctagctttggttcactcggcccagttaacgttcatgatgacgttaaaattgtcgctgaccagtatgtgaaggacatggtcaacattacggtcggggctaacgaagacggtcatcacttcacgaacgtcaaccctgaacgtgatttccacgcggaagcttacgttgacattcgctttgttcaggaaggtgagttatcaccagatggtgcgggcgtcttgaagttcaccaagggtatcgaaattggacatattttcaaacttggcacccgttattctaaagacttgcacgcagaagtcttggatgccaatggacgtaatattccggtaattatgggctgctatgggattggtgtctcacggttgttgtctgccatcgctgaacaacgcgctgatgaaaatgggttgatttggccaaaagcaattgcaccatttgatgtgcacgtgattccggttaacccgaagaaagcggaccaggttgaggttgccgaccaagttgaagcacaattagaagccgctgggtacaacgttttgtatgatgatcggaaggaacgtcctggtgtgaagtttgccgattccgacttaatgggcattcctgctcggattaccattgggaaaaaggccagcgaaggaatcgtcgagattaagcttcgccagactggtgagactttggaagttaaacaggaagaaatcgccaacaacttggccgttctgctcaagaatatcgattaaaatgctgcaaaactaagttaataaaaatatggcaactacccgttgatagtcgccaacaacaatcacctggttggattctgttgactgggtgatttttgtttgccgattaatcacgtggctcaacggtcagactgtgataaaatagtaacgtttcaagtgaacgatttgtgcgttcgctgaagattatttcagatgccgttaatcaccgaggcatcacgctgtcggttaagcaaactgacaaagtagtgccaactgtggaccgcggccttgagcacttaattggggttctagttaatattaaaagtcttgcttggcattgggttagttgttagcgactaagtcattgttgaaacgagattctatttctagcgggtcacggttagcggcttttgattttaagattggatttgctttaatatatatgcaagcgcaaattaacaagtacggtgcgtgtcttactaactgattgtaatcaacaaaaggaggaccactggtgagtttaaaccaacaagaaatgttcgagaagttactcgaacaaattgaaatgccaacgggtcctgaatttacagaagcagcgatcgataaattgaccgttcatcaagcttccaaggtttgggaatttcatttgcatttccaacatgttttaccttatacacaatttatgacttttcaaaacaaactccaaatcgcctttaaagaaattgcacgcgtgacctttacgatcgtgactgatgataccgaggtcaatggtcgtgaactagctgaatactgggaatggatcgttcagcacagtgggatcaagtcgcccctggtccaatcattgtgtaacagcaacgtgccgacttatgaagatggtcgggtcattttgttggctgaaaatgaagttattcaaaattttctaactaaccaagcattagggccgattgagagtacctatcatcgcttgggcttcccgaagttctccgtccacacgatgattgatgagagtgcttcacaggcgaagatcaaggaatttcatgaacaaaaagcgaagtctgatcaagcgttggctcaaaaagcggaagcggctatcaaaaaggccaatgagaaacggcaaaagcaggcggatgcaccagcaccaattgatggtcctgtccaattaggcaagcagatcaacccgcaagagccggctaaacagatggtccaaattactgaagaagaacggtcggtcgtcgtggaaggctatgtcttcgatatggaagtgcggacgttacgttcccagcggcagttattgattctaaaggtgaccgactatagttcgtcaatggtcgtcaagaagttctcacggaatgctgatgacgaggcacaattcgcggcactgaagcctggaatgtgggtacgtgtacgtggttctgtgcaggaagatagttttatgcgcgatttaacgatcaatgcgtatgatattaacgaaacgtcgcatgccagtcggcaagacacggcgccggcagatgagaagcgggttgaattgcacttgcattctaatatgagtcagatggatgcaaccaacagtgtcagtgattatgtcaaacaagccgctaaatggggccatccggcgattgcgattacggatcattcgggggcgcaggcgttcccagaagcgtttgcggctggtgaaaaaaataatatcaaaattttatacggtgtcgaagctaacatggttgatgacggggtgccgattgcttataatgacgcccacgttgatttgaaagagtccacctacgttatttttgatactgaaacaacggggttgtccgccatttatgaccgggtcatcgaattgtcagcggttaagatggtcaaggggaacgtcgttgatcagtttgaggaatttattgaccctggttttcacttgtcggaaacaaccactaatttgacgagtatcaccgatgatatggtgcggggctctaaatcggaagaagaagtgtttaaacttttccgcgaattttatggtgatgcaatcgtggtcggtcataacgtcacctttgatattggctttatgaatacgggctatgcccggcatcacatggggccgattacaaatccaattattgatacgttgacgctggcgcggtggctgtatccgaatttacgcgggtaccgcttaaacaccctagccaaaaaattcaacgttaatttggagcaccatcaccgcgccatctatgatgctgagacgactggtcatttgaaccacctgtttttgaaagatgcggaggaccgttatcaggttcaattccacgatcagctgaatgatcatatgaatgaaaatgcggcttaccgccatgcccggccatttcatgcgacattgtatgcgcaaacccaagcggggttgaaaaatctcttccgaattatttccttgtcgaatgttgagtactattaccgcgtgccccgtgtaccccgcagtgttttaaacaagtatcgggatggcatcctggtcggttcggcttgttctagtggtgaagtctttactgcaatgatgcaaaaggggaaggaagaggcccgacaaaaggccggctactatgacttcctggaagtacaaccgaaaccggcatattcggcgctgatcgagagtggtttgattgctgatacggatcatttggaagaaattatcagcaacatggtggaactaggccatgagatgaatatcccggtcgctgctacgggggatgtgcattatctgaatcctgaggataagatttatcgtaagattttgattcattcacagcccggtaacccgttaaatcggactgaacggccagacgtgcattttcgctcaacggatgagatgcttaaagatttcgatttcttaggtacggagacggcacatgaggtcgtggttgacacgccccgcgcgcttgctgaccaatttgaaatcgtgcgaccggtcaaggataagttgtatactccgcggatgaagggtgccgaagcggaaatcgaaaaactgacgatggaccgtgcccatgcgtggtacggtaatccgttgccagaaatcgtccaaaaacgggtggataaagagctgaagagtatcatcggtaacgggttctcggtcatttacttaattgcccaacgcctagtgtttaagagtaataaagatggttacttggttgggtctcgggggtcagtcggttcgagtatcgtagcgacgctgtctgggattactgaagtgaacccgatgccaccgcattatcggtgtccaaattgtcagtactcgcacttttatacgaataacgagtatggatcgggctatgatttaccacctaaggattgccctgaatgtgggactgacatggtgcgtgatgggcaaaacattcccttcgaaacgttcttaggattttatgggaacaaggtgccagatattgatctgaacttctctggggactaccaacctattgcccataattacaccaaagtcttgttcggtgagaaaaatgtgtaccgagccgggacaattggaacggtcgctgataagactggttatggttatgtcaaggcgtatgaacgggatacgaatcaaacacttcgttcggcggaagttgaccgattagcaaagggaacgactggcgttaaacggacgactgggcaacatccggccggtattattgttgtgccggattacatggatatttatgatttcacgcccgtccagtatccggctgatgatcagagtgcggcctggcaaacgacccactttgatttccattcgattcatgataatattttgaaaattgatattctgggacatgatgatccgacgatgattcggatgttacaagatttgtcgggtgtccaacctgagagtattccaccagttgatccgcacgtcatgaagattttctccagtcctgaagttttaggagtcacagaagaccagattttctcgaaaacggggacgctgggaattccagaatttgggacgcggtttgtccgtgggatgctcgaagagactcacccatccacgtttaacgaattacttcagatttcaggactttcacacgggactgacgtgtggttaggaaatgctgaagaattgatcaaggatggcacggttacgctggccgaagttattggttgtcgtgataacatcatgaccgacttgattcactacggcatggaatctgatatgtctttccaaattatggaacacgtgcggaagggtcgggggatcccggatgaatggcaacaagcaatgaaggatgccaacgttcccgactggtacattgaatcttgtctaaagatcaagtatatgttcccgcgggcccatgcggcagcctatatcttaatggcgttgcgggtggcttactttaaagtgtacttcccgttgatttattacacggcttatttttcagtccgtgctgacgattttgacctggttgcgatggcccatggtaaagatgctgtcaaagcgtcaatgaaggcgatcactgacaaagggatggatgctagcgccaaggagaaaaacttactgaccgttttagagttagccaacgaaatgttggagcggggctttaaattctccatggtcgaccttgacaaatctgatgcttcggattggctgatcgatggtgatacgttgattgcgccgttccgagcagttccggggttagggttgaacgttgccaagcaaatcgttgctgcccgagcggacaagccgttcctgtcgaaggaagacctgtctaagcgtggaaaagtgtcgaagagtttgatcgactttatgactgaaaatggtgtgttaagtgatttgccagatgaaaaccaactctcgttgttctagaaaacacgacaattgttaaagtttgatgaatttttgcggtggttgatgcatttaacagcactcagacagatttatctgatttagggcctgtaatgttgatacaccggcaattgtcaggctgttgaagcggaagtttaccgtgacttgaaagctaacggctaaatgctataaatggcgtaaacttgcggtttcaacataattgtgctaatatatgggttgtaatttaaaactcgttaacgagtgagcagcgatgctcactctttttattggactaatctgaataggaggcgcagccttgagtagtaatgttgttgaaaccattcagccagtggccgcagccattgtcagtgctcaccagtttgaactcgtggatcttgaatttgttcgcgagggtcaaagctggtatttgcgattatacattgacaaaccgggcggcattaatattgaagaatgtgcaatggttagtgatgaacttagtgaaaagctagatgcgatggagcctgatcccattccccaagcttactttttggaagtttcttctcctggtgcggaacgcccattgaagaaggaagcagattttcaaaatgctattggtaagtacgtgcacgttggcttataccagaagttggatggcaagaaaatttttgaaggtgatttgacggcggtgacgccgaccactttgaccatcgattacttggataagacacgtcacaagacggtgacgatcaaccgagaacaaatctcacaagcccgcttagcggtaaagttctaaataagtaaaggagtctacacatgagcaaggaattattaggggccttagacaccctcgaatcagaaaagggcattaaaaaagaagttgtcatcgaagccttagaagcggcactcgtttcagcctataagcgtaattatggccaggctcaaaacgttgaagttgactttgaccaaattaagggtaatattcacgtttatgccgttaaagaagtggttgaagacgtctttgattcacgtttagaagttagtttgcaagatgcattggctatcaaccgagcctacgaaatcggtgatgatattcgatttgaagtaacaccgaagaacttcggccgaattgcagcgcagacggctaagcaggtcatcatgcaacgagttcgtgaagcagaacgtggcattatttatgacgaatacagccagtatgaaaatgaaatcgtcactggtgaagttgagcgccaagataaccgatttgtctacgttagtttgggcaaagtagaagcggtcatgggtcgttctgatcagttacctggtgaagtttatcggattcatgacaaaattaaggtttacgtctcgaaagttgaaaacgcaacgaagggcccccaagtattcgtttcgcggactgcaccagatttgttgaaacgtttgtttgaacaagaagttcctgaaattttcgatggcatcgttgaaatcgtttcgattgcacgtgaagccggtgatcgggcgaaagttgctgttcgttcaaacaatcctaacgttgatccagtcggtacctgcgtcggtcccaagggacaacgggttcaaacgattgtcaatgaattacacggcgaaaatatggacatcgtggaatggacggatgatcaagccgtatttatcgcgaatgcattgaacccagcggaagttttggatgttatttttgatcctgaaaatgagcggggttgtaccgtggtcgttccagattatcaattatcattggcaatcggtaagcgtggtcaaaatgctcgtttagctgctaaattgaccgggttcaagatcgatattaaatcggaaaccgaagcttctgatataatggatgcaaaccctgatgatgttgcagttgccgaaacggaaacgactgaagcagcatcagacgcggcagtgcagtccgataccggcgaagatgaggaaccagcaacgtccgacgcagccgtggcgacgcctgcctcagaaactgctgtggatgaatcagcaagtgacgctgaataagttcgtcactaagtgagtgaagtaactaaaggaggtctgggattatgaaaaaaagaaaagtgccgttacgaaaggacattgtgacgggtgaaatgcatcccaaaaaagacttagtccgggtcgttaagaataagcaggatgaagtgtccgttgatccgactggtaaaaagccgggacgcggcgcctacattgccttagacgtacaagttgcacaacgtgccaagcaagaaaagacttttgataaggcgtttggtatcaaagtgggtgcagacttttacgatgagttagtggcttatgttgatcatcaacaagcccgaaaggaactcttcggaaatgacgcctaagcaagcttgtttaaacctactgggcctttcacggcgtgccagcaagcaaattgcaggcgaagggctagccctggctgcaattcgtaatcagacggctaaactggtctttattgccagcgataccggtcccacgactgccaaaaagtttcatgataaggcccaatcttatgatgttccagtgatcgatacctttactaaagcagaattaaatacggctactggtaataagcgcactgtttatgcaattaccgatgccggatttgccaagaaaatggtggcgatcatgacacagtaaaggagggtgaagatatggggaaaaagcgaatttatgagttagcgaaggagctcaacgtcccaagtaaacagctgattgcgcaagcacagcagttgggattctccgtcaaaaatcatatgtcgacactcggtgacagtgaggcgcgccagttacaaggcacgaccacagttacccatcctaaatctcaaccggctccagctaaaacgagtcgggctacgcaagccgtagcaaaaaatgtgacacgaactgctaatcagcagcaatccaactcgcgtcatcaacagagtggtgattctttgaataataatcgtaataataaccaaaataatagtcaaagtcgtaatagtaacggtaatcgaagcaataatggcggtaaccgtactaacagtaataacggcaatcgttcggccaatgcttcacggagcaacagtgctcgtaataacggtgggagcaatacgaaccggtctaacaacaataataataataaccggtctaataataacaatcgctcaaatacgagtaacaaccgtaccaacagtaccggtaatcgcaccaataatggtggtcagaaccggaacaacaaccggactacgacgaacaacaataataacaacagtaaccggagcaatgggtcgaataatagttcgcgtaatggcagcggtcgctttggtggtagtttgaatagcaacaataacggtggtggtcgttatcgtggcggtaacaacaataaccgtcggcgtaacaaccggaacaataagagccggaacaataagaatcaacggatccgccaggtcaataataagccagcgccagttcgtaaggacaagccgttgccagaaacactggtttacacggtcggcatgaatgcccaggatttgggtaaattattgcaccgtgagcctgctgaaattatcaagaagttattcatgttaggtgttgcagttaaccaaaatcagtccttggataaagatacgattgaaatcttagccactgattacgggatcaatgcgcaagaaaaggtccaagttgatgtgaccgatttggacaagttctttgatgatgaagttaataataccgacaatttggcgccacgggcaccggttgttacggtcatgggacacgttgaccatgggaagacgaccctattggaccaattgcggcatactcacgttacagagggcgaagccggtgggatcactcaggctattggggcttaccaagttaagcatgatggtaaggttattacattcctggatacgccaggacatgcggcctttactgaaatgcgggcgcgtggtgctgacatcaccgacatcaccgtgttagttgttgctgctgatgatggggtcatgccacaaacaatcgaagccatcaaccatgctaaggctgctaaagtaccaatcatcgttgccgttaacaagattgataagccgggtgccaaccctaaccacgtgatggaacaattgactgaatatggtctgattcctgaagattggggtggcgatacgatctttgttcagatttcagcgaagttcggtaagaacctagatgaattgttggatatgatcttacttcagtcagaagtgctcgaattaacggccaaccctaagcaaaatgctgcgggatctgtattggaagctagtcttgaccgtggaaaaggttctaccgcaacgttacttgttcaacaagggaccatgcatgttggtgatccaattgttgtggggaatacttacggaaaagtccggacgatgaccaatgaccatggtaagcggatcaaggaagccgtgccatcgacgccaattgaaatcactggtttgaatgatgtgccggatgctggtgatcgcttcgtggtctttgatgatgaaaagacggcccgtgatgctggtgaacaacgtgctaagcaggcattgatggaagaacggaagcaaactgctcacgtcaccttggataacttgtttgattcaatgaaacaaggtgaacttaaggaagttgacgtgattattaaggctgatgttcaaggttctgttgaagctttagctggtagtttacgtaaaatcgacgttgaaggtgtgcgggtcaatatcatccatacagcggttggggcgatcaacgaaagtgacgtggccttggcggaagcaagtaacgcgattattatcgggttcaatgtgcggccaacaccacaagccaaagcccaagccgatactgacgatgttgatattcgcttgcatcaagttatctacaacgcgatcgatgaaatcgagagcgcgatgaagggaatgctcgaaccaacttataaagaagaaatcactggtcaagccgaaatccgtgaaatctataaggtttctaagatcggtacgattggtggtgggatggtcactgatggtgtcatccaccgggattctggtgtgcgggtcattcgtgatggtgtcgttatttatgatggcaagttagctagcttacggcgtttcaaggacgacgttaaggaagttaaacaaggctttgaacttgggcttcgaatcgaagattacaacgatattaaagtcaacgatgtcattgaagcttacgtgatgaaggaagttccagttgaataacctttaaaagggggattagcagatggcacaacattatcgagttggtcgtttggaacaggaaatcgaacgcgaagttaatgatattttgttaaaacgggttcgtgatccacgggttgcgggtgtaaccattaccggtgtaacggtaactggcgaccttcaacaagcgaccatctactacagtattttgtcagataaggcatccgatggtgaaaagacggcggctggattgactaaggcgacgggattaattcgtagtgaattaggctcacgacttagcatctataaaaccccggaattaacttttgaacgcgacaactcggttcaatacggtagccggattgatgaattaattaataacttaaagcgtcaagattaggcgctggaaaaatagtcgttgtgaatccagatggattgacagcgactatttttgtgttcaaattgaatggagccgttcgctgtcaatcactgaggttaagcggtttagatggtgctgattgtagggtcacactagtcattcacacactgcttgaacgttgtcggtagactgactaatcaaggtagcctgctcgcgaccgtcgcaaacaattggtttaatgagtagtcgtactgaagacgatttttgtaaatagtagtaggatgaggcgaattacgcatcgtggcgcttttacaagcgaaaatgatttcttaattgcaaaattaaaatgaaattagggttgacgaatcaaaatgagaatgttttaatataagcaatcaatgaaacggaaaggatagatgattatgacgacgttagcattcaacgcaacttattattatggctttgcttattttaggtagcgcccgtgttggaaccttagatacggacggcacctacgttcgtgtctaagcgaagtcaattcatcttggccagctagacaccgtgagtctagctggaataatatcatcaattaggattaaattttgatgagccggctagattttcacaatctagccggctttttttatttccacgaaggagttgttattcatgcgtcagcaccaattatcaatcagtctttacttaaactactttattcatggtattggcttaattattttaacgcaaaacatgcaagcgttaagtcaacactggcagaccccgttagcgacggtttcctatgtcatttctgggattggcattgggcgcttactggcctactttattctgggaaatttatcagatcgttttggccgtaaagtcttcgtcaatcttggcatggcttgctacttcacgttctttgtggggatggcattggtcactaatattcagctggcatacggtttggcgattttggccggtattgcgaactccgcgttggatgcgggaacctacacgacgtttattgaaatgggtgggcggcaaggctcagccaatgtcttgttaaaggccttcatgtctgccggtgaattcttattaccactgctcgttgccaactttgaagcacaacgaatctggtatggctggtcatttatcctggccgcggcaatcctagtggtcaacagtatcctgttgaaccggcagcagtttccactaaaaaatcaagttgctcaagccggaacgggcgtatcccagcaaccacttaagaaccggcgctggttggcgacagttggtttagctggttatgggtatacttcgatggcacttatgatcctctacacgcagtgggtcagcttgtttgccactacgacgttgcatttttcgtcagtgttagcgcactggttgctttcactttacagcattgggtcaatcaccggcgttattgtgattttctggttgttacgtcgtggggtggcagaaaccaaattgttgttggcaatgaatggcggctcgctgctggcgttagcggttatctgttatagtccagcggctgggctgtccatgctggcggctttcgggtttgggtttactgctgcgggtggcgtgatgcaggtcggcctcaatttatttatcaaaggctatccccacatcaagggccgaatcacaggaatttatttcacgtttggcagtattgcttccttcacgattccgctcgtgactgggtggctgtcaaagcaaaatattgcgaccgcgatgcgctttgatttagttattgctgtcagtggtctcgcctttgtcggcctagctgtatgggcgctacatgtcccaaccacacttagtcaagaacgccaacgtatcaatcatattgaccagcaaatcgtccgattactcaatcaacgttttgagacggttacagccatcggggagttgaagcaacaacagcaacttccggtattagaccagcaacgtgaacaacgggtgttacaacaagttgcggtgaagagtacccagaccgcgcataccccttatttacaagctatttatcaagcaattatgcataactcacgcgcatatcagacggatttacacacgaatttacacaaggaggatattgatcatgattaattacgttacggcaggcgaatcgcacgggcctcaattgacaggggtgctgaccggtattccggctggcttacagctagacattgatgccattaatacaggcctcgcagcccggcaaggtgggtttggccgcggcaatcgccagcagatcgaacatgacaccgtccaaatcactggtggcgtgcggcacggtgttacgctaggttccccgattgcattaacgattatgaatcgcgatcacgcgcactgggcagcaatcatggatccggtaagtccagctacggcaaccaatacgttgcggcaagtcactcgtccacgtccggggcatgctgacttagtaggcggaatgaagtatggtcatcgcgatctacgaaacgtgctagaacgttcctcagctcgtgagacagccatgcgagtggctatcggtcagatttgtaagcaattattggcgcagctagatattcacctagttggctacgttcaacaaattggccctaagcaagtgacggccgatttaacactatccgttgatcaattacaagcccaaatcgcgcaaaatgatttgcgattaccagatgcggccttggttcccgaaatccatgagctgatcacagcaacgaagaaggccggggataccttgggtggtgttatccgggtcgttgccgaaaatgtgccggctggtttgggcagttacacgaactgggataccaaattagatggacagttagctgcagcagtgatgggagtcaacgccatgaaaggtgttgaaattggtgatggatttgcggctgccagccattatggtagccaagtgatggatgagattagttgggatgaacacgccggctggtcacggttgaccaatcatttgggcggctttgaaggtggcatgactaatggaatgccgattgttgttaaggccgccatgaagccgattccaacactttacaaaccattacaaagtgtggatatcgcgaccaaagtcagccaaaaggcgagcgtagagcgttcagacacgacggccatcgtccccgcctcgattgtggttgaaagtgtggtagcgattgaattaacgcgagcattgacggcaacgtttgacgggagtaacttagctcgcttccagcaaacagtgacggcataccgcgaagaactccgacaatattaggagggcttatgcagattcatactttaggcccgaccgccacggatagttacgcggccgcgcaagtttataatcatcgcaactggcaggaccaagcggtgattgtcgaacacccgagctttgaaaccattttaactgatttaacggcctattctggtgaccaactggtgataccagctgctttcaaatcagacacactgaatgccagctggggggatatacattacgcattattgtcccaattaacgttgagcagttgttttatgacccagctcgatccacttgtcgtgctccaacgagtaaatgccgataatcaaattggttacacgcatgcagcgaccgcccaattgttgacgagggtcgtgcatcaggtcgtggtgcaaacagtcgccagtaaatatttagcgtatcaggcttatcaacgtaatcaggcggcctacgtgctaactaatgagaaaaacgtgacactgacgactcatgaacgtgaacttgcacgtttgacaccttcgatggtgtggtgcgtctatcaaataaattaggtgatgatgattaatgataaaaaaactaagtattcaaccagctagtgggttacaaggtgacttaagtgtaccaggcgataaaagtgtctcacatcgaggcttgattttaggggcaattagtcaagggacgacgatcttgcatcactttttgccagccgccgattgcctatcgactttaacggcgctgcaaaagttaggggtgccaatcaagcgtgtcgatacgaccgttacaatcagtggccgcggcttacatgggttgacccaaccacaacaaccattagacatggggaatgcggggacggccactcgcttattaactgggttgttagccggtcaaccgtttgagacgaccttggtcggtgatacgtctcttagtcaacggccgatggagcgagtgcgtcaaccattacaagccatgggggcgcaggtacaattaacagccgggcacttaccgatgacgatcactggtcggactttacatggtagttgtaccgagatgcaggtcgctagtgcacaagttaagagcgccttgattttagcagccttgcaggccgatcaagcaagtacaattattgaaaaattaccgactcgtgaccacactgaacggttgttgcaacaatttggtggtcaaattgaaacggcgcctgatcagcgaacaatcacggtccaaccgcagccagccttggttggtcggtcactaacgattcctggcgatttttcctcggctgcttttttcgtgacagccgcgacgattattccaaattcacatgtccggttaacgaacgtgggactgaatccgacacgaacgggtttcttaaacattttgcgccggatgggtggtcaagtgacggtcgatcatggacaccgaatgggcgaaccagttggcacgcttgacgtgcggtttgcacaactgcacccggtccaagtcactgctactgaaattcctgccgtaatcgatgaactgccactagttgcattgttggctgcgactgcgaatggtattagcacaatcaatggggctgctgaattacgagtcaaggaaaccgatcgcattgcaacgattgtgaccgagcttcgaaaacttggtgtgcagatcacttcgcaaccggatggcttcgtgattgatggtcgcaagtcttggcggcagccgaccgagccattagccagccatggcgatcaccgaatcggtatgatgatggcgattgcagcgttgcgattagccgctcccgccgaactagagtccgccgaagctgtgaacatttcatacccgacgttctttgaagatttagcacgtttaagccagggggtgtgaagatgacaactgtattgatcaaaggtttggggctaattggcagttcgttggcactaagcattaagcaggcccatcccacggtgcacattattgggattgattgtgacgatgtcagcctgagttatgcgcgtcaacagggtatgatcgatgctagtggcactgatttggccgcggtcgcgagcgacgctgatgtgattattttagcggggccagttgatgtgatcgttgctgacttgcaccgactggctatgatgccactcaaggcaggggtgcttgtgacggatgtcgggagtactaaacaagtggtgatgcatgccgcgcttgccatacaacagcacggtgtgactttcatcggcggtcatccaatggcgggttcacataaatcgggtgtgacggctggccgcgccaacttattcgagaacgccttttacttgttggtgccgggccggactaatcaagcagccgttcaacggctgcaagcattgttacaagcgactcacgtcaaatggttgacggtcactgcaatacagcatgaccggattgtaggacagttaagtcatttgccacatattgtcgctgcggctttagttgatcagactcaggtggctttggcagattcggcactcgggttgcgattagcggctggtgggtttaaaagtattactcggattgccagttcggaccccacgatgtgggcggccatcctgatgactaatgctgaactaataaccaatcaattgcaggattatattgaccaactgttgcgcatcaagacagccattagggtgcatgatcaagcaacattgtacgaattttttgcgacagctaaggtgacgcgtgatcacttgggaccggaacagttgggaggactaccaaacttttatgatttgtttttgaacgtccccgaccgtgttggcgctctcgcggatgtcactcagcggctcgcacaggctcagctgagcttagtcaatattcatattttagagattcgtgaagagattgatggtgtcttgcaactgacatttagtgatctaaagacgagaacgcaagcatcgtcgttgttagctgatgcgggttatcagattgtaaggagaaattaagaatgcgagcaattttaattggatttatgggtagtgggaaaacaacggtcggtcggcttttggcggccgggttagcaactaaacatgctgatttagatgatttgattgttcagcgggcgggacggtcgattacgactatttttgcggagcaaggagaggggtacttccggcaattggagcatcagactttgctccaagcactcgaaacacccgggattttatcgaccggtggtggtactccgaccattgcaatgaatgcaattagcctgaaacaaagcgcggtgccagttatctggttgacggctagtgatcaaaccactattaaccgtgttaaaaatgatactagccgaccacttgtcaatgaattggatacaggggcactgattgcgttgaagcagcggcgccaagccttatatgctgatgcggccgatttgacgatcgcaaccgatcaactgacaccccagcagattgcccgtcaaattcagcagtggttgaatcagcagccagttgcgctccaagcttgaagaaccatgtagctgtcaactgcggttagcgtgccggttgcattttaagacgataacattgaataagcgtacatcagccacactaaggccgttgcacgcttttttgatggcagcatatgttgaaagtcatcggcgtaattagggacggtcccgcgcggtatccttttgataaggggactaatttgtgcgattcttgtttttcagtcgttttatttgactaatagggattaagctcacggttttctggatcaatgagttaaatacagctttgccaggcacatacgtggtcgtcagtggcaccggaccagcgtgtcgatttggggtatcttagttgcggtgctcagggccttgaattctgtgataatccgcttacatatttgtgaggtgtggtatactgaaaaccgtcgattaagaacgatcgaatccgtggcacggcgattggctgccactagaaaccgaatttaaatgattgaaggcgttttttatgttgaacgggattctaccattatataaacctcgtgggatgacgagctttgactgtgtcgctaaaatccgacgactctatcagacccgcaaagtaggtcattcagggacactggacccaaatgtggatggcgttttaccgatttgtattgggaatgcgactaaagttgtgcaatttttagtggcttctggcaaagaataccaagggagcattaccctcggatttgcaacgactactgaagatttagatggtgaggagattgcgcgccaagcggtcacagagccgttcacaagtgaccaagttgatgctgcgctggcacagatgacgggggccattacgcaaattccaccgatgttttcagcagtaaaagtaaatgggcggcgtttatatgactatgcgcgcagtggtgaaactgtcgagcgcccagaacggcatgtcacaattagcagcttcaagcaacggcaggcatctacctatgactcggcaacccagactcagacgatctattttacggtcgcttgtagtaaagggacttatgttcgcacgctagcggtggatgtcggcaaagtgctcggggtacccgctgtgatgagtgatttgacccgattaaagagtggcggctttactttagatgaaaccgtgacctttgaggaaatcgcggcccacgtcgatgctggaacggccggagcattattggcgccaattgataaagctttaagtcagtacccgcgagtcacgttaacggatgagcagtggcaacgggtcaagaatggggcctttattacggcggcagaagggcaacaaactgatccagatgcgaacacgatggttgcgttagtttaccaaaacagcctaaaatgtctatatagttatcgaccggacgaacagcggtacaagccgttcaaaatgtttgcggtcaattaaggagtttttgtcatgcaggtgattaatttaaagtatcccgtggcgtttagtcagattcccgaaggaccaatcgtattggccttaggattttttgacggcgttcaccgtggacatcagcaagtcgttgcaacggcacgccaggccgctcaggcgcaacacgccaaactagcggtgatgacgtttgaccagcatccgtcagttgtttttaaacacactgatccgcagcaagtccgttatttaacgacaattgatcaaaaaacggcattgatgagtgagctcggcgttgacatcttatatgtacttcactttgatgccacggtcggtgccatgccaccccaaacgtttgtcgatcagttaattgttggattacacgcacaaacggtggttgctggttttgattacacgtacgggccagctgaaattgcaaatatgcagcgtttgaatgactatggtcataaccggtttgaaatcattgaagttcctaaggcggaattagatgctgaaaagatcagttccacgcggattcgccgcgctttggacgcgggagatatcgatacggctaaccggttactgggctatcaatatgaaactgccggcgaagtagttcatggtgaagcgcggggccgaacgctcggctttccaacggccaacgttgctcacgggcccaatacccgggttcccggaattggcatttacgcgacgatggtgcagattgggacacgctgggttatgggaatggcctcagttggacgaaatgtcacgtttggtgatcaccgaccaatcacggttgaaatatacttattaggtttccaaggagatctttatggccacaatttaacggtgcgttgggggcaccggatgcgcggtgaaattaaatttgctggggcggatgccttggttgcgcaattaaagcgggatgaacaaaacacccgtgactattatgtggcgcatccctttgtggtcacaccccggattcaagttgcacaacaatcaaatcgtttggaggcacaatgaatggacacaacaacaatttttcaacacggcacattaggcttacttgttcccggattatttgacgggacgattacggctggtgaactcttaacccatggtgatacgggtattgggacgttagacggtctcaatggtgaagtgattattctaggaggtcacgcctatcaagcacgtgaggatggtcaaattcgggaaattcagcccgaagagacgttaccatttgcatcggtgcactttgaaaagcctgatattagtgcgcaattagctgcaatcacacaaactgatttcgagcaacaagtggttcatgactatcgtttgaccaacgtgtttgcggctattcgcgtcgatgggacctttgcaaaagtcaagacgcgagtcgcgcctcgtcaggagccaccgtacaaaacattagtcgcggcaacggcaacacaaccggaattcaccggtgaacatgttgacggaacgattattggctactacgcaccgcatttgttccaaggcgctacggtcggtggctttcacttacactttctaagtaaagaccatcaattaggtggacacttgctggggtttgaagtcgaacaagcgacgctgaaagttcaacattttgctgactttcatgtgcacttgccaatcgacaatgaagcgtacttacaagaacaatttgataatgaaaccattgatcatgccattaataaagctgaacgttgattagtttgaaagctgattaccgttaaggccaggtttcactagaatgtctgttggcaatgtacatcaggctagtcaaaaatctcgagagtctgtaactcttgagatttttttgttgtggctggtgtgctgagtaatggcagcagaaaagcgagtagtctgctaggcaccatgcttgcattgtgaagggtgagggtgtatattagcactcgtaagtaaggagtgctaattggggggcgacggtcaaataagtccagtcatagtgggactggggtcctaataatttaagcattcttttctagaaatactttgtctttccttgactttcatcagggtggttgttatattagtaattgtgttagcactccattaagttaagtgctaaaaagaggtgatgatcacgttaactgaacgacaaagcctaattttaaaggccattgtccgtgactataccgagggcggtaatccagttggatccaaatcgctagttcaagaactaccgatcaaggtcagttcagcgacaattcgtaatgaaatggcccgactagaagatttaggattaatcgtcaaaacgcatttgtcttcagggcgaattccatcgattaaggggtatcggtactatgttgaccatatcctaaagcctgaaaaggtggacggcaaagacttgaaggtgattcaacattcattaggcggtgaatttcacaagatcgatgagatcgttgctcagtcggcggatatcttgtcgcaactgacaagttacacgacctttacattgcgacctgaacttaaagatagtcggttgagtggtttcagactcgttccgttggggaatcatcaagtaatggcgattctagtgacgaataatggtgacgttgaaaaccagacgtttactattcctagtgacattaccggcgatgagctggaaccggtcgttcgtttcatcgacgatcaactggttggcctgccgttacaagacgtcctccgccaattaacgcatgagattccgttaaaacttgcacagtatttgcaagatccagatggtttcttagatatttttggcagtgtattgtccaaggcagcttccgagcgcttttatgttggtggtaagttgaatttgttcaactatacggaccagcagagccctaaagagttacagtcattgtactcgttactcgaccaaacggaccggttagctaacgtgattggtccacccggtcaacggattcaagtccgaatcggtaatgagatcaccaacgatttgttgaagaactacagtttaattaccgcgacttacgatgttgatcaacacggacaaggtgtgattgccttgctcgggccgaccgccatgccgtattcacggatgattggactgatgggtgcgttccaacgagaattagcccgcaaattattagattattaccggtactttgacgagtgacggacagggagatgaaaacattggcaaagaaatcaacgcggacgacgccggaagattcacaagcgtcaacaactgattcagcagcaatgtcaactgccagtgaagcgacacaggcagcgacgagtgcgactgatgatcaagctgagcaaacgacagcggtcgatccgacacaacaaattactgatctcaaagcgcaattagatgcgaaagatgaccagttattgcgtgcacaggcggagatcgtcaacatgcaaaaccgcaacaaaaaagaacaagcggcgctgttgaaatatgacggtcaagcacttgcaaaggatgtcttaccagttctggataacttggaacgggctttggcaacgccagctgacgatgaagcggcccaacagttgaagaagggtgtcgaaatggtctatggccatttacaggatgctttgaaaaaacatggggtcaccgaaattgcggctgcgggcgaaaagtttgatcccaatattcaccaagctgttcaaacggtgccagttgatgatgatcatccagctgatacggtagtacaagtcttacaacggggttacctattgaaagaccggaccctccgtccagcaatggttgttgtggcacagtaattaatcaataaaaatactaaattaaaaagaggtttgttaatttatggcaagtaataaaattatcgggattgacctcgggactactaactctgcggtagcggttcttgaaggtaatgaacctaagattatcaccactcctgaaggtggccggacggttccttcagttgtggcattcaaagatggcgaaactcaagttggtgaagttgccaagcggcaagcaatcactaacccgaatacggtagcttcaatcaagcgtcacatgggtgaagctggttacaaagttagcatcgaaggtaaggactacaccccacaacaaatctcagcaatgattttgcaatatatcaagggctttgctgaagattacttgggtgacacggttgaaaaggccgttgtgactgttccagcttactttaatgatgcccaacggcaagcaactaaggatgctggtaagattgccggcttaaacattgaacggattattaacgaaccaacggcggcagctttagcctatggtttggataagaccgacaaagatgaaaagattttagtctatgaccttggtggtgggacttttgatgtttccatcttggaattaggcgacggggtcttcgaagtattatccacaaatggtgatacccaccttggtggtgatgactttgaccaaaagattatcgactggttagttgatggctttaaagctgacaacggtgttgatttatcaaaagacaagatggccttacaacggttaaaggatgctgctgaaaaggctaagaaggacctttcaggtgtttctgaagctcaaattagtttgccatttatttccgctggtgctagtggcccattgcacttggaaaccacgttaacacgtgctaagttcaatgaattaactgctgacctagttgaaaagacgcgcattcctgttgaaaatgccttgaaggatgctgatttatcggctagtgacttagacgttgtcatcttgaatggtgggtcaactcggattccagctgttcaagaagctgttgaaaagtggactggcaaagaatctaaccattctatcaaccctgacgaagcggttgctttaggggccgctgttcaaggtggtgtgatcactggtgatgttaaagacgttgttttgctcgatgttacgccactttcacttggtattgaaaccatgggtggggtcttcactaagttgattgaccgtaacacgacgattccaaccagcaagtcgcaagtatttagtacggcggctgataaccaaccagctgttgacattcacgtgctccaaggtgaacggccaatggcagcggataacaagacgttaggtcgcttccaattaacggatattccggctgcacctcgtggtgttcctcaaatcgaagttaagtttgacatcgataagaacgggatcgttaacgtatctgctaaggatatgggaactaataaagaacaaaagattaccatcaagagttcatcgggtctttctgacgacgaaattgatcaaatggtcaaggaagccaaggaaaacgaagaagccgataagaaacgtaaagaagaagttgacttgaagaacgaagttgaccaattgatctttactaccgacaagactttgaaagatcttgaaggcaaggtttcagaagatgaagttaagaaagccaaagatgctcgtgatgctttgaagaaagctcaagatgataacaacattgacgaaatgaaggccaagaaggacgatttgaacaagatcgttcaggacttatcagttaagttgtatcaacaagctcaagaagctcagggtgcacaaggcggtgccgacagtaatgctgctggcaatgccgactcagccaagggcagtgatgacaacacggttgacggtgatttcgaagacttggataaagacaaggataagaagtagcaccggcagaacaaaaaggccaaggccacgtggctttggcctttttgctttaaatatgctagtattaatgagacttaattaaggttcattaggaggttacaatggcagagcaagacttatataaggttctgggtgttgaaaaggatgccagtcaggacgaaatcaagaaggcgtaccgcaagctttcgaagaagtatcatcctgatttgaatcatgaacctggcgcggaagaaaagtttaaagctgtcaatgaagcgtacgaaacgttaggcgatgcccagaagcgggcacagtatgatcaattcggatcgactggtggccaacaaggcttcggtggcgccggcggtttcggcggtcaagactttggtggcttcggcggcggtggcggctttgaagatgttttcagttccttcttcggtggtggcgctggtggttcacggcgttctaacccaacggccccgcaacaaggccgagacttacagtatgagatgacactgaagtttgaagatgcgatctttggtaagaagacgaccatcacctacaatcgtgaggaacagtgtgagacttgtggtggctctggtgccaagccaggaacgtcaccagtgacctgttcgaaatgtcatggtgctggctatattcaggtacagactaatacgccactcggtcgaatgatgagccaacaagtttgtgacgtttgtcatggaactggtaaagaaatcaaggacaagtgtgccacttgtggtggctctggtcatactgaacaaagtcattccatcaaagtgacggttcctgctggagttgaagaaggccaacaaatgcggcttcaaaatcaaggtgaagcgggaacgaatggtggcccttatggtgatttattcattatcttcagagttgagccaagtaaggactttgaacgggatggcgcgacgatttacttcaagttgccgatcgacttcgttcaggccgctcttggtgatgaagttcaagttaaaacggttcacggggacgttaagttgaagatcccagctggtactcagacggggacaactttccggttacgtggtaaaggtgcaccacgattacgtggcaatggcaacggcgatgaacgcgttaccgttaatattgaaacgccaacgcacttgaacaagggtcaaaaagaagctttgaagacctttgctaaagctagcggcaaatcagttgctggcaatggcaagagttcgttatttgacaagcttcggggtgtttaaccgagcgaactaattccagaaatatacaaaaagctgggcgatgcccatcacaaaaatgtgatgaggattgttcagctttttttagtgtcaatcaagcactccggcctgtttattaagtgacctttcagtaacacggtttttgtgcaaactgtttcgttatcctgtcgtccggggattagtgagtgctagaattagtcaaggaggtgaagtaatacgctgctagcttacgggggacgtaacgttgatgttacaaaaccgttacaaatatgtcgtatcagcgaacgaaaatgcaggattttgatctttttgagccggcctaaccgttattggtcggtaggttgttacactataacttgaacttacgtcctattggcggcgtagctaatatcaccaatcggttcgtaattgatagctaatggggaggtcaatcattgtgaagcaaagcaaacttttagtaacagttttgcttggactgctgattgtgggtgctggtggcggctactatgtttatcatacagagcggcaagcagcgattgctaaaaagcgtcaaactgacaaagcattgaataagaaagcggcattaaaaaatagccagcttagtcgtaagattaaccagacaacgttttcgaataataagaacacggatgagcaagtgactaaggctttaaacctaagccattttgtggggtcagcattagttgttaagaatgaccatgtcatttataatcgtgcctttggttacgcaaacaaggctaaaaatcaacgtaataaagtcaattcaaagtatcaaattttatcgattcaaaagtcaatgacggcggttggcattatgcagttggtgcaggcggggaaagttaagctgactgatccgatttcgaagtattatccaactttaaagcatgggcgtcagacaacgcttcgccaaatgttagatatgacaacagggttccgtttgaagagcggttcaaaagaattcttaccagaaaatcaagtgattgattttgcggctcacaatgttttttactacccagataaaaatggaatttataattattcatccgttaattttctgttgctagctggcattattcgcaaggtaactggtcaatcatatcagcacttctttacaacacattttattgacaagttgaatctgaatgaaacgggctttttgattcatggtcaaggtcaagatgcgacaactggttaccgagcgcttgcagaccaaacacttccgaattatgatcaaacaatgccagaaagcaaatcacaaatggccaatgagttaggtactgggcaagtttatatgagtaccgcggatttatttaccgttgaaagtgccattcttaaagggcagttgctgtcaaaaaagaacgttgcaattttgcacacgcgcacagccacaggtgaatatggcggtggtgtttataacatgagtaatggtattcggtcacacggacttggttatggctatgaatccagcatcttcctctcaccggatgggaagactggtgttgtattaatgagtaactactatcgcaaagctgctggtattcaagcaacagccaacaagatttttacggaattaatgaagggtgatattaagtaactgacattgggttagtggaggaggtgatggcatgtttgcaaagttgaaaagctggtttcaacgtccggtcgttcaattcattgcacttacagtattttactttgctgtcatgctcgccttggtttatctttacggttatagtgggatcaaccaagcgaagtttatttacaacgaattttaaaaatggatgcagtaacactattgtttggggggagttttaattatgattaagaacatcattacaacgattgatgattatgcacggacgcaacccaataacgtggtttatgatgtgcaaggtgtaacgcacacttatgcggaattaaaagcttattcagatgccttggcggcgcatcttgacacgctcgatttaccagccaaggatccaattattgtgtttggtggtcagacgtttgaaatgattgcgactttcttaggagttgttaagtcaggtcgggcgtatattccaatcgatacacattcaccaaatgagcggttaacaatgattaatgagattgctaagccagctgccgttattgctgttgctgatttgccaaccggtgtcgggacaacccccgtgattacaccagatcaattggcggctatctttgcgactcccgttgattatcaagcggatcatgtcgttagtggcgatgataattactatattatctttacttctggtaccactgggatgccaaagggggtccaaattagtcatgataacttggtcagttacgttgactggatgttgagtgatgacttcggattgcctgaccagccgaactcgctgtcgcaaccaccatattcatttgacctatccgtgatggacgtttacccaaccttagcgttaggtgggacactatacgcattaccgaaggccgtgacagatgatttcaaacaattatttgctgcgttgccgacgttaccaatcaacgtttgggtctcaacaccatcatttatggacatttgtttgctagaaccaaagtttaatgctgaaaacttgccaactttgacgcacttcttgttctgtggtgaggaactcacacataagacggcggcgacactcaagaaacggttcccagatgcccggatcttcaatacgtacgggccaactgaaacctgcgtcgcggtaactcaaattgaaattacggatgccgcattagcgcagtatgatcggctaccaattggttatgccaaagctgatacgcggatacttgtggttgatgaaaatggtgaggcggttccaaatggcacggaaggtgaactgattatcgccggaccatccgtttcgaaggggtatttgaacaactctgaaaaaactgccaaggctttctttgaattagacgggcaacccgcctatcattctggtgatattggcacgatggatgcggacggtctgttccgttatcgtggccgcgttgattttcaaattaaaatgcatggttaccgcatcgaactagaagaagtggatcacttcttagcacagcaacagcatattaaacaagccgttgccgttccaaaatacgataaagagcacaaagtaacgcaaatgattgcgtacgtggtaccaaagccgaatgacttcgaaagtgactttgctttgaccactgcaattaaaaaggacctacaaggaatgatgatggaatacatgattccacaacggttcgtctatcaaacgagcttgccattaacgcctaacggtaagattgatgtcaagtcgatcattaaagaggttaacccagaatgatttcttttgacccatatggtaacccaacgtactttgtgctgctctttatcgcgttgttaccgttaatgattggtctgttatatggtcggcgatcccattggtatgaatcattgatatcgtttatcttcttaatgctgacctttggcggtgttaagtggcgcactgggatcgcgttaattatctatttggtctatcagatcacactagtttggttgtactcaaagtatcgacaacgaccagattcacctaataagggctgggttttcgttgtcagtgtgattttagcgattattccactagctgtcgttaagatcacaccagccgtggcacatggtgctaattcaattattggtttcttaggaatttcctacctgactttcaaagtggtccagatgatcatggagacccgtgatggggtgattaaagaattccatccggtactgtttggccagttcttgctgtttttcccgacgatctcgtctgggccgattgaccggtatcggcggttcgttaaggattacgatagtgtcccgacccgtgaaaagtatctcgggttagttgaaaaaggggtccgctacattttcttgggattcttatataagttcattttggcttatatctttggtacgcggatgctacctgtcgttgaacacgcggccttgcaagctcacggcatgtcatgggcgttagtcggtgtgatgtacgtctatagtatggatttattctttgattttgcgggttacagtttgtttgccgtcggtatcagttacctgatgggtgttgaaactccgatgaacttcaatcaaccgtttaagtcaaagaacatcaaagacttctggaatcgttggcacatgacgttgtccttctggttccgtgatttcatctacatgcggttggtattctttatgatgaaacacaaggtctttaagagccggatcacaacggccaacgtggcatacgttattaatatgttgatcatggggttttggcacggggaaacatggtattacatcgtttatgggctattccatggtttagcaatggttgtcaacgatgcttggttacggtacaagaagaaacatcaagcgcagttgccgtctaataaatttacggaatactttgcgattttcctaacgtttaacgtcgtttgtttcagtttcttgatcttctcaggattcttgaacacgttattctttggagcccggccataatataattacaataagggagcgtaatgacaatggatgatacaaaagcaacggttttatcaattttagcagacttaacgggggaagatgtttccagtaacatggacgttaacctgtttgatgaaggaatcttagattcaatgggttccgtccaacttttattggaacttcaaaatcaattaggaatcgaagtgccggtctctgaatttcaacggtcagaatgggatacaccggctaagattgttgcaaaggttgagaacttgcaatgaacgttgccaaacgcctttttaagatttttgggccaattattttggcagccgtcttattattggccgtactgctttcaccgttctcatttggattaaaccatatttctaaggatactgagaaaaaagcggccgtttccttgtcagccaacgtattaaaaggtcggttagttaaacgacaggcgctggatgatggctatgtcccgttctttggttcttcagaatggtcacgatttgatccaatgcatccgtccgtactggcaacaaaatatcaccgcaattaccgaccatttctactcggtgcgcgggggacccagtcgttgacgcagtatttcgcgatgcaatcggtgaaaaagcagattacaaataagaaggccgtctttgtaatttcgccacaatggtttgtgccacaaggaacgcggaaagatgcgttttcgtactattactcaccactgcagaccattgattggttacaggatgagcagaatacggcaatggaccggtatgccgctcaacgtttgttacagatgccatcgggttcttctgatcgcattttggaaggcgccctggcacgtgtggcagctgggtttaaaccaacgagcgcacaaatgacgtatattaactataaggcacgtgtccttggcagtgaggatgagttcttctcacgttttggaattgcgggcaaaaatttacggactgtcaatgcgcaagctaacaagttaccagcgacatataactttaatcagttaaaccaattagccggtaaaatcggtgcggcgcaaacggactcgaacagtcttgaaatcagcaatcaattttggaacacgaagttaaaacgtaattacaagcgactcaaagattcacagcgacacttgaattacacgaagtcaccagaatttgccgattttcaactggttttgaatcagtttgcaaagacacacaccgatgtcttgttcatcattccaccaatcaatcagcgctggtctgcttataccggactgtcaatgaagatgattgctcagtttgacaagaagattcagtaccagttgaagagtcaagggtttaataacgtcttggacctgacccaggacggtggtaaggactacttcatgactgatacgattcatcttggctggcgtggttggttagccgtggatcaaaaggttgatccattcttgactaagaagacgaagccggttcattatcagattaatgacgacttctattcaaaagaatggcaattactcaaacccagtgaaatcaaggattttgaataacctactaaaaagtacaggccatattggcttgtacttttttgttacgtcatttattcagtggcgcagcggggtgtctggagcggtctgatagaaaaattgtgcttgtgccactaacttggtataattgtagggattaggatttaggaagaaagtaggaaaatcaatggataaagcgacaatgcaagaccgacaacaacatattcggaatttttcaatcgtcgcccatattgatcacggcaaatcgacgttggcggatcgtattctggaactaactgatacgatttccaaacgtgagatgcaagaccaagtgttggactcaatggacttggaacgtgaacgtgggattacgatcaaattgaatgcggtagagttacactatcaagcaaaggatggggagacttatatcttccacttgatcgatacacctggacatgttgacttcacgtatgaagtctcacggagcctcgcagcctgtgaaggggcggttttagtcgtggatgcggcgcaaggggtcgaagcccagacgctagccaacgtgtatttagccattgatgatgacttggaaattgtcccggtgatcaacaagattgacttgccatcggctgaacctgaaaaggtgcgcaaagaaattgaagatgacattgggattgatgcggaagatgctgttctagcttcagcgaaagccggtattggtatcgaagatctgctcgagcaaatcgtgcataagattccggctcctcagggggatcttgatgcgccactcaaggccctagtgtttgattccgtctatgatgattatcggggcgtggtgctgagtgttcggattcatgaaggcatcgttcgtccaggagatcggatccggttgatgaacagtggtagtgaatatgaagtgacggaagtcggcgttaattcaccgaaaccgttagcacgggattatttgatggcgggggatgttggttacattacggctagcatcaaggatattcaggatacccgagtaggtgatacggtcacgaacgcgaaaaatccggccgaaaagccattggcgggttaccgtgaaatgaatccgatggtctacgctgggatttatccgactgataatgccaaattcaccgatttacgggaagcgttggaaaaattaaaattgaacgatgccgcattggaatttgaagcggaatcatcacaagcactgggctttgggttccggtgtggattcctgggactgctacacatggacgtcattcaggagcgcctcgaacgggaatttaatcttgaactaattaccacggcgccgtccgtaacgtatcatgtgcggatgactgatggcacggagaaaaaggtggaaaacccggctgaaatgcctgaggcgtctgcaatcaaggaaattcgtgaaccgtatgtgaaagctcagattatggtgcctaatgattacgttggtgcggtcatggaattagcccagcgtaaacggggcgagtttgatacgatggagtacttggatagtaatcgggtcaacgtggtttatcacattccgttgtccgaaatcatttttgacttctttgataaattaaagtcgaacacgcgcggctatgcctcgttagattatgatttagacggctaccgtgccagtgacctcgttaagatcgatatcttattaaacggtgaccaagttgatgctctgagttttatcgcacatcgcgactttgcacctgcgcgtggacgcgagattgccgccaagctcaagacgattatcccccggcaaaactttgaaattccggtacaggcaacgattggttctaaagtcattgctcggacgaatattaaagcttaccgtaaggacgtgacggcccatctgtacggtggtgaccggacgcggcggatgaagctacttgaaaagcaaaaagctggtaagaagcgtatgaaggctgtcggtaaagtcgaaatcccgcaagaagcgttcatggctgttctgaaaaccgacgaagacgaaaagccgaactgatagggttccgcgtaagcggagctcttttatttttccgttttgccaacattttgccaacattgaaactgtgatgttggcaaaatatacatatatcgaaaaagtgtctatcatctttttaactgttgttttttaacatattttcgaagatatcaacagtatcacgtttcatcttattggttacgtgggaatagatatctagcgttgttgaaatacgtgagtgaccaaggcgttgctgtatttctttgtacttggctccattttctagcagcatcgttgcgtgtgtgtgccgtaatgagtgaaaattaaatggaaagtctaattcctgtgatagtttagttgtgtagtatttaattacgctaggggtaatcggcttaccattttgtttggtacaaacaaatgggctatcaaagtaaaattgtccgtaacgcactttattttccttctggtaagttctgaaacgctttaaaacagttagcagtgaatttccgactgcaattgtacgatagcttgccttagttttgggtgacgtaacgtcaaattcttttttcttcataatcatttgcttgttcacggtcaaggttttgttatcaaaatcgatgttgtcccatgtgagtcctgaaacctcaccacggcgcaagccagtgttgaagctgataataagtgggagatacaaggggttagattcaggaacaagtgctagtatctgcttgaactggcccatattgatgattttgagcttatctcgagcagcttgctgggttatttcatcatcattattattagtgggctttacaatgtagtttgctggattttctttgattaattggtaagggaagacggccatcttaaagcccttacgtaagactgaaacaatgatctcaatagtgtgctttgagagcttgtctgtgggtaggtcatttacgaacttttgaattgatgctggaccaattgatttcattcggtacatgccgatatcgggcttaatgtaattgttgataatattacgataattcgtttgcgtgttatatttaagagtctttacaacaaaattctcgtgccaataatcgaagtagtctgctacactcatctctgtcaacttgatgacaacaccgccgcgctcaaactcatcaattgctttgcgcagggcccgttctgcttcttcacgggtccgaccaccaacgtgctcgattcgctgccgtttaccgtctatggtggggccttcatatgcataataccagcggttgccacgtcttctaattgatcctcgcatttttatacttcctttcagtctttaatgtcaaaatgaacaacttcactaccagcagaataaagcatgtagttcttgcgataggggaataggtccaaccgtgcaatagcgtcaacggtgatatagttgggtcggacaagtccatagcgatgatccccaatagaaacgtgatagcctgtaaatggtacgtaggtgatgtacacggaccatttatcatcgacgatgtagccggtagtttttgagcgtcctggtccgggataaaacttgtcctgcagctccaattgtttttgttcttttccggtaattttttgaataatcatgataatatcctcctaatgtccaaacgtatgttcttttttacttttaaataaaagcccgtgttgggggccaattttctaatttacagatactgaatcaacaacaatatcagattttaaggtcttaccatttaattttatggtagatgtgagtgcgccaccttttacagtaatattatcgccttcattaatgttagtttcatcaaaggtatccacattgatctctgtaacagtcccgtatgagtagcctgaagatgcatggtcatctttagggaggataacaacataatagatatctgtattatctggattcttttgaatgtaggcaacttctccactagtttcgacgtttttaccgatgtatttatcagtttcagttgcaaatgtttctaagtcaactttatcataatggatactacgagtagtagatttagcagcagacgacgaactatcactagaattatttttggataccgattcgtcaaatgaagaattggcagcaaccatagaatccatagccgaactagatgaagatttataagaattaacggcctcagaagaaggtttaacaattatttttttataaaccttaagcttgttaacgttatttttattaggttcgttggaaataggatcagtatctgcgtcaatatcatcgattgtaaggtaatatgggacagtctttgcatcatcgttgtcttcattaaaatgaaataggcctttagaatcacttgtaaccgtatccttaacttgaccactcttattgagaagataaacaccgatattttcttccgttcttccttgaactgagaacttgctattgtcagaagtgacaatgctcgaatgattaaccgtaatagttttttcctttttgacattggtcgcagtttctttgtgatgtgagcttgattgagtagatgtttttgaactattaccacaaccgcttaatataaataatgacgcaacaatggcagccccagtgactacttttttcatataagactcctccaaataaggtgtttttcaagttgacttttggtagattgtaaaattaa

SEQ ID NO: 10 - DNA, 75617 bp, Lactobacillus plantarum
agttttaagacggaccctagtcaatttttgtcatttttctttgtattcttttgtcgactgctgttcaagcatcttctgaacgtgtaagctagagctaatcaaagttattcctaaggaggacactgtcatgatacctagtcagcattttcaatccactccaaccgtccaatttgacttattaacatacatgattggtagttaccactacaactggcatccgcaaatcgaactcttatggttattgcaaggtacggtcgaagtgaatgttgacgggacgcgccatcaattacacgcaaatgacctcatcttgatcaatgccaatcgcggccatgccacctttgccttgaccccagaatgtatcgcgctccgtttacatattctgcccgatttctacactagtcagggcatcgacctcagttcaggtgcttttctactcaacagcgtgacgacgccccaacaccgtgactaccaaacgattcgccaaattctggcacaactctatctaggattacatcagcaggactggccaatttttgacttgaacgccctgtactttcaattgacgaacctgctacatcacgatttctttgatactggaatcacgatgacttatccccaacccaagacgcagagttcactaaaccggatcattgattacattaaccaggcttacgatcgaccaattaccttaaacgaagcggcaaaaatcagtcactattcaccagcctatctctcacgcatcttcaaagcggaactcggcctgaatttttacgaatatctaacccgctgccgactacaacacgccatctacgatctggaaaacccaaccataagggtcgccgatctagccttagccaatgggtttcaggaggtcaagtccttcaatctaatgtttaagaagcattttggtcagacaccttccagttaccgtcaacatttgtcacacgggcaacgtcctgaatatgaccagttcaagcaaccgctcactcccacacaaactaccattgtccaaaagcaactcaagcactgggcccaactcacaagtactgatcaactcagtgcttgtgaaatttgcatgtataaactacattttcaagaatatcaggcactcaaacaaaagatcgcgcaattaaaaacattgcttaatcaataattaatggcataacaatttttgtgattacgaacaactgaacttaccgatattttgatcaagtattggttcataccaaggtacgacggcatcactcgtcagaaggccttggtatttttttgtcatttttaaccggctacctgtccgcttaccatcactttcacaatccaatacctggcataactcggcgagtagcggttagttttgtatcacacagttacttacaatgtagctgtaaattgataggaggaaaccagcatggatacaatgacatacgactataccgaaccaacattatcaactaagggccaacggatgcgcgacattttggccgattatattgcgctcatcagtcatcgactaccagatgatgtgactgccaaactcgaagaactcagtaagatcgaagtcgatccactccaaaagctcgtgtacgacatgatgatggaaaaccaattacttgccaataaacttaaacgcccaagttgccaagataccggtgcgttacaattcttcattaagtgcggcgcgcagttcccactattaggcgaactcaatcaaattctgaaggacgccgtttatcgtgggacaaaaaaagcgccactccgacataatgctgttcagacatttgacgaatacaataccggtatgaatattggtgacggcatcccctcgatttttctgcaagttgatggtaatggcactgacatctcaatgtacgtgtacatggccggcggtggctgcacattacccggggctgccaaagtcctgatgcctggtgaaggttacgaaggcgtcgtccgtttcgtgatggatcgcatgacgagctacggcattaacgcttgcccacctttactcgtcggtgtcggcgtcgccacatcggttgaaacggctgcgcttaattctaaattagctttaatgcggcgcgtcgatagtgaaaatccaaacgctaatgctgccaaactcgaacacttattagaagacggcatcaatcacattggcctgggaccacaggggtttggcggtcaaaagtcagtaatgggtgtcaatgtcgagaataccgcccgacacccatcaacaattggcgtcgctgttagtaccggctgctggtcacaccggcgcggacttatcaactttgacgcagatctaaactatgacttaccactgaacaaaggagtcgaattatcatgaaaacttaccacttaaccaccccaatttctgatgacgatattaaggacattcgtatcggcgacatcgtctacttgaatggctcactaacaacctgtcgggacgttgcccatcggcggctcgttgaagaacaccgccccctacccgttaacgtgacagaccgagcaattctccacgctggcccgatcattaaagatctcggccatgacaagtacgaaatggtcgcagtcgggccaacgactagtatgcggatggaaaaatttgaagaagaattcgtaaaacaaacccgtgtcaaactaatcgttggtaaaggcggcatgggaccgggaaccgaacgggcctgcaagaaatatcacgccttacacctcgtctaccccgctggcaatgctgtttatgccgccctgcacgtcaataagattgttgatgcccagtggaaagacctcggaatgcccgaaacactctgggcgtgtgaggtcaaagacttcggtccgttaattgtctccatcgatacgaatggcgacaacttgtttgaaaagaacaaggtcatcttcaacgaacgtaaagaagctgagattaaaaaaatcaacgaacaagttaaattcattaaataaccgaccattaacagcctaagcggatcaccctgcttaggctgttggtctaaaggagtctttctcatgattagtatggatacacaatctactttaaaaacccaagctttagccgctctgagtaccgtgatcgatcctgaacttggtgtgaacattgttgacctcggtttgatctacgatgttgcttacgatgctgacctaaagctctgcaccgttaccatgacactgaccatcatgggctgtccactgacaggctatttgaatgaccatatcaaaagcgcattaatgaccgtcgcgggtatcgatcaggtactcatcaaccttgtctgggaaccggcctggtcgcttgataaaatgtcacgggcagcaaaaatgacattagggttgcattaattctaatttagaaatcgtgtccggattagcatcatttgctgactagtttcagcagtcaccgtgagacgattttaacgtttgactagaaaggtggtcgttttcgatgaccaaattacaatccgtcaactaccagcaacttacatggccgctgataattggtttgattatttggctgagcgcgccatttcgtcccgcggggctcagtctattagcatggcacatgctggctctctttgttggcactatcattggttgcattacccagccgttacctattgccggtgtcgcaattattggtctcacacttggtgtcttacttggttttacctcgatgacggatgccatggccggctttggtgataacacggtttggatgattgcaatggcttacttcctatcacgaggcttcgtaaaaacggggctagggcgacgagtcgcgctggtcttcgtcaaattatttggtaaaaagacccttggattagcctacgcgctgattggtgtcgatctcgtcactagtccggccacgcctagcaataccgcccgcgccggtggaatcgtcttcccaattattgaatctttagctaaagcatacggctctgacccacaaaacggtacgcagcgtaaggttggtagttttctcattatgtcagctttccatggtaatattgccaccagtggcttattcatgaccgcgatggcaccaaatctcgttgccgtggccttggcccaagcaatgcagattcacatcacatggatggactggttactcgccgctctattacctggtcttatttgcttaattagcgttccagctattatttattggctctatccgccagaaattaaggatacacccaacgcgcatgcgtgggctgccaacgaacttgagcagatgggggccatgactttggccgaaaaactcatgggcggtatttttatgttggccctctttctttggatctcagctagtctcactgggctagacgcgaccttagtggccttcatagccgtcactttgctcttattaaccggtgtattatccgttgacgacttattacatgaaactggggcttggaacacactcgtttggttttcaattcttatttttatggctggcaaactgaacagtcttggctttattccatggctttcacaaactatgggccaggccctgcaaggaatcagttggctatgggtcttggcagctttgatgctcgtttacttttacagccactacctgtttgccggcgccactgctcacgtctccgccatgtacggcgccttcttgggtgtggcaatttcagccggcgcccccccaatgctagcagccctactattaggctttgacggtgccattttcagttcgaccacccattacgccaacggtcccgcctcgattatgttcggatcaggttacataacgcagtccgaatggtggcgtctgaatctgtgccttggtggtttctatctattagtatggggcgttggtggcacactctggatgaaacttttaggctattggtaaactagttgtttttcaactatacaatttgacaggttcagacactcattcccgtatttcccgactccgggctgagtgcccatttctgggggaaggacgatctagccgagcaagtttacgcaaatcagaacttttgccggtgaccctaaactggctttttaaactcaagactggcatattttaatgcatgcttcatgaaaattaacgcgcacaatgtgaacttactcctgactaacgacttgatcatacaaacatcacgccctaaccaataacaatcggctttccaactattacttggaaagccgattgttaatctaccatgtaagtccatcagaacctggacgtcaaaagttctgatgctccctcaaattttcagatcccacccggctaaccgtcatgtgtcgaactgaagcatattgtaaacttacgtctaatcacgacaccgaccacaagtcacccatccaagtcgccaagtccgtgaccgctatgggatacaggtggggttgcccaaccgccgataagtagacccaggtcagcgctgtaccgtgcacttttttgtcgtgttgcatcactgcggccacggcttgcggcgctatcggcggtaattccgtgggcaaccctaccgccattaagcgtgccttgagcgtcgacgttaaattagtcggcgctaacccatgtgctgcaaacaaccgacaaacctgtactagaccaatcgctaccgcttccccatgcatcagttgaccgtcagccaatagttcgactgcgtgaccaatcgtatgaccaaaattcaataattgccgctgaccctgttcatgctcatccgccataacgacgcgcgctttgaacgccacactagctgcaattaaatctggtgctgctggtaaaatcgctgccacactggtaatttggtgcaaggattgccaaaaatcaccgccaactaatgctgcgcacttaacgatttcgccataaccttctgcgagcatccgtggcggtaacgtcaccagaattgccggatcaatgacgactaaatctggttggtaaaaactgcccactaagtttttgccagttggtaagtcaatcgcggtcttaccgcccaccgaactatcgacttgcgctaataatgatgtcggtacttgaatcaaggcaataccgcgcatataaatcgaagcgacaaaccctgctaagtcaccaaccaccccgccaccaagagcgaggacaccgtcactgcggctaaaatgggcggcactcagctgatcgattaacgactggacttgtgaccaacttttgctctcctcaccggctggaaccgtcatcacgcgcaccttgaatccagccgccgtcagttcatcagttaccagcttcgcatagtacgggcccacattggtatccgttaccaccgctacttgacgggcacaccataccttagttaccaatgttcctaggtgatgtaaactgttaatcatgatcttgatctgatactgtttaactcgcgtcttgacttcaatgtttgtcataggcacatcctacgcccacgtttgcatcagatcatgtaactggaaagcctgttgcgccatttttaagtacgtcgcgggttttaacgcttgcggcccatcggataaagcttgcgttggctggtcatgaatttcaacgatcatgccactggcgccagctgctacacctgccatcgccatcggggtcacgagttcccaggtaccgaccgcgtgactcggatcaacgatgactgggtaatgtgtcaacgattgcaagactggcactgcacctaagtcaaacgtgttgcgtgtgtacttattatcaaacgttcgaattccccgctccaaaagcatgatctgatgattaccaccagctgcaatgtattcagctgcattgagcacatcgtcgattgttgccgacattcctcgctttaatgcaaccggaatttgggtctgtccaacggctttaagcaacgagaaattttgcatattgcgtgcaccaatttgaaaaatatccgtgtatttcgccaccatcgccacgtgttcatcatccatcacttcggtaatcatatcaaggccatgtttatcagccgccgtccgtaagtattggagtcccgtctccccgaggccttggaagctgtaaggtgacgtccgtggcttgaatgctccgccacggacaatcgtcgcaccaccctgcttggcaaccgcggccatctggtccacgtgttcagcgctttcgactgaacacgggccagccatcatgacgaattgattaccgccaatcacactgtgtagcgtcttaataatcgtatcttctgggtgaaagagacggctgctttggaccgctgcgggaactgccgtcaagattgattcactggctgcttgcacatccgcgggaagtgcttctggacgcaatccttgaattgcaattcgattattgtgcgtgaagatctcgtgatccgcaccaaattgactcactaactttgcctgcatagccgtagcggttgctggttttaatataataatcataataatttcctcctactaatcaattctcaaaagttaaggcctaagcctgcgccgtaatcggcggagtcgcttgaatactggctaacatatcttggcggacctgttgaactggcatctgcttaccagtccaaaactcaaaagccaaggcaccttgccaaatcaacatccccaaaccattatatgtggcgcacccctgctgacgcgctaagcgcaaaaaggtcgtttctagcggttggtaaatcacatcatagaccgtctgttgtgggactaattgctggataattgagattggtaatggcgttccagcagtcgtcatgccgatattggtcgcgttaatgatcaaattgctggtacgagcaacttgctgcatccgtacttggtcttcataggcacagagccggagtggtaccgaagtcgtggtactgagttgctccaaccagtgctgaacaccggcgtagcgttcgttgttgcgtttaaagaccgttacactcgcgacaccataatctaaagccgccgcaatgattgccttacctgcgcctcccgcgcctaaaaccatgacgtgcttatcaaccaagttcagaccttgatgtaagagatcctgaaaaactccagcgccgtccgtgctgtcaccaatcagcttgccagcttcattcttaatcgtattgaccgcttgaatccgttgcgctcgcactgtcaaaccatctagtagcggtacaacggcttgtttgaatggcattgaaaggttcacccccgcgatacccatgctacgaattccagcaagcgtatcagccaatccatccggtgccacatcaaacgccaagtagcgcgcatttagcccccagtagtcaaaactcaaattatgcattcgcggtgagcgactgtgccgcgcggggtgcgcgataaatccaaagagtgccgtttgtccatcaatcatgctttaactaacttcctttctaaatgactcgcaattgttgaccaagatccacgtgcgtttgttgatacgtccgcactaggtctgctaccgtgaactggttagcggctaatacttggtcggccgctccactggcgccaaagtggtccaagcctagtaccgccccatctaacccaacgtaacgttcccagccagatgttgcgcccatttcgactgcaactcgccgccgaatttgaggtggcaagacctgagcttggtaattcgttgattggcgcgcaaagttttccatcgacggcattgaaacgacactgacatcttcacctaacgtagctagtttcgcctgggcctgaagaagctaaagcaacttctgacccgcttgcaatcaagattcccattggctggcggccacgctgcggtgagagaacataaccgccacgagccacaccagtcatggccttagtcttagatccggatagcactgccaaattctgacgggtcaagacgagcacggttggatgatccgtcgcgttgatggcttgccaccaagctgcgaccgtttcattcgggtcagcgggccggatcaccgttagattcggaatcaatcgtaaactcattagctgttcaattggctgatgagtcggaccgtcctcgccgactgcaatcgagtcatgcgtgaaaacgtaagtgactggtaacttcatcatcgccgccaatcgaatagccgcacgcgtgtaatcggaaaagacaaggaaggtgccaccaaagacccgcaagccaccgtgtaaagtcatcccattcaaaatggtgcccataccaaactcccggacaccaaaggcaacgttgcgctgatccggggtcaccggagtcgacaattgatcctgctcaatggtcgttttattcgaactggctaaatcagccgcgcccccgactaatcctggtaactgagcggctagcttctgaatgacggtatgactcgtgatccgcgaagcttgggcgccttcatcaaagatcggtaaactggtggctaagtcaactggcagacgcatactgagctgttgttcgaaacggtgttgtacggcttgtggtaaaacctctcgttgtgactgccaccggcgatgtgcacgctgaccacgttgcaagattagttgctgtgcgcgtttagcaacggccggcatcaccgtaaatggcgcggcttgccaccctaattgttgccgcaaactagttaaaccggccgttcccaacggattgccatgcaccgcattcgtacccgcttgtggtgcgccaaatccaatcgtcgttttaacagcgatcaggcttggacgtgaactgtgtttggcacgctcaatggcggcattaatcgccgtcaaatcattgccatcacctaccgtttgtgtatcccaaccataactagcgaagcgctggttcacatcggtacgaaacgaccggctggtggggccatcaagcgaaacagcgttatcgtcgtacaatacaattaatttttgcaattgttgattaccggcaaagctggcggcttcgtgggagacgccttccatcaaatcaccatcaccgactaacgcataagtatagtgatccaccaactgcggtgactcggagaactgagccgctagttgccgttcagccagggccatgcccaccgccatccctaacccctgtcccagtggaccggtcgtggcttccacaccatccacgattcccagttcagggtggcctggcgtgtaactgccgaattgacgaaaacgttgtaactcgcccattgtcacgttgaagccactcacatgtagcagactgtacaacaacgccgacccgtgtccggctgataagacaaagcgatcgcgattagcccattgagactgctgtggatcgacccgtaattgtcggctccacagtgcccacatcattggagccgcgccgagtggcaatcctggatgaccagaaccggcccgttcaatcatttccgcactcagtactcgtagattattcaccgctaatacatcaatttcatcaaatgcttgcattaacttcgctccctctcattttggctaataaaaaagactcacagttacaccaactgtgagtccactaattcttcgcagggtgcccgaaaaacaccgctactcagaagcagaaaagtcacacagtggttgttcacaacactgatatgacttttccataaattttaatcattccaaaatttactggtcacatccgttgcgagggcgtgcctcgcagtggatgccaaggcactaagtaaaccagtaataataatacgaattcaattgtaaattggtattaatcgtcatgattaaaatctccttaatttataatgtgtatttgatgacttaaaatatacggctaatcaatagaattgtcaaatggtttttgcaaactttttctattaatcaacaaaaacatgttggtccaccctcgatttgctagtcgtcatcatcctcgctaactgctaataaatactggtaaatcagcaagtttgcgtgtcaaatcattttacagatattaaaatggttccctgccactttctgaaaatatttttagccagtagcttgcactgacttaacttataatccaccgcaaggcaaatcattaaagtctaaaagccgcactccaacgctaaatttctcacaacgaacgactgacaaacggtcattttcgattacaatttcaacaatgttccgtatgctttagcaactaaccttagccgctcgtcagttgtctgaactgccatctattcccaaccagctagttggtcttcaccaccgcacataatcgtgataaccaaaaatagtgtcgccagcatccagagcagattccagccacactatcatcagtttatgtgatccccattttagtcacaataattgccgcaactacaccaaactacgctttcaaggctgcggggactgccactccaaattcagcaccaacttgctgcatttccgtcaacgtctgtggatcaatactgacgccctgcaccaaattttcatcatagtgccggtattcccggtcacctggtatcatgatcttagtacctggtagatgcttcaaatgccgaatacggtcaaacatagtcgtcacgttggccttcaacacctcgggatcgccaaataaggcgggattaatcgtcatgaagaactgactaaagtcatgcttaccggtgttcgtatcagccgacagcgacccttgcgctaaaattcccgtgagtaactcaataattagtgagttgccaaagcctttgtaatttgaattgacttcctgctggccacctagggtcaggaccccaccaccaggacgattctcagaaaacgcaattttagccaagttatcctccaccgtctgcgcatcatgcaagacttgacgatgctcatcaaccgcccaatcacccggaatctgtgcaccttttttggccagcacttgaatcttcccgcttgaaaccaccgcagtcgcgccgtcaaaaacgaaaggatgcgggtcggctggaaaagtaaaagctaatgcgttggaacccaaaaaagcttctgtcgcattcgtcggcaccaccaacggccgcgtattagtcgttgaaataccgatcaaacccgctttgcaagccatgcgcgaataatagcccgccgttccaaagtgattcgaattgcggataaccgctaatgaaacaccgagttgcttagtcttttcaatcagtttattcatcgtaaacgccgacgcaatctggcccatgctctggttcgcatcgatcaatagactggtaggtgtttcattcaaaatcttcggttgattcgtcggttccaaggtatgatccttgatcatccgcgtataccaagccagccgctggataccatgtgatgagattccacgtaaatctgcatcgaccagggtgtctgccagcagtgccccatccttggcactaaaccgttgggccttaaaaactgcttctaaaaattgtcgttccgtttccgcactaattcgcatcgttatattttcctccgtttttgacagccagcactcgcctaacttggcgagcaccgggatatcacactttattcagattgctaaacagcttgaacacgttcattatccgattcctaattagaaaattcaatgttttatgtaaatgtaattaaaaacagatgtgtaaaacgttaatttttcaattatgccccactcagtttctttccttaactaacctttcactatccgctaagcggcctgtctttccatgctatattgaagacacttaaactagaggagggacccgcgatgcaccgttatacctatcatttttatacaggactaatcacgggcttgttaatttggggccatcccctcggcggtctagctagtcgcgtacgaccgacactaccgtacccaccaaccacccttcaaagaacagccacccaagctgttttttcaccaaccgaattttatcaaaccatccgtcagtatccggatctggttaaactagcaaaattcgacccaatcggtatgttgcaaggcaccaccattcagccgggactacaagccaccctgactagggacctcgtcactaaacaactcacgacgacgacaatgatgattccacagggcgttgttattgccggtcgttatcgtctaaccaccgcttacgatgccactggtcgaacccaatctgtcctatatgtacaggatcgtttccgacatcaattatgcaacactgtcttattgcatggtaaaccacatgtgggtggtctagcttatgaccctcaccaccagcggatttggttgtgcagtcatcgccacggtcatggggctatcgtgagcgttagtctggccgcattacggcacttcgacccgaccacttccattgccgttcactatcagcaacgctggtcactgccaacactgagcaatgcctcactactgacctatcaccatcaggccctttatgtcggccagttcaaacctggacagaccaccttggttgcccgctatccactgacgagcgccggcacgccatacagaatgaccacgagtcacgccattttaccaaaggcagttagtgactggcacggcaagctcccacccaatattcaaggaatggccttctatgaccactacgtcttgttatcacagtcatacggccccagcgcctcacacttactgctattcaagcgcagctaattaattcaacagcaccaactgaccaccggtatcgcgattcttcgattgcctccgcaactcgaacagatcagcgttcatcatcaccaggcgcaactcctttatgaaaccggggccaccccctaccgccagcagcaaaatcacgccattgatcggctgatttcaatcaacttacagcgcctcattgaataggcaaattagtcgtcgaacctcatcaccatgactgaaaagcacggtcctagtcactacgccattattgcagttaacccataactgaccttccgatgcgtccagtatttactgacatgcccagttcaatttcttgatcagcattcacgctgctaccaggattgcgacaaccaactagttgttaccgtaaattactgctgtatgtaaaaatacagcatgtattaattttccatggccgcccaaataagcgtacaatgtaacagtaagtacaattaagggagaaagctatgtatcagctattaacagattcaaccgttgatttaccttatcaactacttaaggacaagcatgtcgattttgtttcaatgaacgtcacgattgacgaccaggaatacgcggacgatttgggtcaccactttgacttgactgacttttatcatcggattggtaacggtgtgatgccttctaccgctcagattaatatcggccagtttattgaatttttcaagccgtacgttcaggcacatacgccaatcctatacctcggcttttcatcaggcttaagtgggaccttcaataatgcgcaacaggccaagaccatgcttttacaagaccagccagatgccgagatctacctcgtggattcccgagcagcctgctgcggtgaaggcctgatgctactagatgccattgacaagcgcgatgctggtatgccgatcgcccaattggcggattggctgactgaaaaccgcctctattatcaccaatggttcaccgttgatgacttaaattacctttatcacggcggccgggtctcacggacctccgcgacggttggatcactcttacagatcaagccagtcatggacgtcgacccactcggccacttgcgtccagtacaaaaggtgcgctcacggcgccggtcactgaccacactagttaacaacacactagccgatttacgtgatcagaccaagccgcgcattatcattgccactagcgacgctcaggaagccgcccaaaccgttcgtgaaaagattttagccaaggttcctgatgctgaaattttgctcgaacacattgggccgactatcactagccataccggcctcggttgcgttgccgtcttctcttttggtaaaactaaacgtcagtaattaaaatggattgagccgtcaatggcccaatccatttttaagtaaccgagcgttacttgcttagcttgtttcaaggcgggctaactgcatagtcgctcaccccggaagtcgtactgacatgaacacgtgctgccagccaggacgctaacaaagtggtctattttatatcatgagccctaccatgttttagttttgtgttattttttctgttcaaacaacaaaaaaagcacccgtccatagacaggtgctttctcatatagccagaaaatgttgataaaacaacgtttttggataatattaacgttttgagaattgtgaagctttccgggctttcttcaaacctggcttcttacgttccttcatacgagcatcacgagttaagagacccgcgcgcttcaaaggagtacggaaatctgggtcaacttcgagcaatgcccgagcgatcccatgacgagttgcgccggcttgaccatggaagccaccaccattaacgttaactaaaacatcatattgatcagttgtttcagttacttcgaatggttgtaacaattccttgcgaatatctgcaaatggaatgtaatcttcaacagatttgtcattcataacaattttaccagtacctggtactaagcgtacgcgggctactgaatctttacgacggcctgtgccgcgatattgtacttgagccaatgtagtttcctccttagattaagttagtgatgtccaaaacttcaggcttttgtgcttgttgcgtatgttctgcaccagcataaacatgcaacttcaagcccatcttgtggcctaaagagttgtgaggaagcatacccttaactgaagtttcaatcaatttagtaggttcctttgccaagaagtcaccggcagtccgttcctttaaaccaccagcataagcagtatgatgataataaatcttccgttctgctttcttcccagttaaagcgaccttgcttgcattaataacgataacgttatcaccagtatccacgttaggggtaaaggtaggtttgttcttaccacgcaagattgatgcgacgacagttgaaagacgacccaaaggtacatcggttgcatcaactacataccatttacgatcaatttcacctggtttagccatatatgttgtacgcacgttgtgttcctccattttctgtgtttgtttgacactcaataagatttccggggcttatcgtggggcaaacaataccaacgactagtctacccaatttcgcctcagaagtcaatactttatcaaatcagcttgtaattcattttgttcataatacacttttttcatataaagtccagccgcaggagccgttccccgcgcttgctcacggtctttagccgctagtaatgctggaatacagtcaactgcgcgccggccctgaccaatttccatcaaaacagccaccatgattcgaacctggttatataaaaaaccactaccgcaaaattcaaactgaatttcgcgttcatccggcaaggcccacgctttggctgaatagatctcacgaacatggtcatgtgcttgcgaaccggacgcaacgaaggtcgagaaatcgtgccgtccttctaagtcaccgatggcttgctgaattctgtcaatatccgcagcgaacttaaaatgccccgtatagtgccgtttaaatggatctacaaattcattttgataggcccgataccagtaccgcttaccgaccgtatcataacgcgcgtgaaaatcattcggcacaatggaaacggcctttacgattgtatccatcggtaacatgctgttcaggccgcgccgaaccccttctggattaatttcgtacggcaagtcaaaatgcaacgtctgtccaaacgcatgtacaccagcatctgttcggcccgcgccgtagatcacaatcggttcaacgggatctttcgccatcttattgaccgccttagtgacgacctgctcgacagttcgctggtgtggctgacgttgaaaacccgcaaaattggtgccgtcatatgctaaaactactttataccgcgtggtcacaatatccctccagttaaaaacgtgggtcgccatcagtgcgacgcccacgttaatcagtcttcatttatgcacgcaagaaaatcaatgcaacggtcaagatcgcaaagcatccggtagcccacgtatcacgttggtgccacttaagaatccggtacttactgcgaccctcgccgccttgatagccacgtgcttccattgccgttgctaaatcctcagcccggttgaatgagctgacaaacagtggaatcagcagcggaaccacggcacgcatttgttggaagatattgccctcaccaaagtcgaccccccgggcccgttgtgcattcataattttttccgtttcgtccatcaacgttggcacaaagcgtaaggcaatcgacaacatcagcgccacttcatagactggaaaacgaaccgcccggagcggcatcaaaatatactcgatggcatccgacaattccagtggcggcgttgttagagttaacagcgttgacataaaaataatcaacacgaaccggcaaaaaatatagaccccgttgatcaatccaagttggctgattgtaatgatgcccaattgaaagtaaacgtgcccgccacttgcactaaacaacacttgcaggatgacggtgaataaaatcaaccaaatcagcggtttgacgccgttgatgaagaacgaccatttcacaccggataggtaaatagcggccaatgtaaaggcaaatagcaaggcataggtcgcccagttattggcaataaaaataatcccaataaaataaaaactcagtaacagtttcgcccgggggtccatatggtgaaccacggagtctcccggaatgtagcgaccaaagatcaatttattcatcatgagcggccacctcccccatcgcgttcggtggcaactgttggacgatggctgctgctaattcgtcctcggtcaacggccactcatcaaattgccagccttgcttttggagtgtatgtgcaaaggccgttgttttcggtaagcccaattgatgggcagtcagccacgcaggatctttgaagatctcacgaggcgtccccgttttgacgatttgtccacgatccatcacgattacattatccgcgtaattggcaacatcatccatctgatgggtcactagtaccacggtcaaatcacgttcatggcgcaaacgggcaaacatctccatcatatctaaacggccctgagggtccaatccggcagtcggttcatccaagactaggacttgcggctgcatcgcaaggacccccgcaatggccactcgccgcatctgtccaccagagaggtcaaacggtgaccgcgtcagtaacgactcgtctaacccaactaaagccaacatttcagccgcagttttcaaagcatccgcttcgctggccccaaaattctggggcccgaatgcaatgtctttggccaccgtttcttcaaacaactgactttctggaaactgaaagacgatgcccacgtgttgccgcaatcgtttcaaatccttattactcgtcgttggcgtaatgacccgttcaccaatcgtgaccgttccactagtcggtttgagtaaggcgttcaaatgctgtaaaagtgtagacttaccactccccgtatgaccaatcaaagccgtataagagccggtgggaatggtgacgttaatatcagttaacgccttagtttcgaacggcgtacccggttggtaagtaaaatctacttgtttgaacgtaattgccataaccagtccgccattcctttctctgttaaatactgtgcgggcacttgaacaccctgccgctttagcgctgcttttaagcgctcagcatatggcatgtccaatcccatcttaattaaggcttctccatgctgaaaaatttccgctggagtcccctcttccttaacctcaccgtcattgatcactaagacccgattagcgctggccgcttcgtcaatatcatgcgtaattgacaagaccgttaacgctgaattagccttcatatcgcgaatcgtcgtcaatacttcctgacgaccacggggatccaacattgacgtcgcttcgtccagaatcaaaatctgaggccgcgccgctatcataccagccagcgccacccgttgtttttgaccacctgacaaacgtgccggttcacgtgtcgcaaaatcctgcatgttgacttgttctagagccgcctgtacccgcgttagcatctcaggacgcggcacgccctggttttcaaggctaaacgcaacatcatcggcaacggttgccccaacgaattggttatctgggttttggaaaaccatcccaattttgcgccgaatgtcccaaacggtttcttcagataatacttgaccatcaaccgtaatcgttccggccgctggtgctaacagtccgtttaaattcttggccaaggtcgacttaccagaaccgttatggccgacaatggcgacccattcacccggcatgaccgtaaatgaaatatcgtgtaacgttaactgatccgtagcttgttgcgggtaacgataatctaaatgtttaacgtcaataatcggactcaccattgtccctcatttccttaaaattcatggttattatcataacatatctgacggaacttgtagtaactgaacttcacgtccaatcttactttaaatcagtggctggcccgtatttgtaaccagcatcgccaaacagcgtgaactgcttcttcaagttattggagacgtatacttttttatccttggtaataaaaatggccccaataccttgatccgctttaccattaatgtacttcatcccgcctttgaggcctttgtcaaaggtggccgtcgatagtgcatcgccatccaccgacttcttcgagatgatggaaacgcccatcaaattgttttgataaggtgcccctgtttgtgggtccatcaaatgactgtaaactttaccattcttcttcaaatagcgttcatagatcccagaagtaacgattgacttattcttagcaggtagtgagccaatggccgtaccccgtgacgcttttggatcttggataccgactgtccagttacctgacttcgtttctttagggctgtcacccagaacataaatattaccaccgaggtcaataatggccgttgaaaccccatgatttaataagtacgtcttcacttgatcggtcatgtaacccttggcaatcccaccaaggtctagttgcattcccttttcttctagataaacggtccgtttcttgtcatttaatttaacttttttgtagtctaccagcttaacgttcttatcaatttcttgttgagtgggcaccttggcatcggaaaatccaatatgccagagtgatgtgatcggaccaatggctaaatcaaaggattcgtctgaattcttactataatagtaagctgctttgatcattgggtagatatccttgctgacagccactggctttttaccggcagcggcgttgatcttatcaatttcagatcctttttgattgacagtaatttccttagcttccgttttcaacagcttaaacgccccagctaacacgttatccttacccttattataaatccgcaacgtgacaactgtgcccatcatgaactgggtatcctcgatcggcgtcttgacgaccttagttggtttgggtcggctactagcagcatttttgcgactcgtactcgtcccacacgccgtcaatggcacgatcattgcaacaattaatccaattcgaacccatttttttagcttcattccaatacttcccctatttttaatttcaattgtcattataccaaagtcttgattcatccggtgagactgtttgcgcgtcatccaagcttttctacgctagtctgacatcagcgcacctacagcaaacggtacaactcgacggtcgggtttgtactaccacagccattttgcacttaacattcaccgccactattattttttaaaccaatatccatgtatggatttagcttgctcaaagtcgtgcccaactgagtgacaaacttttgtggttgttcaattaaaaacaaaaggccctcagcatgcgcctcaggcctcaaaagaatctaataattaaattgcttattcagagaaaatcatgttgtcaacagtaatcgtgttggtgtcacccttttgtgccgcgttttgtaattgttccgcgtacataataaaggtgttagaagattcagtggcacccgtgacaacgtcaaccttagttggatcactactcttaactaatgacttgttcaaagctggttgataagtcttagggttagtcttagcaaccttcttcatttgcttgttgtaagctgcatcgtcaactttggacttgccattcttgttcacttggttatattcagacttcgtaatcttattatccttgaccgtgattgcgaaagtaactttgtaaccgtgtgagtagttcttttcgttcaacttgtaggtaccatctttcatcttggcaccattgtcaatcttaatggtcgacttgttacccgcttgggcagcttgaactaattgttgtgtgtagttttggaaggtctttgatgattcagtcgcaccagtcacaacatcaatggagcccacgttaccagtagcggcagagcccgtcagcgtcttgtttaacttaggcatgtaagtcttggggttagtcccagcgatcttcttcatttgtttgttatatgaagtatcatcaactttggacttgccgttcttgttcacttggtcataactggacttagtgattttaccgttgttattaactgtgatactcatcttggtccgataaccatgtgaataattttcttcttcaaggttataagtacccgctttcattttgctgccagcggttaatttagcaaccttagttgtcttagctgatgagcttgaagatgaactcttcttggatgaactcgagctagaacttgaagaactgctaccacaacctgctaaagctaaagctgaaattgcaacaactgaagcacccgtaataactgatttgaatttcatgatatcccactcctaacctttttgtatgaaaattcacattaatcttaacgtttaaactggtaatagtcaatcccattccattaaaaaaatgatattttagcctaataatagcggtattgacaacgttttccgttcaaacctcgatgccactattttcgcggcttagataatgtgatagtttatgcattctttcccataatccatagacaaccgcttacattatcgttataattattagtggaattatctttttacactattattcaagggagttgttacgcaatggcaaagaaaaatattgtcgttgtcggtgcggggtttgctggtgtttacgcaaccaagaaactgtctaagcatttcaaaaaaaatgcagacgtcgagattacgttgattgaccggcattcatacttcacgtatatgactgaattacatgaagttgctaccgaacgggtggaacctgagcatatccaatatgatttgcaacggttgttcgcacggcgaaaaaacgttcgtctcgtgaccgataccgtgacgggcatcgacaaaaaggcacaaacagttactaccgaacacggaagttatcaatatgatcaacttttaattagtttgggtggggaatccaatgactttgggactcccggtgttaaggaacacggcttcgaattgtggtccttcgaacaagcgatggcattgcgcgctcacttatctgcaattattcggcggggggcggcggagctcgaccctgctaagcgcaaagccatgttgacctttacagtctgtggttctggttttactggttctgaactgattggtgaattaatcgaatatcgtgatgttttggctcgagacaacaagctcgatccaagtgaaatcacgctccaattggtcgaagcagcgccgactattattaacatgctcaaccggacgcaagccggtaaggccgctaagtacatggaaaaacatggtgtcaaaatcatgacgaactccatgattaccgaagtctgtgaagaccatgttaacttaaaaggcaaggatccaattccaacctacacgttaatctggacagccggtgttcgtgctaatagtatcgttaaaaagttcggcattgaaactaacccccgcggtggtcgcttgatggccaatgaattcatgcaagctaaggattgtaacaatatcttcttagccggtgattcaaccagctaccaagaacctgaccaaccacggccagtcccacaaatcgttcaaggggctgaagaaaccgcagctaaggccgtcgaaggtattattaagaacgttgaccagactgacgttacgatcaagccatttaagggcgcttatcaagcatccgtcgactcaattggttccaaatatgccgttgcacaagttttagagaagtggaacgtctctggttttattgccgtgcttttaaaacacgccatcaactggatgtactacgttcagattttctcaggttactacctattccagtacttcatgcacgaattcttccggactcgtaataaccgtaacgtcttccgcggttgggtctcacgggctggtaacgtactctggagtgtgccactgcggttcttctatggtgccatgtggttatgggactgctggactaaaattcagggatctgaatcctggttcactgacaagttacggttaccattcgaatggattaccgtggccgcaaccagtggtgcctctcaagcaactaaagccgctgcaaccagtggtgcttctgaagctgccacgtcaaccgctaaagccgctaagggtgtcttcagtctttcatacatgtacggtaaagaacccctgatggtctttgacaaaatgccacattggttcgaatcaattaccaaggtcttcattccgaacatgcaaatggccctcttcttccagaaattcatgacttgtgttgaaatcgtcattgcattatgtattttcttcggactctttacttggtttgctaacgcagtcaccattggcttagttgtcgtcttctgcttatctggcatgttctactgggtcaatatttggatgatctttgttgcccttgccttaatgaacggttccggacggacatttgggttagactactgggtcgttccgtggatgcaaaaacaccttggacactggtggtacggcaacgttcgttctcattacgacggtgttaaaacccgctagatgcgttataattaattaaatcctttcccgatggttcaagggttgtttttctcccttgaaccattttttatttcattgaattggagggttaacgatgcataaattacggacaatgatccggacattcaaacgttatggggatatgatcaagccgtttgatattattattattgttgcgctaattattttatcgttcaccccactagcgattttttcataccagcaaaaacaacaagctgaacatgcggcactagtggctaagcgaaaggccacgagcaatgaaaccacgtataacgccgtggtctcacataatgggaccgtcttgaagcgtgtcaatattacgaatctgaaaacgactaagcacttcacctatcgcgataaccatgggcactacaacacgatcacatttaaacctaagcgcgttgcgattacgaaagccaactgttctgaccaagtatgtgtccgccgaggctggattcataaacctggtcaaacgattgtttgtttgccccacaaactcttggttgaaattaaggccagcaacggtcaagtcaaatctggcggtaatggtttagttacggagtagaatatgaataattcatttgaacgatcaaacaaaactcatcgtaatatttatatcgcgttactggttgcacaaggcgtgatcatcggcatccttgaacggatgattccattcccgtttgcctttgccccaggtgccaagcttggtttagccaatctgattaccattgttgcaatctatacattatcattaactgacgtgataaccctaacctggctccgtttgattttaacggccctcctaggtggcactttatcaacctttctgtatagttttgggggcgcctttctcagcctgtttgccatgctgttggtcaaacaattagggcctaaacgcgttagtattattggaatttcagcaactggtggcgtcatgcataatgttggtcagctattggtcgcgagtcttattgcacagacgtggacggttatgctctacttgccagtgctttcgattattggactagcagcgggaagtgctctcggaatcgccgccaactacttgttcacccacgtcacgatcttacgctatctcaaattcaatcgagaacaccatccagatcaaacaaaggagtaacccttatgcaatcggcaacacaattacacccaatttggcgtgattacccggcactacaaccggagctgcaacaagtgatgcagctgatgacggcgaacatcaatattcaagatgccgacatcaatgacgcgattttagaaatgattcatggtggtggtaagctcttacgcccggcatactgcctcctattctcacaatttacaacaactgatcggcaacggatggtggccttagcggcgtcattagaaacgctccataccgctacgctgatccatgatgacattgttgacgatgctgcactacgtcggcaccatgtcacgattcaagaacgttttggtaaagatactgctgtgtatgcgggcgactacctattcgttgtagtgttcaagattctagcgcactattcaagcagtttcaaaagcatccagatgaactctgagaacatggaaaagattctagtgggcgaggtccaacaaaaggaccgccactaccaccttgacattaccatggcagaatacttgcaacaaattcaaggtaagaccgccgaattattcgcactgagttgttttctaggtgcttatgaatctggtcaaagtagtcatttcgcccagcgcgctcgtaaagcaggtctcgcaattgggatggccttccaaattcttgacgatattttagactatcaagaagtcagtcaggaaacgggcaaacccatcctcgaagacgttgctgaaggtgtctacacctcgccgttgatttttgccttacagacagaagctaagcacgatttattgccgctgatgcgactacagggggcaatttcggacactcagcgccaggaagtacaacgacttgtcatcaatgccggcggtgtggtgcaagcccaagaactcgctaccaagtacactcaagacgcgctggcaatcatgcgtaaacttccagaccagcctgcgaagacggatctgattagtctaaccaaacggctgttggaccggcataattaactagtaatcaatcgactaaggtatcaaacatcctgtttgataccttttttgtcgcccagacacagctaaacgcccatgtgcttcatcttcacagtcagtacctgagaccactatgtccactttccagattcaacaggtcataatctgcaaataacaaaccgttgtcatcacgagtattaaaaacacttatccattccaacaaaaaaccgctgatttagggaatcaatccctaaatcagcggtcgctcgtaactagcaccaaaaaaaatcacttagaactgcgatatgccatctatgtctaaccataaataacttccgaactagacttagctactattttgccagtagccaccatcataacgcccgtcaatcatcagtcccagtgatccgtaaaacaatcttaactagtcaacgagttccaagacaaccatttgtgcaccgtcgccacgacgaggcatagtcttgtaaattcgtgtgtaaccaccattgcggtcagcatattgaggacctaagtcactaaatagcttttgcaatgcagtttgtacagccacgttgtcgccatcttccttaacatcggcaacgacgtcccgcatgaatgcggcagccttccgacgggcgcttaaatcacccttcttggccaaagagatcattttgtcagcagttgaacgaacttccttagcacgggcttcggtcgtttcgatcttgccgttaacgatcaatgacgttgtcaaatcgcgtaataaggcacgacgttgtgaacttgtacgttgtaatttacggtaactcatgaacggatatcctcccttgtattagtcttctttgcgtaatgataacccaaggtcagctaattttgccttaacttcctcgagtgacttgcgtccaaggttgcgaaccttcatcatatcagcttcagttttgttagttaattcttggaccgtgttgatgccagcacgcttcaagcaattgtatgaacggacggagagatctaactcttcaatcgtcatttctaacatcttttccttatgcgtttcttccttctcgaccatcacgtcagtgtttttagcttcatcggtgagatttacgaagattgaaaggtgatcagtcaggattttggctgatagactaatggcttcacttggagtgattgaaccatttgtccaaacgtctaaggttaacttatcgaaatcatcacgttgaccaacccgcgtgttttcaacttgatagttgacacgttcgattggagaatacaatgaatcaacagctaaaacgccaattggcatgtcatcttcacgatgtttgttatcctcagcggaaacataaccacgaccagtatttgcggtcatacgcatatggaagtgtgccccgtctgctacggtacaaattggtaagtctggattcaagacttctacgtccgcatcgccaatgatatcaccggcagtaacgttagcaggacccttaacgtcgatttccaacgtcttggtttcgtctgattccaacttaagtgcaatcttcttaacattcaagataattgctgtaacgtcttccgttacgccctcaatcgttgaaaattcatgaagaacaccatcaatttgaatactagtaacagcagcgccaggtaaagaagaaagaagaatccgacgaagtgaattccctaaagttgtaccataaccgcgttcaagcggttctacaacaaacttaccatagttgtcgttttcatcaattttatgaatgttaggtttttcaaattcaatcattcttatcttttacccctttcaaaacgcgtggtgtttagtagttgtgcgtacaaaatgaagtttgccctcaaaatgaacgtcacagattaaacacgacgacgctttggaggacgagaaccattgtgaggcactggcgtaacatcgcgaattgcgctaacttccaaaccagtagcttgtaaagcacggatagcggcttcacggcctgaaccaggacccttaacagcgacttcaacagtcttcataccatgttccattgatgccttagcagcagcttctgcagccatttgagcagcaaaaggtgttgacttacgactacctttgaaacctaatgaaccagctgatgaccatgcaatggcgttcccttgcatatcagtgatcataacaagtgtgttgttgaacgttgaatggatgtgagccacaccagattcaatgttcttctttacccgacgacgacgggttgtctttctagttgccataaaattcgaaaacctcctttattattattttttacgtccagcgatgctgacctttttacccttacgagtacgagcattgttcttcgtgtgttgaccacgaactggtaaaccacgacgatgacgcatgccacggtatgaaccgatttcttgcaataacttgatgtttaagctgacttcacgacgtaagtcaccttcagttttgtagccatcgacaacggcacggattttgtcttcctggtcaggagttaaatcacgtacacgaacgtcttctgaaacaccggcttcagcaaggatcttctgtgcagaagtgttaccgataccgtagatataagtcaaaccaatgacaatacgcttgtcacgtggtaagtcaatcccttcaatacgagccattaatatttcacctccaacttaattaaattatttaccttggcgttgcttatgctttggattagcagagcagataatcatcacgcggcctttacgacgaataactttgcagtgttcgcacattggctttacagatggtcttactttcatgagttttttacctcctataaggtacgtagaccgagcctacttgaaacggtaggtaatccggcccttagttaaatcataaggtgacatttcaactgtaaccttgtcaccaggcagaattcgaatgtaatgcatccggatcttacctgatacgtgtgccaagatttcagcgccgttttcaagttcaaccttaaacattgcgttcggcaacgtttctttaatggttccttgaatttcgatgacgtcttcctttgccaagtactgtccctccttattatcagattccgtgctaccacgtatttggtccattactgaaccagtcattgtctaatcataacattaaaaaaatattaaatcagtcaacggctaaacctgaataattttatcacaacgacctttgaaaagcaaacgtcgctgctgaaggaatctggtttacaggttatcaagaattttcttgatatctttgtagacatcatcaatgtcgcgatcaccgtcgacattgtagagtaacttttcttgaccgtaataatcaattaatggcgtgttcaacttaatgttcacgtctaaccgattcttaacggttgctggcttgtcatcatcacgttgatagaaatcatgaccgccacacacatcacaggttccttctaccttaggcttgttgtacaacttatggtaagttgcaccgcaagtccggcagataaaccgaccggaaagtcgttcaacaagtactgcgggttcaacatgaatgttgatgaccccatcaagtggcttattgagttcttcaccgatttgtttcaaagcatgagcttgatcgatgttacgtgggtaaccatctaataggaaaccatttttagtatccgcttcagctaaccgatcacggacgatgccgttagtgacttcgtctggtactaagttacctgcatcaatatacttcttggcttccaagcccatcttcgtttcgttcttaatggctgcacggaagatgtctccagtcgagatatgtggaatatcaaaatcttcaagaatcttctgtgcttgagtacccttaccggcacccggtaagcccattaaaatcaggttcattgttgacatgttttttcctcctgaatgcacaaatgtgttgagtctccccaacacattcgctgattaacgaatgaaaccgacatagtcacgtttcatcatcaatcctttaatttgacgaattgtttcaagggcaaccccaacaacgattagtaaactcgtcccacctaaaccgattgattcatcgagaccccaaatatcagaagctaataatggaatcaaggaaatcaacccaaggtagagggcaccgaccgtacttagtcgcattaacaattttgaaacccaatcttgagtatccttacctggccaaacaccaggaatatagctgccttgcttttgtaagttcttagagagcttttcaggattgacctgaacaaacgcatagaagaacgtgaagagcacgatcagaatggtgtaaagaatagcaccagtcgtcgactgcatattgaagatattactcaaaacggtataccaggtttcgtcaccatgactggattggaatcctagcaaaatcgtttggggcgttgcaatgaaggaactcgcgaaaataacaggaataactccggcaacgttcacctttaatggtaggtaactactgtcaggtgcaccagctgcacgacgagtgtattgaattggaattcggtcattagcttgttcgacccacgttacaaacataacgatgatcagcacaagcaaggctaacccaacaacaaacaagccactcttccaccagtcgctctgtgaaacattaacgaactgttcttgataaatttgataaatcgatgttggcatacgggcaatgatcccggcgaagataataatggaaaccccattaccgattcctcgatccgtaatcatatcacccatccaagtcgtcaacattgccccaccagtgaggatcaccccaatggtcaggtaagtcgaaatacttggattgttaacgagcttgagttgactcaaagagttaaaaccagccgtaatcccaatcgactgaacaaaggccaagacgatcgttaaccaacgggtcgcttgattaagcttgcgtcgaccaacttcaccttgtttgccccattcaacaaacttaggaacaatgtccatttgtaacaattgaacgatgatttgtgcagtaatgtaaggggatacccccatagcaaggatggaataatttgttaaaccgccaccactgaatgtattcaacatacttatcagccctgaagatgccaccgactgaagtgcctgtgcattaactccaggaactgtgatataagagccaagacgaaatacaatcaaaacgcccaacgtgaacagaagtttattccgaatatccttaactttgagagcgttcttcatggtagtcagcaaattagatcacctcagttttaccgccagcagcttcaatggctgcaaccgccgttgcagagaacttgcttgccttaactgttaactttttgttgagtttaccattaccaagaactttaacagcagaactcttcttaactaagccagcttcctttaatgattctggtgtaacttcggcaccatcatcaaaacggtttaagccgtcaaggttaacaaccgcatattctttacggttaatgttagtaaatccacgtttaggaatccgacggtacaatggcatttggccaccttcgaaaccgacacgaactttaccacgcgccttttgacctttttggccacgaccagaagtcttaccttggccacttgagtcaccacgaccaattcgacgacgtgaaaaacgtgaaccttcactaggtgttaattcatgtaacttcatttagtaggcacctcctctttgaaaatttgaattacttgatgatttcgacatcgactaagtgtgcgatgtggaaaatttgaccgcgagttgctgcgtcatcaggtttaacaacggaactattaatccgacccaaacctaattccttaacgattttacgttgcttaggaagacggtgagcagcactgcgtactaaagtgatctttaattgagccatgttgtttgtcctccctattcagctaaatgttcggctgaaacgccacgtaaagcagcgacttgttcagcagtctttaagctctttaagccttcgaacgttgcacgaacaacgttaacgggggtgtttgagcctaatcgtttactagtaacatcatccacaccggctaattccatgacggcacgaacggcgccaccagcggcaacaccagaaccttcaacggctggcttaagcatgatgcggccaccaccgtaaacaccaagtgcttcatgaggaatggtggtaccaaccattggtacagtgatcaagttctttttagcagcttcggaagctttccgaattgcttctggaacttcttgagccttaccagtaccgaaaccaacgtgtcccttgtggtccccaacgattactaatgcagcaaaacgtaggcgacgaccacctttaacaactttggtaatccggttaatggcaacaacattatcgtcaagatctaattttgatggatcaatgaaagtcatatggtattattcctcctttgttagaatttaagtccgttttcacgagcggcttcagccaaagcttgaacccgaccatgatataagtaaccgccacgatcgaaaacgacgtcaacgattttcttttcagcagcgcgcttagcaacaacttcaccgacagatgcagccttttcagtcttgttgttacctttaacttcgctatctaaagttgaggcacttgcgagcgttacaccctctacatcatcaataacttgagcgtagatgtttttgtttgaacgataaacatttaagcgtgggcgctcagcagtcccagaaatcttaccgcgaacacgtgcgtgacgacgttgacgtgttttgtttttatctggtttggaaatcacaatagtcacctctatatattagtatggacagctttacgctgcattatttaccagtcttaccttccttacgacgaacatattcatcgacgtaacgaatccctttacctttgtaaggttcaggtgaacgaacggcccgaacttcggcagcaaagtcaccaacagcttgcttaccaataccagaaatattgatatgcgtgttatcaggaacttcaacagtcaagttttcaggcgttgcgaattcaacagggtgtgagtaaccaacgcttaatactaacttcttgccttgcaattgggcacggtaaccaacaccgaccaattgaaggttcttagtaaagcccttagtaaccccttcaaccatgttgttaacatttgcacgggtagtaccgtgtaatgccttcatcttgtagtcatcagatggacgagtgaatttaacttcgttgccttcaaccgtcatcgtaatatcactggcgatgttccgcgttaaagtacccttaggacccttaaccgtaacgacttcaccagcttgtgatacttctaccccagcaggtagttcaattactttataaccaatacgactcacttacttgcacctcccgtcttaattaatgattaccaaacgtaagctaatacttcgccgccaagcttcttggcgcgagcttctttatcagtaatgacaccttctgaagttgagatgatagcaatccctaaaccgtttaaaaccttaggaacagcatcagccttgacgtatgaacgtaaacctggctttgaaatacgcttcaagccactgattacacgttcgttgtccttaccatacttcaagaagacgcggatgatgccctgtttgtcatcatcgatgtattcaacgtcgcgaacaaaaccttcattctttaaaatttcagcaatgttgcgtttgatttttgatgcaggaacttctagtgaatcgtggcgtaccatgttagcgttacggatacgagtcaagaaatctgcgattggatcagtcatcatgaaagtttaacctcctttaacttgggtttgtttttaccagctggcctttttcataccagggatttgacctttgtgggccaggtcgcgtaagcagatacggcacaagtggaatttacggtaaactgaatgtggacgaccacaacgttcacaacgggtgtagttttgtacgttaaacttagcaccgcgcttttgtttagcaatttgtgattttttagccaacttcgattaacccccttcggttatttagcaaatggcatgccaaattgagttaacaactcacgtgattcttcatcactatcagctgtcgtaacgattacaatgtctaaaccgcgaacacggttaacattatcatagttgatttctgggaagatcaattgttcacggacacccaatgtgtagttaccgcgaccatcaaatgaacgagtacttacaccatggaagtcacgaacacgtggtaatgaaacattgatcaacttgtccaagaagtcatacatacgttcgccacgtaagtcaaccttggcaccaattgccataccttcacgaagacggaaaccagcgatagatttctttgcccgggtaaccaatggtttttgaccggagatcaaagttaattcttcaactgcttcgtctaagtttttagcgttggtaactgcatcaccaacacccatgttcaaaacgatcttagccagcttaggcacttgcattactgaagtgtaattgaacttgtcaactaatgctggaacgatttctttttcatattgagcttttaaacggttttccatgaaacttgcttcctcctttcagtcagtcttagttttctaagtctttaccagactttttagcgtaacggacacgcttgccatcttcacgacgaacacctaaacgtgtaggttcgttggttgatgggtcaaggtacataacgttagaagcatcgattggtgcttcgatgtccacgataccgccttgtgggttaacgttcgttggtttttggtgtttcttgatcttgttaacaccttcaacaacgatccggttcttggcagagataacctttttaacagtaccttcttgaccacgatccttaccgctgattactcgaactttatcaccagttttaatcaacattaggttgcgcacctccttatttacggtgtgtgactagagtacttctggcgctaatgaaacaatacgcatgaagtccttatcacgtaattcacgagcgacaggtccaaagatacgagtaccttgtggagtcttgtcatcacgaataataactgcagcattttcatcaaacttgatgtatgaaccgtcagcacggtgaacaccagacttagtccggacgatcacagctttaacgacatcatgagctttgacaacaccaccgggtgttgcttgtttaaccgtagcaacaatgacatcaccaatgttagcagttttacgaccagagccacctaataccttaatagtaaggatttcacgggcaccggagttgtcagcaacttttaaacgactttcttgttggatcacagtaagtgtcctcccttcatgtaattttattcagctaataatctagataataacagctttttgaacaacttcaattaagcggaaacgcttagtagctgatagaggacgagtttccatgatcttgacgatatcgccagttttggcttcattcttttcatcatgagccttgaatttctttgaataacgaacacgtttgccgtataccggatggttcttgtaagtttcgacaataacaacaatggttttgtccatcttgtcagaaacaacgcgtccttggataaccttacggctattacgagtatcttcactcattcgtgattgcctcctttatactctacttgtttaactcttgttcacgcaacgcagttttaatacgcgcaatgttcttacgaacttgttttaaacgagcggtgttttcaagctgaccagtggccaattgaaaacgcaagttgaaaagttcgtctttgtaagacttttctttttcgagcatttcagtagtggacaatgctttaatttccttagccttcatctgattcgccacctacttcctcacgcttaacaatcttagttttaacaggtaatttagttccagccaagcgtaaagcttcgcgtgcaacttcttctggaacaccagcaacttcaaacataatcttgttacgtttaactggtgctacccaacctgcaggagtacctttcccattacccatccggacaccgacacctttttcagtgtaagacttgtgagggaaaatcttaatccataccttaccgccacgcttcatgtaacggttcatagcaacacgggcagcttcaatctgccggttgctgatccagtgtgattcgagggtttgtaaaccgtaatcaccaaaagcaactgttttaccgcctttagcttcaccgcgcattttaccacgatgaacacgacgatacttaacccgtttaggtaccagcatgtttagtttcctcctttagcagatttcttttctggcaagatttcgccacggtagatccaggtcttaacacctaatttaccgtaagtcgtccgtgcttcgacccatgaatagtcgatgtcagcacgaagcgtatgcaatggaaccgtaccatctgagtatgcttcaacacgagacatgtcggcaccgtttaaacggccagcaacttgtgtcttaatacccttagcaccggaacgcattgtacgttgcatagcaccacgcatcgcacgacggaaagcaacccggccttccaattgacgcgcaatactttcaccaactaatttagcatctaaatcaggcttcttgatttcgatgatgttgatgtgtactcgcttaccagttaaattgtttaattctttacgaagagcttcaacttcagaaccacccttaccaataaccatccctggttttgcggtatggattgaaatgtttacgcggtttgcagcgcgttcgatttcaacggtggagacggaagcgtcggcaagtcgttgttcgatatacttacggatgcgtaaatcttcgttcaagtaggcagcaaaatctttttcagcgtaccattttgcttcccagtcgcgaatgattcctacacgtaatccggttggatttactttttgacccacgcgttatccctcctatttttcagtaactgtgatcgtaatgtggctagtccgcttgttgattggtgaagcagaaccttttgcccgtggacggaaccgttttaaggttggtccttcgttaacaaaagcttcgcttacgaccaaatcttcgcgatctaagtcaaagttattttcagcgttagcaacagcagaaagtaaaactttttctactactggagaagcaccccgtggagtgaacttcaagattgctaaggcttcggcaacacttttacctctgataagatcgacaactaggcggaccttacgagcggcaatacgaacagtttttgcagttgcacgtgcagatgttacttgttcagccattctttatatcctcctaactattacttcgttttcttatcgtcagttccatgaccatggaacgtccgtgttggtacaaattcacctaacttatgaccgaccatgtcgtcttggatgtaaactgggacatgcttgcgaccatcataaacagcgattgtgtacccgataaaacttgggaaaattgttgaacgacgtgaccacgtcttgatgacagatttcttgtcagaatcagattgtgcatcgattttctttaataaatgcgcatctgcgaaaggtcccttctttaaactacgacccatcgtgtgacctcctctcgataactacagtaaattcaaattttattagtgtttgcctggacggcgaccacgaacgataagcttgtttgaacgagccttcttgttccgagtcttcttaccaagcgtcttcttaccccatggagacattggagatggatgaccgattggtgctttaccttcaccaccaccatgagggtgatcgttagggttcattacagaaccacgaacagttgggcgcttaccttgccaacgtgtacgaccggctttacctgagttgattaattcgtgttgttcattaccaacagtaccaatagtagcgcggctagttaataatactaaacgaacttcaccagaagacaaacgaacaattgcgtacttgccttccttacccagtaattgtgctgaagtaccagcagagcgagctaattggccacccttacctggcttcaattcaatgttgtgaataacagtaccaacagggatgttagttaatggtaatgcattaccaaccttgatgtcggcttcggcacctgattgaacttgcataccaacttccaaaccttttggtgctaagatatatgatttcacaccgtcagcgtaaactaataatgcaatgttagctgtccggttaggatcatattcgattgccttaacggttgctggaacttcatccttaatccgcttaaagtcaaccaaacggtattgttgcttatgaccgccgccacgatgacgaacagtaatgtgaccataactgttacgaccggcagtgtgactttgtgagtctaataatgacttttcaggcttcgtcttagtgatttcagagaaatctgaagcagtcatattacgacggccgttagtggttggtttatacttcttaatacccactagagttacctcctaaattagatttattgttgatcgtcgttgaacaacttgatttcgttagaatcagaacttaaggtaacaatagccttacgacgcttcttagtgtagccggcgtaacgaccttggcgcttaagttttcctttaacgttcataacgttcactttaacgactttaacatcgaagatttcttcgattgcttttttaacttgggttttcgttgcctgtacgttgacatcaaatgtgtagcgcttgtcgtccaagtcagccattgatgattcagtaactacaggacgtaaaattacatcgcgtgcttccattatgcgagcgcctcctctaattgatcgagggctttttgggtaacgactaatttgtcactattagcgacatctaagacgttaacacctttggctttaaggatcttaacatttggtaagttacgacctgccaaagcagccttttcattgtcctcttcaaccaaaacaagagtcttggtatcgacgttgaggttgtttaatacatttacaaaatccttagtctttggtgcgtcgaaagctaagctatcaactgcaactaagctgttgtctaagaccttttgtgaaaggacagacttcaaagctaagcgcataaccttcttaggtaatttgtaactgtatgaacgaggggttggtccgaagacaatcccacctttacgccattgtggtgaacggatagaaccttgacgcgcacgaccagtacccttttgacgccatggtttacgaccaccaccgcgacgagcactacggttcttaactgcgtgagttccttgacgcattgatgcacgttgcatcaagatggcatcaaaaaccacgttttcgtttggttcaacaccaaacacagcgtcgttcaaagtaacgtcaccattttgcgtaccgtcttgtttaaataatgctacgctagtcatgtattatgtcctccttccttatttactcttaacagatgttttaactgttacaaatgacttgttggcgccagggacattccctttaattaataaaacgttgttttcaacgtcggcacgaacgatttgtaagttttgcatcgtacgttggtgattacccatccggcctggtaatttcttacctttgaatacccggttgatgatggcacccattgaaccaggacgacgatggtaacgagaaccgtgagccattggtccacgactttggccgtccttatggatattaccttggtaaccatgacctttagtgatacccgtaacgtcaacggcgtcgccagctgcgaaaatatccgctttgacttcgtcacctactgtgtaatctccaagctcaacattacgaatttcacgaatgaagcgcttaggagtcgtttttgcttttgctgcatgaccttgagcaggtttgttcgtcaagacttcgcgtttgtcgtcagcacctaattggattgcttcgtaaccgtcattttcaacggtcttaacttgcaacacaacgttaggttgaacttcaacaactgtaacgggaactaattcgccgctttcagtgaagacttgcgtcattcctacctttttccctaagattcctttagtggtcatgagtacacctccaattaattgattttagtttagtaaattaaagcttgatttcaatatctacaccgctaggcaagtctaacttcattaatgagtcgaccgtcttaggcgttgggttaacgatatcgattaaccgcttgtgagtccgcatttcgaattgttcacgtgagtccttaaacttatgtggtgaacgtagaacggtataaatagtccgttcagtaggcaatggaataggacctgaaatagtagcaccagttctctttgccgtttcgacaatcttgtcagctgactgatcaagaatgcggtgttcgtatgcctttaagcgaatacgaattttttgctttgccattgttgtgacctccttcgtctattttgaaaataagactagctccgtgaaaattaccgccacgtcccatgacaatgtggccgggcgtgtcgcaacctttcacatcaaagctaactacgactacttgatgatggggatatagttatccccttctaaataccaagcacaatctataataaatgaaaagctctgtaatagcaagtgttttcgcactttttttataaccatcgttgtaaaccgtgttacctttttgaaccagctcaattaatgtaacacaaattccatccaattaatagcgtttgcgcctaatttctttttggtgagcgctttacatttctcactgccgaccggccacgatcatgtggacacctactagattgcattaacactttctcaggaacaagacccgcgttcagcgtcatacatttttgtctggagtcatttaatcggacttcaacacgcttaattcaaccgctcctacatctgacggcgccgttacactgacccacgttcttgttcatctaccttctattatattgtcatctgcttatcaccgaccgtcagcaccttggccgtggtcaccgacaaccgtcaactcaagtggtcatctccgatacaaaaaatgcgatgttgtccgcgttctccttattatgctatgagtctcgcacccttaatattatggctgccagttttatggtcgcagcggctagtaacttaactagtgcgacccttgttgcgcggttgtacccttgcgcgatgacataggcctgagcagcactgtgctcgtcacagccgtacccaatgctagtgacggccaaaactatccctaagccgcttcaattgatgtgccacgctgtcttacgacgagcagtaatcacatttagttcgacaagaaatttatgtaaaaaaagaacgtccagccgaagctgaacgtccttcttattatcaatcaagcttatttggcaggagtgccgccattcttcttgatgatatcttcttgaactgactttggtaccttttcgtaatgatcaaaggtcattgtgaaagtcccacgaccttgagtagctgaacgtaatgtggttgcataaccaaacatttcagccaaaggaacgtatgcgtgaacttcttgggcattcccacgttcttccataccttcgatgttaccacgacgagcagtaacgtgacccataacatcacctaagtaatcttctggggcaacgatatcaaccttcatgataggttcaaggataacagggccagcagtcttaacggcattccgcaatgctaatgatgcggcaatcttgaaggctgcttcactagaatcgacatcatggtaagaaccatcatagagcttagccttaacgtcaaccaaaggataaccagctaacacaccgttagccatagcttccttcaaaccttgttcaactgaaggaatgtattcacgaggaacaaccccaccgacgatggcatcttcgaattcgaagcctttaccttcttcgttaggtgtaaattcaacccaaacatccccatattgacctttaccaccagattggtgaacaaacttaccttgaacttgagtgctcttagtaaaggtttcacggtatgaaacttgaggcgcaccaacagtggcttcaacgttaaattcacgccgcatccggtcaacgatgatatccaaatgcaattcacccatcccggcaatcaaagtttcaccagtttcagggttagtttcagccttgaaagtaggatcttcttcagaaagcttttgtaaggcaacgttcatcttatcttggtcagccttagtcttaggttcaacggcaacctggataactgggtcagggaattccattgattccaagtgatatggatgttcaatcgaagtcaatgagtcaccagtagtcgtgttcttcaaaccaattgcagcggcgatatcaccagagaaaacttctgggatttctttccgttggttagaatgcatttgaagtaaacgaccaacccgttcacgtttgtccttagtggcgttcaagacatatgaaccagattccaaagtaccttggtatacccggatgaaagtcaaacgaccaacgaatgggtcagtagcaaccttaaatgctaaggcagcgaatggcttatcatcaccggcaatcaagtcaacttcttcttcagtttcaggatcagtagccttgtatggcttaacatcaagtggtgatggtaagtagtccacaacggcatccattaacatttgaacacccttgttcttgaaggctgaaccagctaatactgggaagaattcaagtgctaacgttcctttacggatagcagccttaatttcttctttgctgatttcttcaccgccaaggtacttttccatgatgccgtcatcgatgtcagctaaggcttcgattaagtcatcacgtgcagcttgggcttcttctttgtattcatcaggaacgtcaaccgtatcccattcagtaccaagttgatcttcatcataaaggtcagccttcatttcgattaagtcaatgaccccttcgaaattgtcttcggcaccaattggtaattggatagcatgggcgttagcttgtaaacgatcatggatcgtgcttacagagtacttgaagtccgcaccaatcttgtccatcttgttaacgaaaacgatccggggaacgttatacgttgatgcttgacgccaaactgtttcagtttgaggttcaacacctgattgggcatccaatacggcgatcgcaccatctaaaacccgaagtgaacgttcaacttcaacagtgaagtcaacgtgccctggggtatcgatgatgttaatccggtggttcttccactgtgcagtcgtggcagcagaggtaatggtgatcccacgttcttgttcttgggccatccagtccatttgtgaagcaccatcatgggtttcaccaattttgtgaattttaccagtgtagtacaagatccgttcagtagtcgtggtcttaccagcatcgatatgggccataataccaatattacgggtcttatcgagtgagaattctcgtgtattagccattagaaaatgtgttactcctctcaatataaatggaattaacagtataaagtttatttcaaaaaatgactactatatgcgcgcatataatagtcacctttttgtgattagttaaaggcgacctttaaccatctcacggaaatattaccaacgataatgggcgaaggcacggttggcttcagccatccggtgagtatcttcacgcttcttaactgaagcaccagtattgttagcagcatccatgatttcacgagctaaccggtcggacatagtgtgttcgccacgtgagcgagcatattgaacgatccaacgaaggccaagagtcgtcttacgatctgggcgaacttcgattggaacttggtagttagaaccaccaacacggcgggccttaacttcaagtactggcataacgttcttcatagcttcttcgaagacttccaaaggatcgttaccagtttgttctttgatttgatcaaaagcatcatacaaaatagttgatgcggtaccgcgcttaccatctaacattaagtggttaattaaacgcgttactaatttagagttatacattggatctgctaaaacttcgcgttttgcaggtgcaccttttcttggcatttaacttacctccttattatttctttggcttcttggtaccatacttggaacggctttggcgacgatcttcgacaccagcagtatccaaagcaccacggataacatggtaacgaacaccaggtaaatccttaacacgaccaccacgaattaagacaacgctatgttcttggaggttatgaccaataccaggaatgtaagctgtaacttcgattaagttagataaacgtacacgggcatacttccgtaaagccgagttaggcttcttaggagtcatggtaccgacacgagtagcaaccccacgcttttgtggcgctgggttattagttgcaaccttcttgtaactgttatacccaaagtttaacgctggggcatttgattttgatactttagacttacggcctttgcgaattaattgattaattgttggcatgttctaaagtgtcctccttccaaatatctgttttttaagtccacacatccaggtggttcttttttgagtaaaaaagaatgcctggagcatggtaattgtgcgcttagccgaccagtcagcatgtctgtattcctgatacaggaatctgtctgcaaaaagcacctttactagactatcatgacatgccgaagttgtcaataaatgtcctgaaaaaatagtggtgctttacattgcgtaactagtgatgaaaggtggtccttccatgttaaccagcagtctttttattattggcctctgtctgggctcattcgtgacctgtatggcggaacgcatcagcaacggacacatactcattagcactcaacgatcaaggtgtccacactgccggcatcaattacggttctggcaactgataccattactcggcattctacttcaacggggacagtgctatgattgtcgcactcctatcagcctccgttccagtctgattgaattactttgtggtagtctactagcttctagcagtgcgtcattgtcattgacgctgccacttctgattggttacttggtattgattttcaatagtcttactgattatctcacttttgaagtctacccgctgacattacttcttccagccggactgggcttatggcaacaacggccacccctgacgatcagtctctacctcgtacttgccttactagtcgggttatacttgctggcccggctaactgccacctttggtctcggcgatgttgacattctactcatgcttgttttcatcattccagccgacacactgttgacctgtctcgccattgcggccgttgccgcattagttggttttatcatcagtgccccacaccatcgcttaccattcgtgcccttcatcagttggagcttcatcatggtcacccaactcacgggtctcgcatagcgagctataattgcaatgttctagtacgtccgattattgcttgttagtcagtgcgcgtcctgttcggatgaacgaccactcaactggtacaatttgtcgtcgaattgtttactacttggaactttaaacaagcgttaatatcgtatcagttgttctgaccctcagtagtaatatggtgatttagaaatcggggacagctcacaattctattattaacctgaaagttacctgataagattccggtctcaaaaaagtaacgactaatccgtcaaaagttgcgtacgcacgtgcccaccattcgaacaccatcccgagcggaagacgtttcttagcactacaagagtgtgcggtttagacgggctgagactgaggattagtgttagctaaccgaaagtctcattccaatctgaacacgtttcaccaatatagtattaaggcacggcagtccagcaattagcagaaatgcctggagcgcagtgcaggacacactaactaagcaagtttacacaaacttgaacttttccagcgaggctcagttagtcttccccccctgaagattaaccttcatcgccgaacgccccagatagcctacctacaatcgtgcatacaaaaaggacgaccacaatggccgccctttttagttacttagcaattacttgctagcatcttgttcttgcatttgtttttcaaggtcgctgattgagtaaaccccatcagccacgttgccaacttcctttggtttgatatgacggtaaaccggcataccagtcccagcaggaatgatcttaccaatgataacattttccttaagcccgatcagtggatcgttcttaccacgaatagcagcatcagttaagacccgtgtcgtttcctggaatgaagcagctgacaagaaactattcgtttcaagagcggctttagtaatcccaagaatgactggccgtgacgttgcaggaataccaccagcaatcaaggtcttgtagttctcgtccttgaagtctgcaatatccattaacgtcccaggcaagacgtcggtatcgcccggatccatgacccgaaccttccgtaacatttgccgaatcatgatttcaacgtgcttatcgccaatttcaaccccttgcatccgataaaccttttgaacttcacggagcaagtagttttcagttgataagacatcacgtacttgaatcaattgcttaggatcgatcgacccaatgttcaacgcagcaccacggtgaataaagtcgccttcactaaccgccatccgtgctgttaacggcaacgtgtaagtccgggtatcagtttcacccttaaccgtaacttccttcgtccgttccgctggattttcttcaattaattcaaccgtcccagtaacttctgagatttcggcacgccctttaggattccgtgattccacaatttcttgcacacgaggcaacccttgggtaatatcgtccccggcaacaccaccggtatggaagttccgcatggtcagctgagtaccgggttcaccgatagactgtgcggcaactgtcccaacagcttcaccaacttcaacttcatcaccagtagccatgttacggccgtagcaatgttcacaaaccccatgcttagtgttgcaagtaaatgcagaacggatcgtaacttccgttacaccagcatcaacgattttatgagctaagtcttcgtcgatcaagacgttgttaccgacaatttcatcatgcgtttcaggatcaaagacagtcttcatcgtgtaacgacctaagatccggtcatacaacggttcgatgacttcgttaccttccatgattgcgtgaatccgcaacccacggtcagtcccacaatccttttcacgaacgataacatcttgagccacatcaaccagacgccgagtcaagtaacctgagttggcagtcttaagcgccgtatcggtcatccctttacgagcaccgtgggttgaaatgaacatttccaagacagacaaaccttcacggaagtttgaaaggattggtaattccatgatcttaccgttaggggcagccatcaaaccacgcatcccagctaactgagtaaagtttgaaatgttaccacgcgcaccagaatcactcatcataaagattgggttatccgcgttgaaactttcaatcagtttttgttggatttggtccttagcgtcgttccagacaccaatgacccgttcataacgttcgtcatcagtaattaaaccacgacggaactgttttgaaatcgtattaacttgtttatgggcttcggcgataattgctggtttttctttcaaaccagtaatatcggcaaccccaaccgtcaaaccagacttagttgaaatgttgtaacctaagtccttcatccggtcaagcaagagtgacgttgctgtcacgtgatattgcttgtaaacttcagcgataatgtcggccaagaagcccttcttgaatggtggaatgatttcctgggcatccaagaattgatgaatatcttcaccaggcttcaagaaatacttgtccggtgtaccagcaatcaagttatcgttagttggttcgttcaagtaagggaacttgccaggcaaaatgttgttgaagattgccttaccaaccgtcgtgactaagactgcttgcttctgatcgtccgtgaatggcttgtcaggcattgatgagacctgaatgccgacccggctatgcaaatgtacataacctgattggtaagccttttgcgcttcattcaagtccttgaagatcataccttcgccttcacgaccgatttcttcagtcgtcaagtagtagttaccgataaccatatcttgagatggcgtaacaacgggtttcccgtccttaggcgccaaaatatggtgggcagccaacattaagagccgtgcttcagcttgggcttcatctgaaagtgggacgtgaatagccatttggtccccatcgaaatcggcgttgtaagcttcacaagccaatggatggagccgcatcgctttaccactaaccaagacgggttcgaaagcttgaatccctaaacggtgaagcgtaggggcgcggttcaagagaacaggatgttccttgataacgtcttccaacacaccccagacatcgtcatcagcatgttcgatctttcgcttagcattcttgatgttagaagctaattcacgtttaaccaattccttcatgataaacggtttgaacaattccaacgccatttgacgtggtaagcccatttggttcatcttcaagaaaggcccaacatcgataaccgaacgaccagaatagtcaacccgcttaccaagtaagttttgacggaaccgcccttgcttccctttcaacatgtgtgaaagagacttcaatggccggttaccaggaccagcaacgggacggccacgacgaccattatcgatcaacgcatcaacggcttcttgcaacatccgcttttcgttttgcacgataatcccaggtgcatttaagtccaacaagcgtttcaaccggttattacggttgataacccgccggtacaagtcgttcaagtcagaggtggcaaaacgaccaccttccaattgaaccattggccgtaagtccgggggaataaccggaattgcgtccattaccatccaagctggttcgttaccagatgtcacgaaagcttcgatgatatcaagccgccgaacggcccgggtccgcttctgaccagaagcatccttcagagtttcctttaaatcacgtgcctctttttcaagatccacgttattcaataaccgtttgatggcttcggcacccatggcagcttcaaattcgttaccatattgagccttcttctcacggtattcacgttcagaaagtaattgcttcttttcaagtggcgtattaccagattcgataacgacgtatgaagcgaagtaaatgatttcttcaagtgcccggggactcatgtctaagactaagcccatccggctaggaattcccttaaagtaccagatgtgagtaactggtgcggcaagttcgatatgacccatccgttcacgacggactttactacgagtcacttcgaccccacaacggtcacagacaatacccttataacgaatccgtttgtatttaccacaagcacattcccaatccttagtaggaccaaaaatccgttcgtcaaacagaccgtctttttcaggtttcaatgtccggtagttaatggtttctggctttttgacttcgccatatgaccagctgcgaatcttgtctggggatgccagaccgatttgcatgctttcaaacttgttgacatcgatcaaaggaccgacctccctttttattgattatcttgctgagcgttggttgtttcagaaggcttagcggcgtcagcttttgcggccttgtccgcagccttctcatcttgttgttgtttaaacttgctgagtgcatcgacattgacaacttcatcgtcatcatcatccatgtcccgcaattcgatttctttgtcttcagaatccaagactttcatgtcaagaccgagtgcttgcaattccttaaccaacacgcggaatgattccggcacgccaggctttggaattggttcgcccttaacgattgcttcataggtcttaacccgaccaacaacgtcatcggacttgtaagtcaagatttcctgcaaggtataagctgcaccataagcttccaaggcccaaacttccatttcaccgaaacgttggcccccaaattgcgctttcccaccaagtggttgttgcgtaaccaaagagtaaggtccgattgaacgagcatggatcttatcgtcaaccatgtgactaagcttcatgtagtgcatgaccccaacagcgacccgcttatcgaacggttcaccagtccgaccatcatagacgatcgacttggcatctgaatcaaccccagcttcacgaatggcttcccaaatatctgtatcttgagcaccatcaaagacaggcgttgccatgtgaattcctaacttccgagcagccatccccaaatgcaattcgagcacttgcccgatattcatacgagaaggcacacccattgggcttaacatgatatcgattggtgtcccatcaggcatgtacggcatgtcttcttcaggaaccacgattgaaaccgtccctttgttaccatgccgaccggccatcttgtcaccaacttggatcttccgcttttgtgcgatgtagacccgaaccatcatgttaacgccaggagataattcatcaccgttttcacgagtgaagatcttaacgtcctggatgataccgccgccaccatgaggaacccggagtgacgtatcccgaacttcacgcgccttttcaccaaagatcgcatggagaagccgttcttcagctgacaattccgtaacccctttaggcgttaccttaccaaccaagatgtcaccgtctttaacttcggccccaatccggataatcccgtcttcgtcaaggttcttcaatgcatcttccccgacgttaggaatttcacgagtcatttcttcaggtccaagcttggtgtcacgtgcttctgattcatattcttcaatatgaattgacgtgtagacgtcttcacggactaaacgttcattaataatgatggcatcttcgaagttataaccattccaagtcatgaaagcaactaatgggttttgcccaagggctaattccccaccttccattgctggaccatcggctaagacttcatcgttatcaacgtgatcgccaactttaacgattggccgttggttatagttcttaccaccgttagaacgacggaatttcattaacttgtaagtgtctaatgaaccatcatcgcgacgaacgcgaacttcgcgagcatcaacgtattcaaccgttccttcatgacgacaaatcaaggcaatccctgagtcatgtgcagctttatattcaatcccagtcccaattaatggcgcgtgaggatcaagtaacggcaccgcttgtcgttgcatgttggcacccatcaaagcacggttagagtcatcgttttccaagaaaggaatacatgccgttgcgacggcaaccacttgtttaggcgaaacgtccatgtaatcgacattttcgattggcgtttccaagttttcttccttgttacgagctaaaacagtgtcttcaacgaaagaaccatcatcattcaatggagagttggcttgtgcaatcacaaattggtcttcttcatcggctgctaagtagtcgatcttatcggtaaccttatgcgttgtccaatcgacacgccggtatggcgtttcgatgaagccgtaacggttgaccttcgcataagaagacaaactgttgatcaaaccaatgttagggccttcaggcgtttcgattgggcacatccgaccgtagtgggtatagtgcacgtcacgaacttcatatccggcccgatcacgagtcaaaccaccaggtcctaaggctgataaacgccgcttatgcgttaattcacctaaggggttggtttggtccatgaattgtgacaattgtgatgacccaaagaattccttaattgaagcaaccactgggcgaatgttaatcaattgttgtggcgttaccgtcgcagcatcttgaatcgacatccgttcacgcacaacccgttccatccgggataacccaatccggaattggttttgcaataattcacccacggaacgaatccgccggttacccaagtgatcaatatcatcggttgagccaagaccttcttgcaagttgaagaagtaattaatggaagcaatgatatcagcaggcacaatgtgcttgaacttcaaatcaatgttgccattaccaatcacgttcacaaccttttcagggtcgttttgtgaataaaccttaacaacttgtaagaccattggattcgtaacaacggcttcgtcagatggtgtgtaagtaaccgtcttaaagtcgtcacgttccaagtatggggatagtttagccatgacattcttgtcaatgaccgtatccttttgcgcaataacttcaccagtatcaggatcagctaatgtctcagctaacgtttggtccattaagcgcgtcttcatgcttaacttcttgttaaccttgtagcgaccaactggtgcgaagtcataccgttttggatcgaagaaccgagcagtcaataggctccgcgaactgtcagccgtcttaggttcaccaggacgtagccgttcgtagatatcttttaaggattcttcaacccgggagtcgtcggtgttcttatgaacgtccttttccaacgtcaacatcaaactgtcagtttcacccaacatgtcaataatgtcatcgtcagaaccatagcctaaggcccggactaattccgtcaatggaatcttccgcgtacgatcgatccgtacgtatgagacattcttggcgtcagtttcaagttctaaccaagcaccccggttaggaataaccgttgtgccgtagctaggacgcccatttttatctaattcctcattgaagtaaacgccgggtgaacgaaccaattgtgaaacaatgacccgttcggcaccgttgataataaacgtcccttgttcagtcattaatggaaaatcaccgaagaatacgtcttgcgacttaatttcaccagtttcatggttagttaaacgtagggtaacgtgcaatggtgccgagtagttggcatcatgttcacgagcttcttcgacggtgtactttggttctaataattgatagtcgacaaattcaagtgaaagttttcctgcgaaatcgtcgatcggcataatatcttcaaacatttcccggagaccttcatccaagaaccattggtaagaatcggtctggatttcgatcaagttaggcaaatcaagaacttccttgatacgtgcataacttctacgggtacggtgtttaccgtattttactaaatgtccggccaagttgttcaccccttcttattattccggaacccgccacctccggccaaatattacatttgtgttacaaatgcgtttttgaccgaattttaggcataaaaaaaccaaaaatagtcgcttaagttgactatttttggatttatattaacgagccgcacagacaatagattgcgcgttcgctcgagttcacggttacagacaagttataatatacatcgaataacgttagttgtcaactagtagacttctctgccgccattagttttctggttcactcgcaaccccgtataagatcatctttaaaagagtttgaacgcgggtccgctcgtcagcatgaggatcaccgatttgatgaaaactgttaaacagtggactcaagctggtgatatagaaattcgtcgccatctgtggtgtgacccccacatgtagttgcatgtcaggttgctcaaaaacggtttgaatcggcttcacataatcagtaacaaatatgccgcccaactcgcgaatatgttcatgcgttaatgctttgaaactggaatgaattaacgtgaagacatcagccggatgcttatgcgttagtaatagcgagacttctgttaattgatccaacggagaccaatccgcacggacttgaatcgcttcaatgccagccttgatttccgcaccgaccgtcgtaatgacagccagaaagatgacctctttatctttaaaatggtgataaagcgcgggctgcgtaatgccaatcgcattcgcaatgtcgcgcgtacttgtcgcatcatacccatttcttaaaaacagttcccgggctgtgtctaaaatcgcctggtgcgtcttcgccatctgttcggctcgtgtcgccatgttatcatcttctttcttgactttatttcctattataatttacaccaatcagcaccgaaccaccagcctcagatcctacagttcacttcagtgggtagcatcttaataccgattgaacctaaaagatgacgcctgaagtggactaccacttcaagcgtcatctttaatttaatcgcgcctactttgaggaaacggtcgaacgaccatctgccttaggctggtttttaatattaattgtaatggtacccttgctagcaccaatcgtaacttggtcatcgaccttgatcgcgccggtcaataattcttcactcaaccgatcttcgatttcagtctgtaatgcccgtcgaattggtcgtgctccgtactcagggtcaaagccagccttcgcaaccacgtcaatggcagccggagtgattttgatcttgataccttgttgggccactcgatcaacaatttcttgtgacatcaacttaacgatttcgtgtaattcttccttattcaatgaatggaagacgattgtttcgtcgatccggtttaagaattctgggcggaacgtctgttttaacgttgctcgaatcgtcgcagcaaccgcattgtagtcattggccttatcagttgcaccaaaaccaactgatttttcatcacgaagtgtggttgccccaaggttcgacgtcataatcagaatcgtatttctgaagtctaccttccgacccttagaatccgtcaagtagccgtcatccaaaacttgtaacaaaatgttaaagacgtccggatgagctttttcaacttcatcaaatagcacgaccgagtatggtttctggcgaaccttctctgtcagctgaccgccctcgtcataaccaacgtaaccaggtgccgagccaatcaaacgactagtcgaatagcgttccatgtattcagacatgtcgatccgaatcatattatcttcagacccgaacatcgctgctgccaaggcttttgctagctccgtcttaccaaccccagttggtcctaagaacataaaggaaccaattggccgactcggatctttcaacccgctgcgcgcacggcgaatagcacgagccactgcggatacggcttctggctgtccaacaacccgttcatgcaaaatcttttccaagttaactaagcgttcactttcagatttttgcaattgcgttaacggaaccccggtccattcggcaacgacctgagcaatatcctcacctgtgacttgtaaatcatagtgtggtgttgccccctcagtcacttcggcgtcttggtcagcttcgattcgatctaggcgttgcttcagttgcatctcctgcttacgaatatcagcggcctgttcaaaatcttgtgcttcgatcgctgtttccttatcctcacgcagttgcgctaacttgtcctggttcttggatagctttgttggttgatccatctgatcgatgcggactttagctgccgcctcatccatcaagtcaatggccttatcaggcaagaaacgatcactgatataccggctggatagcttgactgcttgatcaacagcttcatccgtaatcgtaacccgatgatgttcttcatagcgtggccgtagtccatctaagatttcaacggcttcgtcttcggtcggttcattgaccatgaccgttgcaaaacgccgttccaacgcagcgtcagattcaatgtacttttgatactcatttaaagtggttgccccaatcgtttggagttcccctcgtgcaagtgcgggtttcagaatattagaggcatcaatagccccttcagcaccaccggcaccaatcaaggtatgcaattcatcgataaataagatcacatggccatcgttgtaaatttcatcaatcacttttttcaggcggtcttcgaattcaccacgatactttgtcccagcgactaacgatcccatatcgagcatcatcaaacgcttatctgccatatcagttggcacatcaccggccacaatcttttgggctagaccttcggcgattgcagtcttcccaaccccaggttcaccaatcaagaccggattattcttcgtccgccgtgacaggatctgaatgacccgtttgacttccttggaacgacctactaccgggtccatttcttgttcactagctaattgggtcaaatcgcgcgccagagaatccaaggttggcgttccttcagtcttcttgccaccgcgattagccgcgttacccttgcgcttactcatggcgtcactgacacctagcttgcgaagaacgactttacgcgtctgacctagatctaagtttaaattcattaaaattcgcgaggaaaggatactttcatcagagagcatcgctaacaacaaatgttccgttccaatcttgttggcaccgagccgttttgcttcatcaccggcaacggacaaaatttctttggcctttggtgaatatggcaagtaagtatccttgccaacattgctcaacgtcccatagccagtgaaccgttcgatttcttcacgaatgtcatcttcactaacggcatattgttgtagcaccttattagcaattccattcttttcgatggccaatgctaatagcaaatgctccgtaccaactgcctgatgcttgaaatatttggcctgttcctgtgccagtaccagcacacttttggcactaggtgtaaataagttatccattgcgattcctcgctttctttagctttcgtaacgcaagtggttcaagattccgataattatccgggcccgcagactgttttctaagtcccggtccgttaatcctaacgtctcgtggtcaatcgccactaaaatcaattgcgcttctcgacgatttaagacgtcgtcctcgtataaactttggacgaccgcataagcatctcgttgtgtgattgaatcgccgatcacctgtatgagggcgtccaacacatcagcatcatcgaccaaattaaccttctcaatgcgaatataaccaccaccgccacgtttactttcaactaagtaaccattttggatcgtaaaccgggtcttaatcacataattaatctgtgagggtaccacgttgaaaaggtcggcaatttctgaccgtcgaatttcaacatgctccgagtccgccaaaatactttttaaatacttttcaataatatccgagatattttgactttgcatgtgcttcacccttttcattatctttgactaatattgactattattatacgaggataatggaaaaaagcaaagaatttcacccaaaccgcggactagcatgtgcttaacggttgttacagcatagcacgccgaacgtttgctttcaattgattcaaccgtttagaacctcataatgattaaattattaggtctccatattcattgaactacctatttaaaatatgtcaagttgagtcactcctcattgcaggcgacgggcactggtatcacaacgatgaacagcagttctgagactaatttctccgagctcatgactaacagtggctgttgccttgtcaggatcatgagtcacaaccaccgtattcttcacatggctgacttagtgagtaacgtcgcaaaagtgtccctgaccgttgaaacatccctgcttacaaaaaaggccataaaaaaatccagccaaatgactggattagttggtttaaccgtaatcgggaaaacaggatttgaacctgcgacccctacgtcccgaacgtagtgctctaccaagctgagctacttcccgagaaaattaaataaaaagccttagcacttaactaagactgtgttaaacgatcgggaaaacaggattcgaacctgcgaccccctggtcccaaaccaggtgctctaccaagctgagctatttcccgatactaatgcacccagtaggagtcgaacctacaaccttctgattcgtagtcagacactctatccaattgcgctatgggtgcttatttaaaatgccgaggaccgggatcgaaccggtacggttatcactaaccgcaggattttaagtcctgtgcgtctgccaattccgccaccccggcaaattaaaagcggaagacgggattcgaacccgcgacccccaccatggcaaggtgatgttctaccactgaactacttccgcataataaagctattaaattgtaaatgccgactagaggattcgaacctccgacctcctcattactagtgagatgctctgccaactgagctaagtcggcatgtgcgggtgaagggactcgaacccccacgtcgtaagacactagaacctaaatctagcgcgtctgccagttccgccacacccgcatgatgttaatcatgccttgttgccggttcaaacagttcttactggtatgccttgacaactatttaactttatcatcatgttgaatacttgtcaacaacttttttcaaataaatggataaatatactttttactggataaacaagttatatttttccgacaagaaatattatagcacggtagccgaaaatagcaaaccctattttcaaaaaaaggtgaataaatttcagtaaccccagctttttcgcccttttgcgcctgaaatgttgtcccaacattctgcccgtcccgcaattatttagtcaactcggccgttatttccactcacattttaaaatcgacagttccctttaatactcattaattatgcaaaaaaagcgaactcgcatcactgcgagttcgctaacttcatctcaattaaccttgtttttcaatcttcgtcttaccgtgcatatatggaactaatacatctggaatcgtaaccgtcccatcttcattttgatagttttccaaaatagctgcaacggtccgaccgacagctaagccactcccgttcaaagtatgaacgaattgcaatttgccatcgtcatcgcgatattgaatgtgcgcccgccgagcttggaaatcagtacaatttgaacaactcgagatttcccggtacttgtcttgttctgggaaccaaacttccaaatcatgtgtcatggcagctgtgaagctcatgtcaccagtcgttaacgtaataacgtgatatggtaacccaagtttctttagcaatgattcggcattgttggtcaacttctctaattcatcccatgaatcttctggtttcgtgaacttaaccatttcaactttattgaattggtgtaagcgaatcaagcctttcgtatcacgaccagcactaccagcttcttcacggaaggctggtgataaggccgtaaagtaaactggtaatttttcagctggaataacttcatcacgataatagttgactaatggcacctcggccgttggaatcaacgtcaaatcttgcgtcgtaatccggaaagcgtcttccttaaacttaggaaattggccggtaccgtacatagattcatcagtgaccatgtatggcggcaaaacttccgtatacccttcagcttcgtgctggtctaagaaaaagttgtaaacggcgcgttccagtttagcaccatcgcccacgtagtataagaaacgactaccagaaaccttagcaccgcgttcaaagtctaagatgcctaaatcttcaccgatatcccaatgtgctttcggcgtaaagtcaaaatgccgtggtgtcccgattcgacgtaattcaacggcatcttcttctttcaagctaactggtacgtcgggatggggcatgtttggtaaatgtgcagccatatcctgaacttgggcatcgactgtccgccgttcttcatccaacgtcttcacatcggcgctaaccttttgcatttctgcaatttcggcactagcgtcttccttgttccgcttcttctgtgaaatttcgcctgaaacttggttacgcgtcgacttcaattgttcgctcttggcgatcaattcacgacgcttttcatcagcggccaataaatcatcgatgtcactcgcagcaacgccccgatgaccaagctgttcttttacaaaatctggattttgacgaatcattttaacatctaacataacgacgtctccttttcacttttaatcgtaaataaaaacagtctctcctcccaattgggacgaagagactgcgattcgcggtaccacccaagttcaggatcatgattaatcccacccttaaacggataacggccgtgccgtgcagtattacctgcccacattgtcgcgccggagtttcgactaccgattcacaccacccaccggttctctgaacgtctacttaaaaacgcgccgtgtttaatattcactgtctactataaaacattgattctaaaaaggcaactagcctaaactagccactttttcgtcgatcaaccgaatgacttccttacgcgcatccgcatcggcgacaaagtccagctgatccccgtcgatctgcatcttcgggctatgatcataattagcgtaccagtcgtcatagcgttcattcaaagtctgataatatttatataaatcaggatcttgatcaatttgttcgtaagaacggccccgcttttggattcgtttgagcatcgtatcaaaagaaatattgatatgaataagtaaatcaggactcttttgatgagacgcttctggcaattcctgcatcatgttatctaataatgaatcataaatgtcaacttcggtattcgtcgcccggccaagatcaccattcaaatgaaataataatgaatcttcaaaaatcgaccggtctaagacgtccagatcgttagcaaaagctgatttaatactgtctaaccgtttatttaaaaaatagatttgtaataagaaggcgtacttcttaggatccttataaaataacggcaaaatgggattatcatcaactgactcgtaaaacgctttagaaccaaagtggttagccactaactgcgttaaactcgtcttgccggcaccgattgttcctgacattacaagcatggggcgtctctccttttaatcacgtcaaaattttgattatctctaaatgcaacactacatattgtacgcacccacgtcttaaaatgcaatatctggtgagtcaattcagtaaaaaacttcgcaccagccacaactgcgacgcactagtcagcgatccaagcaactcactaacacacactgggttacccaagccggcgctggtggcacttcagctttgagtgcggcctctgaccagcataatcaagtgacaacgtgtcatgaccaaataatactcagttgagacgaacccacattgctaaaccgaagacaatttaaaagcgcacgctagctaattcctaacgtacgccataaatggtattaattggggccatcaataatacggctagcttattacttggccgccttttctcgagcttgcagcaagctgacgtactgttcgagagtcaaattgtgcttagtcatgaattccgcactcgccttaccaacgtaacggaaatgccaagattcatagtcaatcccggtcgactgcttaccatctttagtaaagcgcaacacaaatccatagtccgccgcgtgattaatcaaccactgctgacccttgttcttgtcggatgatgacaataattgattaccatgagtgctgtaccagtgcgtgttcatgatatctgctgcgagaccagtttcatgctcactaccactaggaactgcgacatattctttagtcagctttaaggcttccttggctgattttccttgattctcataggtttgaatcgactgattccaaacctctttttgataagcaactgaacgatacccagacacgattgttgctggatagccggctttttttgcccccgctagaaaggcttccaatggtttgacgatagaactacggacttcaataccatccacgcttgacttattaaatgtcatctcagcgcgcttatgccacttattgacgaccactaagtcgctatcggtcgatttaacgcctttcggtaaggcactaatcagtcgttgccgcttggtctgcgtcttcgtcgacttagcactcgtagaactactagtcgctttagacgtcgactggctagcaccacagccagccaggacacctgctaatgacactaatgctagacctcttaacaaatttctctttaacatctctctcgctgcctttctcatttcagcttagcatagtcatagccgactagcctattcttaaggataagtttgcgaatttttaatgattccatattctcattctatcaaattaccatagatatcagattagcgcaccctcaatttgccgcttgctatcattacaatcgtgcaagcccccattcataacgatccgccgtgaccatctgttgcgagcagtgttatcagcataaatcaggacacctaaaaatacgaccgcgccttgagttgacaggtccaactctcgccgtcaaaaaatgcgattgacccagtgtcaaccgcatttactcaaactatcaaagtgcgtgcttaatcttgatgatgtcgtttgcgtgtcaaatcaaccttgtctagcggaatcatcttagtatgatagcgaatcttataatagacatacaagatgatgaataacgggatgctcatataggtcaccccaatagcctgccaatcaagcgttgcaaatgaatgtaagtcttgaccaataatgaccacgacacacaagataaaggcgaaccacgggccaaatgggaaccacttggcatggtaccgcaattcactcaattgatgaccctgcttaacaaacgcgcgacggaaacgcagatgcgaaatagcgattcctagccaagcgataaagcccgttaacccactggccgaaacgaggaaaatataaattcgttcaccgaatagactcgacaagaacgtgagtaatccgatcaccgtcgttcctaataatgccatgattggaatcccacgacgattgaccagaccaaatgtcttgggggcataaccctgtaatgacaaagaatataacatccgtgtcgaggcgtacatccccgaattagcagctgacaatacggacgtcaagatcactgcgttcatcacactggccgcagccgccaacccagcccgtttaaagactaacgtaaacggactgatggcaatatcgctcgctgatgaccctagaagatctttcgacgtataaggaataatcgccgcaatcacgaaaatggctaaaatgtaaaataacaaaatacgccagaaaacttgtttaatagccgccggaatacttttctccggtgttgctgactccccggccgtgatcccaattaattcggttccttgaaacgaaaaaccagcgaccacgaagacactcaaaatcgttggaattccaccgacaaatggtgcctttttataggtaaagttactgaggccagtggcatgaccgcccatgattcccacgatcgtcaagacaccgataaccaagaatacgagcacggttaccactttaattagcgaaagccagtactcagtttctccaaacgaccggactgacagcgcattgatcgtaaaaatcaagacgagcgcaatcagactaaaaacccaccccggcacggatggcaaccagaactgcatgacaatcgccgccgtactaatatcgaccgctaacgtgattgcccagttgaaccagtaattccagcccatcgcaaacccaagtgccgggtcaacaaacttcgtggcatacgtggaaaacgaacctgaaacgggcaaataagttgccatttcgcccagactagtcattaaaaagtaaaccatcactccaataccaacgtaggccagtaatgctccccctggcccagccgttgaaattgccgaaccggacgcaacaaacagcccggtcccgatactaccacctaatgcaatcatggataaatgccgcgtctgtaaggaacgatgcacttcctgatgttgtttttctgccattgcagaacctccaaaaatcgatttatatctaaaagtgttcacaccgattcaggttagcacaatcaaaataaaaagcctctttgcctcacgataacgtgcgcaaaaagactttaatcagattgattgacataattgctgatttcatcgtcgatagcgccccgcaactattctagctgcgacagtccatgatttattcaaccaaggcccaacggatgaatcggtcactgatccatcgatttcggcggttgccccgttcactgaccttcataagtggtgacccacttccagccggctactattgttaaccgcatcctcttctttcgatatactcaactattatatctgaccgaccatcttttgacaaccggtcactaatgttaattttaataaaactggtctggtaacattgtcttgcctaacgctttgttatcagaataatcaattggaatatccaccacaactggaccatccgtggcaaaggcctgatcaagcactttttccaaatcagcaggttggtttacccgcaagccagtcgcaccaaagctttcagcatacttcacaaaatcaactgggccaaagtggaccgctgcatcctcgccatacttcatttcttcttggaatttaaccatatcgtaggtgccatcattccagatcaaatgaacgatattttgcttcagtcgaacagccgtttccagctcttgggcggaaaataggaaaccaccatcaccagagacagacacgatttgcgtatctggacgaaccaaagccgctgcgattgcccaaggtaaggccacccctagcgtttgcatcccattactgaacaacaagtgccgtggttcatagctccgaaagtgacgcgccatccagatataatgactgccgacatcgaccgtcactgtcatgtcatcactgacccgttgttgtaaggctgcaattactgacagcggatgatttaacttggactgcttatcaatattaggtacgaaatcacgcgtctgaagccgttcttgtaattcacccaagtaagctcgcgcactatcgctaatatcatagcccttcatgtacggcaacaaaaagtctaacgtctgggcaatatcaccgatcaattcggtttccggttggaaattatgatcaatttcagcgcgcattgcatcgataaccacgatacgggatttgccttccgcattccagttgcggggttcatattcaatcgggtcataaccgaccgcaatcactaagtcggacttctttagtaacatatcccctggttggttacggaataacccgacccgaccgaagaaatggttggcttccaaatcacgtgaaatcacgccggccgcttggaaagtctcgacaactggtagattagcagcagccaccaagttccgaattgctttcgtcacttctggtgaagaagcccgcatcccaactagcaagaccggcaacttagctgctttgattttttgtgctaataacgtggcttcgaccgggctagcaggacctaacttaggtgcctggattggtgtaataacaggtgtgcgtacaatcgaatcagtgacatcttgcggcacactgacaaagctggcaccctgcttagcagctgtggcttcctggtaagcgtttgcgagcacttccgaaatgttttccggttcttgaacttccgcactgtactttgtaatcggcttaaacagtgccgcgttattcatactttggtgggtcaaccgtaacaagtcagcacgctgaacttgaccagaaattgccaagactgggtcaccttcagcagttgccgttacgagccccgtggctaaattgctggcaccgggaccagatgttgtcatcactacaccaggtttcccagtaatccgaccgattccggcagcgataaacgcggcattctgttcatgccgcgtcacgatcaaccgcggacttttcgggttgactgggtgctccaagcgctcaaagacccgatcgatcttagcgcctggaatcccgaatacgtacttaacgtcgtggtttacaaggctgtcgacgatcgcatcggccccgtaatatttcttatctggcatgttgttcccctctatcttgtgaaattcattgttagaataccataaaaaacgctttaataacagcattttcagccttgtgaaataaagtgtatcattttgaaaatgatccccgattggcaaaagcgcgtcaatattggtttaccaagcgaaaccgctcccaatttttatcgagtttgtacgccgtctcacttatgcgcccgcatccgactaagcaatgcatttaattgggccattttatcatctgaataattcgtccaatccaacactggaatttgagtaacagctaataattccttgatcaacgtcgccagtttttgctggtttaaaaaatctaaccataattgatccgctcgcgaaaaaatcccgttgaccactttcgtcccttcgtgagcgaccggttcaacgtccttaaatactcggtcaaaataaccataattcggaaaggtctgcaacgtcccctcgatggccgcgaccacatctgtaattgaaatatcctcaggtgaacgtgccaagtggacacccccgttatttccactggtagacgtgaccagtcctgccactactaatttacgaataatcttacgaatatacgaagcggaaccaccaattcgctcgtgcaagacatccgcagtcaacggaatctcaggttgctgcgtagccaacaataccaacacgcaggcggcctgttcaaacgattttgcgagttgcattaactcatctcctaaaggtttaattccacacaatcaaagaataactccgtctggccagcgccaaacggggcgtaatctggatggcgaacagcatcatactgtcgaaaattagcatgttctaagattcgcttagacgccggattattggctaaacaactggctgtgatccgccgcaaatgaagcgtttcaaacccgtatcgtaaaatacgtgcgactgctgccgtcataatgccccgcccccaatatcgagcgttcaacatatacccgagatccatctctaaagttgctggttcgcccgtattcgtcatgcgctcatacaaacccacactgccaattacgcggtggatcgctgttagttcaatcgcaaaaatctgtggtaacttcgcttgttgtttcaataagaattcggcttccactaagctgtgcgctggcgtaaagcccgccgatgccgcaattgacggatcacgaactaagtcataataatcctctgtatctgccaacgtaaatggccgtaactcgagttgctcattccgagttgtaaccgtaaccatgcccatatctgttccacctgacttgcgttataatagttatgttaaccatatcaaattgaggtgattgcatgcaagttattaagcaaaaattaacagcgacgtgcgcgcaattgaccggttatttgcatcaaccggatacgaacgcacaccaaacgaacttacccgccattattatcgtcccgggcggctcatacacgcatattccagtggcgcaagcagagagtctcgccatggctttcgctgggcacggttaccaggccttttacttggaatatacgctactcactgatcaacaaccactcggattagcacccgtattagatttaggacgagcagtcaacttgcttcgtcaacacgcggccgaatggcatattgatccgcaacagatcacgcctgctggttttagcgtgggtggtcacattgtggcactgtataacgattactgggcgacccgcgtggcaactgaattaaacgtaacgcccgccatgttaaagccgaataacgtggtactcggctatccagtcatcagtccattgctaggttttcccaaggatgacgcgaccttggctacctggacaccaacgccgaatgaactggccgctgaccaacacgtcaattcagataatcagccgacttttatctggacaacggctgacgacccaattgttccagcaaccaatacgcttgcctacgcgactgcgttagcaactgctaagattccttatgaactacacgtctttaaacatggcccacacggactagcccttgcgaatgcacaaacagcatggaaaccagacgccaatcagccgcacgtcgcccactggttaacattagcacttgaatggctagctgataatcgttagttcattaccagtcgttgctagttaatattttatagatgtaaacaaaaaatcgtttgcttcgatcaatttctcgcaatcagccgagtagtgtcgattaaagcaaacgattttttattttgagtctattatttagtgacacggttgcctgctaaataatagattagtttaagtttgttaattgtctttataaatatgaacgataaaacaacggccatttcaataatcctggtgcccagaaaacgtagaaccattgcatgatttgactccaagaccatgccaatagcacggccccaatcgtatcagttggataatgtgcattcaagtaaatacgtgagaaaatgaccaatactaaccatacgacactcacccacttgacgatcattgccattcgataacttggcaactcaggaacaatcaacatgataatcacgctgaccaacacgaaggttcctaaaacgtgaccactgggataactatatccggtatcctgcgctaaatgaccaattggtcgcgctcggccgatgatgtgcttgacaataaagcctaacgccattgaaccaaccatatatgctagcgtccagaacgcttgaatcttatatttaaatccgtacattagaaacgccaggatgacgatccacaaaatgtccattccgggtgacgccaaccaagcaatcaccttataaaatactgtccaaataccgctattactaatttggaccagcgacgttaaggccacatctagtaaatcaataccaaccgcgccgtcactaataaaatagcttaagtaggcaaataaaattaccccaatgacaaacttgatcggccgactacgcgacttatcgatcatcaaaacaagaacccccatttaatattaaaattaacaaaattataccatagtctattaatcgactgaacgaatcattaatatctctcagggaaccttaaaaaaaacaaagaattcccattttaatcacgttttattaacaaaaaggttatgatttatctgacagtcatcggtaatcaagctaaatcttacgtggattcagttcccgctgacccgaaaaaatgctaaactatgaataactattaccattggaggaagagttcatggaagacatgccaagtcgctcagaaatgcatcgtgagaaatcacaaggaaacaattcacaggggaacggcaacgggcccaagaagaagcaccccgttcgcaataccgttttaatcattattgccgtgttattagttgggaccggggcctttgccgcgcgaacttattttaacgccaagaatgcggccgacaccgtcttcaagagtagtggtattaaaaagagtcggaatacgagcgccgtattgaatggcaagaaacccgtctcgatcctattactcggaactgataccggggccctcgggcggaactataaaggccggaccgatacgatcatcttagcaacgatcaaccccaagactaagacaacgaccctgatgagtttaccacgtgattctgaagtagctgtctccggcttcgaacaggacttcccgactaagttaaacgctgcctacgcttatggtagtgccggaacgaccatcaagaccgttcaaaaatggttgaacgttccaatcgactattacgccctgatcaacatgggtggcatgaaaaaagttgtggatgaaatcggtggcgttgacattactccaattcggacatttacctacgaaggctacacctttactaagggccaaaaagaacatatgaatggtgccaaagccttggcttactcccggatgcgttatgatgatccactcggcgactatggtcggcaacagcggcaacggcaattaattaccgccattatcggagaaagcgccagtgcttccaacttgcttaaacaagatttcttaaattcacttgctaaacaaacacggactgacttaacattcggtaatttaactagtatcgtcactaattaccgtagtgcaaccaagaatatcgtctctgatcacgcccagggtactggtaagatgattgatggtcagtctttcgaagttgtttcgcaatctgaaaagcaacgggtcacgaacgtcttacgtaagtcccttaatttaaaggctgcgacaaccggcgaaaaatttgctaaccaaaactaaccatctgatttgatgataagagtcgtgactacttgttgcgatgtctcagctaactaattaaaaagggcgccaactgaactgcttagtagagcagttcagttggcgcctttttctgtattgaatgcgagtcgtaataactaatctaagcgcgtaactattcagaacgctggcacacggcaaattagtcgcactaacccaccacttttggcggaatttatttatggcgcttagtcttagcgtccgcaaactttgttcacgattcacaactaatcagccaacagttaggttacgactccaatcggtgcaaccgccactggcgaatacaaaatgcgataagccggttgagtaattcagctaataagaatcccaatgcaatcgcaccagtaatcataatcacttgcaacgtgaatgaaaccgcctcacgataattacccagcgcaaagttacgcaccatctgataagcctgactgccgggcacgaatgaaactaaactcggaatattgaagataatagcgggcatcttcttgtagcgagctgctaagctgctgaggacgccaataccgaccgagccaattaagcttcctaagacgaccccaccatcaaaagcctgaacaatcaaatagccaccccacgttagggtaccaatccagcccgcaacgtttaacgcttgatgtggaatattaataatcaggccaaaccccagtaccgcaatgtaagccagcactaattgtccaattgtgcccatcatgattcctccgaatacccaggctagtgcccgtacttaaaataatgtaatgacaacggcgatcccaaagcctagtgctgccgcactcagcatcgcttccacgccacgtgcaggcccactgacgaaattaccagccagagtatctcgtacggcgtttgttaatggcactccgggcactagtggcatcaacgacccgataataatatcattgacattggttccccacccaatctgacacacccattccgcgccaaacccaattagaagtgccgccgttaactcgctcaaaaatttaattttaagataccggttaagcagataaaagaccaagtaacctaatgttccaataataacagttggccacgtattaacaatttcctgacgaaacataatcatcaaggggccactgactaaggctgcaccgaccaactgcaaccacaacggaaatgagcgcgaagctgcatctaactgattaagccgttgatataaagttggtaaatcaatggtcgtagccgcaaattcacgggataactgattgacctgtgccactttttcaagatcgatcgttcgctggttaaccgcggcaatctgcgttgcattacgtccttgaatcgacatcatgacacccgtaatcgtcacgtaggtattggcagcaacaacccccgcattctgagcaatccgcatcatcgtatcatctactcgcgaaatctccgaaccattctcgaccatgattttaccagccttcaagcaagtcgcaataatcatctcatcggttgtcactgtcatcccaccctttaataatcagaattacattctctaatgattcttactttagccaatgtctggctgttagtaaagccttatttacgataattaagcatccgctgcaaaacgacaaaaaaaccggtgatgagaattaattctcatcaccggtttaagccatttaagctgttaattatgcttttgtaacgttaactgcttgtgggccacgatcgctttcttcaacgtcgaagtttacagcttggccttcatcaagactcttgaagccgtcttcttggatagctgagaaatgtacgaatacatcgctaccgttttcgcgagtgataaaaccaaaacccttatcagcgttgaaccatttaactgttccgtgttccataataaaaaatcctcctagtgcattttgcacgtataaaataatgtaaatcatgattcggtacaaatggggatagtttattgaaacgatctgaccaaaattacctaaccaagctacaagaacaattgtagcatattgtttctaaaaagggtagccaaacaccatgatttccatgaaatgtttatgtgatgataaatgaaacagaataactaactaacaattaacaggtttgttcggaaataggtgccgcatgcttactttacaaagacattgtgcgccgctttatagctaactgggatttcctcgcccgttttctgaatggaaacggtaacaggaccttcaaatggatcgtgctttaaaaccgtgacctgctgtccaatcttgagcggtgtatcatgcaaataaactaataaatcatgattatcaataaatcgctcaatcgtaaccgttgtgccatcctgcgtatctgctaaactcacatgactgtcttcctgataatgaccatccttatcgggaatcgcgccaccatgcgggcaatgcgtcggattgcctaaaaaggcttccaaagaatccactagtcgttcactggtcacatgctccagcacttccgcttccgtatgcacgtctggcaaatcataatccaatttatcaactaagaaatcttcccagattcggtgcttgcgaactaacgtttcagcgtagcgaatgcctttctttgttaacgaaatcccagcatacggggtatgcttagccaagccttcctgaactaatttaccgaccatctccgttacagagccggccgcgatgtctaaacttaaggcaatttgcttattcgacaccttttttttcgtaccaccaagctcgaaaataatttttaagtaatcttccttcatgggggtcatgaatattcttcacctcaactaaatagttacttctgattctctctaatataattctaacatcttactacaattgagacaccagttctagtctctaataacgacaaagctttgaaataattgcctaatcgtgacataattaattgtagcgcaaaataaccaatttggttactaatttagaaacgtgcttgttcaactaaggaggaaccgcatcgtgaatgatgatgctcaattatcaattacgcaattggatagttctttgcagcacaaggcagttgaagactttgccgcattctacttaccactttttgacgctaacaaccttgaaatgatgtccaactatgatgttgccagctatatgacagacatcaatgaacaccttacttacggccgctacatgaccaaggctcagcgcttgagtgacaccgttagtttttcatttaccgcctacgtcaacttgattgatcgactcgatcaacaatactttactagtggtaatccagcactaccatggaatgaatggttagccgccaagtttgctcaaactgcgacatcttaacaattcctacttaattaacgcgcgctactcgtgattatttcatatagaagtagaattaatactaaatgaaagacaagcaccacgcgtacttatagattatttaaagagattgagttgatactcggtctcttttttgttgataaccacactgatagattacgttttaacgtacgaaagtacaaaaaagccccaagctttcccgcagcacttgggacctctggtaaatatcatcaccgggcgattgaagactactactagtttcaattacacgttgttttatgcacgattactacctagttctagctaggcatctctcagcgcttattcgcgctccgttgtaaatccttttgcaaagttaaacttcaaaacacgaccaacatgacaacggtcaacccagccataagatcggttgacgaacgggaaacttaaatgcccaagtgacttaccgacatttaccaacttaaatttaacattaattaatcggttacacaagctgaaggttgctagcgctctgacttaacgggataaagtcgataatgtggcgtctcatcttgaatataacaataaagctgttgtgtcttcgcttcgtcaaaatatcccaacttgaccatgtggtgaccatcccgttcttcgattccttgaaaagccgtcatcataaagatgcgcatcatttccatttggttattatacccatcggcccgctcgacagccgctgccagtgtaaaaccctcgtctaacatcatcttgataaaatgaacacgcatcagcataccatacgaataacgatgcgtggtattcttctcactcactttaagactatgaatataatttttctgttcccagtaacgtagctgtgtctgagagacgccggtcatcttcgccaaatcgctaattccgattgtgaattgatgcttacccagctgttctttaaatttcttaaaaaatacaccgtcttcttgcttatccacgggtcaacctcttttctaacattttcaatactcagtatattatttttaatattaatgtcaagtttgttgacaaagtcgataaatccgattatattagacaacgtacttttttagagagaagggatttacttgtcaactcctgttgatacgcatgggaagccttataaccgtggcttgctcattgcagttttattagttggtactttttgtaccgttcttaatcaaacgattttaaccactgccttcccaacgttgatgaaagatttcgacatcacaacgtcgaccgtgcaatggttaacaaccgggtttatgttagtcaacgggattatgattcccgttagtgcgtggttaagttcacggatttccactaaatggttatatctttccgcaatggccattttcgaagtgggtactattatctgttggacagcaccaaactttggcttcttattggctgggcgtttgatccaagccgttggggtcggggtcaccatgccattacttcaaacgattatgctatctatcttccctgctgataagcgtggggctgccatggggactgccggaattgttatcggtttggccccagccatcggtccaaccttatctgggtgggttatcgacaacttatcatggcgtgatttattggtagcgtcaagaatcttg

SEQ ID NO: 11 - DNA, 75637 bp, Lactobacillus plantarum
cttcaattttaaatccggcaacttatcagcatcgctcatttatcaaacaaactggcaatatttctatcgaacgtgattgggaaaagcttttcgacgaagcgtggttgattaagcatcttcgtggctatcgctaagctcaagacttagaggggagtggtttgatgatgacatcaacaccacggttattacaagccattcaacaaacgaccaccgcaattttaaaaacaaaccttgttggtatttacctgcatggatcctatgttttaggctcatataacgaacaggtgagcgatttagactatctgatcgttgttcggcgttcgttaacattagctgaaaaacggcagttaatgacagctaccataacgcaattgtggccattagcgccacacaagggattagagtttcatgtgctgttactgagtgcaacccagcattttgtgcatccttgcccattcgattttcatttttcaaaataccattatgaggattatcaacggacaccgctagcctacctaaaagcgatgcacggcacggatcctgatcttgctgcccacttaacgattctccaagcagcgggacaagtcttacttgggccagctattacaacggtctttggccccgttcctgcgacggcctattgggacagtatcaagtctgatatcgcgaatgctgaaacggcgatcgttcagttaccaatgtatacggtattaaacctttgtcgagttcgcgcttaccagcaagatcagttaattatttctaagcaggccgggggtgaatgtgggttacaacagctgccaacacagtggcatccgttgatcaggcaggcgttagcagcctatgctggtcaacaggacgaacaggttatacgatggtcacgtccaaacttagtggcgtttgcacgaatcatgttagctgagttgggcttaaaatcagaatagtttgtgagtttaacaaaaaatgcttactggcgatcatccaccaataagcatttttgtcaccaccaacttaaagtcggctgttataaatcaagaaactaatgtagcagttatcgccatcaggtaaatcatagccagtgttttcgttgctaccgtcattttcgtgtaaaacaacgaattcaccagaaccataatcttggtcgtttaaatacttcactaaacgttcatcacattcagctaaagtcttaccggtcacaacgcgccggttccaaccacgatggatctcagtatttggattaagcatctcttctcaactcctcttaattataaagtcatcaattgcgcttgccgagcgggttgctgatcaagatcagcgcgcgttaggtcagcgtcgacttggtgggtactgttaaaaataatgaaacgttcaccaacggcttggacttgctggtagttatggcttgccatgatgatagttttgccggcagcttgtagccgttgcagtagggttagcatttgctgctgagcggcaattgttaagccgttcagcggttcatctaacaataaaatttcagggttcaaggcgagaacgctggctagtgctacgcgcttcttttcaccacctgaaagttggtaagggacccggtctgctaagttagcacagtccgttaattgtaagcagtcggcgacgcgttgcgcaaccatggctgctgataaaccgagttgtcggggaccgaaagcgacttcctcagtgaccgacgtgttgaatagttgaacatcagtattttgaaagaccatgccgatccgctgatgaagttgttgtcgattttgggcatcagcgagataagtggtcgtaatcggctgatcgtgaaactgataagtgccactagttggactagctaatccactcaatagtcgtaaaagggtcgatttaccagatccattgggccccattagacagacaaagtcgcctgagttgaccgttaagctgaggtccttcaagccacacgtatcaggataatcatagcaaatattcaccaatttaatcaataccacgttaatgcctccaaaaaataaataatatccagacaataatcgctgggctcagggcaagataatcgcgccaatgggtacgacgcccggttgagcgcgcgtaatgaccattgaacccgcgtgcttccatggcagcgtatagttctagcgcataagtgtaacttttaagatataaattaccaaataatgcgccgattaaacggtatggatgagccgttggggcgaccgtccgcaattctagtgcttccatcgtcagcaatagatgttggccgagcattcgtaagtacgtgatggcaatggccaaagtcataattaatagatcagggcaatggagtgccttcaagccagccaataaatcttgaaacggcgtggttagacggtaatattgagcgtttgccagcattagactggttttaaggccaaagaataataacgtggtgggaccggctaaccagtagctcggtaatacgaacagcatggccatcccaacactgattagccagcttcccataaaacggcgcagttggcgtggaggtaaccataataattggcacccaactaatagtgctaggccccataacagaatgagattattacttaaagcaattaaaatgacgagcaacaggagctgaattaatttgaattgcggtgcaacgcgccaatgagacgttgccgtgactggcgctggctgtgctagtcgactgagtaattggcgtaggtgacgctgattacgttgccaaaatttcgctttaatagcaggtgttggcgtggtggtcgtagtttgcagccaagctggaatatcagtgttgggacgtgtcggtttcatgttgaagacctcgaatcaaaagtaagaaaatcaaaacagcggtaatggccgataaaatataacccacactgaccggtaagcccgcgatggcgtaatcactgaacagggcctgaaaatggaacccgtggaccattccttgaggcgcgtgagtactgatatgttgttgcgctagccgttgctgtaattcttgggggctccattcgccccaagccgtattgctagccaacaagcctaatggtgataacaccgctaatccgagtagcagtgcgatccacggccgctgattgcgccgagtgggtgtctgatagaggttagtcggtgcgactcgttttacaaattgaaagacaagcagtgtgaagacgacttcgacccagccggcgactaataagtgagccgtcaacattgcgggtatcgtaatgttgaggccgtatgggcagtagagcggcgcaccacttgccgtatgagccagtatgggttgtaacccgagctcgataccagcaactagcgccgccatattaatgcctaagtaagcaccaattgcgagccccaacttttcatggtgccatttttgacctaggcgatagcaggcgtagccgacaaacggcataatgaccgccatattcaacgcgttagcgccaaaggctaggataccgccatcaccgaataataaggcttgtagtagtaacgtcacggtcagcgcaagacacgccgcccatgggccaatcaagacagctaacagggttcccccgacagcgtgagccgtggtcccacctggaatcggcaagttgaacatcataattaaaaaagccaatgaagcggcgatgccgagcattggcagggtttcatgatgttttttgatttgaactttaacttttaaaacggcgacggtccagacgggagccatcgcggtgaccaacgttccgcaagttgcgggacttaaataattatccggaatatgcacggatgagcacctcactaatttgcaatttgatctaagaggtaactaacatcttgaataataaatttgtgatttttgaccgtaatgacgccgtctgttcgtaattccttgagcatccggttgacactgctccgggagctaataccacagaaaccggcaatgtcgtcattggtgaccacaaagtcaatcagaatcccttcgtcaacttttcgtccgaacaaatcaacaagactatagataaaggcacaaatggctccttttttaccgttcatgaccatccgttgcagtcgaagaatgttttcggacaactttttacggtaataatttttaacgtagttttgcagttcaggcgtgctgttgacgtacttccaaaaagcgacccggttgacctggtaaaaagtggcatattcggactcaatacggacgttaaacggttgatccgtagaacgagaaacttcatcacgcagcagggagatcacgtcgggcttggcaatataagataaattatattcgcgaccgtcttgtaaaataatgctgtttttgatgatgccgtcctttaagacgtacgtatagtgttcggctaaaccatgataggtcaggtaagtatgccgcttttttttgattgtcggcacgtgatgggcttccaaataacttagtaaatattcaatatcagttaataccatcttagtttttcagttctttcgtgaatgatttttaaggttgaggtcagtaaaaatagcgattctcaacggtaatcacgacgataacgctacttaagcatagcggttttcatgattgtgacaatcgcatttaaagtatacatttgttaactatttttgaaaacttaaaatgtaacggacaagttatccgtcttctagtataacaaaaaggtgcatgtaaaaaattagtttttagagaaagaggatggctaaaagtcatggttgcaattgatttaccatatgacaagcgcacaattacggctcagattgatgatgaaaattacgccggtaagttagtgtcgcaagctgcaacatatcataacaaattatcagaacaggaaacggtcgagaagtcgctggataatccaatcggctccgataagctggaggaacttgctcgtgggaagcacaatattgtgattattagttccgatcacacgcgcccagttccttcacatattatcaccccgatcctattgcggcggttacggtcagtggcgcccgatgcacggattcggatcctcgtagctactggtttccatcggccatcaacccacgaagaattggtgaataagtatggtgaagacatcgtcaataacgaagaaatcgtgatgcatgtctcaaccgatgacagtagtatggtcaagattggccaattaccatctggcggcgattgcattattaataaggtcgctgctgaagcagatttgctaatctccgaaggctttatcgaatcacatttctttgctggtttttcaggtggtcggaagtccgttttacctgggattgcttcatacaagacgattatggcgaaccattccggcgaatttattaactcaccgaaggcccggaccggtaatttaatgcataatccgattcataaggatatggtgtacgctgctcggaccgctaaacttgcctttattatcaatgttgttttagacgaagataaaaaaatcattgggtcatttgccggtgacatggaagccgcccataaagtgggctgtgactttgtcaaagaactttctagtgtaccagccattgattgtgacattgcgatttcgacgaatggtggttatccgcttgatcaaaatatttatcaggccgttaaaggaatgaccgctgctgaagcaacaaacaaagaaggcggcacgattattatggttgccggtgctcgtgatggtcacggtggtgaagggttttatcacaacttagctgacgttgatgatcctaaggaattcctggaccaagcaatcaacacgccacggcttaaaactattcctgaccaatggacggcccaaatctttgctcgaatcttagttcatcatcacgtgatttttgtgtcagacctcgttgatcctgatttgattacgaatatgcatatggaactagccaagacgttagatgaagccatggaaaaggcctacgcacgcgagggtcaagccgctaaagtgacggttattcctgatggtttaggcgttattgtgaagtagtatggcaaccacagcagaaatattgcaacaagtggcggcagggcaattaagtccgacggtggctgcccaacagttagaagcaggcaaaacagcggcattaggttttgccaatgtcgatttagatcgtcaacgccgcaatggctttcctgaggtcatctacggtgctggtaagacggcaacccaaattgtgggtatcgtgcaagccttgtcccaacagacgttgccgattttaacgacccggttatccgcagaaaaattcgcggcactccaaccggcgttaccaacggctgtctatcatgccactgcgcagtgtatgacggtcggagaacaaccggcaccgaaaacaccagggtacattgccgtggtgacggcggggacctccgatcaaccggtcgctgaagaagcagcagtaaccgcggaaacttttggcaatcatgttgaacgggtctatgacgtgggtgttgcaggaatccaccgactgtttgccaagttggatgtgattcgtggtgcccgggtggtcattgtgatcgcgggcatggaaggtgcgctggccagtgtcgttggtggactagttgataagcccgtgattgcagtgccgaccagcgttggttatggtactagttttcaaggtatgaccgcgctattgaccatgctcaatagctgtgcgtcggggattaccgttgtcaacattgataacggctttggtgccgcctactcagctagtatgatcaatcaaatgtaagattcagttaactgaacaaggagaagataaatgcaaacactttatttagacgctttttcggggattagcggtgatatgtttctgggcgcgttactcgatttaggacttgattttgagcaattaaaaaccgaattggctaagttacacgtgcacggttatgaattaacgcagcaacgggaagcccagagtagcatctatggcacgagctttgatgttcaggttgcgggtggtaaggaccatggttttgtggaacatcaccatcatcagcatgaagctgggcatcatcatgatcatgaagcgcgtcatttagctgatattgaggcgttaattgacggcagtgacttatcagataccgtgaaacaccacgcgaaagcgatctttatggaaattgcgcaagcggaagcagcggttcatcacatgccactagctgaaattcatttccatgaagtgggcgcgttggattcgattgttgatattgtgggctgctgtattgggttggaattgatgcagattgataccatcatggcttcaccgttaagtgatggtagtggttttattaacgttgcccatggtcagatgccagttcccgtcccagccgtgatgcagatgcgagttggtagtgccattccgattcaacaacggttggatgtgcatactgaattgattacccccactgggatgggcttggtcaagacgctcgtacgtgaattcggaccgttaccggaaaatgccgtgccaactaaagttggttatgggtttggtaaacgggacacgggcggtttcaatgcactgcgagccgtattattcgaaaaaaaaaactaagtcagcaaatcgttaaccggacggctgatgctgtcttaatgattgaagctaatctagatgatcagacgggtgaaggactggggtacgtgatgaaacagttattaacggcgggcgcatacgatgtgttcttcacgcccattcagatgaagaaagatcggccggcgacaaagttaacggttttgggaaacgttaacgataaggacttactgactaagttgattttacaagaaacgacgacgattggtgtacgttaccagacgtggcaacgtactattatgcaacggcacttcctgacggtcgcaacgccgtacggtgacgttcaagttaaagtggcgacatatcaagatattgagaagaagatgccggaatatgcggattgtgcccagctggcgcagcaatttcatattccgtttagaacggtctaccaggcagccttagtggcggtagatcaattagatgaggaggcgtaattttttggtacatcagttgattgctgaatttatgggcacagccctaatgattatttttggggtgggtgttcattgtagttccgtattaaagggaaccaagtatcggggttccggtcatatttttgccattacaacttggggttttgggattagcgttgccttattcatttttggcaatgtttgcattaacccggcaatggttttggcgcagtgtctattaggaaacatcgcatggtccttatttattccgtattccgttgcggaagtgcttggtggggtcgtgggctcagtgatcgtttggatcatgtatgctgatcattttaaagcctcaacagatgagatttcacccattacaattcggaacttattctgtacggcaccggccgttcgtaacttgccgcggaatttctttgtggaattatttgatacatttatttttatttcgagtattttagcgatttctgagattaaaacgccgggaatcgtgccaattggcgttggcctacttgtatgggccattgggatgggacttggtggtccaaccggattcgcaatgaacttagcccgagatatggggccccggattgcccacgccatcttaccaattgccaataaagccgatagtgattggcaatacggtatcattgtgccaggaattgcgccctttgtcggggcagcaattgccgcttggtttatgcatggattttttggaattaattaaattaaatagaagaagggttttattatggcaacattagcaacaaaaaaagcaacgttagtagcagcattaaaggatttacaacgggtcaccgtggccttttctggtggaatcgacagtaccttagttttgaagatggccctcgatgttttaggccgtgacaatgtgaccgctgtggttgcgaactctgaattatttatggatgaagaattcgataaagcgatgagtttagccgaagaactaggtgctaacgttcaaggaactacgctagactacttgagcgatgaccacatcaagaacaacacgcctgatagctggtactatgcgaagaagatgttctacagccggttgaatgacattgcggctaataacggtagtgccgctgtcttagacggtatgatcaagaatgatgaaaatgattatcgtcctggtttgaaggcccgtagtgaagcgggggcccggagcttgttacaagaagctgatttcttcaagactgacgttcgggccttggcacaagaactcggtttgacgaactggaataaagtggcgtcatgctctgtatcttcacggttcccatacgggacgacgttgacacatgacaatattgctcaagtaatggccgccgaaaaatatttgcgtagtttaggttttccaacggtccgggttcgtttccacaatgatattgcgcggatcgaattaccagaagcacgaattggtgatttcttagtctttaacgaccgcgttaaccgtcaattacaatcacttggattccgctacgttacccttgatttaggtggcttccgtagtggtcggatgaatgatacgttgaccaaggcacaattggccactttcgcctaggcctaatcaaattaatgatagtggtgtcgggattaatcggagatgggcggctgaacggcggtgatcatggttcattcgcccacccgatgataatcgtaaccccagccgatacgcacatgttgcgattatcgcctgacaccccaaaaagcgcagttcaaggccgcccttgagctgcgtttttcgtatcttcatttttagatcaacaggcgtcaaaagtcacgacgagtttaccaacgacttgaccagcttggagttgttgtaaaccagttacaagttggtcacggtgcaagacctgagtaattagtgggtcgaccttaccagtttggaccaaagctaataaggcggcggtcatttgcccaagatcggcaacttgcgctgggttaccgctacggtgggcaccaccgaggtccaatttactgatagttacaacttgattacttggaaagtggtccggagttgctaatacacagacaagctggccattgtaagctaagcgcggtaagtccgcatcagcatgaccaatggtattaatgatcagatcaacaccgtgctgctgcgttaggtcttgaatgcgtgtggtcacatcttcatgatggtaatcgatttgggcatcgggatgcagcggtgccacgaaggcttgcttggcctgtgaaacggtcgtgaagacggtcttgccagcagccttagcgagttgaatagccatactgcctacaccgcccgcacctgcatggatcagcacagtttgcgcggcatttaaattggctttgcgcaggagggcttgataagccgtcaatccagcgcagagactagcggcggctgcttcaaagctcacagtcgttggaatcttagctagcacggctgccggtaaactcacgtattcggcaaatgtcccattattggcgagattagcgtgcccacaaactcgttcgccaggccgaaaattagtgacctcagcgccaaccgcctccacgattccagctgtgtctagtcctagtgtgtgtggatattgccaggcggcgttacccgccgcaactaatttaaaatctaccggattgagcccgactgcttgggtcttgatcaacacctcagttggcccgaggttgggcatgggccgttcttgccattgaagctgttccatagtttgagcggatggatctggcacaacaagtgcttgcatcttcaatcactcttttcttaaaggcatatttgctttttattataaccggtcgcggcggtgaatttaaactttaatgcctaattaattaagtagcaatgagggtgattcggctaacggaaagattgacgttagcggttacaatcgttagactaaggttagcaattgaatatttttaaacactaggggtgtccaaaaatgggctgagatggtgctgtaagtgccgatccctctgaacctgtaagctcaaacttgcgtaggaaagtgtcacagctaatgttagcggccactggatcaatgcatgttgattggtggtcgtttttgattggtgtgacggtcaatgaggaggagaattgctatggaattacaattattgaatactttacgggatcacaatccgattgtttttaacattgccaattttgttacggttcaagacgttgccaatgggctaaacgcgttaggggcctcgccaattatgtcagctgaagtccaagaagcggagacgatggtccaaattgccggggcagtttgcattaatttaggaaccttgaccaccacccagattgatcaaatgcgagtggttggtaagcttgctaatcagtatcataagccagtcgttcttgatccggtggccgtcggggcggtcccttatcgaaaagaagtcgcgctagcattactatctgattttcaagtcgatgttattcggggcaatgctggtgaaattgcggcattggctggcatggattggcaagcgaagggcattgatgcggggagcggtcagggcgacctggttgaaattgctcaagcttgtgcacagcaatttcaatgctgtgtcatattgtcgggacctactgatgttattacggatggtcggcgcgtggttaaagtcgctaatggtaccccgcttttccaacgtcacgtgggctcgggcgatttactttctagtatcgtcgcggcttttacagccgttagtccaaccgatatttaccaggcggcgcaagtggcttgcttagtcttagcgggagcgggggaacttgtcgccagtcagctgacggccgatcgtcccgccacatttgccattgatttgattgaccggctgagcttagtgacagtgtcagaaattcaaacaattgctaaagttgattaaatataatgaagggtcgcgagatttaatgaatgaatttccacaagtggcaacgattgctggtacggatagtggtggcggtgccggtgtcatggccgatttaaaaacgatgcaggcacgtcacgtttttggtaccgcggtagtcgttgccgtgacagctcaaaatacattgggggtccaagattttatggcaatgccgacgaagctcattgacgaacaatttgcttcgttagcagctgacttagacattcgcgcttgtaaaacggggatgcttgcggatgctgaacatgtccatgccgttgtcgagaacttgaaacgagttgattttgggccgctgacagttgatctagtcatgattgcgaaaggcggggcggcgttattagccgcggatgcgattaaaacggttcgcgacgaactgctcccgttagcgactgttgtgacgccgaatttgccggaagcagaacgattaaccggtcaggcaatcactagtaatcaagcgatggttacagctggacatgcgctacaggggttaggtgctgacaatgtcattattaaaggtgggcatggtgataatcctgatttagctaatgacttcgtattgttagctgacgggaccgccttttggctttcggctccacggattgatacggtgcggacccacggcacgggagataccctgtcggcatgtattaccgccgaattagcaaaaggacggtcaatggctgcggccattaaaacggctaaggcgtacgttgctgggacgattcaggatggtatccaggtcgggcatggtcatggcccgttgaatcattgggcaaccccaagtgagcaggtgatcgttcatgacgcttaaatttgaacccacacaattacgtgcttattttgtgtgcgggacacaagacgtgccgggacaggatctaaatatggtcgtccaaacggccttggatgcaggcgtcacggcattccaataccgagataaaggcaatagccagttgactacggctgagcgttttgcattggggcagcagctgcgggaacgctgtgcgcaagcgcacgttccctttatcgtcgatgatgatgtcgagctggcactcacactgcaagcagatgggatccacgttggtcaaaaggacgaccgggtgacacaagttattcaacgggtcgctaatcaaatgtttgtcggtttgtcttgttcaaccttagctgaagtgcagattgctaaccaattggaaggcattgcctatcttggtagtggtcccatctttccaacgacatctaaggccgatgcggatccagtagtcggtctgacggggttgcgacaattagtcatgactgcatcctgtcccgttgtcgccattggcggaattactgtcgcgcaattgccagctattgcggctactggtgcggctggcgctgcggtgatctcaatgttaacgcgtagtcccgatatggccgccacggtcaaggcgatgctaacggctacggaggggcactgatgaaacatgacgggatttttcggagccaatttttactgtggctcggtgcggctatctcaattgccgaaatcttaacaggtacgctgatggcaccactggggctgacacgcggattggctgcgattgtattggggcacttgatcggctgtggcctgttcttggttccagccggctatttgggggctaaattacaccagtccgcgttagcatcagcccaactggattttggtcgcggcggggtgttactagcgtcaggactcaacgctttgcaactcgttggctggacggcggtgatgatcgtcaatgctcagttagccatgaacagtattagtggaaagctatttggctttcgaagtccgctattaatggcaaccatcgtggcgattttgattattgcgtggttgctcatgggtagtcagttactgttcaaaatcaacaatgccgttgtgggcttgttggtgctcgggacggtgttaatgctcgtaatggtatttatggcaccgacaactagtcagtcggtatcaacgactagcatgacgtttgggcaagcagtggaattgaacgttacgatggcactctcatggttgccactaattggtgattatacccagcgtgttgatcgtcctttaccagtcgcactagtcagcgcgggtggctatatgttaggcagcttagtgatgtttgtgacggggctattagttgtgttacggacagggcaaactgatatcacggcattgctgacgcggtccggtttaggattggttgcattgctgattatcgttttttcaacggtgacgacgacatttttagatacttattcggccgccacgagtttggctaatctgaccggtagccgccatgttaatcgattagccgttggtgtgacggtagttgggctattgattgcgctgacggttgccatgacgtattatcagaacttcctgtatttgattggttcggtcttcacaccgctatatgctattattttcgtcacgtactttgtgcggcacgccacgttaccatactggttgaacttttgctggtgggttgtggggattgtcgcctattatcagttacaggccattgatttcattggtggcacgacgctattagtattggttgggctgagcatcgccgtctggttgacgggaattatcgtcaaaccaaccgagctcgaatatcgcgagcttagtcattgacaattagatgtaaaaagtaaatgataatcccattggtaatacgcatgttaccgtgggatttttttgagagagggcgacagaatggttaaaccgataattggaatcgcaccaggcgttgtgacagtgaacagccagatgttcccggggcgggtccgtgattatgtgaatcgtgattatttgaaatcagtaacggataatggcggtgtgccattggtattaccggtaacgaccgacgcaacgacgattgaacgatacgttggaatgatcgatggtctattactttgtggtggtgcagatgtggcctcattgacgtatggggaggaaccccagcctaaattgggtggggtaaatccggaacgggatcagtatgaaattgcgctgattcgtgccacccacgccgttggtaaaccggtgttcggtatctgtcggggcttacaaatcttaaacgtgtgttatggtggcaatctttatcaggatatgagtgaattaccagctggtcagggtaccttaaaacatatgcaaggacaattggccgcttacggcatgcatcacgtgaaggtcgtaccaggtacgaccttagctgaatatttaggcaccactagtgacgcaatcgcagtcaattcatttcatcatcaggccgtgaaacaggtggcaacgggctttcaggtggtggcccaaagtgcggatcaggttgttgaagcaattgaggcgacagctggtggtctacagttgggtgtccagtggcatccagaaatgatgcaacaagtaaactccgtgcaggcgcggttgtttgcggcgtttgtgcgggcttgtgtggcgtagatagcattgactagcaaattgataaaatagggcgtggttattctgaattgtaggataaccacgtttttaatgtgcggccgcaaaactaatgaatgtttcacgtgaaacatctgaaatggtgttggcaactagataactaatccaagatattgtaagctgacgtgtaaaacaattcgtaaagctgttaatactgtcagcgctttcgtataatggaataaagttattgttaagggggtgaccgctatggaacgaattgaagctggcatgagcgtaatgacgttgaagaagcagacctatcgggttatcgctgtgattaatcaggggcaagaactgttagttcgcgcccacgagccagaaacagctgacattgaaataattccagtaactacagttgttcaagtaactgaacaaaattcaacagacgatgcagccgtcgcattggatacagtcacggtcgttggcgaacggtatgtcgatgatattgtggcaacgttaacgacgctcggagtgggtatggcggtgttgctccagcgagaaagtggcaatcaatacgatgataatgccatctcagtgtggacgttgcaacatgctaagttaggctacattgcccggtatcagaaccagccgtacgcggcactgatggatcagggacaacgattgtacggcatcgtgacggtattagatcaacaaaaacagcatcttgaattgatgctatggcggactactgcagtcccaagtccgattgaggcgttgcaaatccgccaacgattggctaagccgaggacaaatttaggggcggtgccaacgcattcgttacagacaccgttaggaacaattgtcatgatgtgcaatggtcacccgattaagtatcagcaggttccgttatcgccatggttgacgcccactgatgaattacacgtcaccaaacgttatctattaacgcctgattggtcacaagtgccgccggacagcctcattacttgtcaagtgacggcgaaggccgacgtggttcagcggtggcaaaatgaacacatttcagcagcggtcttaacgaacgctagtagcttttatgtggttggtatcagtgctcaaaccaagacggggctgaatgataacttggtcgatgatgctgcgcaacccgcggttatttaccgagttggccagattagtgcacatatgcaggccggcttcatggtcagttgggcgccgtttggtgatccgcgcgtacaaccagcactgaaattagcattgcacttctcctcacaaccgctagttccttaccatccagtaacacctagtcgcaccaacgcgacgtttacgcagcaagagttggcagccttgttagtctccgcattaccaaattatcagggtggtcaacgcttagaaccaagtgtgacagcgataacggtagaaaaattgcggcagacgttaggtgatcagacgtatcatgcgctggcgaattatcagcgtcatgttcagctagttgcgggtagtacggaaggcgtcaacgagaccttgttacaggcgttgattcatgcagtcacgtatcatgagttgacgaccatgcactactaccagccgactgtagggatggtcgaccaggttatttatccgattcaattatttagcaccacgactaaggatgaggatgatgcgcaattagtgggttgcttagcgctttacaattacgaaacgtttgaaatccaacaggtgccgctgacggcaattgctcgtatcgcgattattgccgatccggagcatccccagacaacaccggagacggaaagtccggattggttacgcatatttttacatgggtggaatgacgatttttgaacgaacagtcaaaaattaatttgcttacgacttataagtattcgtgatacaagccagattgaattcgataaaaaatcccgctgaggctttaagctcagtgggatttttggttaggttatttggttgccgaatgggtctgtaaatattcctgggcggcgtgaatcatatctgcattttgttgatttaacaatggcggcaagttgtcgaagtcaaagtagtcgagtttgagtgtttcatcagtggcttgggtcagaacgtggccgccaatgggttttacaagaaagagtgcactgattgtttgagctacatcgccgttaggataggccgtctcgcctttatcaaagatgccgatgcgatcaacaacttcgacatcaatgccactatcttccttatattcccgcaagcaggccgtggcatacgtctcaccgtattctagatagccaccgggtaaactccagttatgcgtatcggtacgaaggttcagcaagacttgttgctgatcgttgactaaaataccagcggccgtattcaaaatgattggtttgtgaccaaccaaagcccgaatttctttaatgtaatttgccatgacgaaacctcgtttctagtttaattacccttattataccgataattctgactgaaagctgtttgttgataaatttatacgaagcatgctcgaaccgcgttagagcaagtacatactgactatgtgtcactaaatccgtttgcgtcggtgcacttttttagctaagataaaagctatatactgtcagccgtgatagtgtgagttctttgattttatgaaaagagagtaatttatgcagagaaaattaagtacgggccagatgcaaatgattgcactgggcggcacgatcggagtgggcctatttatgggatccagctcaacgatcaagtggaccgggccgtcagtgctaattgcgtacatcgtatcaggggcctttctatacctgattatgcgggcactaggtgagatgctgtatgtcgatccgaataccggttcgtttgccaagtttgcttctgaatatattcaccccgtttttggatacttgacggcttggagcaacatttttcagttcgtcgttgttgggatgagtgagatgattgcactaggcggctactgccggtattggtggccgaacttgccagattggattccgggcctaattgccattgtattcttatgcgcggccaaccttatctcggttaaaatgtttgggacgctggaaacctggttctcacttattaaagtggtgacgattattctgatgattattgccggtttaggtctgattatttttggtattggtaacggcggtcatccaattggaatcagtaacctgtggacccatggtggtttcttcactggtggggtgaagggctttgtcttcgcactagcaattgtgttggcgtcgtatcaagggattgaattgattggagtcacagctggtgaagctgaaaatccacaaagcacgatcgttaaagcgattcgttcaacggttgcccggattttaatcttttacgtgggggccatcttcgtaattgtcagcatttacccctgggataagttaagccagatcggttcaccgtttgtacagacatttgccaaaattgggattaccgctgcggcttcgattatcaacttcgtggttattacggcttccttatcgggaacaaattctggaatttatagtgcgagtcgaatgacttacacgttggcggaaagtcaccagttaccaaggaagatgactttattaaatcgtcatggagtaccattttattccgttattgcgattgcgaccgggattctaattggagtcgtcttgaatgttgtattaccaatgtttttcaaggacgctagcgagattttcgtgatggtttacagttcgagtgtcttgcccggtatggtaccgtggtttgttattctagtgagtcaaattgcgttccgtaagcaaaacgcagccaagatggcgaaccatccttttaaaatgccattatcaccctattcaaattatttaacgttggccttcctcgcgttaacactggtcttcatgtttattaatccggaaacgcgctactcaattttagtcggtgttgtatttctggtcatcatgacattgatttatttccgtaaatacgccggtaacaaggaagaaacgttgtaatcaagagcacttgccagtaaatggtaagtgcttttattttgggcttttattgcgttaaaattaggtatcaatatcaatatcaatatcaatataattatcaggaaaagtggtggcacgatggtcaagcaaggacattatgcaaaagtcagtaaacagaaacggttacgacaattaaagcaacgacgtcaggcccaggagaagcgggcgattatgccagaaatggttagcgaatttttgcaagtgcgttaccacctgacgcaagcggcaaaacagcggccggcgatgcgacagatgatgcaacgttttatggcacagtggttagccgcagggcaagcagaattgagcgacaatggtcagacaacgtggtcagtagtggcattgacgaagcaaacgttacagacctttaatcggcagttaccgtggcaggggtatgccttagttgaccaggaaatggcgcgctggacggcttttctgaacaaggaagtgccagctgtgccgttaagtgagcggattacgttaactgaggcactgtccccagcgacgtggcaggcctgcctatcagagcaattagcaatcaatgccctattagcattaactggtgattcacgacaattgggccaaataacgactgagcaagtacgacagctacaaaccagtattcaaacagcgacggggattgattgggaaaaggttgctcagttgcttgattcgacagtgattgcccagaatacactttccgaagctgggctggatgacaagacgcgccaatggctagaaaaattaaagaagctaacgccacaagattttaacgaccatgttgaatgaatagtcaaaaaaggaggatggtgaaatgcgttttatcacgtcagatcacgttcagttagattatacggatgaaggccaggggcagccaatcgttattttgacgggatttggtggcgctaaggatatttggcgcgctcaaatcccggtactgattcaggcgggctaccgggtcattaatttagatgggcggtgccaaggtttatccgagcacacgacgaaaggcttacgtatgagtcgtcgcgcggtggatgcgcatgaattgattgaaaaattacaactcgaacaaccaattttactcggtaattcgatgggggccgcgacttggtttgcgtacgtgtcattgtatggtgatacaggaattaaggccctgatcgacgtggatcaaacgccgcggatgatcaatacaccgcactggcaatatgggttcaaacaggttcaatggcaggatattccggactattttagaatgccgctgggacactcgacgtttaagcacatcgatgatgcgacgtatgcgcgcgtcaaggcagtagaagcgcaggcaccgttcgatgcgaaattaatgtttccattgttggttaaccacgcggttcaggattggcgggatgtgatccgccaattgaccgtaccgttcttgatcattgcgggcgccaagtcaccgttcttcaatcccgactttgcggcagtgactgctcaaatggcactacgaggacagagtgtggtcattccggaagctggtcatatcgtgatggcggaacagtcggcagcatttaataaggcgttgttggaatttttggcgacgtgctaaacgaaaagcacttttaacacctgtattaaaggtgatattacagtcttgaatagtagtcatatcaagcaggtttagaataaaataatgtattatgttgtcttgaataacggccacatcaaaaacagtttcacaatactaaaaaaggctcaccaactaaaacaggttggtgagccttttcgatttattgactaattactaatcaatcacgccatcttttcccatccatcggaaccgaataaacttcccgacctcgatcacaatcaagacgacgatcccacagataatcgggatgccccaaccataccagaagttgatgctagtcgtatggaagacggattgcatgaatggtaggtaaatgattcccagttgtaagagaatcagaataccaatgatgtagaacgccatcttattttggaagaagtacttggaaatgacggggtggtcattccgcaagttgaagaggtagaaaatcttaccaaagatgatgatgttcagtgacatggtactaccgacgacatttggtaatccaagtgcggtcaagtagttgtaggcgaagatccccaatccagaaattaggaaggagacatagccgatttcaaagtaatctaattttgacaacaacccagacttaacattccggggcccccgggccatgatgccggcctcgggtggctcaaagatgaacgcaaactggatggtcagcgcggacaccatattgatccacagtaattgcgtcgggtacagcggaagttcgtggcccattaaaatactaatgatgacaacgaggccttccgcgaaactagttgggagtaagaagcgaatcgtcttacgaatgttatcgaagacgtggcgcccttcacgaacggcggcgacgatatcagcaaagtcatcatcggccaggaccatatcggcggattccttagcaacttcggtccccttgattcccatagcaaccccaatatcggcttgcttgagggccggggcgtcgttgaccccatcgccagtcatcgaaacgacgtgattattggcctgttgggcacgaacaatccgtaatttgttattcggtgttgcccgtgcgaagacgttataatcatcgatgtgtgcttgtaactgctgatcgtccatcgcgtcgatttcaggaccagtaatcgctttgacattggcggccaagttcaacttgttggcaattgccatcgccgtatcagggtggtcccccgtaatcattttaacttgcacgcccgcttgccgtaattcggcgatcgcggtagccgcttcttcacgaggcgggtcaatgattccgactaagccagctaaatgcagcccaccaatggcttgtgcatcaatggtagtcacgtcatcatcgacttcttggtaagccagcgccaccacgcgcaaaccatcggcggttaagtcgtccatggcgtcatcccagtatgccgtttggttagcttggtcagttaaacgcaggacagtcgcgggtgagcccttgaccattagtaagcgttgaccatctaagtcggccaggcgagcagaaaaacggaaggcggaatcgaatggtagcgagtcaacttcttcaacctcaggatcatgaccagtcattttacgatacagcgtcgtcaaggcaccatcggttggttcaccggtcagttcccagcgattgttttcgaagtgtagctcggcgtcggtcgtttggccggcaatcttaacgagccattccatcgcgttatcttggtgccagtcgactttgttgccattgagcttgagatggccatcgaagttaacgccaccattatcatcataaccgacccccgtcacatcaaacgtatgctcaggcgtcacgaccttagtgaccgtcatttcatttttcgtcaacgtcccagtcttatcggtgttaacgatatctacggcacctaaagtttccacggcggggagtgacttgacaatgacgtttttcttcgtcatctgccgggttcccatggctaagaccaccgaggtactagcgggcagtccttctggcatagaaccaacgaccatcgtaataaccgcaattagtaaagttggcaaactataggtatccatgaccattcctaataggaataataggacggctgccaccacgatggcgatggataagccaacccccagtgagttcagattacgcatcagtggggtagtggtttgtttgacgtcgctaacagactgctggatatgaccgatttcggtatcttcggcggtagccgttacgattccgacggccgaaccgctagtcaccgcggttgacgcgtaaaccatattcttacggtcagccaaagctggcgtggtctcagtaatcggttcttcttgtttctccacgggattagtctcccctgtcagcacggattcttggacgttaaagttatccgctgaaatcaagcgcatatcggcaggaaccgcgtcaccggcttctaagttgactaagtcaccaacgactaattcgcgggcgtcaatttccagtttttttccatcacggatgacgaaattcttggaaatcagcatttcacgaatccgttctagcgcgttgccagcttggcgttcttggacataaccaatgatggcattggcaataataaccagtccaataacgatagaatcggaatagtggtgcatgaagaacgttaagaccgctgctgcggctaaaatgtagataatactgttattaaactgcttgatgaattgaacgaaccgagacgtacgcttggtctccagttcgttgcgaccgttatgttgtaaacgttcggcagcttcagcagtgctcaatccattctcaggatcggtggcgtactttgcggctaaggctgattcatcaagctgccataagttatccgcatcgggagggttctgggtgtcgttttgctcttcattagaggttaacgactgattgtcatcttttatcattcaattcgctccttaaaaataaagttattaccggtgaggttctgtaaaatcacgacgtttattgcgtgttaaataggccaatttcgccacatcctttcttaattagcgttattataaataatattatatacgaacaatctaggtgaacgccattaaaatatttgacaaattcatgacaaattattgcgttagttgcaataatatatcagattttggctagtttgtcgctgaaaatgactggttttcctcgaattgttgggtaaattaaatagggagaacttaagatgacagataagttaacgttattgcaatatgatccaaatccaacggctatggtagggccagacgtggatggccgctttactgttccagctaagctactctacatattttctggtgatgattattttcaacaattcgtcactcggtatcatggtcaccgtttaggccaatttaataccattactaaagttagctgggtttatcaaatcggttatcgtggtcaaaaattggcagtagcgcaagcgccccttggttctccagctgcgacaatgtatttagagatgttgattgattttggtgctcgtaccgtcatagccgttggtagttgcggcgcattaacagcactaccagaggaacaattattaatcccaacggtggctttgcgtgatgaagggacgtcctttcattatttagcagcagctgattgggtgccactcgatccaaaggttatacaggtactcgggacaacattgacgaaggcttgcctgccatggcagatggtcaaaacgtggacaacggatgctttcttccgtgagactgtgtctaaagtcaaagctgctcgtcagcagggttgtcaagtcgtagaaatggaatgttcggccttagctgcctgttcggcgtttcggcaagtttcctttggacaattactatatacggcagacaccttagcacaactagagcactatgatccgcgacattggggtgcgggcggtgttcttgttgccattgaactagctacggaaagtttggccgcatattagcgaataaaaaacgagcagtcgatgactgttcgttaatagtggttaatccttgatggggtccttcattaataaccagagaatcaggtaagcgatgataccagggaacatgggtgtaattgctaaaacaacaaataatagccgggtaacgttagtattccagttaaaatgttcggcaattccaccaatgacaccggcaatcacccggtccgttgcggaacgatgaatatcgatcttcataagttaattcccccttaataatgctaactataatgtagcaggtttgattcaataacgctactaatttaatcggttggaaacggcgtagtggtaagaaccgtggtatagtaggtgatttcggtcaaagcttggtgaagtgcatgatcgtagcgtttgctcaggggcgcgttatcgataaagtgaccgttactttgaagggtttgtggtacgttaccaatgggcgttggtttagggaggacgaccattcctaatcgttggagaactggaactagtgcggccgccccaaattgaccgccgcgcatattgtcagaatatgagataatcttagccggtttacgggcgccttcgaatgccaaaaaatcgaaggcgtttttcaatccagctggcatcgcgtgattgtattcgggtgtcaggataatgtaaccgtccgcactagccatatcggtgagccattgctgctggttagcaggtagctcgcggtgcgggttcgccatcggtggctcgggttcatcgaaaaggggaagctgatagttggccaaatctaaaaattggtagtgaatcgtagaatgagtcggtaattggtcaatgattaattttagatggttaaataaagcgcggccgttagcctgtgaccgggtactccctaagatgattgcaattttaaacatagtgggacctccagatatttttattgattctaatgaatacaaaatgatagtatagacttaataatattggtatgcaagtatttattcacttgaattaaaaaggagatatttaaatgacaacaccattagttagtcagttgatgacggaattaaatcaatttttgacgcaggatagcgttgatgatcaagaaaaacgctgggccatgcaacaaacgactgatccgcaattacaagcggcattaaaacaactatcgacgacggatattaaaattattgcgtatctgggacggcgtggtgccagtcgagctaagtcgctaccggcaccaacggaactttcacaggcgacgatttctcgcggtttgactaaattatctcgattgaaattggccacgaaatatcgggatttgaccaataacaaagaaattctcgtgcgattgacgacgctgggcgaagcagtcgctgatttacacacgcaactggacgcggccattgctgctaaagcacaagccattgctgatgactattctgacgcggaactgagacgctttgttagcctaatgcgacggattcgtgaaattaaaatttagcactccggttaaatgagtgctaaattgttgcattcccacaaaatggtgttagtatatatatcgaaggtcaggaaaggtcaaacaaggatttgaattactgaccagtattaatagccaagtgaaattttgaaaggggattgttagtatggctaatactttaatgaatcggaacgatttcggcatgttggatccgtttgaacggatggcacgctccttctgggcaccattagaaaacatggatcaagtattgaagaccgacattaacgaaactgatgatcagtatcaagtgaaggttgatgtccctggtattgataagcaagatgtgaagttggattatcgtgacaatgtgttgtctatcaaggttcaaaaagatagctttgtggatcatgaagatcaagaccaaaacattgtgatgaatgagcgtcatactggcaccttgcaacggcagtatatgttaccaaacgttgcggcggataaaattacggcatcccaagctgacggtgtcttaacgattacgttacctaagacccagccgagcgcgaatgacggtcaaatcgaaattcaataattaaatcattaaatcatcagtaacaagtgagcggcccaccgataatcaaatcggtgggccgtttttgacatcaacaatcggtatgaattatgaccggtggttggtaagctgttggtttagctggatgactttgatgcgggcgagtgccatttcaattaaccatagaccgatataggctccggtgtaaaccaaggtatagaagccaaaccagcgaacgtttaatggaaaccagccacagagaatcgcaagtggggtcatccctaggtaagaacacagacaatgagcaatggtttgtttcgtaatcgaccacgtttcaatttcgaatagccagctactgaatgcccaaacttcaccaatcagaatccacaataatgtcgaaagctgggtggcggctaagggcgaggaccagtggctgacaaaagtgggattagaaggaaataaataggtggtattaaagaaggttgagaaccccaaggccattaagtagccgataacgatgcctccgatggcgccaatcaaaagggtgtgccaaagtcttttcataattgtgccgcctttctaatttgttgggtatagcgtcgtgatgcgtatgttgttgtgccggttgttaggttgacttgaaagctaccccatttggttaaggtaaaatttttaacacaggcgattcgcacaatttcactactagaaatacgtagaaattggtggggtggcagttggtccattaaagtgtgtaagtggctgtgaacgaggtaagcaccggtggttgtttcacaataaagtcgtttattggcagtgtaaaaacgtgacaccgattgaagtggcagcttaatgagcgagcgatcttgaaaaacattgatgaatcgtttcagagatggttaactggacgtgcatcgctgattccccccttaaatagcgattttgataagcttattgtagtgaaaaatgcggcttgacactagtgcttattgctacttggtcaactaaacgggctaactggtcaggaaatatgacaaaaaatttcccgggaaataattgtcactggtggtcgctaaatatgataagctaattaacggtataatacttactgaaaattagtgtcagttagatatggagatgacgagcgtggatgacgcagaacgtgaacgcggaccatggcatcgtaatttgattgttttatggttttgtacgttcgttgcgggaatggcatttagcgaaattatgccatttctttcattatttgttagtcagttgggtgatttcacgaaggcccagattacattttatagcgggttagcttttgcagctgattacgcgatttcagcaatttcggcaccactgtggggcatcattgctgataaaaaaggtcgtaagatcatgctattgcgcgcgtccctagggatggcagttgcgatggggttaatgggttttgtaacgaatgtctggcaactagttgccttgcgcgcgctacaaggtgtgtttgcgggctttatttctaatgcccaagccttagtcgcgtcccaaacgccacgtaaatatagtggacgggcgttgagcactttgatcactggtgccgttagtggtcaattgtttggcccagtgattgggggcttgctagcccaattgttttcgattcgaaacacgttttttattacggccggattattaatggtggcgtttttgttgagtctgttctttgtacaggaacacttcaaaccagtcgcacatcatcgtgaaccaggtgacagtcgcaatcctttagcagcgtttcaaaatccgcgcttgattattgtgatgttatgttcgacggccatcgtccaatttggaaacgcctcgattgcaccaatcattagtttatacgttcgtgaattgatgcattaccgtggcccgattacggttgtggccggaattatcgcagctttaccgggtatttcaaacatcttttcagcaccgcgccttggacgttatggtgatcagcacggttctggtaaggtattgttatttggctatatttttgcggtgattatgtatttcccacaaggcattgttacgagcgtcgtggccctcggtattttgcggtttgccattgggatttccgatggcgcactatatccagagattcaaacggttttgactaagaatacgccagtacatcttacctcaacgatttttagctataatcaatcttttcaagctattggcaatatgttcggcgccttgctcggtggtttggtggctggttggttcaattacaacgcggtattcattatgacggcgttacttttgttaattaacctaggtttaattttgtggttagttcctgatatttggaagaacggcaaacgggcagtttcctaggtgtttggtagttagtctattaaattggctagctgccttttttgttacttgtccttgaacatgatgttaattcagtgtattgttagtttcatgaatatcgaaataagcaaacaagatcaggctgatcagcaacgagtggcgattttcaaagcactggccgatgctaaccgattacggattatccgggtgctctatcaagcacaacgggaaatgacttgcagcgaagtgggggcgcaattaaatatcagcaagtcaaccgtctcttatcactttaagaccttgcggttagtgggtctcaccaatacgcgacgaaaggcacagacgaagtatctatccttacaattagcgacctttgaccggtttttaccggggttcttagcaacgctttagtttttttgctttttagttcgacaattatcgaactaaaatcttggaaagaagatgtcaactacttatgaccacaacacatcaacatagccgctatttaacacttggaatgatgttagcggcaacgaatatgcgtttaccaattacaatgatgccgggattaatcagttctttgaaacggacactgggtttgccgagctcgatggcgggattactgaccacgatcccattattgacgtttgccattatgtccccattgattgcacattgggggcggcgatttggcaacgaactgacaatttatgtcatgttgatctttctagccgttgggagttatctgcgggtcatcccaacgattgctgcccttttcattgggacgttactagtcgggattggcacggacggtggcaatgtcttgattccagcgattattaaagataattttccgacgaagattccagtcgcaactagtcaatacacgctctcaatgctattagtcggttcactgggaacgggactttcgggagtgttggcggcacactggtcgttaccactaacgatggcggtgctatcggtgattggactaattaatttggttgtctggttgccaaacttgaaatacaatcatcgcgcaccaacagttgcgatgaccgcgagtgatgggcagtcaacggcaactcacgggagtgtttggcggcggccgttagcgtgggtcgttacggcctttttcggcttgcaagcactagtctactattcattactgacttggttaccaacggtatttgttgcccacggcttctccttgattgtggctggcaatttagttacggtcatgcaattgagcggcctaccgatgtcatatttagtgccagcgacttctggtcatcggcgcggcgtttgggcaatgattatggtggtaggtgtcggttttattgcgggaattggtggtatcttactttccggaacgaatttttgggtggcagcactgtcctgcgtcttactaggattaggctctggagcagccttcagtttggcagtcgtcttctttacgcaaaaaacgaccaatgggtttgaaacggctgacttatctggtatggcccaatccgcgggctatttgttagctgcagtggggcccgtactattcggctggttaggcggtcaattaggctggggaccagtactctggttagctatcattctttccgcgttactagcattatccggcagcatcattttccagcatgcaacgatttatgagtaattaatatcacaataatgcagaacgagattggcccaagtcaatttcgttctttttttgaaactttatctttgccttagagttactctaagggattacactaatctctattcaattaaggaggccacagtaatatggcggttattcaaattctaacggtcgtcggcgtggcgatcatcggggcaagccttgtaggtgatcccactcagcaacgacagtcaaaaccagtaaaggagcaaaaataagatgacagtgttaacaacgatgtatcaactagcaaatggtgtcaacattcccaaagtcgcattcggaacttggcagatacctggtggtgaggcaacgtatcaagccgttcgtgcggccttagcagcgggatatcggcatattgatactgcactggcctatcaaaatgaagcaagcgttggccaggcgattcgtgattctggcattccgcgtgagcaaatctttgtgacgactaaattaccggccgaaacgaagtcatatcaaggtgcactaaatgatttcgatcgctcactgaaaaatttgggcttagactacgtggatctctatttggtacacgcaccttggccatgggggcaagtcggtcgagtttacgatgaagctaacctcgatgtttggcaggcaatggaagctatttatcaaagtggccgggcgaaagcgattggtgtctctaactttgctgttcgggatttgaagaatattcttaaccaggcgacgataccaccaatggtcaatcaaattcaatattacttgggcttcacggaacctaagatcaccaagttttctgaggaacatgccatgcttgtagaagcatactcgccgttagcgacgggcggggtcctcgataatccgcaagtacaggcctatgctgataaatacggcgtcagtgtggcgcagttagcgttacgcttcgttttacaaaatggggtcttgccattgcccaaggctgttaatccagcccatattgaggcgaatacgcaattggacttcgcaattagtgtggccgatatgcaagccttaaacgacttgccagatgcggctggttcatacatgcacaacccaacccaaggttaacgaacaaaatgtttgaccgcacttgggtcgataggagtaaactgaacataattaataaacgataaggagcgatttgatgacaacgattaatgcagctaacgcgggtacttacgcgtttgatgatcaattcaaagttaaccggatgggttatggcgtcatgcagttaacgggtcctgggacatggggaccatacgctgatcctgaaaatggggtcaaggtagttaagaaagcactggaatatggcgttaatttctttgatacggctgattcatacggtccatggtttgctgaccggtacttagcggcgggcttgaaggatgccgctaatcgtgatcagatcttcatttctgataaggtcggtcaaacgcggcaaggaccgaatgtgtggacgccacttggtgagccacggtatctgcgtcagcaagtagaagtttcaatgatgacactggggattgaccatgaagacctagtattcttacatcgaattgaccctcattactcgattgcggatcaagtcggtgaactcaaaaagcttcaggatgaaggtaaaatcaagcatatcggtctgagtcaagtaactgttgatcaaatcaaggaagcgcagcaagtcgctaagattgatgccattgaaaatctctataatgtcgccaatcacggtgatgatgacgttgttgactacgcggcctcacaaaagatggcttttctgccatggttcccattagcaacgggtgaactggctcaggctgggagtgtcctcagcacgatggcccaaaagtatcaggtgagcccagcgcaaattgccttggcttggctattgaagcggtctgataatatcataccgattccaggaacaagttctattgagcatttacgggacaatgtggcagccgccaacgttgatttaacaacggccgattttaatggattaagtcaattaagtgttaaatgagtatttaggtcgggaattcccgacctttttgtttgcctaaaacgagctaaacgacgcttgaaattcatggggttgacggttaaaatgaataaacattgaatgagaaagaggattgagcaaatgagtacgcgtttgatgagtgatgagccaacaatttatttagcaggaccttggtttactgagggccaaccagaacggctagctaagatcgaaaaattaatggacgagttagaattgacttattacagtccacggctagacggcatcgatttgacgccggatgcgaccgaagctgatcgaaacgcggtatttacggacaatgtggaccatttaaaacgggccaagttagttgtcgccgtggttgatggctttgacacgggaactatttgggaaactggaacagcatatggtttagatatccccgttgcttactatagtgaaacgttagctgatggcacgtttaatgtgatgctggctaagtccggcaaagcggttattgagaacatgactgatttgaaggcttttctacaagatcccactgccgatgattttcaatatacaggaactattcgttaatttgaacggttagtcaaaataaaaagtgagccgtctgcatttgttaaggctcgctttttgcatacataaatggcagaacttgtggtgggaatgagccgcttgaaaaaatgtaatatttgttaaaggcaatgtgtttaattggagaaaagtcatcaaatggtgttacgctatgggcagaaattggttgactagcgcaaatattaagaaagcggcaagaaaacaaaaaagttcagttcaaactagacaatcactatccaagttgtataatgtacttgtaagcgttatcagaacctaattacctattttgggggcgttatttatggttaaaagtaaagcaattatgattggtgccgggctatcaaatatggctgcggcggtctacttgattcaagagggtcattgggatggtaaggacatcacattctatggtgttgatatgcacggtgccaatgatggtggtgccacgactgattttaccaatgagtattggaataagaatcatccgatggctaacacgactgggtatgttgcccggggtggtcggatgctgaattaccggacgtacgttgacttaatggatttattggaccggattccatcggtaactgaaccggggatgacggcggccgaagatacgcgtgattttgatgcgaaacatcggacgtatgatattgcccgcttgatgcagggtggtaaaggcattattaatgctggtaagttaggattcaataataaggatcggactttgctgactaagttgattatgatgccagatagtgaagaaacgaagctcgacaacgtttcgattgctgagtacttcaaggatgatccgcatatgttccaaacgaatttctggtatatgtgggaaacaacctttgcctttagaacgcaaagctctgctcaagaactgcggcgttacatgcatcaaatgatttatgaatttacacaaattgaacacttagttggtgtcaaccggacgcgttacaatcaattcgaaagcatgattttgccattaattaagtacttgcaagggcaaggtgtgactttcattgataataagattgttaaggattggcaatttaaagacacgccaatgcaagacgaaattacggtgactggcttagtcattgaggatgcgcagactggcgaaacggaagaagttgaagttgatgaggacacagcggtgatcttcactaacggttcaattaccgattctgcaacgatgggtgattacaacacgcctgctcctgaaaatatggattatggtgttagtgctagtttgtggaagaaggctactgagcggttctataacttagggacgccagataagttcttcaacgatcggaatgctagcgaatgggtcagcttcacgttgacgactaagaatcatttattcttaaatgaaatcgttcggatcaccacccaggaacccgggaatgcgttgaactccttcttatcaactacgccaattacgccgttgaaccaaaaggatgttaatatgtcgatcgtggtgcaccaccaaccacactttacgacacagcaaccaaacgaaacagttctgtggggctacttcttgtatccacggcgtcaaggtgagtttgttaacaagccgtatatcaagatgacgggtaaggaaatggctcaagaattaattggtcaactttccaaagtagatccgggtccaggcaatattaaggacaaggaaaaggaaattttggacagtattgtgaacaatattccggtatacatgccatatgcttccgcactctttaataaccgggctaagtctgatcggccagaagtcttaccaaagcactcaacgaacctagcctttacgggtgaatttgcggaacaaccataccagatgatcttcacggaacagagtgcggtccgctctggtgagattgccgcttatcactttgctggggtcccaatggataacttggtcaagacaccacggtacgataaggatccaaagaccttgctcaaggcaactaagaagatgtttgattaattaaatgctggcctgtcagtggttaatactgatgatggcatgatttaaaaacgctccccatgaaagatgactttcatagggagcgttttagtgtgcatcacgatcagtagtgacggctcgttgagacgccgtcattaacaggatcaggttgctaagcaatttagtggttgatcaaattttagcagctgctttaggtgttaatttagacggtgtgtgtttagtagtggttttgaccgtgagatgctttttggttgcaagtttgggcgcctttttagcgttttgcttggcggtctttttgattaattttggtgccattttcttagttttcgttggttgggctaacgtttttttagtggcgagagtcgttacctttttagttggtttgatacttgccttagggtgcttgatcgttagcttcgttgattttactttggtggtcttcttagcaatcgtcaacttagtcctcggggttttcttggtcgcttttaatttagcggtcggggcgttccctttaatcatcgtggtggctttagcccagccgagggccttaccgtgttcactaatgagataatatgtggccgacgtatgcttgccggttgctaaagtaatcgtcttagttaccgtgtaagtctttttagtgctgagttttgctttggccgggctaacaaaggcgattgcccgatcggcggcaaagtgaattgtattcaaagtcgtggcggccttcgcgtgcattgtgatggcgggaaagtgggtcgctttagtaagtgcatgggtagtggcttttggggttaccgtggcggcattagccgtggtagtcatggcaaacgggctggcagccaatggtaatgccaaagcaagtgttgcaacgactgatgttaattttttcatttcaaaatcccccttaaagtgaatcttttttgattcgaagatagtttagcaccttgactgctttgcaacaatcgtaatatcaataaaattatcaaaaagtgggtgaatttgaatgcaatcaataaaggcttgataacaaacgaaccgcggtgggagtaaccgttgggttaatgagagtgaccgagattttagaactaacgttcgcactgaatgggaaagttatggtatgctagaacggtatttttactgaaaggggtgggcggcattgccggcagcaacaactttaataacccccgctgaaaatcgtttctttctgttaagtgaacgagctcgacggcggaccacgctccaacaaattagtgcgttattacgcgcacacgtaacggtaaaggctgacagtgatttcttgaaaccgactgttcgtaacttgattttacaagatcatgcacagtggttgaccgactgtagtcatgagtggcaacttttggcgagtctgccgtacgttgttaacccgaatgaaagccgacaagcatggcatcattgcgaattgtgtcataagccggttcgttatgagtaccatgttcaaaacaagcataatcatcgtgagttgattgtcggttctgaatgcgtcaaaaagttcatgaacgccgaaacgcgttacttgatggtgattacaacagaagataacttttatgcggtggcccagtatcagacgctgactaccgctgtaccaacagtgccaacgatcatgtttgctcagccgtggctaccacaattaccggctgagcaagcgccccaagcgcgcaagttgcgacaaacaacgacgcaaaccgtcacgacgtacctaaaacgtcgtaccaagcagctaccattacaggaactaaagcccgctgaacaaacctatcagcggttagtccatgatgaacaaacggtgattgaagcggctgagcgggcggcccgtcaagcaattgtgactaatcaacaacaacgccaggcacaagcgcagcaaagtgctgtgaaggccgagcaaaccttgcgccagagtcacgcctatcaatgttatttacagcagctggcggccattattgtgatgcgtccggaacgaccgatggcgaagcaacagtttgaaaaaatcacgccaccagcgaccgaacgccctttggtgaactcttatcaattcgggcaaatggtgactgaatatcgacagactgggaagattcaagttcggcgcctagccatgcttgatcatcagttcgttgccgcacttaatcaggtgactcaacagctagatgaacaacaaacgacgcgtttttatgacgatgtcttcaatagttgttggggctggcagtatcatcagcaggcgacccaacgtgcggattgggagcacttattgacgacccggtggggccaatcattgtcgctggcttggtttgaacaattagccatgcaaacgacaatgccacaaactcaacagtggcttgcggacaatgcggatgccggtatgcaagcagcactacagcaacgtttggctgcgcatgaagaccgccaaccgattgcccgtgaccggatgactagatcggaattacgacagttttgtttgcgtgaacagccagctgcgccgacattagaagcatttgaacaggtctttgaccaacagtatcaattgcccgtcgaccggcaagtaacggcccatgaaacgttagcctattactatattgcgcgtcaatatcaaggtgaccatcagcgtgcgttacaacaactgaattggttattgaaagtctaaatgtttcacgtgaaacataaaaacgcccactgattttttcagtggacgtttttaattcggctgacaggttaactattaatgacgctgtgatagcgcgaggctgcaaattcatacagcggccggctaagtggtgtgacctcaacggcttcttcaaatggtgccgtaaccatggtgttgtcagcgtttttagcgagtttgacggcccaagttggatcataaagtaattgttggcccactgcgactagttcggcagtttgtaacacagtcttgacatcgtcgcgggtccggacgccaccaacaccaactagtggcaatttaccttgtaacgcttcgtgcacgtaggtcatgatggatttatcttgatactgcgggtctcgtgaaacacggtcatagttgttgagtgagacatgaacgtaatctaatcgactttcccgtagttgtgagagtaaccaaagggtatcttcaagccgaatacctggttcttcgaattcttctggtgagaaacgatagccaacgatgaagggccggtccgcatattggtcaacagctgcaaagacggcctttaataattcatcaataaagcggaaccgttcttgcggcgtgcgaccaccgtattcatcggtgcggcgattactatgtggtgagaagaactgttggatcaaataggtattggcaccgtgtaattcaatcccatcaaagccggcttgaatcgcgcgccgagttgcttcaccgaatgctgaaattgttgcgtggatctcgtcaatcgacattgctcgcggtgtttccgcatcgtcacgaagggccgcaacggcactggcagagacaatctgttcgccatttaagacggctcgatgcgtcattcgaccggcgtggaagatttgaacgatagctttggcaccttgactttgaatgccatgagcaagtgcacttagaccgggcagcatcgtgtcatgcgcgatactaagctcgccatgccaacccttaccgagatcttcgacgttggcagcacccgtaatcacggcacctaagccagtagctcgttgtgtgtagtagtcgatttcgtcatgggtgatactaccattgtaaaagctttgagtcgtcgtcatgggcgacatcattaggcggttgcgtagtgtaacgccagatttgaatttgagtggttcgttaaaactagtcacaataaaacatcctttcaagctagttttgcttactttttgtaagatctagtttcagtttagcggttgaaatttgttttttcaattttaaagtcgctggttttagttaatcttggcataacaggatggtgcgtgtggaataaggggattgttgctgttgttaagtcaggtgaggcttgataggtagatgcaaacaaaaaacttcatcgataagcatggtcgacgaagttttttggaaaattatgatgcaacgttatgccttaaacggattccagaaacggccaccgttgaccttaaagagggcgatgccgaggatgatcagcagagcaactaacgttaacgccagatagtcgttacgtttaaagcgttgggccatgtaccatgtgcgatgttttcccttaccgaagcgccgcaattccatcgcctgactaatggtttcgattcgatctaagcttgaaaaaatcaatggaagcagaatttggatgccgccacgaatacgggtcataaaatgcgcttttttcgacatttcaaacccccgagcctgttgtgccagactgatagtacggtaatcagcttgaacgtctggaatgtaacgtagtgcaatcgctacggaatagctgatacgataagaaattccaatcttattgagactcgcagcaaattcgctgggattagtcttcatgagaaaaatcagggcgagtggcacggcaaacgtgtactttaataacaaattaaattcataaaaaagttgttcggctgtcaagttaaagtagtgatcagcagatcccagtagtaagtgttcggtaccataaatcgagacgccgtaatgaggcgcaaagacgtacaccatcactaagtttaaaacggaaaaaccaataataacgttaagcacgaacgcgatatcgcggtaatgaatttttgaaaagcggaatagaatcagtgaaaaaatcatcaccccgattaagtaacgcgtgtcgtaagtcatcatcccgataactgataagccaacaaagcagagtagtttagtgctaccgctaagtcggtttaaaaaagtatgacggtcgttgtacccgatcaataattcatgttgcatcttagcgcgcctcccgttcagcctgaacaaattttgcgacgaattctgtcgggtttaaatggtgcgcttctgccagggtgtataaacttgtcttggctaaggaagcttgctgaatgatggatgcgttggtcaacacatcggctgggcgagcatccatcaaaatgttgccgtggcccaacacaatcgtgcgatccgtgtattctagcattaggtgcatatcatgcgtgatcaacataatcgtcatgtgttgttcctgattgatcttagttaagaaggtcatcatttcagtatagtgttgcaagtcttggcccgcagtaggctcatcaagaattagcatggccggttctaatacgaggatggccgcaatcgtgacccgtttcttttgaccgaaactgagcgcagaaataggccagtggcgaaactcatagagaccacagaccttcagaacggcctggacacggcgctttacttcatcgtcagcgacacctcggaggaccaaaccggcagcaacttcatcaaaaatcatcgttttagagatcatttgattggggtcctgaaggatataaccaatttggtcggcacgttctttgactgattggtcagctagggaatgaccgttaaatcgcattttgccggactgtggcatcaaaaacccagtaatcagattgcttaatgttgacttaccagtcccgttttgacccactagactaatcatttcaccctgatgaagtgtgacggtgatatcgttgatgattggtttggcgggatcgtacccgaatgtcagatgctcaattgcgagtaacggttggtcatgaacggtgggcgactgtagttgtacgccggcggtccagttttgcaacgtcgcggtgaggtcgggtacttgtaaggcttggaggttatccaagtgttggcaagttgctagatcaacaccggctagtttgagcgctgaaaggtataatggttcgcgtagcccgagttgagtcatgagtgattgccgcaaaatcgtttccggccggtcgttagcgacgatcgcgccgtcttgcatgacaatcagccggtcgattggttgctgtaacacgtcctcgatgcggtgctcaataatgatgacggtcaggtcctgcgtatgagtcagctgatcaatgagtgccatcgaggctttacccgatgccggatcaagactcgctagcggttcatcaaataataggattttactattgtcgatcagaacaccagccatggcgacccgttgcttttgcccaccagataattcctgcgggcggtgagtcaataagtcctggaggtttaaagtttgggcccactgttcagttgcttgtcgcatggccggttgggtctgctgatcattttccaatgagaaagccatatcttcgacgacagtcaaaccgacgaactgactatcaggatcttgcagtaccgtaccgacgtcttgggataatgcaaaaatggagctctcagtaatggtttgaccagcaatccttgcttggcccgtcactgttcctggataggactgcggaatcaagccgttcaaacaccggcctaatgtagatttaccggagccagaaggtccagcaatcaacactttttcaccggggtaaatatccagattaatatcacgtaaagttggttccgtttggctattatattgaaaagagaaatttttaaagctaatgatgggtgcgctcatgttattaacgttcctttgttaagctcccacgttgggtccgcgtccgggcgtacaagactagtaggatggtcccaatgatggcaactgagatggaatcggcgatccaagtaatgacaccttgaaggtaaactttgttggccggttcatgataaataataatatcaccagttggtgctaaaagcacccaaccaataaagttgacgatgatttggtaaatgttaaaccagactaattttgccgttcctagtacgccattttcaatcttgagccgatttttagctagtccgaaggcaaccccaatcagaccatcaacgatgacccaggtccaccaaggcgaaccataagttacgaagtcgtttaaggcgtgaccgatgaacacggctaaaccagctgcaacgggaccaaagatggctcctagtaaggctaaaaaccccatcgcgacgttaacctgggtattcggcacacccgttggaatggcgacaaatttcatgagaacaaaaataacggcggcgccgatcccggtagccacgacggtacgaattgaattggattgcttgttttgcatagtgtaacactccttaagtattgagaatgaataagttctaataaccattaataaaagcgaacaggcgttaatttcagatcagttatggtcataaaaaaacgcgcctaaaagcgaatgctttctaggacgcgtttgcgtgttaccaccgagattttcccacagggacttatcatgatcgtaacggatcgctccgactgagatggccccagtagcttcttcaagaccatcttcaactaaccacgtcatcgttttgcaccaaaaatacgactctctaagcacgagaattagcttactcatcttgtcacagctttttctaatctgaatttaactattaaagcatacgccaaagtctgtgggggtgcaagtaaaaccgaacggatgtagccggttacatcgagattgaacgggaaaatcgggaacagctgattaaatggtggtcaaatgcgctgattcattcggctatacggtcagtgacggatgctgatgattagttggattggtcgttaattaaacaaagccaataaaagtatatacaaatgatttcaattagctactaaaaggggtaaactagttgacaagaccaaatgatgaaggggatgtgagtagtttggcttataagtatgaaacgattgcggatagtctgcgacaagacataaaatccggtaaatatacgccgggcgaattgatgcccgaccagaataaattagctgaaacttttgatacgacacgaattacgattcacaaggccattcaattactgattattgaagggatggtttactccaagcgtggcgcggggacctttgttcgcaaggactttggtttgactgaacggcgccaagaaacgctggtagacaagcccctgggaacaacgcaaacgaatgccggtaaaaaggtgacgagtaaggtgttggaattacaagctcgcttgcctactaagcgggaagcggaacagttgttaatcgatgagatggatccggtgtacgttattcggcggacccgctacgttgatggtaaggtgtgggcgtatgagcatacgattatgccaacgagtatcgtgacgttgacgaagcaagtcctcgaaggctcggtctacggttacttagagcaacatagtggcaagaaaatcgcgggttcacaccgtattatctcggcagcccgagtgacggctgatgacgttgccgcaatgggcgcgactctgaatgatcccgtgttggtcattaatcagattagttacatggatgatggtcaaccctttgaagtctccgaatcacatttcccatacgagacaagtacggtcgtagcggatgttcaaattcattaaagcaatcggtaaccgcgttaatcagtggctaccgattttttgtggaaattattctggggagttgcattcaagaaaacggtggcccataattaaattgattgaaaaagaaagcgcttcaataatctgattaagggggatgaaaatatgccagctaacttttatcaacgattaattgataagtatgaaccaatgacggaagcagcgttcttagtgttagtcagtgttcgccagccgattaccagtgaagcgattccggcaaagatcgctgaaatgaccaataatcaactacagctaggattgggaaccttatttacgaatttgcatgccatgactaaggattatttaatgacggaacgagtcgatgaaaatgacgtgcatacctatgaaatcacggggagtggtgaatcggttttggcggctgaacgaaaacgactgcaattattgaatcagatttgtgagcaggcgggattgtaatgggttaatttaacggggaagtgagtatatgtggcgttatcaaatggcagtcaaaggctctcagagcaggaattgcgatggctcaatcagcaggtacaacgcgggcaattactgcggcgtatcagggggaactggtatcaatttcaaaaaacgacgacgcggtatcaagtctttagtgaatatgtgagcggtaatgttgcaactgaaatcgacgaccagcacacaccgttcaaattgttagcacggctacaattgacgaaaccagccgtacaggtgatttatacgggcacggctcagactgagttgcagggggcacgagtggatcgtcaggacgcaccgttgcagttgaaaattgcactggcgcaacggggacacttgttaaatgtcatgaatattaggttagtggttggtctgatactggccgtgatcgtgattagcctgaatgtgagtgataacgtggccagttggggaatgctagcatggttgctatttaccttctatcctgcatggcaagcaagtcggctgcataaacaggcgaatgcgctgcgagtcattacgcaacaatatgatgatgcttggcggccaacgatgcacgttttcttgaaaaacatgtccactgagctggatacagaaaaagtggcaggtctaggggcgtgggcttacgtcggtcaagatcatcacgggatgtactggtatgacttgaagacgctggcaagtgctgcggaaatcaagcaatcgctacagctaattgtggaagatagcgtttctgtatcgattgtaagttggctgggattggcaccaattggatttgtttaaacttttaaaatggaagtggtaggtatgtggcggcatcgatttttgatcaaaggttctgaacaggagttggcatggctgaatgcgcaagcgcagcgacgctatttattgatggctattcatggaaattggtatcagtttaaaaaagtgccgacggtttatcgggtctttagtgagtatgtgccgcaagcaatcgcggctgacatgagcaacagtaacagcgcgtttcaagttctcgcccaagtgcaagtacagcaaccagatgttcagattgtgtataccggcagcgaccaaccagcattacagcaaacgacaatggcaccaactgatcctaagattcgtttgcaagtagctttgcagttacgtgatcgggcgatgaatacgatcaacctcagtctttatgcaggggttgtggtatggggattgtttttgattctgatccttcatcggggtgatacagatttaataggcatctggatgctaatgctgttagtaggacttctcgcggtattaggactgtatcggacggcgcatcgtttgcagaatcaaatcagccagttacggcgtgacactgaacagtacgacggggcctggatgccgacgatgcacgtttttgtgagtgcattgactgctgatcttgacaccgagaaaccggcattaaagtcgttaggtcggtggaccttagttggtcatagtaaaaagggccagtattggtatgatctgcaaacgctagccaatgcgatagaaattaagcagactttacgaccatttgttgcgactgacactaacgttaacgttctgagctggttagggctcgcgccactgggctggtttgtgtgattggcaataattgtttgtacaattaacatataaaacgttagactattctgagactaacgttttttttgtgtttaccggtctgatgataatataaatgataaaaagtgacatataatcataatagtagtattctaaataaaagacaaagctggaataggttgagtgttagttaatcagctggaaattaatggatattgcgcgaattttactataaaagtttttttattcgtcacaaatatttcatataatcgggttaacttaaatagtacaagctcgattgtgttgaagacaattgagctgattacacagaaagcttagtgaggtgattttgatgcgacttaaggatttaactggtgagactttcagccgtttgaccgttatcgaacgggctgaaagtgcgccgaatggtaatgcacggtggttgtgtcagtgttcatgtggacgacaagtagttgtcgatagttatcggttacggaaagggattacgaagagctgtggctgtttacgggcagatgttagtcgaaagaatatttttgaaaatccgcaaacccgtaaaaatatgggacgtagtgataacttaccgctttatcaaggaacttcggtcgatcgattgaaaccgaatagccggaatcggagcggggtcattggtgtttcctttgaccgatgctcacagaagtgggtcgcacggttaatgtatcggggccgcttagttttgaatcagcagtttgctgatatggatgatgccatcatggcacgtaagcaagcagaacaacgctacgttatgccagtgttagaagaatatgcgaaatcaagcgcggattaagatgcgtacataattagcatgccaggagactggtgtgctttttttgcgattattacccgggaaataaacgagttagattaatacccgtgaggaccgattatttgtgtttattgatcaaactagttagacttaacgagcaatttaaattagaacggaggaactttgagcatggaaatgggattagcagggaaacgggtcttggtcactggttcgactaagggaatcggacgggcaattgcggtagcatttgccaaggaaggcgcggatgtggtcattaatggtcgccgcacagatacggtggcagcggttgtggatgaactcgcagcggcatacccaacaactcatccagtggcggcaccgtatgatattagtgatccgcagcaagctgacaaaatgtttcaacaaattccaacggttgacgtattggtcaacaatatgggaatctttgggccaatggcttacgatgagattgacgatgcaacttgggaacgcttctttaaagtgaacgtgttgtctggcaatcggttggcaaaacattatttacctgcaatgttagcccaagattttggacgcattatctttattgcgagtgaagaagcagttatgccttcgggggaaatgccccaatattcgatgactaaatcgatgaacctttctttagcgaagagtctgtcgaagttaacagttggtagccacgtaacggttaacacggttatgcccggctcgacattaacagaaggtgttcagaaaatgttagatgatatgtatgctgattcagatttgccaaaggatcagtgggagcatgactttatgattaatcatcgaccactatcacaaattcagcgtttgattcggccggaagaaattggtcggttagcagtgtttatcgctagtccgtttgctagcagtttttctggtgaagcattgcgggcggatggtgggttagtcccaactatcttctagtggctaatgaagacgatatatctttctggttctgccatagaaattcagatgtcaaaaaactgttttagcgagtaaagtttatcgccaaaacagtttttttgttgacttgactagcctcagaagccagtttcaagcggattagatgtttaaaatgaaatttttaactgattgactggctagtcattgacttactagtcaacggcgcctatgattgcagcatcaacaataagatgctcgaatttgaaggatgggagtgagtcatatggataaagaaccgttattaaggattagtcacttgcaaaagcatttcgggaagtttcaggctctcaaggatattaattttgaaatcaacgcgggggaagtttttggatttatcggtccgaatggtgctggtaaatcaactactattcgggtactacttggaattttaaaagctagtggtgggcaggcgacgatttttggtcgcgatgtctggcaggatagtgtggcgattcataagcgaattgcttatgtgccaggcgatgtttatttatggcctaatctaagtggtggggaaattattgacttgtttcttaaactaaacggtggtcagcatacggctaagacggacgcgctaattaaacaattcgaactggatccgcgtaaaaaagcgcgcacttattctaaaggtaatcggcaaaaggtggccttgattgcggcactctcaacggatgctgatctatatatttttgacgaaccaacgtccggactggatccgctaaatgagcagacgtttcaaaatgaagtattggctttaaaacggcgagagaagagcgtcctgttatctagccatattctgtcagaagtggaaaaaatgtgtgatcgcatcggtattatccgtgagggacagattgttgaaacggggtcgttagctgagatgcggcacttaacccgaaccacggtcgatgtgcaaacacgactgcctttggctgacttgaccaccctagctggtgttcacggggtcacagcgcgccacggagataaccacgtcagtctagccgtcgatgctgaccagttgacgccggtagtgcagtacttggcgagtcggaaactgatcagcttaacaacgaccccaccaacgttagaagatttattcatgcgctattacacgaccgaacaacaaccggtgaaggggaagtgatgctgatggcaacacaactatttgctcgtaccggattactgatacggttcaacttacgacgagattggaaaaagttgctcatttgggtcgtcgtgttgacggggctattcacggccatcgccgcgaagtttgatggtatttatggcactcagatggcactgaatgaaattgtcaaaacgcttaaaacgcccgcgatgatttccttatttggtgcgttttcggccaaatcgccatatacgacggccaaggtgtttgcaactgaaatggtggtttttatggccatcgtcatgattgtgatgaatatcatggtggccgtggttacgacgcgcggggatgaagatgatggcctgctagagctagtgcgtgcccacgcggtcggtcggttagcaccactattcgccggggcagctgagttaacggcgctaaatggtttgattggttttctttttgccctcgggctgaccgtcgccaagcttccgggagcgacgacgccaggtaattggttaattggtctgggcttagggggcttaggctgggcttttggaatgttgacgctgttacttgcacaggtaatgactagtgcgagtggtacgacgatgctgagctatttgctactgggcgtcatgtacgttgcacgaatgggcacggatgttaaccgtccagacctgacttggtggatcccctttggttggattgaaaaattagatgcgtatcaaaccaatgattggttaccaatcggtctgtatgtattactgggtcttggttgtttaagtttggctgcagctcttaatgcttatcgggacttgggcgcgggcttagtcgaatcacggcgcggtcggcgacaggctagcggtttgttgcggggtcccgtgaccctattatggcggcaggcacatggtctgattattgcatggctactagggaactttatcttaggtgccgcgtatgcgtccgtctttaatacgattggcgatctggcaaagagcaatccaatgatcaaacaactgctaggtgcgttagctttagcagcagcgaatcgcttgatcgtcaaaaatttcattgctgtgttggctatcgtcatggtgatcgttgcactggttccagcagtacagttaatgctcaaactggtcaatgatgaacaaaaaggctatctacatcaagtttatgcgacggccacatcacggtggcacgtgtgggcaagctataccggctgggcaatcgtaacgggactgctcgttttacttgccggtctaagtggtatgtatttgatgggcctgacgagtatggtcaagcccatcagttgggtgacctattggcacgtgtttgcggcctatgcaccggcgatgttagtgatggtagcggtgacgagtgccttagcgggctggcgacctaaatggcggtatgctgcgtggatctgggtattttacgccttcttctcattgtatcttggtaatttgattgatttgccaaaatgggcacgccgtttaacgccccttggctttgttaacaaggtaccaatcaagcccttagatggaacgacaagtagctggtgcctgttattaactgtgctaatattagtagtagcagcactaagttatcggcggcgtgatctagctcagtaaacgaaaggagtgcgtgacatggcagtaaaacaacctgttcctaaagacccggcgaaggtcgagcgtattatgcacgcggccatgcacacctttgccgtcagtggctatcgagatgctaaaacggatgtgattgcgtccgcggcaacggtgtctaagggcctattatttcattattacggtagcaaacagcgcttgtatttggccactgttcagcttgctactgacacgattattgccaccattaatcaacaagtttttgatgttccagatgacctagtcacgttgatggtgcggagtgcgcgttacaaggcggcgtttggtaaagaccacccggatgaaatgaaggtcttgattgacgcgtatggcgcgctggagcgcttgccggtaaagatacaggcacaaatgaagatcctgtatactaagtcgatgactatttcccgggaaatgatcagtcaggtgctggataaaatgacgctgcgtgcggatgttgatcgtgatgcaacgattgctttgattatgggtgtttacaatcagatttttatggaatttcagacctatatgcgtgagaatcatcaagttgaatcgatggccgatatcgaatgggtggtcagtcgcgcaaaaacctacatggcgattttagaacatgggtttatggcggcagatttagatgaccagcagtaataatacgtatttcaacagtcgacggatgtttaatccggacgactgtttttcgaccggtggattcggcagcgttcaatagtgataatgtttattcgcttttttcgttagcaggctaaaaatgtggtaagttagacttaatagatgacggatgaagtgagggatcggaatggaattacatttaacggcacgacagacgggattgtggcaacggttgatggcactggcacgtgagcaattgatgggactcgccatgcagatggagtcgactgggaaagtcgatcgaccgacactgacaacgcttgcccagcaattggctttggacgatccactaccagatgaccgcctgagccaacgggttttgagtacattagcgctggcgcaaagttcagctgggctcgctatgagttttgccagtagttggcaagttgaggatgcaatattaacgtttggaaccccgcaacaacgccaacggtattgtgcacaatcaggtgtttttggactcgcggcattaccggaacaagtcatggctagtagtaccgtcaaagcaacgccggtaacagctggctggcaactgtccggtgcggttaaaacggtattgaatgttacacaggcaactgagtatttagttctcgcacagacaccaccgaatgctacaggggcctttgttattagtgctgatcagccaggcgtcacggtcagccaaccaataacccctttagggttacacggattgaccatcgcggatgttcaactcaccgatgtcccggttacggccgctgatcaaatcggtcaattgggacaaggacaacgagtgatgcaacgggcgcaaagcttggggcaattatttgccggggcgattacagcgggaatatggcaacatgccacagaccaggcacgacagttagcgctgacagaacagccgccgttaactgccttggcgccagcaatggcgattacggccgccttacagactagtgtctacaatgcggcccaacaggccgatgatgagcgcccatttacagacgcagcgcaattggcggcaatgtttgccagccaaaatgccttggcgccgtttaaaattttgatgccattgatcggtgatctagcctatacgcaacactcgccgttaagtgccttgcaaaatgacgtggcgacactaccgttgattgttggcacggatacgcaattggcgttgacttttgccacgacgagcctgaatgacgaagtggccgatgtcccgacaacgggaccccacacagctcctgagcacctagtcgtggccgacctacatcgggtcgtaaaacgcttgaatttgactagggatgtgccagtcaatgtcggcagtattgctacggcgaaacgcgtcgtggcattaggtcgaggcgcgatggaaccggcagtattgcttcaagcccaacaattggccaagtggattggtgcagcattggctgttacccagccgctaacggctatggaacaatttagcattgagcaacaaattggtgcctcagcagtgacggttgcgccagaagtcttgatcaacattggcgtcgctggtgatgatgattacttggctggcatggctggtgcgcaacacgttctttctgtgaatacggatgaacaagcgccaatcttcaagcattcacaacaaattttcgtgggctgtgccgctgaatttttggccggaatggtggcagcattaaattaatacgaagtcgagttcggcactgttggtaggtctgacggggtcgtatgacaatcaattgtttgcacaaaaactaagggtcacagcaatgtactgtggcccttggttttttacttagctttaaattaagtaccaccagtcattacttaattaacgaaataattaatgactgccgtcacttaaagcgtgcggtgagctggttcagaatcggaatcttaaatagggcgatcaagataactgagtagcagacgtaggttatgacttcttgtatcatgcgcgttgttagcaaaacggaccatggtgttaagtacatgagatgaagccagaggctgtttagaaacaaattgagaataaagacgacgataaagttagcgacgagaacgcgtgtcagtgaagtttgatgttgaaaggcgtatccaaagactaacccggtcagaaaagcggttaggataaaaccaggaaaaaaggtgaactttgggaagagcagcattccgagtagggaggaaatcgcgctactgccggctgtaactagtggtgaaaataaacgggccgttaaaccaataataataaacgcgaaggatatcttggttagcaatagttgaattgacagtaaacttcctaagataagttgcatggcaattaaagcaccgagtaacgggatacgccgaaccgtgagtgatgatgtcataataattgaagccccctaagtgtgttgaatgtattttaggggaatttgttgagaattactagacctgaaattattggttataagtaatataaaaatatcactaggagaaacgctatgacgttatgtagcgtttctcctagtggtcaattaatccggaatatggcttccgttgggcatgggttgcagttatcgctacaatgttgataaaaggcagtatggaggcgtttgaatggcatacattacaaaaaagaagattgcacaagcctttcatgacgtcgtcctagtgaggggctttagccgaacttccgtgacggcaattatgagcaccgccgattttagacggcaaacattttatgattattttcaagataaatatgaattattaacctggtttattgatgacaccctgactgaaacggttgaacataatctgaattatttgccttggatcgacattattaaactagtttgttacgagttagatgcgaatcgtcaattttatgcagaatgtattaacacacagcatgaaattgacgtgacggcacttgtcggtaaccacttagccacgttattgactgaactaacgcacgccaatacaacagaaacgtcggccctaatctggttgctgtgcttgggaatcgcacaatcgttaacgcataatatcgttgcgaatcatcctgaagattatgaggtgctttctcagcacgctattgcggccatcgaaatgacactcgaaattttgaactagttaggccaagcagcagttttgacgggtcggtttagagcagttaaccagtcagggtcggctaggctgagtaaggttaatgacaacccatgcatcccgttagcagttaaaaaagttcccactttgttgaagtcgattgttagtgcggctaaggtgagtaattcgtgaacatcattattgaacaccatgagttccatgggcgttgtcccaccgagggagttaacgaaaacggcgtaatggtcgtcagcatgccacttaaagttgagacgtaatttactaattaattcctgtgcgagtcgttctgacgattgaaaaggttcacgccgataaccgggttccccgtgaataccgataccgtaataaatttcaccaggattcaagttaaacgatgccgttgactgtcctggaatgcgggcgccgctagcagcaaccccaatcgtgtgaatgtttggcactagggcggcagcgatgtgggtcaattcagcgatagaggccccctgagctgcagcggcaccaagaattttatgcactaaaatcgtgccagcaactcctcgtcggcgctgttttaaagattcatgatccacggaaatatcgtctgccacaatacatagaccagtttgccaatgttccttttgcagttgttgttgagcagccgtaaacgcactaacatctgctggaaaatttttaacaatgaaaaaaacgcgacgctggcgtgtcacctgttttgtgactttaacgatttcttgagatgtagggggttgaaaaaccgttcccatgattgcggcagttaacataccaggtccaacataaccccagtgtgccggatcgtgaccgctgcccccaccagcaattaacggaatctgatcatcttgaaagttgctgtcgtaacatccgaatgtatttggtacccatgttaaatttggataggcccattgaatgccctgagttgcttgactcagggcattttgaggttcattaatgatttgcatgggaacaccttcttatattgttaatttgattttattataacgcattcgaatgaccatgcttgtcagaagctggcggacaaaataacgaaactgtccattatttttgaaagcggattcatttacaattaacgtgttaattcgagaaaggaaggacaacaaaaatgaaaaaaataattaatgatcccaagaatgtcgtcgacgaaatggttgatgggttagtacgtgcctatcctcagtatttaactaaattaccggataccgaagcaatggttcgtagtgatcaagattcaatgcagggaaaagttggaattgttagtggtggcgggagtggtcatgagcccgcccacgccggctttgttggccctggcatgctcagcgctgccgtggcaggacaggttttcacctcaccgacgccagaccaaatttatgcggcaattaaggctgtcgatcaaggtaagggcgttttcttagtcgtgaagaattattctggtgatgtcatgaatttcgatatggcgaaagatatggctgaattagatgatattcaagttaaatcgattgtcgttgatgatgacattgctgttaaggatagtttatatactcagggtcgtcgcggggttgccggcactatctttatgcataagatacttggggcggccgcggatcaaggcgctgatttggatgatttagaaagtttagcaacgcatgttttaccacggattaaaaagattgcggtcgcattatccgcagcgacggtgccggaagtcggcaaacctggctttgaattggcagatgatgaaatcgagtttgtcgtcggaatccatagcgaaccaggttatcggcgcgaaaaaatcaagccatccaaacaacttgttcaggaattgctaggtaaattagatgatgaattacacctacagtcagatcatcagtatgcgttcttggttaatggtatgggagcgacgccattgatggatcagtatgtcttttgccatgacttgttggatgaactggcaacacggcacattcaaccggcctttatgaaggttggtaattatatgacttcgattgatatggccggtatttcactgacgatattcgatgttgctgaatctcaatggctagattacttacagtacccggtcaaaacaatcgcgtggtcataaggaggaattgagaatgttaacagttgagaacacaacagtatggctgaataagtttgctgatcagattgaacaacaccaaagttacctaagtgaattagatacgccgattggcgatggtgaccatgggggtaatatggctcggggcctagcagcagttaaggcagcacttgccacgcaaccagcagacataactaaactatttcaagcaacggcgatggcattgattagcaaagtcggtggtgcttctggaccattgtacggaacagctttcttagaaatggcaaagcaaagtaagattgatagcgatttaggtggattgttggccgctgcattagctgggattgaaaagcggggtggcgcgacaaccggcgataagacgctgattgatgtgtgggcgccggttgttcagacggtccaagcgggcgaattgacgcaggatgttatcgatgatgcagttgctagcaccgaaccgatggtggctaaaaaagggcgagcatcctatctaggtgaacgttcagtgggacaccttgatccaggtgctgtctcgagtggttatttatttacaacgttactggatacggagggaatcttatgagtttaggaattgtagttgtttcacacgtcccagaaattgccgcaggtattcagcgtttgttagggcaagttgcccaggacgtttcgattacgattgctggtggtacggatgacaatcaagtcggaaccagcctgaccaaaattacacaagcgtttgatgcaaatcatgcggatgaactcttggccttttatgatcttggtagtgccaaaatgaatctggaaatggccattgaaatgagtgataaaacggtccatttatatgatacggcactcattgagagtgcctacacggccgcatcgctattacaggcggctgtgccacttgcggatgtcgaagctcaattagcgccattaaaaatcaagtaggatggtgacgaaacatgcacggttttttaggtgaatttttaggtaccatggtgttaattgtatttggggttggtagtggtgccgccatgaatttaaagggtaattatgcacgccatcagaattggacgtttatttgcttggcgtggggcctagccgttacgtttggggtctatgttgccggacaatttggttcggatggtcatctaaatccagcggtgacagttggttttgcgttattcggttatttgcaaatggctaacgtttggccgtacttattaggccagttcttaggggcctttatcggcgcggtaatcgttattattcagtactacccacactttcaagctgccaaaacggcggcagatggcaatcaagttggcatttttgcaactggtccagccatcagtaacccggtatttaattttctaagcgaaacgattgcgaccttcttctttatcttcgtgttgttgaatctcggtaactttacccagggattaaagccattgatggtggggctgctcattgttgtcgttggtcagaccttgggtggaaccacaggctttgcgattaatccggcgcgtgattgggcaccacgattagcctacacgattctcccggttcctaataaagggttggctaattggggttatgcctgggttccaatgtttggtccattgcttggtggtattttggcagctggtctggaaacaattattagttaaatactcacaactgtgccgattttgttgggcacagttttttgttataaagtataattaaataaataatgcaagtttatgcaatcgcttgcaataacgatgaaaacgttttatatttaatgagatggattcaaatagatcggggggatcatgatggcaacgatcaaagatgttgcccagcgcgcaggtgtttcgccttcaacagcgtcacgtgcaatgcatggtagcaagattatcagtaagccaacacgtgacaaggtcattaaagcggcgcgggagttaaattacgcgccggattttaatgcacagaatttagcaactaaggctagtaatacaatcggggtggtactaccagtagatcatcacgaaatcttttctaacccatttttcttagagatgattcggggtatcaatgaagtttgtagtaagaatggcgcaatgacaacgctagcaacggggatttcaagtgatgaactggtgcataatattgatgtcatgattgcacaaggccatatcaaaacttttattttactgtattctgaaaaaaatgacccagttgttgagcgcttgaagcaatttgatgtccaatacgttgtgattggtaaaccttaccaagacgtcaataaaacatcgtatgttgataatgataatatccaagccggaacggatgcagcccaatatctaattgatcatggacaccggcgcattgggtttttgtattcggatttatcacggatggtgcaaagtgatcggatgcttggctatcaacgtgtaatgatgcaaaatcagttaccaaatattatgttggaagaacggtttgagactcatgcggcgggtgttaaaacactacataagttttttgaacagtatccagatgttaccgggtttgtggccgtagatgatatgttggcgttgaaattacaacaggttctccataatgatccgaactggaaagttaaacaattctcactgattggttttaataactccattttttctgatttagcgcacccgatgctgacatcgattgcggtctttccacagcgtttaggtgaagaagcggccaagattgcgatggctgaccatcctgctgatgaattatcaacggcagtaattgtgcctcatcaaattgttaaacgccattccgtccaccaaatcaagtccttacagtagtaagttaggggggtattttgattatgataacgctaaacgatgtcgcgaaaaaagctaatgtctcaaaaatgacagtttcacgagtcattaatcatccggaacaggttcgtcctgagcttcgagagatgattttaaatgtgatgacacagctagactatcatccgaatgcggcagcgcgagcgctagtagggcggagaacccgggttgtaaaattaacgatttttgaagacatggacacgacggaaccctattacatgatgttgctcgcggggattgcgaatgaattgaatcaacatcaatacgccttgcagattgcgacgcgcaatagctatgaggttggcgaatgtgatggctatattttgactggtattcggcaagccgattacgcatgggtcgaacgtcttaatcagccagtcgtctttgttggtagcaatcgtcagggatacgactacgttgatactaataattatcaggcggtctgggaaagtacacgttatgccgcggaacagggctatacgcatcttgtctttattggtatcgctattgccgaaccgtttgagctagatcgtgaacgaggttttcgagagtacgtcacgacacatcatattagcgctcagattattcgattagccaatcattcacacgttgcaactgcgtatgtgaagagccattggtctggttttccacgtaatacggcgtttatttgtgcaagtgatcggttggcgatcggcgttgaaacggcaattattaatcaaggtggtcgcgttcccatagaatatggcattatcggttttgatggcgtgttattaaatcagattgcagccaaacggttgacaacgatgaagcaaccgcttgaagcaatgggacgagctgctgcacggctattattggctaatatcaaccatactgatcgttctcgcgggcggcatgatcaagaaaaaatcatcattaattcacggttgtcggtggctgaatcgacccgttaaagaggagtctggataaatgagcaagcattggtatgatcaacaaacgatttatcaaatatatcctaagagttttaacgatagtaatcacgatggcattggtgatattccgggaattaccgcgaagattccctatttgaagcaacttgggattaccacgatatggttaaacccaatttatcaatcaccccaggttgataatggctacgatgtttcggattactaccaagttgattcgagcttagggaccatgacggacgttgagacgctcattaaaacggtccatgagcacggcatgtatcttatctttgactttgtcttgaatcatacttcagatcagcatccatggttcaagcaagctctcgctgatccacagagtaagtatcgggactactatttatggcaagatcccgcagccgatggtgggcgcccaaacaactggggctcatttttcggtggcagtgtttgggcgaaggatccggcaggcggctcacagtattatttccacttgtttgataaacggatgccggacctcaattggaagaatccggcagtgcaacaggcgatgcgtgatgttgctgagttttgggttgaaaaggggattgatggtctccggttagatgcgtttattcatctggctaaagcagattttcgccaaacttatccaaatcggactggtgattcgacacccatcattagcgatatgttttatgcccacttaccgaaagtgcatcagtacttacacgactttgtcgccgcaatcaaagctaagcacccggatacgtacgtcgtcggtgaagcgtcatccgctgacccccatttgatggtcgactatacgacactaggtacggatgagtgtgatcaagtgattacgttcagaacttttgcggacgacaatacccaggatgatccgagcttctccgacacatttcagccccgaccgatggatgtgacggcctataagcaaaatacggtcggtattcaagcggctttagcagacaccagtctaccaacactttactggaataatcatgatatggctcgggtcgccacgcgttacggtgatcctgattatccgcaagcaagtgccaaggcgttagcgacggccctgtatttgcagcgtggcattcccattatttattatggggaagaattaggattaacaaatatccgttatcatgatattgcggactttgaagaccagacggtacccacctttgttgcgagcgctcaagccgctggtaagtctaaggtggaaatcatgcggatgttgaatcaaactcataaaatggcggggcgcggccccatgcaatgggacaatacggtttatcatggtttctctgaccacttaccatggaaacatggtgatactgatgacatgaatgcgcaagcagaaatcgctgaccccgacagtatttatcactattatcaacagttgctgcagctaaagcagtgcgcaccctttactaatggtcagttcattatgctcggaagtgctgaacaactctttacctacctcattgatgatggtcaaaaacaagcagcgatagtttgtaatttaagtgcgcaagcgcaaacgtatctgttgccgtttgttggtggtaaagtgttgcttgtacagggtggtgcaacatataggggacgccaagtgacgttaccagcttggagtagcttagtcgttaaatcggcataagcaatgtgagtgcatgattatcctaaaattggtatatataaatcatgtgatgtattttaattaacttatcaatctttatataaattggtataaaggttgatggaccaataaatcctaacgtttttaagcgttaggatttatttttggtatgattctgttaacgttaacattacgaaaacgcttgcgaaagcgtttgcacagttgcataataaattatggtaaatgaattaagatacttcgcaaggaggaagcactatgagtacttggaaaaagttggggatgggtgtcctagccactggtttagcactcacgctcgtaggttgtggtaatagtaaatcttcatctagtagttcaaagatggacaagacgttaaaggtttcagcggatccttcatataagtcatacatgaaatcggtgattccaaagtttgaaaagaagtacaacgttaaggttaaggtttcatacaaggccatgcttgatgaagacgatgctttgaagctggatggtccttccggcaagggtcctgatgttttaatggcaccatacgaccgggttggtcaaatggcgtcacaaggtcaactatcaacagtcaagttgaccagtggtcgttacaacgcaacggggaagaaatctgttacttataagaataaggtttatgcagcgcctgtaacgatcgaatctgacgttctgtactacaacaagaagctaatcaagactgcacctaagaacttcaaggaacttgaaaagttagcttctgacaagaagtatgcttacgctaatgataagactaagtcagttgccttcttgactcaatggacaaacttctacaatgcctttggtgtcatcaaaggttatggtggttacgtctttgctgatggcaatacgaacgccaagaagatgggcttgaacaattctggcgccgttgaaggtttaacttacatgacgaagtggtttacgaagtactggccaagtgggatgcaaaatgtcacttctaacgaaaactttgtgacctcacaatttacgtctaataagactgctgctgttattgatggcccttggatggctgcaacttacaagaagtctaatatcgattatggtgttgctgttttacctaagttgaataacggcaaagattatcaagcgtttgccggtggtaaagcttgggcaatctcaaactactctaagcataagactgctgcacaagcttggttagacttcatctctaacaagactaaccaaaacaagctttacaagtctgctagtgaaattccagcaaacacagctgctcgtaaggaagctgtaagtactggcgatgacatggctacggccgtttcaaagcaatacgacaaggatgttcctttgatcaacttaccacaaatgtcagaagtttggacaccagcacaaacgatggttaccaatgctgctagcggcaagatgacaccaaagcaagctgctaataaagcgcaaaagacgatcttaactaatatctcacaaaagtatgataagtaattaaaattgtaatttaagggggctgaaacaaaattcgttttgtctcagcctttttaaaaggaaaaatgcacgatatttagaatttatttaggaaaggggtgcgggcgacatgcaagtcaaggatgtaaagaaagcgcaacgcctgtcaattattcccgggctcggtcagctgtataacggtcagaccataaaaggtgttggcttcattattattctattggcatttattgctgagttcatcttcgggggctttagcgcatttgccaatttagtcacattgggttcagtctcaatggaagacaactctttgttcatgatgatctatgggacgttgcagattctattgacaattgtgtttatcgtattttatattgcaaacctttacgatgcgaaacacgttgcacagttaattaataatggtaaaaaggtctcccatacgtttaaagagttaggtgcgagtttagtagatggtggctttgcttatttattaaccacaccggcctatattttaatggtttttacgattgtgttcccagtattggttacactactgatggcttttacgaactatgattttgcgcatattccaccagctatgttattggattggattgggttcaaaaacttcacatcaatgttcttcttgagtagttaccgggcaaccttcaacgctgtttttggttggaccgttatttggaccgtatgtgcaaccacgttacaaattattattgggattgccaccgcagtaattgctaaccaaaacttcatcaaaggtaagcgcttcttcggagtgatcttcttgcttccttgggcgattccagcgtttgtatcaattatgagtttttcaaacatttttaatgattcagctggtgcgatcaatgtgcaggtcatcggcttatggaatacgttagttccatttgctcacattgcgccgatccactggatgacggatacgttctggactaaagttgctattattatgattcaaggttggttaggattcccgtacatttacgttatgattactggtatcctgcaagcgattccagaagatctctacgaagccgcaacgctagatggtgcgacagtaatgcaaaagttcaacaagattacgttgccaacgatttttgctattgcagcgccaatctttgtgacgcagtatacgtttaacttcaataacttctcgatgatctatctgtttaaccaaggtggccctggtgatgtcggtgctaacgccggtgggacggatatcctgatctcatggatctacaagttaacaacggggacgtcaccacagtattcattggccgcggccgttacgttgattatttccgtcttagttatcgggatctcattgattgtcttcaagaagacccacgcgtttgaaatgggggactagtgttatggataatgcacaagcagtggcacctaagaatgccaattcaaagcaaaatagcgcgcgtcggcaccgtttctggaaagaattctttacgtatctgtatatggtcattctcggaattattattatttatcccgttttgatcacattcatcacggcgtttaaggatgctaacgtgcaagccttcgtccttgattttggtggtaagtggacgttggttaactttaagaacttatttacgcaaaccctgtatggtagctggtatttgaataccatgattatttcagtctcatgtatggtcattcaagtcatcgttgtgacgttagccggctatgtttatagtcgttaccgttttgctggtaaaaagttcagtctaacgtttttcatcgtaattcaaatggtaccaaccatggccgctttgactgcttactacgtcttagctaacatgttgaacgctttggaccattactggttcttgaccgcaatttacattggtggtgggatcccacagaacacttggctgatgaaaggttactttgacaatgttccgtatgatttggatgaatcagctaagttggatggtgctggtaatttcaagattttctggtcaattgtcttaccattagttaaaccaatgattgcggttcaagcgttatgggccttcatgtcaccagttcaagattacctgatggcgaagttcttattgacgtctgaatcacattatacggttgccgtagggctccagacattcattaataacgctcaaaatcaacaagttgtgctcttctcagcgggggcaatcttagtcgcgttaccaattgctgccttgttcttctacttacaacggttcttcgtttcaggattgctcgctggtggcagcaagggttaactcaaatattagtaggggtgaaattagatgcagagtacgaaaaacaaaacaaccgcctttccggtccggttttttggcagcctcttctcacctcgaagaatgtttgccaaccgtgatcagtttaattggttacagattattgttttatttatctttttgaccgcggtaatggtcatgccgattccgttttactataatcaccaaacgaattttaatctgtcaccatttttaccacacattgataaaatgatggccagtgatcagatgcaaacggcaatgaaaactgcgaactaccgtgatcagcggttcaaggatgtcaaacatcaaatcattattaaaactaaggataatgttgctggcttcgatctcacgaacgatgatatggcaggacgcaagaatgtcattaatttacatgctagtacgtttcaagtgaaatcggtcggtagtgaatttaaagccaagtatgtgccaggccataacttaaagacaaacgctcatgcgtttctggttaattcttggtatcaaagcaataaagtgatgattggtctatttatgctcatggcacttggattaattattgtgggggtcaacctgatcctcgtaaatggggcggcgttcttcttattcttgtcacgacataataagatcacgcatattcggaatttccgcgaaggcgttaacttaacgttgatgatgatggggattgggagtctgttagcgatggggattggcttaattcattttgatgtcaccatcgaattgaccgtgcagtccctcagcttggccttcgttgtgttgtgggtatatctgaaaacaaaattcaaagatccggaagttgaccaaaccatgttgctttaggtcaattagtaagcatagaaatgaggaagattaatggcacgcgatacgcaaacgcaattacgcaatgagatgatttactcagtctttgttagaaactactcagaagcttgtaattttgctggcgtaactgctgacttacaacgaattaaggatttaggaaccgatattttgtggctactgccaatcaatccgatcggtgaggtcaaccgtaaggggacacttggttcgccatatgcaatcaaggactaccgtgggatcaatccggaatacgggactttagctgactttaaagcactcacggatagggcgcatgaattaggaatgaaagtgatgttagacattgtctataatcacacttcgcctgattcagtcttagcaaccgaacatccagagtggttttatcacgacgcggatggtcagttgacgaataaggtcggcgactggagtgacgttaaagacttagactatggtcaccatgagttgtggcagtatcaaatcgacacactcttgtattggagccagtttgtggacggttaccgttgtgatgttgcgccattagtgccacttgatttctggcttgaagcgcggaaacaggttaatgcgaagtacccggaaacgttatggttagcggagtcagccggcagtggttttattgaggaactgcggtcacaaggctacacgggtctgtctgacagtgaactttatcaagcttttgatgtgacatacgattacgacgtcttcggtgattttaaagattactggcaaggacgcagtacggtcgaacggtatgttgacttgttacaacgccaagatgccactttccctggtaattatgtcaagatgcgcttcttggaaaatcatgataatgcacgcatgatgagcttgatgcacagcaaagctgaagccgttaataacttgacctggatcttcatgcaacgtggtattccgttaatctataacgggcaagaatttttggccgaacaccaaccatcattgttcgatcgggacaccatggttgcagatcgtcatggggacgtgacatcactgattcaaaagctagtgactattaagcaactaccattactgcgtgctgcggactaccaattggcagtcgtagaagaaggtatcgttaagattacttaccgtgcggctggcgaagcgttaacagcctggattccgttaaaaggtcaggtcacagcagttgcgactaagctagcagctggtagctatcaaaatctgttaacagatggtcctactgaagttgtggatggcaagctgacagttgatggtcaaccagtattaattaaatatgccactaatacggcggtaactaaagttgctgaccagtccaattagctgattaatagctttgagtaatcgatcaaaaagcaaccgtttgcgggcgattgcacgtgtaatagtagtttagaagtgagaaaacaagggagtggatttcgatggttgaaatgaatctcgatcacatttacaaaaaatatgagggtaacgataaatattcagttaccgatatgaatcttgatattaaagatggggagttcatcttcttcattggcccatctggctgtggtaagtcaacgacattacggatgattgctggcttggaagacatcactaagggtgacttcaagatgaacggtcaagtcatgaatgacgtggaaccaaaaaatcgtgatatcgcgatggttttccaaacttatgcactatacccgaacatgtcagtctttgacaatatggcctttggattgaagattcggaaaacttacagtaatactgaaatcaaaaagcgagtggataacgctgctgagcaattgggcttaaccgattatctacaacggaaaccagccaatttatctggtggtcaacggcaacgggttgctttaggacgggccatcgtccgggacgcggggacgttcctattggacgaaccgttatctaacttggatgctaagctacgggtcgatatgcggactacgattgctcaaatgcatcaacgcttgaagaccaacatgatctatgtcacccatgatcaaattgaagcgatgacgatggctgatcggatcgtcattatgaatgacggtaagatcatgcaagttgggacaccgcacgaattgtataacgaaccggttaatcaatttgtggctggcttcatgggatcaccttcaatgaacttcttcaatgccaccttacatgatggtcgggtaactgatggtgagggactcgacgtagctgtcccggaaggtcaattgaaagttttaaaggctcaaggctatgaccagaaaaagatgattgtgggtatccgaccagaggacattcatgctgagcaaattgcgcttgaagcgatgtcagattcaattgttaagacgaaggtcgtcgtttctgaattcttaggtgccgaaagcatgttatattgtacagctggcaaatctaaatttactgcccaagtggatgcacgtgattatcataacccgggtgagaatgtggaagttgcttttgaaatgtcgaaggcccacttctttgattctgaaactaaagatgttattcggtaatttcgaacgacggaggagcaacaacaatgaaacgtatttttgaagtagatccgtggcacgtcattagtcatgaactcgtaccgacggataagcgattgcaggaaagcatgaccagtattggtaacggctacatgggtatgcggggaatgtttgaagagcactattctaacgataccctcaaagggatttatatcggtggggtctggtatcccgataaaacccgggtcggctggtggaagaacggttatcccgattatttcggtaaggtgatcaattcggtcaatttcatcaaagtcaatatcacgattgatggtgatcaagttgatttggcgaaggacacagtcagtgactttacgttggatcttgatatgcatacgggaattttacggcgttcatttattattaccaagggtgaaaagcgcgtccaattcatgattgatcggttcgtcagcgttgcacaaaaagagttatttgatgtgcactatagtgttcacaatttgggtgcggaaccggtccaaattggatttatttcgcaaattgatgcggacgtcttcaatgaagatgcgaactatgatgagcagttctggcaagtgctagacaagagtcatgcgattactggtggcagcatgtttgcagaaacgaagccgaataacttcggaacaccgcgctttacgctcggcatgcagatgcttcatgaaacggcttttcgaggtattaacgccccagaaaccgaaaaggcagttacaaatatcttccggggaacgttagcaccggatgaaaccaagaattttgaaaaacgagtcctcgtggtgacttcacgggattacgcggatatggcggcgatgcggactggcttagccgaattaagtgaaacggtcagcacacagtcatatgaggacttacggcaggcccatgttgatggttgggctaaacgctggcagttatctgacgtgttgattgacggtgacgatgcggcacaacaaggcattcgcttcaacttattccagttattctcgacctactatggcgaagataagcgcctgaacctggggccaaaaggctttactggtgaaaagtatggtggtgcgacgtattgggataccgaagcgttcggagtaccgttctacctttcattggcgaaaccagaagtaacggagaacttactggaataccggtataatcagcttgctggagctttccataatgctaaaatgcagggcttggctggtgccttgtacccgatggtgaccttcaacggaattgagtgccataacgaatgggagattacgttcgaagagattcatcgaaatgggtctattgcgtatgccatcttcaattacacacgttataccggtgatgagatctacttgaagactaaaggaatcgacgttttgacggggatttcacgtttttgggctgatcgggtccacttctcagaacggaaacaacagtatatgattcacggtgtcactggtcctaatgagtatgaaaacaacgtgaatgacaattggtatacgaactttatggcgcgctggacgttagaatacacgttagcgagtttgaagaaagtggatgccgctaagcgtgcagcacttcaaatcacggatgctgagcttgcaaagtggcaagatattgttgaccggatgtacttcccgtatgatgaaaaattgggaatcttcgttcaacaagatggcttccttgataaggacgtcaagccagtttcaagtattcctgctgatcaacggccaatcaatcaacactggtcatgggatcatattctacggtcaccgtatatcaagcaggcggatgtcttgcaaggaatctattacttcatggataaattcacggcggaacagaagaaacgtaactttgatttctatgaaccgttgaccgtccatgaatccagtctttcaccagccgtccatgccattctagcagcggacttgcattatgaggataaggccgtggaaatgtatgaacggacagcccgtcttgatcttgataattataataatgatacggtcgacggcttgcatattacgtcgatgaccggttcatggctcgcaatcgttcaaggctttgctggtatgcgagttaaggatgataccttagcctttgcaccgtttgtgcctaaagcgtggacccattatcaattccacgttaacttccgcggtcgcttgattaaagtggatgtcgatcaacagggtacgaccgttgaactggttagtggggaaccactgactatcgaacttaatgggcaagctatcgaggtcgctagcaccgtaacaactaagtaaatatgaacgcttgattgtggtctgaccgtacctggccacaatcaagtttccaacctaagaatgagctcaattcattccaacctaacttctaaatcggtccgtatcagctgatacgggcctttttagtgtctggacataaaagagtccctcacttggaaatatcgatttccaagtgaggggctcggctgttctattcaaatagcatcggtagggttatttgagtgtttgcgtcaatcctagcacgtccatttcgtaaatccgaacggcggtgtcagcaacttgggttggtttatcgacgactaaccggacgtagcgcgccgaagtagccgcgaaagtattgagactagtggcttgcgtgttattgtaggtccgggcaacgtccgtgtagcgtttgccatcagtgctgacctgaatggtccaagcgcgggtgttcatatcagcaccttcgccaccagctttggcatgcgctaatttaaccgcactcacagtcgtttgacggcctaaatccagcgtcaaggtatgcggtgccttaccggttgcacaccatttagtatcgagtttcccatccaccgccattttaggtgcttcactactattcgtgtatccggaggcactggtcttggcgttcttggatagtaaggttaaagcgccttgagctttcggtgtaatcgtaatgagctttttcattgtaacgtgccgttggccatccttatttttagcggttaatgtgacgttataagtgccagccttacggtaagtgaccgtggggtttttggcggtgctggtcgtctttgtggcaccgtcaaattcccatttatagctggttgcgtttttggatgaggcatttgtaaacttgatcgtgttaccgggagctgccagggtgcggttaaccgtaaatgccgctttaggtttacgattatccggccattttaaggtaacttggtcagaagcatcgccacgttggttccaaatatcaactggaacgaccatcagattggtctcgttgtgctgcccattccgtttcaacgcgtttaaatagaaattagtcgtgttagtggcccccagaaatgagcgagaaccgtcattgttaacctgataaatttcgtaatgatccagcttatttttagtggtggcttgccaactcaggttgacaccggcgtacttgccttcttcgtcgaaggtccgattatcaatggtgacctggttgacctttttcggcgcggcctgctgcttgccggtaattgcgaggcgacctaattgaacgctgtagctagcatcagtctcggcggcactgattttgaggctaaggcctttgattgttttttttgttaactgactaacgtcatagctaacggtcgtccagtgcctgctgagtgtccggtcacccgcgatggtcttagtgcggccgtcctttaaggtcaccactagtttagctgtagatttaccagatgccttagcggttaaactaacctgggtatcggcagtgacgtctaggtccgtggtgtagagtttgattgtgctagcggtgtccttacgcattttgccggctaacttgatatcattgccaccttcgtaggcgtcagtgtagtcaaagctggcctttaacgcattaccattgccattattgattaaccagcggtaagtcggattgactgcttgcagtgagcgattgttccaatcacgtagcgaaacatttttccccttaatgaagtagttatagccattgcctaagctgaaattagtgacaaagggctgtttcgtaatggcactttgttcaaccgcgtatgttgaaacacccggccaatgtgttgaagtagttgacggaatgctacgggacggatcattttgatcattgacccacagagcaccttctttggcttgaaattcgtcaaccgtatcggaagaagcgtgtgtccagtccggtgcgtacaatcctagcgacgtgtatggcacatgttgtttattagcgaatagattccaacgaacgggggtagcggttccgtcagcttgaacatcgattcctgcaaagaggttgtaaggactaatcccaagcttttcggcgcgttcgtgtgactttttgagtaattcttgactggcgagacgcttcttcgtccaccagaagttaagaaacatcgagtcagcaactggtttcatattggcatcgactagataagattggttttctttggtcaatgcgttttgccaatccattttaccatccttcgtcatcgagtcataccacatcaggtctagcttggagccggccttttgtttgtattctttgattaactgttgcattagttgggcgtgctttttgctcagcccattactagttgagctggttgcggtctttccggtggaagccgaatcaaaacttttaacttcggggtcggtctcttggttgatgaaccagccgtcaaacccgtaagctttcgcaaccgcgactagtttatcagccatcggagaatgtccgtcagcatcttgttttaagaagtcattgagccactttaacttcccaccactaaccacttgtggaaagaaaacggttccaagaacgggcacgccgtttttatgagcagaatcgatgacatctgcggtcggtggcacaatcaaaccttcgcctgccgaaccgccccagtagacgagttggtcaatatactgccagttggagaagacattcgcatcgaacgtattaatcccgcgaggcgcgttgccactagttgaactattcataatggataacgcgacgaccttcatctttgggtcctgggtcttgttaaccgtcggcagttgccatttatcgatccgtttggctagtggaaccgaggcggtgttgtacttggctgctttatccttgctcaactgccatttcagcagttgttttggaaaccagtacggtgctacgggttgattatccatccccttatcaagggtggcctcagccgtttgacggtaactgatctgctgattagctgactgtttcgaacaagctactaaacctacagcagtcgttatcaaagctagtgtgccaacaatgtagcgatattgtccatgtctcatagcgatatcctcctgtgaactaagcaaaattgacatatccgcgttatgtgagcgatgattgcatgaatcgtaattaaaacgtggcctcgacttagatttttgactaccgcgctctggcaattggcagaaatgcctggaggtcggtgtagggtgaactaagcatgtttacgctaacccgaactctttccagcgagcctaagctgactgcttttgacgttaattattttgcctactttaatcatgactcatgacaaattagctagcacaacgcgtaaaatacaaaaatctatatattactggtatgtatgatatcggtttcagtgacagatgagtatagctaaattaagggaattcttccacaaattaaactaattgatagggtcaatcaattttgatgtaaggggaatgctgggtttcaacttgcgcgcaacgtgcgaatagttgaggattgttgcggtgccgatacaatttaacgaacgcgaatttttgcgtgatgagtggtatgtagtataataactagctaggaaggtgattatttattaggtagattgcaaatttaatc

SEQ ID NO: 12 - DNA, 54543 bp, Lactobacillus plantarum
gccgaaatgcctggaagtcggcttaggacgacgctagccaagcaagtttatgcaaaactcgaactttttccagcgggccttagctggttgtttttggccttatagcggcacctttcaacaatttttcgtgtataagtttaagccttcaatcccattttgtctgcgtgccaatataaataggctttccaagacatcgtccgtcttggaaagcctatttatgattagttgctcaccgataactggggtcactgaatgacaagtcctgccacgtcacgctagttttcaactttttgattaccaaaccatttcttgttgatcttatctaacgttccgttagccttcaacgtctttaggccggcattaattttgcgtttcatcgttttgtcacccttacgcatcccaactgcgaagtcttccgacttaaaggtgccttgcgtttcttggtaatccgcagagttcgcttcgtgcttaatataatagctcgcgtagacgctatcaatcaagagccctttaattcgtccagcattcaagtcgaggaaggcattcgtgaaggtatcgtattgaactggcgttttcttagcaatcttatccttcagcagtttcggattgttttccaatgactcatagcccgaagaacctgactgaacacccaacgtcttaccagtcatatcgtcaaatgagttaatatgatttttctttaaagaaacgaggacttgcttgttcttcaaataagtattactgaaagccaccactttttcacgttggggatttttcgtgtagccgttccaaatcaaatcaattgtgccattgcgcaattcggtcgcattcatggaccagtcaatcgtttgaaagctgatcttaataccgtacaacttaaagacggcccgggcgaggtcgatatcataaccaactagtttcccagacttttcgcgaaagcccatcgggacaaaactgtcgtccaaaccaacgacaacgtaaccgcgtttcttgattttagaccaagtatcttgggtgtcagcgcgtttagtcacattttgaccacagccacttaacgtcgttgccatacccaggagcatcacaacgatcaaactgagtgcaaataatcttttcttcattctgacgccccctattgcttcttggttggttcaacgtggaacatttcatccgcgatattttcagcaaaggttaaatcatgggtcaccacaatttgagtcatgccatcagcctttaagcctaaaatcaacttttcaacttcctgtcgtaagttcgggtcaagtgctgaagttggttcatcatagcataagacattcggtttcatggctaatgcccgggcaatcgccactcgttgcttttgaccacctgataattcgaaaggatactggtcagcgtgatcaccgagattcaaacgatctaataaagtctgcgcctgctgttctgcttctgcgctagactgctttaagaccgtggtcggtgctaaagtaatattctgcatgactgttaaattgggaaacaattcaaaattttggaatacaacaccaatcacactatcgttactccgattagtataggggtcaaatggttggccgtcgactaagaactcaccggcattcaccttttcaagccccgtaatacagcgtaataacgttgttttaccagcacctgaagggcccacaatacttagaatctcgccatccttaacggttaaattcaaattcttaataattgtccgtgaaccaaagctttttgtaatattttttagttctaacatatgatggcctccctatttccagtaactgtaatgtttttcgattcgtccaagcacaaaagtcgttacggctgtcagtgctaagtaaatgattccgactaatactaagggtaccaaagtaacatcgcgcgctgtcgcaacgttaccggcacgtaacaagtcgccgagaccaatgacataaactaacgatgaatccttgaccaagttgatgacttcattgccaactgacggtaaaacaattttgatcacttggggaataacgattttacgaatcgtctgccagtagctcagccgcaagacccgtgcactttcatattgaccattgtcaatcgactgtaacccaccacggaagatttccgcgaagtaggccgcgtagttcagaataaatgcgaataacgcggcgtagtaccgtggaaaaacaatcccaatcaacggtaagccgtaaaagacaaagattaattgcagtaacaacggggtaccacgcattaaccaaacgtagaaatgcaataaccattgcagcggcttgaagttagacattaatcccagaccaacaactaaccccaatggtagcgacccaatcagggtccaaatgaaaattttcagtgtcataacggcaccggataataatgatggcaaaatttctaaaatatactgcatgtactttccctcccaaatttacaggtcacattgtcctgcgtccactaatcggtcacgactcaagtacacaaaaaagtccccttgagtcgaatactcaagaggacggttatccgtggtgccacctcacttcgtaataacttcacagttattacctcagggagttttgtgataataaaaaaatcgtccttaggccagcatgcctaagaggacgatttaatcgcggttccacctcatattcactagttgctcacacaactaatctcaacgagtttatcactaaactccgccgctaacgaggccaaccgaaacagcttactaacttcagctgtccaactcacagatgtggttcgttgtaatccttggtcatcttcccatcatcgataactcgctcggcaaggtccttacaactactcttctgttccctgttttttaatgttgagttcatactaatcgaaaattaatcaaccgtcaagccttttttacttgccacgatgaaaaattccggcgattcgtgaccaaacacccggtttaggtgtatccaaattcattaatggcaccgtttcaccttcgattcggcgggcaatgttgcggtagccttgtgaggctggattcttaggatcaagaacgatcggttcaccgttatttgaagtccgaatgacggcatcgtcatcgaaaacgattcctagcaagtcgatcgataagtgatgcgtaatttcatcaatatccatcgtctcaccatcttgcatcatgcgcgtccggattcgattaatcactaacttaggtgcttcggctaacggatattgttccaataaaccaacgacccgatccgcatcacgaattgctgaaatctcgggtgtcgagacgataatagccgcatccgcaccagcaatcgcattcatgaaaccttgttcaattccggcgggacagtcgagcaaaacgtaatcaaaatctggtttcaactcgtctacgattgcccgaacttggtcaggattcaatgcatccttgtccgcattttgtgcagctggcaataaaaacaataagtcatcaaaccgcttgtctttgaccaacgcctgccgtatttgagcacgacctgcaactacatccacaatatcataaaggatccggttatcgagacccaaaataacgtctaaattccgcaatccaatatctaaatcaactaagcaaactttcttgcccatcaaagcaagggccgtccctaaattggccgtagtggtcgttttgccgaccccacccttaccagaggtgatgacaattgcttttcccatcaaacacgtcctccatttcgagtaaatagcttcggtcgtacccgttttaattgctggagcggctggtagtccaacgcttgaatgtcattaatatagacgacgttcgtcccatcaacaactttttcaagatccactaattctaacaattcaccgactcgaacccgcgggacggtcgctaaggggctaacgatcaccgcatcattgtgatcgggataaccggcctcaagcgcaccgtttacctcacccatcacaaagatactacccgtcgcccggagcaccccaccttcatggatcttaccgaagaacaacacgtcccccgtaatctcaacgacctgaccgttgcgaataatctgattaaccagatgcaccgtatcacgttcaatcatcgctaaagcatccgccgtcaaaataacatctgccgttagcttatgaatactgaataacggatatcgttgaatcaactgtgtcactttttgattttgttccgcagtcagtagtcgactagccgtatccaggtcaaacgagatttgtttatcagtcgtattatcagcctgcaaccgatccaacaagaccttcaagtcgaccataatatcatcgaaacttgcttcttgccgtaaaatcagttcatagccgtcattactggcctttaaaactacactctgttgcatgttagaattcctttctgccgactaattaacactcagatataaccgacgcattggataatataatatgacaaagatggctaggttgaccgcaatcgtcggtcctagcgtgtacaccgcaaagtctgctaacccactagagatcacatggctcatcgtgtaccaaatatacgtaaatgcttccaaaatggtcaaattaataatatagatcatcagtaacgttaaaaagttcaggtcgatccatggcttgatttgtcgacatatatagactaccaacggtaagccaatcatgtaaacgcctaaaatcccagtatagtaccagtcaaacaccaagcccacgaatgcagaccagattccaaccgacagattatcacggtcgtctaaaaagacagcgaagacaatccacagtaaaactaggtgtaagacactggcgtacgggtaactaaatagtttaccggcaaaaacatttgacaccgagccgtctaaaaagagtgcaacaaataacccaattggaaagatgatttttaatcttgagtaacgcaccgttgcacctccctactgttcagcgaccgtcacaactgttaagtcactaaggtccgctgcgggtgtgatttccacttcggatgctagcccgtaatcatcctgcttgacactagcaaccgtgccgacataaagtcccttcggcgtattgccgcctaaaccactcgtcacgactttatcgccttttttgattttaacgttagacgtcacggaacccatctctaaaagattattgctcttatcataacctgaaataatcccgttaacagtcttaccagcactattcgtaatctgaatagcaaacttattcgaagacgaactcgtattagaaattaattcaaccttagaattcgtttggttaacttccacgacccggccaattaaacccttttgtgacatgacaggcatattcttctttacaccggatgtcgcacccttagagatcacgagttggttcatccaagatgatggtgtccgcgtcaaaacattggcggtcaccgtcgtataatcagataacgaattatttaatttcaactgcttgcgtaactgcttgttttccgcacgcgtcgtctgggcactaaccttggcctgcgccagttgatcaacttgcttcttcaatttttgattttcttgataggtgttcaacaagtcagaaactgagttggtcgcactttgtaagccattgactggccaagcaatcacccggtcaaccgcaccagccacatcgtttccaaattgttggatcaatggtggtgtcgatttcttatcacgaatggctactgagacactcatcaagccgaaactaataatgaacacgacaatcgcaatcactagttttcggttagaaaaaaacttttgcataatgaacccccggtcgaaaattcaatgatttaacaataaataagcgggaagacgtcttcccgctcacctgttatcgctttttcataacgtcgatgctcttgagtgattcaccggtcccaactgcaacacagtcaagcggttcgttagcgatgaaaaccggtactttggtttcgtccgcaatcacttcggaaagattcttcaataaggcaccaccaccggtcaaaacaatcccgtggtcaattacgtcagaggcaatttctggggaagtttcttcaagggtttctttaatggctgaaataatttcagagaccacttcttggatggcttctgaaacatctacagatgagatttcaaccgtctttggtaagcccgacaaaagatctcgtccacgaatcgttgacccttccaagtcttcagcggcttccaaagatgctgagccacagtcgattttaagttgttcggctgtgcgttcaccaattaaaagattaaacttctggcgaacatggtaaatgattgagtcatcgatcttatcgccagccattcgaattgaacggcttgatacgatcccacctaaggaaattgtcgcaacatcggtagtcccaccaccaatatcaacgaccatgctcccagttggatccatgactggcagccctgcaccaatagcggctgcaaatggttcttcaatgacatatgcatcccgcgcacctgcaacccgtgttgcatcaataacggcccgcttttcaacttcggtaaccccacttggtacacaaaccatgacgtatggcttaccatttgagcggccgagtgtcttttgaataaagtacttcatcatcgcaacggtcgtatcgtagtccgcaataacgccatccttcattggccgaatcgccacaatgcttgctggggttctcccaatcatatcccgtgcttctgaaccaactgatacaatttcaccagttttcgtgttcttcgcaactacggatggttcacgtaatacgatgcccttgccgtcaacgtacacaattgtgttggccgtaccgagatcgatcccgatattctttgtcccaaatccgaacactacattcatcccttcatcattaacaaatttaattttttatttagtcataatagtaagtattatagcatagtcgcactgcattaaaaaagcattgcctgaatcctagcataccgtaaattaatgaaaaatacagtcccactatttaacttagataaaatttaacaaaaaaacgcgatcaggccgattaaattatcggtcctaaccccgttattttaccacattctgttacgaatccgtattacaatttaacacgccctgctcggcaaaactaaagtaatcgtttacaccgataataaagctatccaagagcggtaaccccatcagttcacaagccagttgtaaccgcttggtaaattcaacgtctttttttgacggcgtcacatcaccactcggatgattatgtgcaataacgacccgggcagtcggtgtcgttagggcaactttaataatttcccgcggttgagccggacaactattgagcgtgccctgaaagacgacctggcgtttgatcacttgatttttcgtatctaagcataacaattgcaactgttcctgctctaagttggcaaagtcccgtgctaaaacggctcccagttgttcactaccatatacctgccccaaaattaatcgacttggccggggtaatagttgcccacatctgagcgccacgattaaaccttgccagcgcggattttcagacgactcatgtaaccactctatagcgtcctctatcgggtactcacgctcaaaggcctgcatcgcgctagtcaccgcgtcgttgggtaaaaacgtcccaaagtaggcttgcattaattcacgaacttgtgctgtcggtatttgttcttcgctgatcatcgtcattgaaaccaccctttctacctagtagtttcgtaaagtgaccggctaaccattaattcaccgacattttaacgcaattttttcagttaactcacaatcatctttgataatatcagtaccaaggacgcagtattatttcttgcgcaattgtcttctaagcatccgtgtcagcccctaatcagtttctgagtcgctgccatccttgaaataagcccgtacgtcactaataaagtacagcgaccccgttagtagtaacgcatcatcactcgacatttcttggagtgtctgcatcaaggcagcttgccaattatcaaatacttcagcggtccggccatttggcatttcatgtgccaacatcgtcgggtcggtcgctggacgttttgcgttcggaccttcgaattgtgtcaaccgtaattgaacattaggtaatgcgcccaaggtctgaatcatttgttgatgctgcttatccgctaagaccgcaaagatgacataaacggtttgctgtccaaatcgctcactcaaagtagctgctaattcagttactgccggctcattgtgcgcaccgtcaatcatgatcagtgggtcctgattcaagcgttcgaaacggccaggccattgtgttgctgtcacagccgctttgacgtcgctagtgaccacgggtagctgagtcgcttggtggtaagttaggtacgccgctattgcaacggccgcattatcaacttgatagtctcccagtagcggagttgtcaagtctttaaaatgcgcctctaacccgtcaaagttaaaccgttcttgccagccttggggcggtaataatttggttgtaaaatcaactcccaacgtccgcaacggcgcccgtttgctcatggcggtatcaatcatcacttgctgtgcttcagccggtaatttaccaacaattaccggcacctgcgtcttaatgatacctgctttttgagtcgcaatcgccgtcaatgtattacctagaatttgcatatgatcataaccgatcgtagtaatcacactaacggctggtgtccaaacattggtagaatcgtataacccacccaacccaacttcaataatggcaatatcgattggctgagcagcaaagtaaagaaacatcattgcggtaatgatctcaaattctgtgggacccccacttgccaatgtcgcgtcaagcttggcaacgatcggttgaatctgttgcaccagaccaacaagttcttcatcgctgatgggggtgccgtcaacactgatccgttcattgaagcgaacaatgaacggcgacgtgaaagttcccaccgttagcccatctgccataaataattcgcgtaaattcgcaaccgtcgaccccttgccattggtccccgccacgtgaatgccggccacctttaactgtggatcacccaattcatgtaagaattggcgcatacgactgagtgtcggggcttttttgaactgagtccggccgtgaataaaggctaatgctgctgaataagtgtcaatcatgttggtcttccttcctgtaaaccgcgcgaatcatcatttggccgtttgctcaccatacttctagctaatgagcccttatattttacgttttaataataaaatggtaaccatcccaaaacgggacgattaccattttaccagtaacacacatttcagttaactattatcgcaaattaagcttcagccttaatatcaactaaacgttgctttaaggcagctagttttgtctgattgtccgctaacttctctttttcactattaacgacgtcttcaggggcattggcaacaaagcgttcgttacctaacttcttcgtcgcccgtgcgacttcgctttcaaacttggcttgttctttttcaagttttttgacttcttcatcgaggtcaacaagttcagctaacggaatgtaaacttccgcatcactaatcacttgtgtcatggctaacttcggtgcaaccacgtcggcgccaattgacagtgtcttcggatgtgcaaaccgttgaatataatcttcattagctttgaaaacagcttgtaaccgagtgttgtccgtcttaattaatagatccacggctgatgacatcttcgcattagcttctgctcgaatgctccgaacggccgtaatcaattcaataagtgaggccatatcactttccgccgtttcgtcatcaaattcaggatggtcaacaggataagcagcgactactaaggattcaccaacgtgtggcattgataaccaaatcttttcggtcacaaatggcatgattgggtgcaataaccgtaagatttgatccaagacataggctaacacgttttgggtattggccttggcttgagcgtcatcaccggtcaagacttccttactcatttcgatataccagtcacagaagtcattccagataaagttgtacaaggctcgaccagcttcaccaaagtcaaacttatcaaaggtagtcgtcacttgtttgaccgtcgcgttcaaacgactcaagatccacttatctgctaacgtccagtcacttgcagctggtaattccggtttgtccatggtgcccaggttcatgataacgtaacggctggcgttccaaatcttgttaataaagttccatgcagcatccatctttgtatagctgaaccgcacatcttggccggccgtcgacccgttagataagaaccaccgtaatgcatcggccccgtacttttcaatcacatccattggatcaatcccgttaccgagtgatttgctcattttaacaccatgttcatcacgaatcaggccatgtaaaagaacattcttgaatggtcgccttcctgtaaattcaagactttggaaaatcatccttgaaacccagaatggcaaaatatcatagccagtcactaaggtattcgttgggaaatagcgcttaaagtcttccgcatcagtgtttggccagcccattgttgaaaatggccaaagtgcacttgagaaccaagtatccaacacgtctggatcctgttcccagttttctggatcttttggtccatcaacaccgacatacgtttcaccggtcgtcttgttataccaagctggaatccgatgtccccaccagagctggcgtgaaataacccaatcatggatgttttccatccactgcttaaaggcatcttcaaaccgcttaggaataaagtcaacggcatcgtcaccctcttgattcttcaaagcttgttcggcaagtggcttcatctttacaaaccactgggttgagagccgcgcttcaacttggacatcagtccgttcagaatgcccaacgctatgcacaattgggtcgattttaatcatcaaatcttgatcttcaagatccttgaccatcgctttacgtgcttcaaaacggtccataccttcgtatttacccgcattggcgttcattgaagcatcatcattcatggtgttaatccgtttcaaatcatgccggttgccgactttaaagtcattcgggtcatgagcaggcgtgattttcaccattccagttccaaactcagggtcaacgtacgcatcggcgataattggaatttcacgttctgctaatggcaagatgacttttttgccaaccaattccttgtaacggtcatcactcggattaaccgcaacggcggtatcgcccatcatggtttcaggacgagtcgtggcaatttcaatgtaatgtttaccattgaaagtatagtctttgtcagcaaatgggtacttgacgtggtagaacgcacccttgtcatccttatgaatcacttcgatatcagacaaagccgtccgtgcttgaggatcccagttgatgatgtattcaccacgataaatcaagcccttgttgtaaagatcaacgaagactttcttaaccgcatctgacaggccatcatccatggtgaaccgttcacgagaatagtccaatgacaatcccatcttagcccactgttgtttgataatcgacgcgtattcgtctttccaatcccaaacttgttgaataaacttctcacgaccaagatcgtaacggctgatcccttgttcgcgcagtttggcctcaacctttgcctgtgtggcaatgccggcatgatccattcctggtaaccataaagtatcaaaaccttgcattcgtttctgacgaataataatatcttgtaacgtggtatcccaagcgtggcctaaatgcaacttacccgtgacatttggcggtggaatcacgattgaatagggtttagctttcttgtcgcccgaaggcttaaataaatcttggtctaaccaagtctgataacgacctgattccacggcggtcggatcatacttagttggcatatcagtagttggttcttctgacattggggcacatcctttcttttggcactaaaaaagtccactcatcctattagactaggacgaatggacttcgcggtaccacctaattttaaagccatcacaagtgatcgctttacagcttaaacatcgttgttaacgaacggtgtatcccgtccggctattcctactaaaacagttcagaatagcagctcgcaagctaccttcacgctaaaaccgccaagcgtgtttcactgttcacgctctctctgttgacgttgtttatcgctactctcttgctcattgctggttgtcactattgtaatgaatttcctgagtgccgtcaatccttattcgaattgttttagggcatccagtgccgcaacgtaatttggctcgtgactaacatctggcacgatttcatgataaacgattttaccggccgcatcagcgacataaatcgcccgggtcaacgtcccattgttgggcaagtatagattggtggcgtaaccaaaggatagttcttcatcggaagccaccgttaagttcttaacgccttccttagcgcaccaaccagcttggtcagcaaccgcgttattggaaatggctaaaaattgaacgtgggggtacttatcagcctgttgattgaacttctttgtttgaatagaacaaactcgcgtatcaatatctggcatcacacttaacaagacaggcttacctagcaagtccttagtcttaatcttttcatcatgggtagtgaacactttgaacttcggtaactggtcaccatcttgtaacggttcaccgactaagtctaatgcttgatcatgaaataatacttgcacgtaaaacaccccttcgataactaatggttttctaatatttgtggtagtaatagtatagctcaaatttaacgcaatttcagtttccgcgcaaataatcgtctcaaaaattatcattcttgacatgcgacgcgttatttgacgttagtcatggtttaaacgtgcttattagttggtttgttgttcgtcagccgatgtgcgtcctaacgtgccaacacgtgtgtacgccgatttcagtatattcaagcattaaaatgtggtgtcgtagccagctggagtgcaagttgggttgcacgttcgagcgaatcgtttgtttgttgttcccagcgggcagcgagtgtgttggccgggtcgtgcagactagttaagatatgttgggcgacttgcaacgcgtgtggttgatgtaaactggtagccatagtttgtagcgcgtcagctagttgttcgccttcagttagctgtcgagtcacttgcatgggggtttcgatggcaacttgttcgttggcgcgctgacccgcctgaatccaattatccgtactagctggcactggtaaccagagcatcagtaaaacgaaccacgttaagcaggtcagttgggacagatcgatgcccgcaccggcccatgggttcagatctaagttacgtaattccaagtattgaatcccatcctgacatagttgtgaatgaccaccagcatgacgcaaccgaacctgaccgtaaaattccttggtcgcacttaattttccattatcaacggccgcttgcagtgtttgacaataatcatttaacgacgcgtacgagaccgtaacacccggccgattggtatacccgctagaactgttgcgtaagcttcgaacgggctgggctggtggcgtaagaccagactgtggccagcagcatggtgagcagccataaagatacgtcagtagccagcgatagtgcaaataattctgcgcaatgtgcaggtaacagtgattttgaaaggtggtgaaatcacgactatctgtctgggcctgatacaatcccatcatcagactagccgccaagctcacattacagtgaacacctgacaacatttgacgtcgtcggccatagcggtgagcaagtccttgtcgataggcgacagcggccgcatccaacttagcgattggaatatcccggtcttctcgtggaagtgtgggcggcatgcttagcggccaaatcagttcaggcagaagcctttgccggacttgttgtgtgagcatcgttaaggcgtgcaacgcagcaaccgcacttgcttgcggttgggtgactaactccaactgtgtctccgcaaagtcccgttgcaggccggacaactcgctgataagtgttggtgataatgccgtatccgccaaatgaccggtcaccgttacccgctggccttcccgttccagcccaatctgaacaacctgtgcattgatcaacgccgtattttccattaataattgttgccactccatccactcacctcgctgattcaatctaaatttatcgtagcatagtcacgaccttggttcgctgattatgacctattatttagctgacttaccattacgaaatgagcttccgcgcgtccctgcttgatcatccaaaaaatcaaaaaaacgagtacccagtattaccgggtactcgtttttagggtaataatatcacccgtttttgacctacaatagttcagcaaaaacgtcttcttgtgtattcaaataattttcacccggcttgatctcagtcattttaacaccagccaaagcgcgtgccatcagtccttcaacatcaatccgttcttcgtaggaccgtgaacggtctagcttcggatgcgtcttgggtgctggcggcgcaaaaatcgtacaacaatcttcaaatggcatgatcgacaagtcataggtatcaatatcttcggcaatcttaataatttccgtcttgtccatggaaatcactgggcgcaaaaccggcaaggtggtcacatcattgatggcaatcatgctatccatcgtttgtgaagccacttgccctaatgattcaccattaaaaatcgccttaccatgccgttgacgcgtaatggcgtccatcaaacgcatcattaggcgccgttgaacggtcataagataaccctcgggcactttttctttgatttcttcttgaatctcagtgaatggaatctgaataaacttcacgctaccagagtaacttgctagcgttgacgctaactgcttggcctttgctaacgcctgttcactcgtgtatggcggactgaagaaatggaccatttccatgtccacaccacgcttcatgccaaggtagccggcaactggtgaatcaatcccaccagaaagcatcagcattcccttgccagcggtgccgaccggtaatcccccggcaccctgaatcgtttctgatgataagaagataccgtttaaccgaacttcaacacgtaacacaatgtccggattcttcatcttaacttgaatcccgtcaacgtggtccaagatttgcccaccgagcatgtcattgatttgatttgtatcgtattcaaactgatgatcggagcgccgtgtgtaaattttaaaagtcatccccggtttaaactgggctttgaccatcgcaatcgccgtttcatagacggcatccatgtcggcatcgacgcgaatacttggtgaaaagttttgaattccaaaaactagcttcaaacggtccatgactttatcggcatcctcaccatttaacatgatgtgcatccggtcacggttcgcgtggacctttagttctggaaagtcgtgcaacgctttgcgtacgttacggcctaagctatcgataaagttccgccggtttttacccttggtcgatagttcaccataacgtaccatgatttcagtgtactgcatgaacaagttcctttccgttatgcgtctgcattaatttttgagaatttttgataaagttgatcaaatactttaataaactggtcagcttctgccagcgtattattctcatcgaggctgacccgcacagcactcgtcgcaatgttttcttgcacgtgcatcgccattaaagtactggaggccaagtgtttcttcgatgagcaggcactcgttgttgagatataaatgccctgatcttcaaacgcgtgaacaatggtctcgccccgcacaccgttgatcgtaaaacacagtatgtggggtgcgaaccccgtcgttggctgactgaaaatcgtcactttaggaaacgacttaatatgctcgtagattcgctgtttgatagctcgctcacgagctaccttaccatcttcatccgtgagcaacaatcgcagggccttcgccatgccggcaattgctggtaagttctcagttccagaacgccagttactttcctgaccgccgccattcattaatggcgctaacttacgaccattgcgcgcgtaaataaagccaaccccgcgagtcgcatgaaacttgtgccctgaaaaggtcacaaaatccacccggtcattcatgatcatgttctggattcctttaccaattccttggactgcatcaatatgaaaatgaattttcggatattgtttcagtagttccgccactccaagtaaaggctgaatcgtaccgatttcattattgactgccatcgttgacactaaaatcgtgtcaggccgaattgccgctttcaagtccgccacgttgatgcggccttcctgatcgaccggtaagtaagtcacttcataaccaagttccttcaattgttccatcgaattatgaatggcaggatgttccaccgccgtggtaattagatgcttcccaaaggcccgcttttcaatcgctgtacccttcaaaacccaattatcgccttccgtcccaccagacgtgaagaaaatttcgtgggcttgcacacctagtaagccggcaatttgttgacgtgattgttccaacaaatgaaaggccgtttcaccaaagttatgcaaactagacggattaccccaaattttttgggaaaccgttgtatacgtctccagtacggcaggagcagcttgcgtcgtcgcactattgtcaaaataaatcattactacgccttctctttccaagaaagtgtgcattgcacttactttcgataagaattctttgcaattataccaaatattactagtgaaacaagggtttttgtttcaaatttctgattaatcacacgacaattgcgtcctaaacaccatttttgttggccgttcccagtcacccttctcagaaccatcacgactacttgcatcatgatgccaactaaaaaccagctggtggcggttgtcatttaacaatcaccaccagctggttattttcagttaactaaaattttgcatatgggcggtcccaactatcctcgtcaggcctcatcgttcatcttatcagcttgtttgttcgcatagtaactgtcctcaatccgtttataggaccccggatcaactttatccacagctgttgcaattacttctaaactccgcgcgtagtcatgagtctcggtaaacaaccgttgtgcttccacgctggcttcttgcacctcttcatgattcgtcttgtaacggttagcgtattgtaagagctgttccgccataaccgcagcatccgttaaatcactggtcttttcctttaaggtcgccatgtccgcctgaataacaatcaactgtttcgtgatgtcttccatattgatcacaagcttattaatatcatggtcaagccgttcgatttccttggcaactactttgaaatagtccaaatagtctttcggtagtccaggcaagttcaaattttcaacctggcgtttgatcgcgtggatttcaaaatcgaaccgttgcagcgtctcgtgggctttggactcttcagcggtcaaactcgccacacctttgttaattgccacttgttcttcttcaatgcctttcaactgctcatcttgttcggcaaaatgagctgcgatctcactaaagacagcttgcttactagtaatagctgtgacgtccgcctgataaacagcttcgatattcttcagttgttcgttcaattcacgcgtccgttcaacttcgccattattcaacgtatagctttgtgctaatcgatccaactcaatttgtaagcggtgattctgattcatggcatgtgtcaagaacttactgatttcttcttgttgttgatcaacaacggccttagcatcgatctctgcttgcatcacgtcgtataagtggtcgatccgcttttcaatcgcatgattgccgttttcagcatccgtaactttcaaatcaccaagtaacgcaatattatcgtcgattgcttgctgtaacgctttgatttctggatcaatcgattcgacctcaaagtgaaaatgttgagccgttaattgttgataaccactagccagttcggctaactgatcaggaaacccactcactaggtccttataaatcggtggaatccgatcaatatccatttcaagagtgccagtatcgtgatgtaactgatccaaaaccttttcagccgcgtcatgatcgccagccttggctaattcggaaaaatgatcaaaatcactttctaagttagctaactgatcctccaatttgtcgatgctcggaccaaatgaaaagttttgcgataataacgtcttccgtatgttttggtacttcttctctaaactagccactgcttggcggtgcgcggcatccgcgtcatctaaggcctgcaagccctgacgaatttctgcctgtcgttgttcaatcgtatctaatgtggccgcaaccttcttcagattctgctgagcatcgagaaatctgatgccccgcgcctgcgaagtaatggccgttaattgctcactaacggcgggtaactgatcattatcaacttcttgaccagcgctctgcaacgcttccaacttcgctaacgatccgcccgttagtccgagttgttcaattttttcgaaatctgtggtctgcgattgcttgactagcgcctgttgccgttccgtcaattgacggacttgcttgtcgatataaaattgaaagcctttgaccgccgcgtagatgacaatcgcaaccacaacaatgccgattgctacttgcatacgaataccccttacattatttattccgttttaattgcgttgcgcctcaccctgttgagaaccgtaaccttgcttttttctgaaaatccaattaaaatctatcttaaattataacatagacgtaactaacggacagtaacaatttattaacattcaaggaggattttttacatggctaccacggaaacatcacttatgaaccaacaactcgacgccctactgtttcaagaaactaacctggtcgcgaacttagctaatgctagtgccctcctcaacagtacttatgacaaccttaactgggccggcttttacttatttaacgaacaaactggcgagctcgacttaggtcccttccaaggcaaagtcgcttgcatgcacatcaaagttggggctggtgtcgtcggaactgcttttgaaacgcaaacgaaccaacggatagccgatgtccatcaattccccggccacatcgcttgtgacagcgccagcaactctgagatcgtggtcccaatcaccaaggacggccaccaaatcggcgtactcgacgtcgactctccatcattagaccgattcaatgctgataacgaagctgaattgaccgaatttgtggcgattctgacgtcacacattgactaatcagcattaaacgtgttatgctactctttgtgtaaaataatgcagcagtgagtgggtaagctcgtcaacagattggtgccaatattttggtcagttagtaacctgcggctgcaatggtgaaacctgcagtccaatctgaacgaatatcgaacttacatcggattattttactccaactaaaattattggaggaaacattttatgtctcgttatacaggtccaagttggaaaatttcccgtcgtttgggaatgtccctttcaggtactggtaaagaattagctcgtcgtccttacgcacctggtgatcatggccaaggtcgtcgcggtaagctttctgaatacggtacacaattacgtgaaaagcaaaagttacggatgatgtacggtttaactgaacgtcaattcgctaacttattcatcaaagctggtaagattcgcgaaggtaagcatggtgttaacttcatgatcttactcgaacgtcgtttggataacatggtttaccgtttaggcttagcaacaactcgtcgccaagctcgtcaattagtaaaccatggtcacatcactgttgatggcaagcgtgttgacatcccttcatacgaagttagtgtcggccaagttgtctcagttcgtgaaaagtccaagaagttggctgttatcaccggtgctgttgaagccgttgttgcacgccctaacttcgttcaattcgatgctgataagcttgaaggctcattaactcgtttaccagaacgtgaagaacttgaagcagatatcgacgaatcattaatcgttgaatactacaacaaactttaatttccggtatttaaaaaccgtcgcgtttgcggcggtttttttgtatgttctgttaatttcagacctgacgctcagcactcacagccgccatgaccggttgataaatcgacaataattgtttgaatgttgtgatgatcaatttattcaacgtatcagcatcttcaaataacggatcaccgaccaaaactgcgcggcccacgaccaactcgctgtgtttatactgatcgaatttcttgatggcctgcgtaatattggccggtgttgcaagttgcgtggccggcaccccatgattattactgataacatagcccgccggcaaggccttcaaaagtggtgttaaatctgcgagttgcatctttgcctgcacggccggtttacactcatccaaaatatcaaaatagataaacaaacggtcaggccatagccccaattcaaaatgtggccaggctttgtagctccgtttgttttgactaaaagcgacccaagtgtctaccggtggattcttaaatcgccgtaaatgtttggcaacgtgcgcgtagaacggtggctcgctaggtgtttgtaaactcgctataatcgttggtgcgacctgttcgaacttaggatcgatcaccgttttgattaaatgcatgcggcccgctaacgtctggtcattaaaaatttcaaaatcttgatttgtaaacaagttttatcatccccaaaactaatttagattaaccataccgcattcactaacgcaacgctaccccccttcccttcgctattattggaggaacatgctacaatgataattactatcaaggaaaggatgttagacaatggctgaaacagataaacaaccagttgaccgcatcgaaacggccatgcacgggacgccaaagttgcatcccgacgaacaacgcaagtacctggggacctttcgggaacgcgtcgaagtcgcagtgaccgttgcccaaattaaacaggccaattacgtcgacgcacttcatcaagcatttacgagccatccggatgaccaattatatattaatggtaatttagaccaggaactgattgggccgtatatcaaggcggctagtcaagccaatatcaaattcactatcaaaacggatgacatctaccacactgctgatgatgattacgcgcttgtattcactgctgcaagcgccattaaccaagatattattgatgttgcgcagcgttatccctcgcaggcttcatcagcaacaccccaggtcgagaaaacacctgggttgctagataaattcaaaaagttactttaatacaacaaaggtccccatccacgcacggatgaggacctttttacgtttgactgcgttaattacgcgctagagtgccataaagactcatgataactaaggccgcaacaatgatccccatgaggctgactgaaacccatgctgttgtgacgatactcagtagtaacaatatcccaccaccaactagcgtatagcccaaccaataacgaacacgccgccaaatcattggccgaatcgtgtgaccacctcggtgcatctgcgcgtattgatttgcactgattgttggcaaataattcccgatggccatgaaaataaaggcaatcaaactaacggcaatacgccaaatatccaattgatggtctaagttataactgatagttgtcgcatagatcacacttgatagtacaggcacgatccaaatgatcatctgttcaaaccgtggcgccggtgccttatgattggcattcaaccgtgtcaccccaacgcaaatcagctgaaacgccatcatcataattggaaagccaacgaccactaataattttgcggccattccattaggttgattatccaaattaaaatgaatagccattttggcgggcaaggccgcataattcacgacgccgtagctcattggtaacagaataacaatatagctcagccacaactgcaagttcctttttgtcatcacttttcatccccctgctttggactaaaacgatatagccacgtcaacatttcctcaaatacgctcgcatttagctcatagtacacataatttttttccttggtcacggtaactaaaccagcttgcttcaaaagcttgagatgataagacaccgttgcattacttaacttgaaatgagccgcaatctcaccagccgattgccgattctggcgtaaatcttccataatctggcgtctgacaggatctgcaattgctttaaaggtcgtattcaacgccatacgggctacctccaatcacctatttagatatatatctaaatagagtataacaggcaaccaggaattcaacaagagatatttagataaaattcgaaataggtgttttcaatcatgacacttaattatgagctatcaaaaaagctggacaaggccagctttcttgtttttaatcttcatttttaaacaatgcatccaacaactgccccgccactggttgggcagtaccaaacattgggaacaagtgcggatacaagtacggcgccgcatgaatacccaagtataccgccatttcaggatgctctggcactaattcggcatagagattgggaatcatcacgtcgaccccagcgaccgctaagtgtaagtctgctaccagcttttccaccgcctgcacataggattgatgcatatcagccgtcgcgtctaacacgtccgccccgttaccaaaagtcgcatcctctcgtaataagatttgagttccccggctgaccacagaatctaaggtcaagtgatatgagtccaggcgataccgttcgatcgttcctaactgtagcgctgattgaggccacttaaaagcggtcccgcgcaacgctcgaccatttttgcggtcaagtaacgtcttgactgttgagcgaccatcaccaacaatattggctggaattcgttcgacgattgcttgcacacgaccatcgataaccaaaaagcgataacttgatgcgactaccacttcctcggccattaccgcggacgtttgctcaaatagttgccggacgacttgttcaaacagtccgcgttcgggcataatccgaaagacaattactttgtgcgactcatccgccgcttttaatacgatcccaccagcttgaacgtaccgatcataatcagcaatcaactgattagctgtatgatatgtctgtgaagccggcaccggaaccccgtgctcagccagaatttgtttggccgctgctttatgtgtcagtacggtcgttagcgcctgtggatttaaatccgttccgctcccattcacaactaattgcgaccgtcctaacttagtcaatcgtaaaatgttagcgtgtgggtcaacaacgtccacctgcactccccgcgtcaaggcctgctgggctagttgctggctcgatagatttagcgcggtaaagcccgcaagttcaaacggacgttcattgctcgattcctgatagcgtgcagcccgttcgagtgcccatgctaacggatcggcttgcatggcaatctgcgcactcagcgtcttctttggatcagtgacccgcgacttcaactgtttgagtaacacggcatcttcatttggtagtccataggttttaacaaaatcagcaagtgcatctaaaacttgaacagccggcacggcctgagcactagccgtcgttggattttcacccaaaacttgacgggtcaattggtcagcttgagcgttgacttgggataccatcttagctggaagtgccggcatcattacgaaataactcgccaacaaacgaacaaatgccaccgcgttcgcgtccaccccgactggactagttggatcgagatccaagccccggtattcaagataatagaccccctgccgggccatcatagctagctgcccattactccgaagccgaactggcccgtcaaaatcattgaccgacaacaactgctgttgacgaacagccgccgtcaacttggccacgtagcgatcaattgacgtatagtctcccgtcacttgactgtagcgaccatcgggatgttgaacactactgcgctgtggacgactcgtagtatccgtaacggctaggcgtggtgaagcgccaaataaatactgaatcagccagttcatgcgcaccaatccctgagcgactttcagataaattgcattgcgaaagtcaacataactgtgatactgctgatggaaagtctcagtatataaacgggtgaataaagcttcattcaagctcatattcacgtgactaccagtcgtcattaatcgctgtaactcatacttacgagctaagtcgcgacgacgctgatagctgacttgatcaacatcagccagtggcacgttcgttagatcatccggcaacacaggcgtactcgacagtggccaaagtcgttcgtccgcatcgagtgaccgccgtgctgcggtattcaagcccttcagatacgccatcaatgcaggaatgtcacgacgcaccggcgtagtaaactttaaagcacttgcggaaaagcccggacgtaactgatgattttgttgcgctgatccaaacgcttgcgggtgtgctgtcgtcgctaagtgaccatggtcgtccacccggtgcatggtgacctctagtcctaaattagcctgatgaacgagtgggactaagtgatactgtacaattgccttaccaacggcatctaattccataatgatcaatcctttataattattttgttcgttaaactgattattcggtgtccttcattgtaaatgctataatagttgggactagttttgcaaggagggatttcaaacgatgcaacaaccattagcctaccggatgcgaccaaaaacgctgaaagacgttgtcggccagcaacaattggtcggcccaggcaagatcatcgcccggatggtcaaagccaaacgactatcatcaatgattctatacggcccaccaggtactggcaagactagtatcgcgagtgccattgccggttccaccaagtatgcttttcgcatgctgaatgcagctaccgacagtaaaaaacaacttcaaatcgtagccgaagaagccaaaatgagcgggacggtcattcttctgctggatgaaatccaccggttggataaaactaaacaagactttttattgcctcacttagaaagtggccgcatcattttgattggtgctacgaccgaaaatccatatattagcattaatccagccatccgtagtcgaacgcagatctttcaagttttcccgctcactgacgatgatattcagcacgcggtggaacgagccctcgctgacgaaaaaaacggtcttggcagttaccacgttgatttagcacccgcggccatgcaccacctgtgcaccgctaccaacggtgatttgcgcagtgcccttaatgggttagaattggccgtattatcatcgtctccggccgatgacggcaccatcgccatttcacaacaaacgattgaagaatgcttgcaaaagaaagccttatccgcagataaagatggtgacgcccactacgacgtgatctcggcctttcaaaagtccatacgcggttccgacgtaaacgctgcattacactacttagcccggctagttgaggcgggggatttaaagagtattatgcgtcggctgatggtgattgcctatgaggatattggattagctaatccagccgcgtgtgcccacaccgtcgcagctgttcaagctgccgatcaattgggatttcctgaagcacggattccgctagctgacgctgtgattgaattagccttatcgccaaagtcaaattcagggatcagtgccattgatgccgcgctcacaacggtccgtgacggccatttcggtgatatcccggccgacatcaaggatgcgcattatcaaggcgctgccaaactcggtcatggtgttggatacgattttccacacgatcacccgggtgattgggtcgctcaacagtatttaccagatgccatcaaatcagccaagtattacgagcccaaaacaaatggccgctacgaaacagcccttgcgcaacaatacgaaaaattattaaaggctaacgagagaaatcgctaacaataccttggttgtgctaataattgcaacttttatttttatatgctagactaagagtcgaaattactaaggtgtgcgcattgctctaaacaaagtgttgccgaacaattaatactactttgggatgtccgttagctaattccataacatgccttatcctttggtagttagcgaattagtcagaacgtcccacctgccttaaagcgggtcaatactgaagggcgattaacggcaccactagtttttccggaagtttacttccgttggtcaggacttgttcctggcctttttttgtggcgtgaaagcgacccaagttcacaacgtcattttactaacaccgtccaaaactcatggggagaatggttaattgggaagccggttatacatgaataatctcggctactgaaatacagtccatcacgctggtttgggtatttctgcaacaatccggcactcctgaacaattactcatcctcataaaaccagcatgacgtgtgtcgcaatcatttgacgctaaattgtgttgtgtgaactactagtactaatcgcttatctttagctagcattgcatttgtcttctcttccggaatcaactaaaataagattaacatcacctgttggaggttcattttgattacattactgcttgtcatatacacgctcattgcgggttggctcagttattatctgctgacgcaccagtcccgaccatttctcttttttgacccgaacaaagcgccgacaatcaaacacgtcgcacgctatggtggcggcttaatgttactagttaccatcgcctgtttcgtgaccatctttgttcaagcgacaatgctaattgccattgtactggctagcggttcactgattatgatggcaattgcactaattttagtgagtttcatgcaaatctcatagaaaacgctttttattttttgcgaaaacctttacaatatagttataaagtaatgaggggtgagaatgatgttacaacaataccaacacattttagttcctgttgatggttcttatgaagcggaattagcatttaaaaaggcggttgccgtcgcgaaacggaacggacctaacgcctcagttcacatggtccacgtggttgatacccgtgctttccaaaacatttctagttttgatacgaccatggttgaacaagtgaccgatactgctcaaaaaacgttggacaagtacgttgcagaagctaaggcggacggcttagataacgtggattattcgattgaatatggcgcacctaagacgattattgcgcgcgacgttcctaaggatatgggcatcgatttaattatgattggcgcaactggtctcaacgcggttgaacgcttattgatcgggtcagtcaccgaatatgtcactcggatggctgtttgtgacgttctcgttgtccggactgacttggaaaataagccagctcctaaaccaaagaaaaagtaatcttttgatacacgtacaataaaaatcggctcagtgaagttacttacctcactggccgattttttactatttgccaaaatcataccacttactgctctaaaattgcccggtaaagcgcctgaccaagatcattcatcgcgaccgtttgcgcggtacgttccccactagcagtcatcatcgtcatgataaaagttccctgacgattctgaacgatggccgcatcattttgaacaccgtatgcttgatagtccccagttttgttatagatcgtcgcgcgtgttggcagatttttgaccaacttactgtgatccgtgttcgccttcaaaatcgttaacatcgcgtgatcggctttgttcgagatcaaacgcaggttcgccagtcgtttcagcaccgttgccacattccgaaccgaagtatcgttatcatgcccggcctttagtgcggcagtatccattaaccgccgagccatttttgtatcagtcagacccaactgtgcaatttccgtgttgaccgccgagaagccgccaacacgatccaacatgatattagcagccgtattatcactctccgtaatcatgcgtttcgtgatttcagcatacgtcaactggcttccagctggtaacgtgtgcaacgtcccggttccaccaactttatcggcagcacgcagggtataacgatcctgcatgcgccaattattttgatggacctgatcaaaggcagtgaccataataaataacgtgatcaaactgccagcacgttgcgctcgattattcaaaaccacggtctggctacccgttaatggcatcaccgctaccgaagtttgaccagccaacccattcgttgcttgcgcaaccagatcagtaactgtcgtagtcggaaatgtctgtgttgccttcatcggtgcgtcagaatcgctggcagccggcttatgcacctggcttttacctgccgactcggcagttgccgatgtcgtagacgaccacaatagttgtcccacgatatagccgccacccagcaatagtaaccccgcaattaataccccaaggagtgtttgtggcctaaagcgactcgaaaaagttgtccgccgtgattgttgacgccgccgctggactcggctttgctgattgacatcaccattcactggcgttagacgatgaccacattttaggcaagtcacggcatgcggtgaattttggtaaccacagttttgacaactcatcttcacattccccccggtattaaaaataggacagtcagcggtgtgccgtgcctaatgggaaccgcaatatctcccattaagcgcggccgttcaccgctaactgtcctatcacgttatctaagcgtcgttagccacttgcaagggtgcaatatggtactcggccatttctttcgtgattttttcggtcaaactactgttatgtgtcaccagacttaacgcatacgccacgtaatagtgatcatgcgctgactggacattatttaaaacaacttcattggccgccttttgtgcatacaaacggtctaataaataaagtgactgactctcctgagccttcttgagtgccaagtcgatcaactccaaagcttcctctggaaaattgatcttagcatacaattgtgcggctgaggcgtaaatcaaaatttcattttgtaagtaatcgtcgtcacccatcggcattgcttgcgcatccattgtgtgtaaggtagcaactgcctgtttgacaaaaatttcagccttgtcataggcctgcttacgttcataagctaagccggttccaagtgtggccaggatggcaaacatatcgtgactagacttgacgaactgattaagcaacatcccaaagttaaagatggcttcgtcagcattgtcattgagcactaattgaagatagccctcatagtaataatactgtttcttatccgtattactacgtaactgcttcggacggatatgctggaacacatcctgagcctcttccagttgtgtatgtcgaatcaaagtatcaatttttttgaaggtccgatataactggtcgtcattttcaataatgacttccgataaacgaattcctaatcgattacaaattttcatcataatcttcatacttggaattttactttttttctcgattagactaatcgttgcctgagtacaaatcccatcagccagttccttctgcgacatgcccttccgctttctgaactgccgcactttttctcctaatattctcatgcttaacccctcttcattgattgccttaaaccaaactcattttgtaactccccttgctgcccccactaaatgaacaagggtatcgtgacacctaatcaatcctcgttaatccgttcgaataattgagcactaaccaattggacaataccaattacgcatataattatattcacataacggaattttagcaagaaatacgcgtaattcttatttaatattaagtttataccatgatatcggccgaaggtcatttattaattatccaggcttacagttcgttaaccaccctaatcaaggacttgttcattaaaagtgagaactactgaaagcgatttaaaggggagcgaattaaccttattaacagcaaacatcaattgtcatgacaccctcaattaatcggttgacgtggcttaataattaagattagttctcatacttctttcagtagtttataaccaactaactaaccaatttatcaattgataaaaataataatgcttagattgaccctgtaatcttcgtagttggcccggtcgatttgtgatcagcccgtcagcccccatggccgtcagtcgctgcattgcaagcggccgatcaacagtccagaagtagacgatccgatgttggcggtgggccgcactgatctgctcacgggtcgcggtcagtgcttgtaaagaataaaatcccgcgacggaattagaaaaatccgtcagataaaacggcgttatgaagccaaccggtagttgcgccgcccgttgatgtaatcgttcaatcacacgatagtccaaagagtgtaccgcccctttttgttgtatcagtcgttgtgcatagttgtcggcaaaaatccccattagttgatcagccgtcccaactgacttgatttcaactaataaaggttgctgtaatttgtgtgccaccgcaaagtactgcttaaacgtactcaagtagcctttttgaccatgctcccgtagtggtaatccactcaacttatcaacggggtactcatgaacgggaccgggttgacccgctaaagctttcagcgttggatcatgcatgacgacccagtggcgatccgctgtcggctggatatccatttcgaccatatcaggctgaacttgctttacagtccttttaagcgccgctgtggtattttggacaccgtcacgaccattaacaccccgatgtgcaataattgctagcggcgccgttggtggcgttcctagccaccagcctgcgtaaccacccaagactagcaaaccggtcaacgtaagtagcccagtttgccagttagagtgaccggcgattgctgtttctggccaaaggcgcgaccaccatcccataaacattaaccaagccagcagttgcaacccagtcatcatgaaaactgcaacaaattgactgaccagctggctaacagcgccactagcccacactatgccaccaccaatgattgccataacgagccagctaatcaggaacagccacacatttcgactttttttaaagactgtccaccaggaaatccgccaacccgttcgccaataattacgccagctggtcggagcggtcaattggcgttggagtgctggtaaccacttccagctaatcagccagcccaacagccaaagtggtcccgccacaggaagccagtcataacgcgtattaaagattatattttgaacagtcgctggcaattgtatgctcgcttgtaaagttgctaaatagcctaaccaaccgagtggtaaccaccacaccgccgtaaacattaacagcacccagcgatacaaaaattgaccggcctgccacgactcatgattactacgagcgaccatggctggtaaccaggcactcaaaagcaacaagcctagcaagctgactaccccaccgaccagaatcccgagcaccttagcgagtaccgccagcaatatgccggccaaccaccagcaggctagcggtccagccagttggcgcgctccctgcatcactaagtgccatccgcgacttaacaacctgacccctcctcacaaaaaaaggcggccgtgatgaatcgcttcatcccaaccaccacaaaactcattactatcttattccgcgtctaacgcaacgaaatcatagtgaatatcagattgacgtttgaattcatcaaaaccaagttggatcaattgatcgatcaacgccgtataactaatgcccgaaacttcccatagctttggatataaactaatgttagtaaaaccaggtaacgtattgatttcacccaagtatggttcaccatcttcagacactaagaaatcgacgcgtgccattccttttagaccaagcgctttaaacgcgtctagcgacatctgttgaatccgtttcgtcaaatcagctggtaattcgactggtaattcgaacgtcacaccactcgcatccacgaacttattattatagtcgtagaacgtgtccgtcttcggcacatcaatggcaccaagcttagatgccttaggattttcattgcctaagatcgagcattccacttcacgcggattgtcaatcgattcttcaactaaaatcttgtagtcatatttgaacgcatcggccaaaccatccaagtattcttgttcattctcagctttatgaatcccaatcgacgatccttgattggctggcttaatgaataaatgatcacccacgtgggcttgtaaataagcgtacgtcatttggtcccggttttccggtgtaaccaccacgtacttggtgttttgaatatgatgatgcgttaaaatctgcttcgtaatatccttatcaaaactagctgccgacgctaagacaccactaccaacatacggctttttcaataacttgaacagcccttgtaaagtaccatcttcccctaagttaccatgaaccactggatagaagatatcaatatctttggccagtgtcaggttcttgatgggagctaatggatcactcatgtccaactttggcatttcttcggcgacgacttgatcttctggttcaccatcaaatacgcgccgagttgcagcatcactcaagacaatcccgttcttcgtgattaaaaacaagtcaatctcgtacttattcttgtccatggcatcataaatgttgtgcgctgaacgcttcgaaacatcatgttctgaagagttaccaccaaacaacataccaacatggatctttttttgtgtctccataattttgttcatcctatcaaggtttatttcatactacggcttagttaattctacaatatctgagcacaattgaaaacatttttacaataaaacgttgttttttacgcgtcaaatggcgcagtcaagacaatcttacccaacatttgccccgtctctacgattgtgtgcgcagttcgcaaatttgctgcattaattccagctaaagtccgcttggtcgtcggtacaatcaccccggcatcggccagttgcgctacctgtgccagaatactcccctgcgtcgccatcgatggcaactgatagttagccttcgtaaacataaactcccaagcaaaattcaaacttttcggctttagtaacgccattggcaaggggtgctgatttgtcactacggcgacgatcgtgccaagtggccggactagcggtgtcactaatggcaagtattgatccgtagagtgtaatagtatcgcatgatcgacagcctgcaaaccggccgcagctaattgcgatcccagatcttgatggtaatctaagacgatatcagcacctaaccgcttaacccattcagtggtttctggcttaccagtcgtcgtaataacttgaagacccgcccactttgccaactggatggccatcgagccaaccccaccagcaccattgatgataaggacgctctgaccaagattcgcgtcagccgctgcagtgaatggtaatttttcaaacaatgcttcccaagctgtcagtgtcgttagcggcagaccagctgactgcgccggcgaccacgttttcggggcacacgcaactaaccgttcatcaaccaattgatactgagcatcactccccggccgatcgacggcgccagcataataaacgacatcatctgtcataatcgttgtcactgcttcaccgaccgccaacactttagcaacggcatcaaaacctagtattcgcggcgttgtcactggcgattgaccttgccgctgcttcgtatcgattggattgactgcggttgctaagacggctactaagatatcacggccacgaggttgatttacattaatggtgacatcttgtaaactattcggatcgctcactggcaacccttgcgttaatccaactgcttttgcctgcattcaaaagacttccttccaaaactaacctaaaaattctaattcatcatccaaataatctacgacggccgttggcagatcatcgtgtaatgcaagtgcttccaataatcgattacgattgaaaatctgcgtccattcagcttcactagccggacgagtatgcatcatcaactgctgatgccagtccttcatcgcagttaacaaataatcacaataaagctcatgtttgtttgtaatcaaggtcaaataagtcgatagtcgttctggctcgccaaaaatcaacggcgttgttaacttttgataacgagcaatcaatgcggccaacagtaataatttatccgcacgtgcgagttgagactcatctgccagttcatctaagatattgccaatatgcgtgtacgcatgcgcccaaccggtggtgcccacaaacccccgagtatccttttcgagtaaaatgtagactgtcatttgctcaacaactagatccagccgcgcgggtgtcataaacttgagacccgcatggtccgcatacaagagcactgacagtaatagtatcgcaaatgaccgctgataaatggcatcattttgcggctcatcgatgtgtgcaaataacatctgatcttgaatcaactgatcaaaaatatcgcccaactgttccggtgtgagtacctgctgctgtaatgcctcgtttaacaaatagtagacgccttgatcacgaaccagcggattcagcgaaccaacgtgtgccatcaataatttgatttgatcgtcgctcatcgcggtcaacgtgcctttcttcaactgctcatgaagtgttgcaatcagtggaagcacctcttcgtcgctcggaatcgttaccgtggttgtcacggtactcggtaactgcttaatcagcgttgccattcgactgggcagtgactgatagatttgtcccgctcgaagttgttgtcttaactttaacactgcatccttaacctgcatcaatttctctgcttgcataatgacctcgtaatctcgaatttaccttctattttagcatgtcagcgcctgtctgcccaaaagaaccattcaatcataaaacgtgacctaattatagacgtcacgaagccaacctgagccaatacccaagtccacaccgcacaccctgattaggccacgtttaatgacaagatgtttcaatccatgcttagaaaaagcttatgcttgcggtaaaacgtccacttgcgacttgataaacttcgctgacgctgctaacgacgctcgttcatcagtggtcagatctagttgaattaatgattcaatcccgtttttaccaatcacagcaggcatgccaacgtatgtcccatattgcggatcaaaagctgaaactgggcaagccagttgtgcatccgcactgacagcttctgccaatcggacaccacaagtagcaatcgcaaagtttgtataatgcttacccgccatgactgcaaatgccccttgccttgcatcttcttcaagttgatcaaggttcagacctgggaaatttttgataggctgcccattgacgctaaccgttgaccaagctacaaattgtgagttgccgtgttcgccatatacgtaccccgcaacatttttaccattcgtaccagctgcttgtccgacatacttttgcatccgcgccgtatctaagaaggtccccgtaccaaaaacccgttgccgtggaaaacctgtcattcgttgtaaataatccgtcatgacgtcacacggattcataatatcgatcaaaatacccttgaagccagatgccacaatcttgggcgcgatctcccgtacaatcgcttggtttaaatcatactcaccaaagcgacccttggaactattcatatcaatggcaccaatattgccagaagccacgatcaacacttcggcatcggccaaagctgaataatcgtttaaaataatcttagtggttgagcttagacgaggtgacgcgtcgtctaaatcgagtttttgcgccttggccaaggcctcattcttatcgattaaaactaattcatcaacggttccttgttgaaccaacgtataagccactgtcgcaccgacttggcctaacccgatcacaccatatttacgcatgctgcaaaccccaatctgtagtttatttaacttggttagcgtaccttgcaaccgctataaagtcaagcaggacgctgtctcataagaatttaatcaatagtactacttagataatatcaaacgtgcattttcattaacccgcttcggaaaattaccgtagtcaaactccgtgaaaaaagctagcctcagggaatccctgaagctagctcaatcaatcaatattctgatttaagatggtccgtttagtcggccgaaactggcaggatggcacccttgtacttcttttcaatccatttctgggtgctcttagaacgtaaagctttcattagtttcttaatagctggcttgttcttatcacccttacgaacagccacaatgttggcatatggtgaatctgatttttcaagtgcaatcgcatccttcttaggattcaacccagcttgaaccgcgtagttcgcgttaataacgaccgcgtcaccctcgttatttttgtagaatgttggcattaacttagcttcgtatgaatgtttaaacttcaaatgacgtttgttggtcttaatgtcattaaaagttgctgaagttaaatctgtcccttttttcaaagtaattaaacccgcatccttaaataacgtcaggacccgaccatagtcagccacgttgctgctgaccagaacggttgcgccgtctttcaagtcttttagactcttaactttcttggaataaacaccgattggttccaagtgaactttccccgctgatacgaggctcccattattttccttattccagttatccaagaatggaatgtgttggaagtagttggcatctaattctttcgaagccaatgccttattaggtaagacgtaatcttgaaagactttgatcttcaagttaacgccttcctttttcaattctggctgcacatgcttcaagatttgtgcgtgtggcactgaagaagcccctacagtaatggttgttgtctttgttgacgatgacttcccacaaccgactaacaaaattgccgttgccgcaactgctaataatcctagaattcccttttttttcataattccgtttcctcctatacgaactttaattaacccgtttatcaatatgccgaactgcaatatccccgataaattggaagataaacacgataatcacaatgattaccgtcgccactaatgtgatggcgttgttattggactgaaacccgtcttggtaggccaaattacccagaccaccagcaccaatggctcctgccatcgcggtgtagccaattaatgaaatcgtcgtgaccgtgattccagaaactaatgccggcatgctttctggcaataggacttttcgaataatctgccaccgggtcgcccccattgattcagcggcctcaatcactccatgatccaattcatggaaggccaattcaaccatccgcgcatagaatggcgcagcagaaataatcagtgatggtaaggccgcgcgcggtccgataatcgttccaactaacttagacgttaccggcaataatagcacgatcaaaataatgaaaggaatcgaccggaaaacgttgacgaacagcgcaacaatccaattcaaggccttagccagcggattctgactcccagccgtctcataaagtaacagacctaaggcgattccgagaatggcaactacgaccatcgacacaatcgtcaaccaaattgtttcccacgtggccgacatcatgctaccccaatcgacatttgcaaatttaaaatatgaatctaatccttgatcattcacggttcaagacctccgtttccacccgcatcgtttgtaggtacgctagagcgcccttaatctgttcctgatcacccgttagttgtaagtacagcgaaccaatcgccccttcttgggtttggtgaatcccaccctcaataatatttaaatctaacggatacttcttcaacatctctgaaacaatcggtagctgggcttgatcgccatggaacgtcagttgtacgatggttccctttggatatttcgccagcagctggtccacgaccaccgttgtgtcattcagcgacggtgtgacctcttcattaacaaaccgcttagtcacagcctgctgtggtcgcttgaagacttcaagtactggtccttgttcgacgattttaccagcttccatcaccgcgacatgatcagcaatcttgcgaatcacgtgcatctcatgcgtaatcaatacgatcgtcaaatggagcttctggttgatcgataacaacagatccaacacttcatcagttgtctgcgggtctagggcactagtggcttcatcagaaagtaaaatctgaggatcattcgcaagtgcccgggcaatcccgactcgttgcttctgaccacctgataattctgacggataagccgtttcccgaccggccaacccaaccaagtctgctaagtgttcggctttcttacgggcatccaccttggacagaccagcaatttcaagtggaaacataatgttctccaaaacggtccgcgaccataatagattaaaatgttgaaaaatcatgccgatcttttgacgttgggcgcgtaacttggccccgctcaacgttgtaatattgacatcatcaatcacaactgacccactagtgggtgtctctaagccattcagcatccgtaccagagtacttttaccagcacccgaatagccaacaatgccataaatgtgaccatcttcgatttttaaattaacatcttgaacggcgtgaaccgccccttgcttagcatcaaaggttttcgtcacatctttaaattcaatcaagtcaattcctccttacgcatcaaaaaaagctcctcatcccagacaattacgacaataatcatcaataggacgagaagcttagcctcgtggtaccacccatcttcacaactagctcacgccagttgtctcaagagttactttgaactccgcatgataatgggtgcgacccaagcttagcttgcgactgctcactaaacttcattacttcaagaccatcttcagcttcacgattaatcccctttcaccaatcagggactctctaagtaatcataaccgcgtactcatcttttcaaaatgataacttttttaatcaattgttaatgtaacgagtataccgagcctgtttctaattgtcaaggcctggcaattagtccacgtcgattaaccaagcaacgccgtcttcaacgctatttaacgcatcgaagttctcactcaacgccgggttgaccgcaaccacggtcccattgattggacagttgaattcagaaacggctttggtcgcttcaacgctcagaaaagcgctgttctgactgaccttgtcaccgatagctggtaactcagcatatttcacttcaccaagagcctcatgggcggccttagttaaacctaaccgcgtatgtccatcaacgtcttttgtccaaaaataagctgcatcttcactcatactaaacaccatacctttacaataattttactattcaaaccggtcgttacgactgaacatgtaggacttgtaatgatatcgcatcgacatcattaaacctatcccagccatattggcaatcaacgccgaacccccttgactaataaacggcaagggaatcccagtcattggtaacagtccgatactcatcccaatattttcgaacacgtggaagagaatcatcataatgaccccggttgaaatgtaagcgtagaattcgttcttcgtatcaaacgtcactcggatcatctggtaaatcaataagaaatacaataaaatgaccacggcacaaccgataaagccaaagttttcaccaattaccgagaaaatcatatcagattcacgcacaggaacagtcacgtgggaaacgttaaatccccgcccagtaatctgacctgaaccaatcgctttcatactctgccaaacttgataagcattgttagacgtgtccgtcgacggattcaaccacgtatcgatccgcgcaaattggtattgcttaaaaccgatagcttccaaaatatggcgaccactctgcgagatcacgagatataacgcagtccccgcaatcgccgccacaatggcaaacgtcggtgccaataatcgccacgaaatcccagaaactaagataacgcccccaagaatcgcgaagaacaccagcatcgtcccaaagtcattttgtaacttcaaaaggatagcaactggcaccatgtacgcaattaacttcccaatgagttgccaatcgctcgccatcgtatgtgttgggtgctccgtgttatgcattgtcacgactcgtccaagcatcaagatgaaggcgggcttcatgacttcagacggttgcaacgtcaaggaaccaactgcgaaccaacttttagccccagtgctcgcaaacagtgatctactgtacaagaccaaaacggccgcaagcaggaagatcccaaaccaataggcaatcggtgccactcgccataactgttccgaatcaaattgcatcacaattacggcaatcgcggtcccaatcacgaaccacatgacttgagaaatcacctgcttcgtgacgtttactgaactagagtcgtgcactgcggcgacataaatcgacgccagcccgatcaatcctagcatcatcactgaaaatatgataccccagtcaattcttgaatcctcgtcttgactgcggagtctagattcttctgccacaaataacgctcctaacctgttgggattagcccaccgcacgcgtcagactaaccctattcacaatatcattttgtactttaagatagtttttattatacaacaacctggtgccgaattctcggaaccaggttgaaggtttactaaaaattagcctttgtgtagatggtaagccgacaagatctcttgcagactctcatcaaaagatttggtatgcgcaaatggttggttgtcactaaccatttcagcttcaaatcgttcaccgacttgagtcacttgtccaatcacttgtttaccgatcaaaacttcggtaactggttgaccgttgaccttagtttcgtttaaagtgaccgaaatcgtcttatcttttcttgccacggtggtcttcctccttgtattgcggattacgacgcaatgaaaaatgggctggtaccggatcaaagccgcccttaactaagggctgacaacgtaagatacgtgcaactcccattagaacgcctttaactgcgccaaaccgatcgatcgcttctaacgtgtaattagaacaggttggataatagcgacaatgagccggactaaacgcagaaaaggcccgctgataaaagcggatgcctttcattaataaccgtcgcatcgtaatttatttcttgttcttagcagttttctgcatatgttcaagtaaaattccagccccctgagcaacgttgttcaatgggtgttcggcaaccattacgggcacctttaagttttcactgatcaattgatcgaggccactcaacagtgcgccaccaccagtcaacgtaattccacggtcaataatatcggccgcaatttctggtggtaaagtttccatcacgtgatgggccgtgctaacgatctgcatcagcgtttcgtgaatagcttcttcaacttgattggagtcaatgtcaattgagcgcggcatccccgtcacagtatctcgaccacgaacttgggtgaccttatcatcatcgccgtcctgcttgaaaacttgtgcgatttgaatcttaacttgttctgcactgcgttcaccgatcaacaagtgatgttgatctttgacgtagttcacgatgtcctgattcatccggtcgccggccattcgtaacgaactacttgccacaatgtcacctaatgataggacagcgatatcactagtcccaccaccaatatcaatgaccatgttcccacgtggttggaaaatatccatccctgcgccaatagccgccacttttggttcaacttccaagtaaaccttgttaccgccagatttttcagcagcttgcaagattgccttgcgttcaatttcagtagtgttcgttggggtacagatcatgatacttggccgcgacataatgccacggacatttaattttttaataaaataggacagcatttcttcggtgacatcaaaatccgaaattactccgtcttttaatggtcgaattgcccgaatgttactaggcgtttttccaaccatttggtaggcttcggacccgactgccaacacttgattcgtgttcgtatcgatagcgaccacggatggttcgttaaggacgatgcccttacccgatacgtaaattaaaacattggcagtacctaagtcaataccaatatctaaagccatgtttttgctcctctcaaacatacaattatacgagtaatcattataccatactctacagttgatgagaactgacggctgtcctagccactcgttcatttgtcactaccaatcaattggctgtgcctaatcatcctgtcgtttcgaccactcatcgaccgtcagcgaataaattgcttcatcacgatattgaccatttaacaagatattttctggcagggtcgcatccaaatgatattggcgtcgctcagcaacagcccgacttgcctggttggcaacgtctgcacctaagatgaccttgtgcagatcaagctccgtaaaagcaatttcttctaatcgttcgagcgctttagtcatgacgccacgaccagtatatttctggcccagccagtagccaatctcaccgttgtgattaatggcactaatattatgcaagtctagcatcccagcgacttcgccatccacaatgatggtggtgataaacacctgtccatgagcctgcttggtcaacattgattcgataaaatgacgctcgtcttgcacggtcgccgtcgcatcaacccacggcatccataacttcaaatggtcgcgattatgatcaactaagtcgaaaagcggctccgcgtcagccacttcagtcggtttcaatgaaatgtgtttgtcgataatattaataaacataagctgtcctcctgaatgttggcgccgggttaccccgcttcgccacaaaaaagccttcaaaaacgagtttatcgcactttgaaggttttgtaagcatttatttcgatttattccgcagcttcgttcgcaaaatcaggattcaacgcataaacggtgccatcgggaacatcaactcgtttaatctcagcacctaatttagccagcttaccatggaagttaaagtagccccgatcaagatacttcaaattagtcacttcagtgtaaccccgactgaccagtccagcgattactaacgctgcagctgcccgaagatccgtcgcagtgacctgggccccgttaaagtcagtgggaccatacataatgacggagcgcccttcaactttgaagtcggcgttcattcgccgtaactcatcaagatgcatgaagcgattctcaaaaaccgtttcagttaataaactagtgccctgcgcacacaactgcaaaattgtcatttgtggttgcatatccgttgggaaacccggatggggcatcgtcttaacggaggttggcttcaagatttctggaccaataacccgaataccagccggttcttccgttactgtgacgcccatctcacgcatcttcgagatcaatggcttattatgttcggcaatagcatcctcaaccaagacgtttccctgagtcaccgcagcagcgaccatgaatgtcccagcttcaatccgatcctgaacgatactatggtcacagccatgcatcgctttaaccccttcaatgcggatcgtttcagtaccggccccggtaaccttagcgcccatctgattcaaatagttcgctaggtccacaatttcaggttcacgagcgacgttttccatcgtcgtgatgccatctgcaagtgttgccgccatcattatgttctgcgttgccccaacacttggaaaatctaagtaaatggccgctccgtgtaactggttcgcggttgcttcaacatagccatcgcggcgttcgatttcagcaccaagcgcgttcagtccctttaagtgtaaatcgattggtcgtgaaccaatcgcacagccacctggcatcgcgactttcgcatggcctaatcgtgctaatagtggtcccatgaccacgattgaagcacgcattttggatacgtattgaaatggtgcttcggatgataattgacgactagcgtcaatatcaattgttttattaatttcatcaaaatcaattttagtattcaaaaatttcaagacgttgttcattgtaaaaacgtctgataacactggtacatttgataaatgtgtctgaccagaactagccaacaagcttgcggctaagattggtaacacggcatttttagcgccctcaatatggacatttcctgtcaaacgttgaccgccatgaactacaatttcctccatggataaaccctccatcactaaacgataatcaacaaacaagttacgtgagatttcggattgcgtaaaaagcacacttactaaaagaacccgattggatcagatgcctcgcacctgcccaaattccactgttcaccgctgtactaagcaaatcggcaacgcgcggtgtgcaatccaaacaccagctcaaccatcaaaacaacctggacacaccatggcaacttgccaatagcagcatgcaggttcaaatcggttcctaatcatcataccatagaacactagtggataaatattacattttacattttcgttacaatttcaacacaaatattaaatacttatgattagttaactaattagaagtccgtcgtgcaattatttgacaagccatacccatattgattagcagtatcgttcgtttgtaatcgttttctttattgtaatctcactataatttgcattctaccattccacttatcgcaatgcccctaatacgctcaatcgattagtaaaatctagttcacgaacatccgcgccgactggacaaaacatttcaacgtcgcgataaaattggccactgaaacgtttaagttcgatgtaaacttagttgttcatgttccctatgccgacctttggaaattgctgccaattgtcggaatgtgatgatcacccatttaagtcgcgatccacgtcttaattactgctctgccagatactgatgcaatgttggcgaaaaatattcgaatcagaccgattcttctagttaacaacgcgatatcgccattagtaagccagtgcttggcccttgatcaacccacggttccaatctgctttgaaccgtgcaagcttaaaactggacagtaacgggtacgactcaccgcggtaagtttgactaacttgtgcatcgcggcttaactgaaccgcacaaaaaaagcacccgcaaataattgcagatacttttcagaattttaagttgttaatgccgagcaacattcaaacggttcatggcacgccgcaaagcgacttgggcccgcgccaactcagcatcatcgtgcttttgttgggcattttgaatccgtgtttcagcgcgtttccgtgcattttcagctcgagcaacgtcaatgtcattctgacgttcagcactatcggcaacaatcgttgccgtattattactgaactcaacaaaaccaccattaacggcaatttcgtcatcttcctgatcactttcaagttgcttgatccgaacctcatcgattgcaagcgatgcaatcacaggaatatggttcggcaaaattccgagttcgccgtcaatcgttcgcacgatcaacattggcgtcttattctcatagacctgaccgtctggagttacgatgctaacggttaatgattttgcattgtcagccatgtaaacccctcctaatcagttaccatcgatttcgctttttcgaccacgtcgtcgatcttaccaacttgacggaatgcgtcttctggtaggtcatcatatttaccttcaagaatttctttgaagcccttgatggtatcgttgattggcacatacgaaccaggttggcccgtaaagttttcggcaacgaagaagttttgtgacaagaagaattgaatccgccgtgcacgcgcaacagttgtcttttcttcgtcagataattcatccatccctaaaatcgagataatatcttgcaattcacgataacgttgcaagacccgttgaacttccgttgcaacttgataatgttcttcacccacgattgatgggtccagagcgattgaagaagaagctaatgggtcaacggctgggtagatcccttgttccgtcaaagaacgttccaagttggtcgtcgcatccaaatgggcgaaagtcgttgcaggtgccgggtcggtataatcatcggcaggtacataaacggcttgaatcgaagtaactgaccccttcttggtagaagtgatccgttcttgtaattgacccatttcagtggctaaggttggttggtaaccaacggctgaaggaatccgaccaagtaaggcggaaacttcagaaccagcttgcgtgaaccggaagatattgtcgatgaataacaacacgtcttgaccttgaacatcacggaagtattccgcaatcgtcaaaccggtcaaggccacccgcatccgggcaccaggtggttcgttcatttgaccataaaccatggcggtattcttcaaaacgccggaagccttcatttcgaagtaaaggtcattcccttcacgcgtccgttcaccaacaccggtaaacacggaaatcccgttatgttcttgggcaatgttatgaattaattcctggattaaaacagttttaccaacaccggcaccaccgaacaacccaatcttaccaccacgaacataaggtgctaagaggtcaataactttaattccagtttccaatacttcagtactggtcgttaattcatcatatttaggcgcatcccgatgaatcgggttacgttctgcgtctggaccgaattctggaccaccatcaatggtttcccctaaaacgttgaagacccggcctaacgtctctttaccaacgggaacagtaattgaagaaccagtgtcttcaactgtcattccccggcgcaagccatccgtaccatccatcgcgacggtccgaacaaccccatcacctaattccaacgatacttccaccgttaaagtgtcatcgttgtccttctgaatgatcaaggcgttattaatatcgggtaacttatcgtttagagagaattcaacgtcaacaacgggtccaataacttgtacaactttacctgtactcattagtcgttaattcctcccacttcgttattcttgcgcaaccaaaccaccagtgatttcagtgatttcagtggtaatagcagcttgacgcgcgcggttatatttcagatttaatttatcgattaaatcgccagcgttatctgatgcagccttcatcgcggttgacgacgaagcatgttcagcagtcttggcatccaagattgcaccataaaccaagctttcagcatattgtggcaacacggccgacaaaatggcttcttctgacggttccatttcatactcgggaccgacatctacccggctatccttggctttacgattatctgactcactttgttcaaaggtctcttcggagatcggtaacatcttaacggcccgaaaaccagaagagagccgattaataaagtggttgtagaagacgtaaagttcatcaaagacttcgttgtggtacattgatgtgactgtcttaacgatttcacgaacctctttaaaagttgggacatcagagacgccgcggtactcataagccacgtttaacccgttctttttatagaaatccgcaccagtgccaccaaccgccaaaacgactgcgttatcggcatcaaccttgtgcgtccgcatgaaatcgttagtctgtttcaacacgttactgttgtaactaccaacgaggccacggtccgaagtgatcaccaataaaccagtctttttaacggggcgttgcgcgagcaattcactaactgaaatcgtattcgaattactgttagcaacaccggcacttgctgacatcagatgagctttggcaagatgtgaaacgatgctttcaactttagaagcgtacacctgatacgtgctggtatgcttttgaatctggttcaattttgaagttgagaccatttgcattgccgacgtaatttgatgagtcttctttgttgagtcaattcggcgcttgacatccattaatgattctgccatgcactactcaccatccttttcagccataactacttcgcagcggcagcggttggctggaattgttctgcaaacgcatctaaggccccattcatcttatcagcttctggtaacttcttggttgccaaaatcgtatcaaagaggtcctgatgactagcatgaataaattcaaacaattcactttggtaacgggcaatatcatcaactgccactttatccaaataaccgttggtcaaagcatataaaatcattacttgttcttcgaccttcaatggtgaatgaacaggttgttttaagacttcaacgatccgttgcccacgatttaatttcgcttgggttgcagcatccaagtcagaaccgaattgtgagaaggattccaattcacgataagaagccaagtcaagacgcaaggtcccggcaacggacttcatcgctttaatttgcgcatccccaccaacccgggaaacagaggccccggcatcaatcgctggccgcacacctgaatagaatgaatcactatccaagaagatttgcccatcggtgattgaaataacgttagttggaatataagccgaaatatccccagcttgcgtttcgataattggtaaggccgtcattgaaccgccacccaattcatcgctcaacttggcagcccgttcgagtaaccgtgagtgcaagtagaagacatccccaggataagcttcacgacctggaggacgacggaggatcaaggaaagttcacggtaagccgttgcttgctttgaaaggtcatcatagacgatcaaaacgtgcttgccgttcatcataaattcttcacccatcgctgccccagcataaggagctaagtacagtaatggcgctggttcagcaggtccggcagttacaacgattgtgtagtccatcgcacctaacttcttcaacgtttcaacttgggcccgtacagttgagtccttttgaccgattgcaacgtagacacaaatcatgtcttggtccttttggttcaaaatggcatcaatggcaacggacgtcttcccagtcttacggtcaccgataatcaattcacgttggccccgaccaattggaactaaggcatcaatggccttgatcccagtttgaagtggttcgctaactgattgccgttgcataataccaggagctttatgttcgattggccgcgtattcgtggtcttaatctcacctaaaccgtcaactggttgacctaatgggttaacgacccggccaatcatggcgtcaccgactggaacttccatgatgcggccagtccgcttaacagtatcgccttcacgaataccatcaaaatcccctaaaacaacgataccaacatcgttgctttcgaggttttgtaccatcccgtaaactccgttactgaattcgagtaattcaccttgtaaggcgttgtcgagtccgtgagcacgggcgatcccatcaccaacgtaggtgacagtaccggtttcagcaactgagagctcagtttgataactttctaattgttgtttgattagagcactgatttcttcagatttaatgctcataaaagtttcacctcttcgtaaactaattgttgatgagtgctcgtcttaaattcgttagttgtaacgcaacgctaccatcaaacgtttgattatttgacttcacaattacaccgccaatgattgcttcatcgactttacgtgacaaaacaacctgattggcaccaacacgtttggcgaatgcctttgcgattgcatcagcttgctcatctgacaacttgaccgcagacgttacttcggcatgcactattttgcgactctcatcgaaacgtgcttcaaacgcgtcaacaatgccaactaagttcgacatgcggccgtaatcatacaacatttgaataaagtttttaatgtattctgaagcgtggtcagtcaaagttgacaacgttgtctgtttttgatcaaccggaagcaatgatcctgagaggacctctgccaattgcgggttgtcgacaaagacttgccgtaattgctttaactcggccaggaatgcttcggtctgatctttttcaactgcaagttcaaagagtgcctttgaataacgacttgcaattgtaagattatcaagactcatgctttcccaacccttcaatatacgaattaattaatgcctgttggccttccggatccaattgcttcttaataatcttcgtagcaatcgcaaccgaaatgtcagcgacgtctgattggacgttcttcaaggcatcttgacgctcctgttcaatatccttacgcgcattttgtttatactgcgttgcttcgttttgcgcatcggcaacgatacttgaccgttgcttttcgccactctttttcgcgtcagcgacaatttcactcgcttcagcgcgagagtgtgatagcgcatcacgccgttgatcagctaagtcactcgcttcttgccgtgacttttgtgctgaatcaatgtcgttcgcaatcttgtcagctcgatcagccatcatttttgtgatgggcttccaagcaacaacagagatcaatgccatcaaaacaataaagctaatcccgataaacaacatatcaccaaggtagagaccggatgcaccgataattaaatgcgagagcatctaatgacacctccttctttcattttcattaaaatgaactcgttgaccaatgattacttgttcataaccatcaaagcaacaacgaaggaaatgataggcattgattcgatcaacccaacaccgatgaacatgttagtccgtaattgaccagataattctggttgacgggccatcccttcaagcatcttagaaataaccaaaccgttaccaataccagcacctaaagcggcaccaaacatagcaatacctgcagcaattgctcccataatctgtgtatcctccttaaaattaaaaaactagaaattattcctcgtcgttaaccttctgagaaatataaactgaagtcaaggttacgaacacgaacgcttgaatgctcccgataaacactgagaaaccttgccataagagttcaattggaaatgagtaaacatagctcaaccaaccgttgctctttgccaaatcagcaaccttcgttagtaacatttcaccagcaaagatgttcccgaacagccgaagacctaaagttaggaaatcggtaaattgttcaaagacgttaataaccgagaaaacagcaaaaggttgtgtgtattctttcaaataaccacccatacctttcttacgaacacccgcagcatgtgcaagtgcaacggtcataaacgataacgtcaaagtcacaatcggatcggcggttggactcttcagatacgtatactgcccgacctgaacgtgaatgaacaatccaagttggttagcgatgaagataaagagaaacaatgtaaatgcgtacaaaccgaagttagacgcttcgttacccttgatcgaccctttgacaatgccattcgtgaactcgatgagccactccagcacattttgtccacccttgggcttcattgttaaatgtcgcgaaagtaaaaaaacaaacaagaaaacaatcagacaagtcacaattactgagatgtcattcgcgatattaaacgtcagtccaaggaatttgactgtaggaactggatcacccactgaatatcacctctttcctttaatttcggtgctacgataaccttaacctttgagctagtcaacgtcaattttatcgtaacctgaaatggtagattagagacacccctaatcaaaatacaaaggtaataataccaccaccgtcgaaaaaattcaaaataatttcaacatttcgtcaatcaataaaaatccaacaatatcaagctttcattaagctttcaaatcgttggattttcattattttgactttattttcattcttggcacgcgcaatgacggcctacttctcatttaccgccgtctttggcaacaccaagttcatcacaattccgagcaccgttgcaactgctagaccactgaactgaaagcttcccagttgtaaataggcattgccaattccaatgaccaaaatcgctgatgcaatcattaaatttcgcttctgattaaaatcaactttattatcaatcagaattcgcatcccacttgaagcaattaccccaaacagtagaaagctgaccccaccgatgacgggtgatggaatactctcgatcaacgcggataacttacccacaaaactaaagacgatggcaaaaaaggcggccccaccgagcacataaatactgtggacccgcgtaattgccagcaccccaatattttcaccataggaggtcacgggtggtccaccgacaaagccggcgataatcgaggctgtcccgtcgccagccaatgtatggttcaaacctggatccttgaagaaattccgcttagtcaacttattgagtaccataatatggcccatatgttctgacatcgtcacaaaggcgattggtgccatactcagaatcgcgccccaataaatgccaggatgataactaataaaaggcaattgaaaggcgggcatcgcaaaccactgcgctttttccacaccagaaaagtcaacgattccaactaacacggcaatgatatacccacagacgattcccaacaatatcggtactaaactcataaatccacgcaagtacatgttaaaaatgacggtcagtaacatcgtcgccatcgcgacgccgaaatatttaatatcataactactcccgttcattgttgcgtccttagctgccgtccctgcgagtgacaacccaattaccatcacaatcggccccacgacgatcgggggaagcgccttatcgatccagtcagaaccaattaaagtaactaataaactaactagcaggtacacacagcccaccgcgacagtcccctgagcgatggccggatatcctgcggtcttcatcagagactgcatcacaacgataaatgaaaagctcgagcccatatacgccggaatctttccgcgcgtgatgaggatatacattagcgtcccaacaccagagctaaacagcgcaatacctggatttaatcccaccaggattggcaccaataccgtggaaccaaacatcgagaacagatgttgcaccgacaagcctaaccaactacctaattttggtcggtcatgaatatctaacacgacttcatcattatgaaacgccgctttctttgtcataacgcacccctttttatgaatgattgcaaaagaaaagacagcccaccactcaaagcggctaggctgtccgaaattacgcacggcttccttgaaagcgtacgtccgttcatccttttcagcctctctgagctaatttaaaggaactgtttaattgcaattagtctactcgtctccgaaataattgtcaactcaatgtttgaaccgaaccagtaacagcccctaaaaacgatattagttcaaaacatcataatatttgcgacaacattcctgaaataatgtgactttctcacccaacgttaccgaatattcgaccaatacagtgtaatcgccatctaaaacaccctaattatccagtgtcccccaacagttaatgtcaataactacctataatatacgcgttgtacaaattattatttggcattaacggtgattaaaacgtgctaattagattattgcacgtcagccggtgtgggtcctatgccgacctccgggg

SEQ ID NO: 13 - DNA, 54392 bp, Lactobacillus plantarum
caagattcttgacgctacctagttttcaggtgcggcaaaaccgatcgtgcctaataaacgagtatcactgtcttgctcagcatgatattgtcgcgctgcgttgacgtcaatcaaatagtagtgatcccgataacacatcacgttacttagtttaaggtcccgatgcacaatttgttgttgccccaacgcctgtagcgttatcaacaattcttgtgcgacgcgcaccgtcatttcgggggaaaacggtccttgtgttgccaatcgatccgctagtgtttgaccattaattaaggtctcaacacttacaatgcaatcagccgccgttaataatgcttcgatccggggcattcggggaattggctgctgcttcaaacgctgtagaacaggaatattatcaggatttactagtttagctaccgaaacaacctgttgcttcttaaccagtaacggaaactcgcgttgcgcaactaatggtcctagtggttcataaccagccgtacttaacaattgcattgcttgaacaatcggtaacaccgtgacacccccctttttatcaaaattactaacttttatcataaccatacttttggaggaattacaatgtcaaaatatcagaataacgaagtcacaccagtcgcaccccattcgcgaacagccgaattagttttaggaattattggcggtatcttcggtatcattgccggcttactggcgatgaccatcggcggcatcggtagtgctttagaaaccagcggatcggctggggtcagcaatcttggcgttggctgcattattgtctctgtcctcgcgattattttaagtgtcatgattaatcgcaatcacgttttaatgggctggttgatcatcctttgtgggattcttaacttcgtctttgtcagcttcttcgggattctaagcggtctgctcattgttattgcgggcggcttagcactaagaaagtaggtaagctcatgcaaaaaacgaaagcttggtatcaaaaatggtgggcgtgggtcctgattctccttggcatcttctttgtcatcagcctcgtcaattctccacaagacggtaaaaactcacaagcagcgacgaccaaaaagaccagcgctagcaagtccaccgctaaggaaaccccggcaaatacgatttataaagtcgggcagacagccaccatcgatcacgtgcaagtaacggttaataatgttaaaaccgcaacgacgctcaatgatgttcagcctaaaactggcaatcaatattatacggtcaccgtaacattgaaaaatagcggtagagataaagtcagctataacccgtttgactttaaaatcaaggccgccggtaaccaaactagcctagatgagatcaacattgatgaaaataaccaattagatagtggtgacctgaccgctggtggctctgtcagtggtaccatgactggtcaagccaaagcagatgggtccgttgaactcatctacaatcccagctacttcagtgatcggcatttgacctttaaattacagtagtttctggtacactaatactaattaagaaggagtattaggggggcactaaccgtggtagaacgcgcaactaaggaactatttaacgaaatcaaacatgcaagtgaggccgaccaatttatgacaaatatggccactagttttattcgtaccaatccggcggaatacctcgccgagcttattcaaatcaaacacgtcactaaaagccaagtcattcggcgcgctaatctaacgccctcgatcggttaccagtacttcgatggcaagcgccgacctaaccgggctcgcatcatcgccctcggattcggttttcaactgaccctgaccgagcttaacacgatgctcaagcgaactggttacgccgtcctttatgctaaggatgaatgggatgctctggtcatcttcgcacttagtcagcgctttgatcttaatcgtactgatgaactactttatcaatacggtctaggcacgattaccgacgaagattagcgtagttgccaacatccacactaatgtcctatggcagactcacgccaactaaaagttcggcataaccaggttctagaatactaaaagaccaggccctaatgagttgaatgctcattagggcctggtttgctcaatctaggtcaaagataaagatgatggtttcaatcaatacaatgaacgggatgtatcgaacaaataagataaagtaccagaaggcctcgttaaaactcacaacattgaatctagttatccctagaataatcaaacagctaactagtatcaaaattgaaaatagcttttttatccttaatcgtttgccaaactctgaccccataattacggccagcaacagcccacaactcacatacccagtgagctgattactatccagcttaaatccaacctgaacccccgtcgaaaagtaaagtgccgcaatgtatatcagcaagtaaatccctgcaataacttgaattcgtctgtagctattcatatgtctccccaatttagcagttcttagaataaaactatactaaaaggaaaccaataagccaatgcttttttcagctatgtagcacctgtaattaagcatcgttaaaataaaaaatcttcaacaataaatatttcaatcccggttgttcaactttagaaccgtgcgcaaggccgattaagaagctacagtcaggtacgctcaatggcactatcttactcatccacgtccgctccaaaacagataagcgctgttccagctgtagctggcaaattcttgattattaaattaataatattcaatttatacattgggattaactcgtttataaccgaagacagattgtcgaagtgctaccgctgctttctgaaaatattttttaacacttggacgctttgcaccatcaaaaaaggccaaacgcattgcgcctgaccactaaaatcaactcgtaatgaaggtgataaatacctcgttctaaactggcgcaatcaaataatacccgccactaagtccaatgaacaagtagatcaaatgccggactgtcgtcatgggtagccgcggcaggattcgtgccgccagcgccgtcccaatgaccgcacctaccataccaatcataatatgggggagcaagactggcgtcagaataccgttcagtacgcggactgtcgaaatatagaccacatcgatcaaaaagaaagtctgcaaatttcccaagtaatccgcagtcgtatcggcaagtgatagaaaataaagggccatcagcgggccgccaataccgaataacccattgaagaaccccgaaataatcatgaagagaccggctaaccaccacggataagtctgattcgccgcacgcttgctcagactaaagtacccggctaacgaaactaacagcgcacctaataaccgtcgcaataattgcacatctaaaacttgaccaagatgtaccgaataggccgccacactggcataaacgataaacggcacaataatctgacgaaagtggatatgctgatgataacgccaaactaatgttatgacactggctgccataataacgcccgccacggccgcactttgagcaatcggaaacaactgtggtaaaaagatcatcatgacgatggccgcaccaaagcccgttaacccttggaccagaccagccaataatccgggtaagaaaaccaataaccataccatcaacgtatcctcttttcatcataataaaaaagaaccgggtcacccagttccaacaaaatctaaatatgaattagtaacacaaaaatcatcactgagactagaccaatcaccactgataaagtcattgaacgcgtgcgataagccacaaatccaacgagaatagcagaaataatcatccccagattgccagaagtgatcactgcgtacttactatcgataaagacacttttaacaactaacgccgtgaatagtgagacgggtacgaaccgcatccattcattaaaccattctgggatcttccgcttcgtaaagaacagtagcgggaaaaagcgtggtatgaaagccacacacgcacaaaaaatgaccaaccaaaaatggtccatactactcattgagctgactgattgcataagaaaaacccctctgtgccctacttgtcagattcttccatggctgtttggccagtaggatcgtgaaccttatagagtaaatgactttctggcttatgtgccaacaagtaacgttcaataaagtaaccggtcaacgacgcgagtagtgttgacaccactaggcccagcgtactcttcattaagaccagaaaacctatcgttagaacgccagacaaaactgccactaagataatcaagcggctcttagtttgcataattgccatataaatgaatagtgccgtcagcgcaaaatccaccacttggagattaatcgtcaatgcactgccaatcaaactaccgataatattacttaccgtccaaaataataacgaatagtgttcgaccattaaggcctgcgatggcttccaatgcttgtccgtcgcaaactttaaatagttgaccgcgtaattttcatcattcatcgaaaacgcaaacgtaaaaatgaacggtaatgattgccccttcagatagcgcgataagctggaacctaataaggcgtaccgtaactccaagaaaaacatcatcaaaataatggttgtcatcggtgcattaattgtcagcatcgatgcaattaaaaattgggcgccaccggaaaagaccattaccgaaattaacgccgtcagtagatggttgaacccggccgcatgcaataaaaccccacaagctaacccgatgggaatatagctaagcccaagcggcattactgttcgtaataccactaaccaatttggctcgttctttttcaccaagaatgcctccagtaccataccagtaaagaattctagcaacaacagcgagcgtcaaattacttagacactcggacttaattttaacatgttttttattgcaatcctacaccttgttaagtttttaagtgtatgtaagcggtatcaataccattttttacttgaaatgttgtcccagaatcactaagtcattcggtcggccacctaattcagcgacttctggcagaaacccccactgttcgtacccaaactttttgaacagcttaatgcttggaatattacttgaaaaaatataagcgataatcgttgttaatcccaacacaggtaattgtttaggaactaatgtcaaaacctggctaccgattccctgtccttgaacactgcgatccaaataaactgaaatttcagtcgtctttgcatacgctgcccgtccataaaatggagataggctaacccaaccgaccactaagtcgtcctttacaacaacccacagcggatagtgttcaggggtatgactcaaaaaccaatttcgacgttgctcaaccgtaactggtttaagatcagccgtcacttgatgactgggaatcgtttgattgtaaatatctacaataatgggtaaatctgacatggttgcagttcgtaatgatacgctcataggtgactttcactccattcgttttaactactgttatcagtctttattatacagttaatcgtggatcatgctaacaaattctatataaataaaaccgcaaagctagtattcaaatatcagcaaaaaagaaagaacgctcaaactggaacgcttgtagcgaatagtcgaagtagtgactaagataggcacacggcctaatttagggaataatttttaacaaagcacctcataattatcccgatttaaacgttgcttttttagcatcgccaaatgaagactattaatactctttttatcataacatccgcagccgttcaacttggtcatccttgacagtgcctttttgaaattactctggatgctaattatttttaattagctaaatcagtggcacagccctggtcattagttgcctgtcatgaatcactattgccaacaaaaaaatcctccttgagcaggcaagactcaattactagcttgcctactcaaagaggaatatatcttttaagaaatatctcgtagcgtttactaagctaatgcacccacagaatctaatacactaactgctataatttatttgaaccagctcttaaccccgcgccacatccgtacaaagatatttgctttgtcgatggacttcttaggcgttacattgatggtcatattcttactagtcgttccgtcaactaccttgatagctttcttgcttaggttcaagttaacagtaccgacagtcttgccattcttaacgggtgcttgtaatttaccatcggttgtcgccgacttcttcaagctaaccttaccagtaacggcactagcatccgtcccggttggcaagtaaatcttggttgcaccactatttgaaacgagttgcaacgttaaggacttcccatcttggacatcaacggctttcacaccattgatcttgccattcttgttaatcgtcgtagtcgtgtagttgtggtaaacatatgacatgatttcagccgtttgagtgaaacgttccgtcccactatcgttagcggcaccggcatgcatgacgaccgtaatgatccggttaccattgctaaacttaacagtcccagtgaaggcattcccagccttagtggaagttccagtcttcaaaccatccacaggaagtgcggagtaatgtttaactaatcctttgagcatgtagtttctgttatccatcttggttgctgaactagtgcccttttcaaaccaagcatgggcaatgctagaagtctttaaaacttctgggtaatctgataatagcttttgcgcaacggtagcaacatcttgtgctgacatttcgttttcagcactgacggcaacgttactgtacccaattgtgctgccaacctctttattggttaatccactggcattaataatggtagcgtccgtgatcccccatgatttagccgtcttccgcatcaagctaacaaacttatggggcgtcccggctaccgcgtcacccaaggctgtgatagcggcgttagcggaatagatttcagtcgcgttatataattgccgcactgaatacgtcttcgttgataataacggtacgttcgcatattccgtgttttggctcatcttagcgactgccttgctaacactgattttttgattccaagacaacttaccttcatggatcgccttaagcactaaatatgtacttaacatcttcgtcattgatgcgatcgccattggcttactactgttcttatcatacaggatctgaccggtcgacgcgtcaaccgcaatggcggctttcgcagagatcgatggtgtactggctgcttgggcctggaggtcagcccccgcaatgcctaaaccagctgtactaaacgtgactgccgcaacgagggcaatcataactttctttaactttcccgcaaatctcatttctcaattatccctttcttaattgctaatgctagttttagtttaaataattatgtctgtggaaacaagttaatttatcatatccgattgtttttttgttaatgggtggtcatgtttaactggcaaatgaataacaaagcttgtctgctcatcatcactttgcgcataaatatagccaccgtggtgatccacgatactttgggcaatcgctaagcccagtccagaacccccggtcgccttagaacgcgattcttcaacccgataaaaccgttcaaataagcgtcccaacgactcagctggaatacgctgaccatcattcgtgacgtgaatcacgacttcttcaccacgttgttcagcttgtaatactacgtttttagcaccagttccatatttaaacgcattagtgatcaaattgctgaagacccgccccagcttttcagcatcggcttcaatgtaaataggctgcgtgccactttctacttcaatcttcagatgcttcttgttcgcttccagctcaaagcttgccgctaactgttctaacatggccgtcaagtttaaccgattaatggccaacggtgtctctgtctgccgtgatttcgtatattcaaacagatcttcaaccagtgacttcatttgtgttgccttcaaataggcaatatgcgcatatttaattaaatcctcttctgattggtactgtttgttctcaattaagcctaaatagccgataattgacgtcaacggcgttcgaatatcatgactgacattcgtaattaacgcatccttagaccgctcaatttcccgttcctcgtccatcgagtggattgccgagtctactaaggcattaacactttcaacgactcgttgtgtatcaccagtcagattaaagtcaatccgatggtcaaagtggccggccgcaatataatgcaactcactaataatatgtcgtaactgcatctgtttgtatcgtcgaattaatcgccaatataatacgaaaccgtccgcaatcagcatcagtccaataaagatattttcataactccatagctggtagttattgggaccaatggtaatcgatcgtttaatttggaaaataccgctctgtaaccccggattatgcgcaatcgtactgttgatcagtactacgatcgacaagtttaaaaggagtagcaaaatcaccgtcactaccccttcaaaaaataattcacttttttcgcgtcccgttaatttcaaaagctaaccctcactcttaacgcgattcgatcttatagccaacgccccaaacggtctgaatgactttttctccatccgtggcttcttcgatcttatcccgcaaatgactcacgtgcaccatcacggtcttagctgagacaatactttcttgctgccaaacacgttcaaaaatatcatcagctgaaaagactcggttaggatgacttgcgagcaaatacaaaataccaaattctaacgcggttaattgaatatccttacccgtcaacgttttaacttcgtgcgaatctttattgatcgttaacggtccaatgtccaaaatatcaggctcggtagtcgtcacgttattttcagaacgtcgtaatagtgacttgacccgtgccataatttcaagcggattgaatggcttggtgacgtaatcgtcagctcccgtaatcaagccctgaatcttgtccatatcgccagtcttggccgacaagactaggattggaagttgggaatctttccgtacttctttgatgacctcaatcccatccatttcaggcatcatgatatccaaaatcattaacgcaatatcaggattcgtatttaatttagtcaaagcttcacggccattataggcgctaattggttcatagccttcgtttttaatataaatttctaatagttgtgcaatttctttgtcgtcatcgactactaaaattttcatcttatttttctccttaaataattctgtttttattttaccaaaaaagcggccgggcttggcagttaacgattgattttagagaaaacgcaactattccgcgtcatttgccgtacggtgaactaataaccaggtatagtatccacctactaagatcaataatcccgccgcaacccatatcgtccgtaatgtccaccaccgctgcaatatcgccgaaacaatcgcgcccgtagcaaagctcaacactaattcccaatacactaaaccagtgtcaagctccgtgcgcacgcctgtcaaccaataattcgtcagcgcgatcgttgccttcttgagattaccggtagagaacacgttattatagccgtggccggcgattgcgctgaaggctgtcgtctgcatcgccatcacgaatgcgagtggtgggaccaccatcgcattactaacagtcgctggtagcatgccgaccattaaacaaacaaccagctctgccaccaaaacgggcaagcgccagtagtgtgaccgcgcgcccaaccattgtttcagtatacccacgacaatcacacctagtgtaaaaaagaggactgttgctaatttagtcaacacacccggtaaattccactgtgccacatcaacactgagaaaaatcaaattacccgtttgaccagctgctaagacaccaccccgttggatgaatgtgtatgcgtcaataaagccaccgatacaggttaagcccaagccaatttctcgtaactggaataaatggcgtgactgaaaccgttgcatctactcacctacttaatatgttgaatttggcacctcactaaactggtacaatacgttttaataagtccatcatagcgcaattaatcatcagtacctaacgaaaacgcgccttttaacccatgacaggttaagagacgcgttcataatcatcacatcattgctgatgattctattgttagctattttgggtggttaaataatcattaaacgctggtgcgaaatgggcatcaactaccttaacgtgggccgctttgaaaactgaccgaatcgtcgcaacttgcgtctgcttgtccatcatccgctgttgctggattttttcacgcaaataatttgtcacatcaatctgcttaccgctatcatcagttacagccgcagtcttagatcgacgactgacaacgttgataatttcataagttggtttgtctttcgtgtcggcagttgccataactgttttgaccggtttcgtgacatagtgtcccactcgtagtttagctgtggcctgtacaattgctggtgctagagtttgattataactgtcaaactgcgctaattttccagcagttgtgtgcgcttgtcgattattctgatattttcgcacttgcgaatcaaagctagcacccgcattcagttcagcaataattttttgcgcttgcttctcattggccgtcgcaatgtgttgaaccgttgtcattggcatataagctgctcgggctttttttagttgcgctttagtcactggatacttagcactaacggctttctccatcaataaattcgctttgatttgcgattttaaacgcggttcagtgacatgattacgttctaaaatcatgtgataatttgcgcccgcctgccgtttgaatgcttttaatttagcagttacttcagcttgtgaaacatgatatcgttgattaaggactttgtttagagtcaattcttgaacagcctgttgcgtcgtcgcttggttttcaatttgtttaaatacttccgcttgtgtgacctggccagcatctgacttgaccaatgtcgtagccttcgcttgacaccctgttaacatgactgcgacgactagactcgcacctacccctattaaccgatacttcatttatattagcccctttctttgcatcactaatgccacgatatcattaaaaatctaatgaacttaataagtaacacaatcgtgtacagagctagtatcaacgtcccaacaagaaagaaacactacggtcaatctacacgaacgttacatctgcctatatcttccgctggtactcaccagacaaaaaaacgtagaacaaagttgatgttctacgcttacttgatgcttattcaactaaaccaatcagactgactcatacgatatcgtcattttaaccgttgactgaatagttcggtgcattctttgtaatttgaatttcatgtggatgtgattcgcggagcccagcgccagagatttcaacaaactgggcgttttcgatcaaggcatcaatgtctttagcgccaacgtagcccatgccagaacgtaaaccacctaacatttggaagataatatcatcaacgctgcctttgaatggcacacgtccttcaacaccttctggaactaacttgttcgcttcgttcacgccgccttggaagtaccggtcagacgaaccatgagcttgtgacatcgccccaacggaacccatgccccgatagaacttgtattgacggccatcgtcaaagacaacctcacccggtgcttcggctgttccggctaacatactcccaagcatcacggcgttgccaccagcagcgagggccttaacgatatcaccggaatacttgatcccaccatcagcaatgatagctttgccgtattcgcgagcaacgctggcagaatcataaaccgctgttaattgtggcaccccgacaccagcgacaatccgggtcgtacagattgaaccagggccaatccccactttaacaacatcaacaccagcttcaaataaagcacgcgtgccttctgacgtcgcaacgttaccagcaatcaatgtctgcttagggaagtgggcccgaatttccttgatcttccgaagcacaccagcggaatgaccatgagccgtatcaataacgatggcgtccgcaccagcggcaaatagggcttcagcccggtcaaaggtatcactagtgaccccaacagccgcaacggccaacaagtgattgttggcatcaacggcagcgtgtgggtgatcatcatccttaacgaccgctttgatcttcttaacttcttcagcctgcgcttcaatgcttaagttcttatggataacagctaagccaccttggttggccatcgcgattcccattgcggattctgaaacagtatccattcccgcactaataattggaatattcagctgtaaattatcggcaagtttaacacctaaattgacttcattcggtaaaacatgactttcggccggaattaatagtacatcatcgaacgtataacccttttttccaaactttgtatcccaattagacattgaacgttagctccttatgtttttatttttatctgtaaaggtaacaaaacatcgcgataaatgcaaggggttgcgcagattttcagaaagttcttattttaagcctgtaacgcccaaccgaatgttccaggttgggccgagcgtacttcacacacaactttcattcagtcattacatccgtatcaccagtttaaaagctaactaggtgaataacaagcaatgaccacttgcaatcgacaaaaagacaagccaatgcacgccatcagcttgtctttcagtccgagcctaaaacatgctcgtcgtaatattaaagcgccgcttcaaccacatccgggcgaagaagacgacgacggcaatgatcaagtacgcgattcctggtaagaccgggttcaatggtccttgaatcattgacatggttgtaaagactaacatccaaacgatgatagccagtactgaccacgcgattttcttccataacgaaactttcttgccatctttagcaggcattaagtattcgaataacttagcaacgcccaaaccaccaatggcggacgtaatcagaatagcggtgatcccgttggcaccagctgaattcttagtagcgttcgtgccgatgaagcccatgatcccgtacattaagcagaaaatcatgaatagcatcaagccattatccagcgccgtgacccaatagttcgccttttgacgttctaccggtgtcttttttggattcacaatctcttcggtccgttcttgaacggtcccgtataattgacgagccgtggttccccgaccttgttccgctaacaatgtagacgtcatttcattcagaactgccgtctttttctcaccactcaacgctgtggcatcaagtgacttgcgcatctgacgcatatattcagcattgcgcttcgtcaactcagtcgcttcgtgaactggccgttctgcggcttgagcctgcttggccccggccgcggcgttcctaggtgtctttgaagtttcgctctcactcactatacaattgctcctttcagcttaaacgttgaagcggaattcgacgatgtcgccatcttgcatgacatagtccttaccttccaaacgcagcttaccattttccttgacctttgcttctgaaccggcttcatccaaagcatcgtaagacatcacttcagcccgaataaatccacgttcaaaatcagagtgaataattcccgctgcttgaggggccttagtaccgcgtttaaacgtccaagcccgggtttccttaccaccagccgtgaagaaggtttccagtcctaatagcttgtaagaagcccgaatcagcttattcaagccaggctcttcaacgccttcagctgctaaaaagtcggccttgtcgtcatcatctagttcggcaatttcttcttcagtttcagcagcaacaccaatggcttgggctccttcttgcttagcatagtccgcaaccacttggaaatacttagagttttctggatcggccatgtcatcttcggcaatattggctacatacagcactggcttagacgttaataagaataagcccttgacgatttgttggtcatcttcgttgaattctagtgaacgcacgggtttgccggcttccaaggcaggtttgatcttttgcaaaacagcgagctcagccttagcttctttatcgctccccttagcagcccgttgcactttagccaaacgcttatcaacagcttctaagtccgctaaactcaattctagattaattgtttcaatatcatcttgcggatcgactttacccgtcacatgggtgatattgtcatcatcaaaggcccggaccacgtgcacaattgcgtcaacttggcggatgttttcaaggaacttgttcccaagtccttcacccttactagcacccttgacgatcccggcgatatccgtaaattcaaaagtcgtgggaacgaccttctttgcggggatgatttcttgaattcggtctagtcgtttgtcgggaacttcaaccatcccaacgttggggtcaatcgtcgcaaatggatagttggccatttcggcgcccgccttcgtaattgcgttaaacaatgtggatttaccaacgtttggtaacccaacgatacctgctgtaagtgccatatcggttattcactcttccttttttaataattaagcttgatcggctttgctttctaatacctttttgagttttttattgaactcacgacgcggcatcatgaccacgtgaccacatcccgtacatttaatcttaatgtcagcgcccatccgggtaatttcccagcgattgacaccacacggatgcgcctttttcatctcgacaatatcacctaaatcatacatgcgcaacgcccctttataaattaattaatttaaatcaatactgagaatttctaaaatccgtgtcaaatcttcatttgacaagtacggaatttcaattttcccttgatcagctttgttcgccttagtttgaatcgaaacggccgtcccaaacttctcttgtaattgttcttcactcgcacggatgtacggtgacttcttgggtgcaacttttttggccggctccttggactcgccgttataacgcgccacgatttgttccaactgacggaccgtcatgttatccttcacgacgcgcttcgctaatggcgctaacttggttttattcttcaaagacaaaagcgttcgagcttggcccatggacagttggcccttttggatatactgtttgaccccatctggcaagcccaataaccgcaaataattagcaatatatggccgactcttgcctaggcgctttgagacttccgcctgcgtcaacttcagcttcttcatcaacgaatcgtaggccgcagcttcttcaagcggagttaaatcttcccgttgtagattttcaagcaccgctacttccatcatttgttcttcggtaacatcacggacaatggctggaatagtcgtttgatgagcgagcttcgacgcccgaaaacgccgttcaccagcaatgatttcatatttattcagctcggcatccggttgtcgtacaatgattggctggaaaacgccggacttttcaatcgagctggcgagctccttaagtgccgtctgatcaaaagttcgccggggttggtacggattggcatgaatatccttaagatctagatcaaccacggcttcttcactagctggttcgttaacatcggcaaacagggctccaataccgcgtcccagcgccttattatctttatctttacttgccatgagcggccaacacttcctttgctagagctaagtagacttgcgcacctttcgaacgggcatcataatcgacaatcgataggccgtggctaggtgcttcagataaccgcacattgcggggaataatcgtcttatagacggcgtccttaaagtatttccgaacttcttcgttgacctgggctccgagattggtacgggcatcgtacatagtcaatagcacgccttcaattcgcaactgtttattaaaatgtttttgtacgagcttgatcgtattcaataactgactcagcccttccaaagcatagtactcgctttgaaccggaatcaaaatcgaatcacaagccgtaaacgcattaatggtcagcaagcctaacgacggtggacaatcgatcaaaatataatcataatcatccttcacgtcatcgatggcatcacgtaagcgggtctcacgtgccatcatcggtgtcagttcgatttctgccccagaaagctgaattgtagccggaacgatatctaaacccttatgactcgttgggataatggtttctttaatgggaacgtcattgattaaaacgtcatagatttcacgttcgatggtcgacttttgaacacctaaaccactggtcgcattcccttgcgcatccgtgtcaattaataaaactttttggcctaattcgaccagactagccccgagattaatactcgtggttgtcttgccaacgccacctttttggttagcgagtgcaattacggttcccataattattgatcaccccttggttgattttttggaatttcaatcgtaatccgatacccgtcatccgtatcctcttcatgagtcttcacgggtaagccggcatcagttaccatcttaattgattttttgatcgtattcacagcaattcgcgtatcgccggtcaacccccgtgcacgtttgcgtttgggcttcggcggcgtttgggtcttcgccactagctgttctgtttctttgaccgtcaattgatcatcaagcacccgtttcaaaaccgcagcctgttgctccacagccaagttgagtagtgcgcggccgtgccgttcgctgatttgtcgctgcaacaacgccgtttgaaccggctgtgctaacttcaacaatctcaacttattcgcaactaacgactgacttttgcccaattctttcgctagcgccgattgcgttaattggttgagttccatcagttcttggtaggcccgagcctcttcaatggccgttaaatcttgtcgctgtaaattctcgatcagcgccattgacgcggtttcaccatcatccatcttttgaatgatggccggcacatctgcccaatgaagtgaagaaatggcgcggaaccgccgctcaccagcgataatttcgtatttctgcggttcgtattcccgcaagacaattggctgcaacaagccgtgatccgcaatcgtagcagccaattcagcaataccagtttcatcgaagacttgccggggttgaaaccggttggggataatggcagtgaccggaatacggacaatttgttgctccgtgggggtcgtggccgcctcggttttatgtttatcacgattagaaccaaataatgaaaatgccattgaaattacctcccaccttacattggtgccgttaacggctgtttcgccggtgtccccggcttgcgtggataccgcttcggtgacggcttcttcttatcaataacaatgatatggcgcggatcagcagtcacgggcaaactaaaggcctcgtcctgaacaatttggccccctaattgttgaacggcgtatgtcccttcagccgtttcagtacgggcattggctgctttcaatgcaatcatctggccgccaattttaacgagtggtaggcagagttcgctcaatactgataggcgcgctactgcccgagccgtcacgatatcgtagctttcccggtgagcagacttcttgccagcaaacgtttcagcgcgatcatggaacgttttcacacccgttaagcctaattgttggactagatcatttaaaaaattgattcgcttattcaatgaatcaacgatcgtcacttgtaactgtgggaacgcaattttgagcggaatcgacgggaaaccggctccagcgccaacatcacaaatcgtgagcggttgatcacgcagcgcaggaacgtagaatgctggcgtgagtgaatcgtaaaaatgtttaagataaacttctggttccgctgtgatcgtggtcaggttgaactgcttattagtcgtgaccaatagttgaaaatacagcgcaaattgtgccaattgttttgccgtcagcgcaatctcgtgttgggctaacgcttgtttaaattcttctggattcattagtaatagctctccttaaaggggtcacattcgtcctctttttgtgaaacaactcaatgtttcacgtcacctcataactttaacgtaaataacacttaaaatcaatgcacagccccgctgttaaaatcgcaataacccttgaaaagtctgcttttacagccatcattgacagctattctagtttgcaatttttctagtcaaattcatgaactgccttgaacatctcaccgttaaaaacgacaccggataaaagtatgacccgatgattcattaataaaaaagaggccagccgaatagctgacactcttacgtttaattcaagattaaattatatcaccgactaccaaacgaacaacccaacgacaccggctgatagtaaggagaccaggatcccagataatagcatgtaaccaacattccgtgaaatcaaatcgttcttttcacgatcaacgattcccttgaaagctccaataatcatcccaatcgttgagaagttcgcgaaggacgttaagaagaccgttaagactgcccggaaatgcggtgcaaaatcgttaactttgctggaaacttcacccatgacaacgaattcgttagtcactaatttcgttcccatatatgaagccatttggaaagcatcacttgggttaaaaccaagtaaccatgcaaatgggaacatgacaaccccaaagatgttttcaagtgataaattgctattgattaaacctaacaacttatcaattaatttggctaacgctacgaaagcaataacgttagcagcaataatcaaaatcaagcgaccagcgcctaagattgaatcacccaagaaagagaagaatggttcgcgagctggtttagcttccttaacttgttcattagctaattcttcagaaccgctcgtttcagtggtggcagtagtttcttcaacagccgcactacctgagattttcgcaatggtatcttcttccggcttaacttctaccggattcaagattgcagcaataatcgcagcgtttaagacgttcattggcaccgccgtcaaaatgaattgaccaggcatcatcttaatgtaagcccctaagatcgatgccgtcacacaactcattgacatcatcgcaatcgtcaagtttcgttgtgccttcatctgcttcaattgtaactgcgaaacagcaagagcttccgtgttgcccaagaacatcatttcaacaacgaagaatgattcgaactttggttgaccagtaatgtaagctaagccccggccaacccatttgataatccatggtaatacgccaatataggtcaaaatatcgaataatggcacaatcaacaagattggtaataatgaactagtgacgaagtccatcgacttaacgttaacccaactagctaacgcaaaggcgatcccatcgtatgatacattgacgagccaagtgaagccatctgccgctgctttaaccgcgtcgacaccgacttgtgaacccgttaagaaccatgccaataagacttctagtactaacatgacaccaactgaacgccagttaatggcgtgcttttgcttggagaataagtaggtaatggcaataaaaaccacaatcccaataatattaactaccaagttaaagaccatgtgaataatccctcttccctatgaatgtaagaaatatgacaaaactacttctattaatttaccatttaatacgcacttgcggtagcactttttaaagaaaagcttaagttcttaattaggccgtaccaatttattgaaaggccccgtccagatagtgctggtaaccgtgagaattttagttatgtctgcccaatttcattctaaattttagtaattctgctaatcagagatcgaaaatttaggcccatcttgattaaccgttaacttattgtgactagaattaatttattaacttagtaatttatctgagtattctctaagtcgttaagttacaaactaatagcaataataaaacccacacattataatctgtaaaattaaagtatcatgattcaatttatctatatttctcaccgcaagtacccgtaattcaaagtcattgtatcaatcaagggccaatttaataaatcattatcagttaataaatacctcaaatcattaaataacagttgaaaatcaccagttacttggcagataatagacttttgttgttacaacccgggaatcattgagattgactatatctctatgttggttgcattcaattatttttagttaatctttttaaaactttatgccaatatacaaaggagaatttcatgcgtcatttggggaaagtaccagtttggattacttatacagtagcctttattattttaacttgcatcatttatagtccactatttctggacggacggtctttgatttggacagtagatgggatttcacagcatttgccaatactaacagcattccaaaaaatgcttaagggaattggcacacaatcattatttggatggtcctggaatcttggcctaggagccgatcaaatgacgacttttgcgtattacgttgtcggcgatccattcaactacttagtcgctctatttccaactactaaaattgaatttgcatatcagtttctgattttgattcgcttatatgctacgggcctagcttttttaacatttgctaggatatggcactttagccgcttaagtcttttaattggttctttaacatataccttcactgcttttgcacttcacatcggcatgcatcatcccttcttcttattacccctcatctttttcccattattatgttggggaattgagcgagtattcagaggaaaatcatggtggcccctggcaatagtaattgcaatcacggttgccagtaacgtttactttgcttacgtattagcactcgggagcgttatttacacaatctggcgttattggcaacaatatcgtcaaacaaaaacgtatgcacgattttggcaattgatttaccacttattaagcgctgttttagtcggtgtagcgtgtgcagcagtgttagttattccgaccgtcctcgccatgttgcactcgacacgtacaggtggccaatttgccaacggattatcgctctacccattaagttattatattgcgctacccaatttggttttaaatagtgatgggatgccgttttgggtcattttaggtatcagtagcctaacttggttagctattttacattcgttacgtcattttaaacaacgatgggacttaaatagtctactcattattttattagtaggcctattacttccagctgttgcagccacattcaacgttctatcttcgccctccaatcgttggctattattaagcactttgctgttcagcgttcttacaatgcgactcatcgatgactggaaaaaacttgatagttgggattaccgactatttctaggcgccagtgttggcttaattataattatttgggtcgtaaatggttttacttttaacgttagtgcgcgcgacctaatatcatatatattactattcgtcttaatcacctggtttatcgggtcaagtgcgatgcatttaagccgcttaacactgataattggctgtttcactctgctatgtcttaatctaattaatactggctttggtgcaactatgaccagttccggagttgccaatccacaacaactatatcgtggaagtgccacgagttggattaataaatatttggatggtgctcaaaaagctttaccgcgtaatgataatttctatcgaactacattaacccctggattctatgctagaggagctgcttctggaaagaaaaacatctcaatgttgctcggcacccatgatattgcatcctatttctcagtacagaatagaagtattagccaattttcacagtcaattggcaatcaagaggccgatcctaattcaccactaagcacagctgatggtcggacaacaacacgcaaccttctgggggtccgttatatatttgaactagcagaccgttatgaccctaaaaatattcccgtaggctatcatgctttaaaaaacaacgatgggcacgtgcgtatatttaaagatcaaccagtggccggtggattatctaacaaaaccggaactatcgtttttgttaatgacaactttttaccattagtatccacgcaaaacgctcagattagcgcagccaaatatcaacgattaaatgctgttgataaagagcaagcaatgatacaagcgccgattactgataagccaataactggtgttaaacaagtgcaacctcaaaaaatagccaccactgtcccctataccgttaaagttaggaatattaccgacaggccagtcaactcttcaagccgactaagccagaaattagtcactactaataaaaaaattgttaatgacaatcaaaccactaaccaagatggtctacatcaattagttagtgattgtcagggacatcaattgacctatgatttaattcttgatcatcctgaaaagtggcaaaataaagagttatatttagaggttagcggtatgacaatggtcaaacctacgttgaatcaatttttgcaaaataatgcggctaatgccgtatttgctaatcgccccaatacaacattagctaagattcaacagtttcgccaggcacttcatactgattggcaactcagcggttactatttatccgcatcaaccgcttatcgaagtaacaacttttcacaacaatcaccaactaatctttcgaattattcgattcgaaaacgtgttattttaaatttaggctattcaagtcatttacgaagaatcgtgaccgttcgttttagtcaagtgcctgaactaaaaatccatcatgtaaaattaatggcagttggatttaaggggcgctaccagcgtcaaatcaaggccattcaaaagcacggccttaaacaacaaaaggtaactaacaacaccattacgggtcgcactcaagcacaaactgccagcgtattaactacctcgattccatattcaactggttggcacttaacagttgatgacaaaccaactaagactcaagttgttaatacaggtttcgttggtgcaaaaattcccgctggtcagcataaagtcaaattacaatatcatacacccggattacgattgggcgctataatttcgttaattggccttttgcttctactggttagtatcctttggcaatcacacgcttggttgcataatcaatcaaaccagtaagaactccagtctattttctcgtattaaaatttacacgtaattcatgctttctgatcaaaaaagttcgattcgtcattgaatcgaactttttctatcagctcccattttgaataataaaccaatgatgaactgacttgatgacaactgaaaattcagtcgttaagtcccccgcaaccgcggagtgcccctgccaaggaattctattataccgcgtttagtccgtttgcgaactaattagttgacctgaccattaaatgggactaaactacggacaattaatgaaagggggtgatgctttttgagtaccatatgtaatcttaaagcatcagtctctgccctattcggagcacatgactgatacctttaaggagtcccgaccaaatttacttggtcgggacttttgctatctaaaagtgtgtataaacagttgcaagttgactgtgagtggcttacattaaaagtgcagtttatttggagatatggagtaacgggaaatatgaaagcaacgacaaaacaagtattgacaggcgctacctggctagtagttctgctagcaatgatcggtggtaccatgctttggcaacaacaagcccacaagtcaaaaccggtcaccaccataacagtgacttctactgaacgtattccaatggtgctcttactagatgaccacttaactcacaatcagattcagcaattaactgcccatattcagaacagtagtgccactcagacactggtcaccgccaaaattacagcgacggggaccgtgacatttaaaggacaattgctcaacagtgacaaccgcccctacatacaagtgcaactgcccaagaaccttgattcaaaccgacaaacgcatttattaaagcaactcctaaccgtcgcccgccagcagtttaaatttcgccggtttaaccttgtcagttacggtcgtggcggtcttactgccactaactatgtcgaacacacaacaacaagcttatcaccacaacaccttgtactgatggccaccccatttaacggtaccagccgccaaagtaacaatcgtcgccaaacgacgccggttgccgccaagtcgcaaacggccacactagctaaattgattgcacaccgccataccattgattccaagatgcaggtattgattgtcgctggaaaagccatcaaagctgaccaacccctaccactgcaaagtgccctggctggtcaatctatcttcaagccagtggtaaaggtctatcaacaaaaagtgttgcgctcatggcgcacccaatccggcttactcaacaaccatcaaatcggtaatacgattcaaacgtttataaactgatttcacccgtccaatcgacctagccatcatttttgctcagagtgcttatctaaaacatatctaaaagattaatagccacctttcctgacaaccaacttggtctactggaaaagcggctatttttagctttaattgtgcgatctggtcgtagtaagcctttaacgttaaaagcagccagcttaagtccgctgaaaaaagtttaagttagtgccaaccctgcctggttgagcgcgtcctacaacgccttccagtcgggatagcgttcgaatggcggacatgtgcgtattccgtttctgatgaattggccgtggctattttagcgacagcgactttgccatataactgtcagtctgataatagaattacgactgttccatgatctttatactgaggtattcaaaacagttgatgtcccattaacatttgttcaaagttcttagtagtaaataataatttaacgactaattgcaccagttaggcggtcgttcatctacctttcgagtggcttcccgaaacatgctcaatgccactgaagtctgtgctggctacgccaacgctctgcctaactttgctactgccataacatctgatccggatactccttggtcaaaaactgtttaatagcacgaatcatgatagccgttgaaggagcggctgcctgggttttgttggcaactaaggcaatctcacgattataaggttcggcaaaggaaaacgtgttaacatctccagttagcttccgtagtgctagctgaggcaaaatgcccatgcctaaaccggattctaccattgaaataatagattgatcatcaatcgagaatcgtaaaaagttattagtaacgtggtagtggtccagtgccagcttggtgtcccggtcataatcgctttgttgtagaataaagttcttatccgcaacgtcatcagtcgtgatgaattcaccattttctgggataaaatcagcgggcgtcacacaatagattggatcattgatcagtgaatgcactaataagttctcattgactggcatcgacgtaaacccaatatcgatagtaccgatcttggcccagttggttatttcattaaagttaccttgcatgactgaaatcttaatatcaggatatttatgattaaattcgcgaataattcggggtaaccagttgatacagacactactgaaaccgccgatccgtaccgatccagagtgcaatccttgaatattatcggcaacttgtcgcaagttactttccgtattcagaatctcttgaacatagggtaaaacctgccgcccatcactagtaagttcaacgcctgaacggttacggatgaatagcggaaaacccagttctttttccaactgattgatcgaatgactgaccgcacttggcgtaacgttaagcgtagcggccgcttgatagaatgtatgttgggcaacgaccgttgaaaagacttcatatgcgaagtttgccataatgatttacctctcttaggtgaatttatttcacttattattgaaaaagttgagttttactaattacaagctttattttatcatattgataatcaaagaaaacagtttaagtacaaaaaactgagtgggggaaaattattatgaaaaaattatttgcaaatcgcgtgttaaacaatgacacttccgacctagatgaggtcttcaagaatagtgcaaacccggaaaacatttccttcgctggtggttttccagatcagcacttattccctgacaacgacttaaagcaagcctatcgtgatgctattgaacacgatggtcaaggcattttccaatactcatcaactcaagggttgccggcattacgccaaaaaattgcagatcgaatggcgactcatgctgacgttcaagttagtgccgacaatgtcatgatgacccaaggtggtcagcaagccatcgacctcgtggcgaagctcatgttgaaccatggagatgccatggtcgtcgaaggcccgacttacatgggggctttagccgccttcgacacttacgaaccgacttactacgaaattccagttgatgataatgggatgaatattcgtcaacttcgtaaaaccttgaaagctcatcctgagatcaaattgatttacacgattcctgacttccacaatccaacgggtacgacgatgagtgccaaacgtcgtcaagcactcgttgcccttgccaatcagtacgacgtcattattttggaagacagcccgtaccgggacctccgttatagtggtcaaaatattccggctatcaaacactacgatactgaaggccgcgtcatctttatctcaagtttctcaaagattctctccccggccttgcgaacaggctggattgttgctgacgacgcaatcatgcacgaattggtcggactgaaatccgcaatcgatgttcaatcgccaaatgtaacactggctgctatcaacagctacctagatcaacacgacatcgacgatcacgttgcaactattagtacttcataccggattaaacgtgacgcgatgttagccgcactcgatcaatacttcccgcaaaatgtccactacacccgtcctaatgggggcttcttcatctgggtaaccttgccagaaggaattgatgctaaaaccttgctcaatgacgttgttttaccgcaagcacacgttgcctatgtgccatccgcttgccaattcgcaagtcgcaaggttaaaaacgggttccggttgaatttcaccagtctcgacgtcgaaacgattacgctgggaattaaacgccttggccacatcttacaaccggcaccagtaattgttccagcagcatcgttcgcaccccaattctaacttgacccactcatcatgcgactaaccgtaataattgcgattagtcgcattttttgattacatctgtcagctgtaatgagtggtcgtgatcctgaatattagcactttttatatcaggatccacatcaaataagccgtacgctttacgaccatttatactgtatcagtttgagcacccgcgcttgcgtcgcttttactgataaaaaagggtttgacagtccttctctgattcgctacactaacgctatactagccgattataaaataagcattggtccgtttgcgacactcaatgcttattttttgttaacagcttcattttcggataaactaggagtgttgtgaaaaatttctaggagtgtgaatcatgaagtcatgggttaaaaaattaagcgttgcagtgcttgggttaggtttagcagttacattgaccgcctgtggtagtaacactagcagcagttcaaagtctaacgacctcggattgcaaaaatcggggacgttgacgattggcttagaaggcacttttcaaccatatagctaccgtaaagacggtaaattaactggtttcgaagttgacctcgggaaagccgttgccaagaagatgggactaaaagctaaatttgtaccaacgaagttcgattcgttagtagctggtttagacacaaacaaattcgacgttgtcatgaataacatgtccgaaacggcggcccgaaagaagaagtatctcttctcgaccccttacatttattctaaatcacaattagccgtcaagaagaactcatcgattagtaagattaccgatattaagggtaagaaagttgccgaaacaacgactagcaataacgcaacggatgctaaacgtttaggtgcaaccatcaccccaaccgatagtttccaacagtcgatcgacctcgtctcacaaggccgcgtcgctgggactattaattctcgtgaatccttctatgcttacttcaagcagaatccgaaggctaacattaagctgattgattccggcgatcacattgcctcacagaaaatcggggccatcgtcactaagcaacaccctaagatgcaaaaacaaatctcgaaagcaatccaagaattacgtaaggacggcacgttaaagaaattgtccaataagtattttggtggtaacgttactgataagtaacgtaccattgcccgctattatggcgggatacatagcaccaaattctaatttgttacaggaggctccctatggattcaatctggcacatcattgtcacatcaacgccgcaaattgctgcagcgggtttaaaatataccattccgattgccattatttcgtttattctcggtttgatacttgcgattttcacggccctcgtcaagatttcgactcgtcgtggttggtttttaattctaaaagccatcgctaacttctacgtctggctctttcggagtaccccactgctagtacaactctttatcgtctatttcgggcttccctaccttaaaatcaaagggctctttccaaatggggtccagctcgacccctggactgctgggattgccactttttcactgaacaccggggcttactgtgcggaaacgattcgagcagccattctctccattcctcaaggtcagtgggaagcggcctactcgattggcatgaccaagtcacaagtactcaaacgaattattttgccgcaagctgcgcgagtctcactaccgccactatccaatagttttattagcttagtcaaggacacctccttggccgcttcaatcacgattattgaaatgttcgaagtcagccaacaaattgctgctcaaaattatcaaccacttgtgatgtactccctggttgctgccctatacgcaattctatgtacgattctcagctggctacaaggctacttggaaaagcggacgtcacgttacttacggccacttaattaggaggttgtcgaatgatcaaattagaacacttaaataagacgtttggcaatcaccaggcgttaaccgatatcaatactgaatttaaagaacaccagacgaccgtcatcgttggcccctcgggttctggtaaatcaaccttactgcggtcactaaatttgcttgaacggcccgaacaaggtttataccacttcaatgacgaaactatcgactttactaagccgttgactaataaaacaattctcaatattcgacgcaaaactgggatggtctttcaaggttataatctgtttccccatctcagcgttgttaaaaatgtcatggaaggccccgtgcaagtcttaaaaaaggattccgcgacggctaaaaagtccgcgctagaattgttggcccgggtcggcttgcaagataaggccgacgcctaccccgaacaattatccggtgggcaacaacaacgggtcgcgattgcgcgctcgttagcgatggatcccgaattcatcttgttagatgagccaactagtgcgctagaccccgaactcgaagctggtgtgctccgcgttctactagccctcgctcaggaagaagactccatgattatcgtcactcacaacatggaatttgcccgcgcagttgcggataagatcctatttgttgaagatggcaaaattctgttcgacgggacacccgctgaattctttaagcagccaacgcaacgaattgccgacttcttagccgcgatgacgttcaccacgatttcagacaaagcaaaccaatagcgttcatttgagttaacgtgcatctaactggaaaatcccagtcagatgcacgttttttagcaccccctagcgtctcacgtcaaccatcgatctggcgcattcacaacaaatggcatttagattaatataaaatgtgattttgatttgacaattgttatttaatcttgtagactagcctcaatatctaaacattgtgatgagatgagtagtgtgattgccacgcaaagcgagccgttggttggtgtaaaacggtcggacagtgatacgaagatggtctctaaatggtattggtgagcattagcaagccagtaacgcgtcgtacccgttagtgtactgagtgaattagctcattgagccaagcgttgtgcacgcgcttggaaactaaggtggtaccacgatcagcagtcgtcctttttcgataaaggacgactttttttgtcaaaaaaatatagctctacgggggtaatcgatatgaaaaaatggctcaaggcagtaagtttaacaattttaggactcgcactaacagtcaccttgacggcatgcggtaattctagctcatctaaaagcagcacttctagcacgagtagtcagctcaaattgcaaaaaagcggcacgttgacgatcgggctagaaggcaccttccagccttatagctatcgcaaagacggtaagttgactggttttgaagtcgaccttggtaaagccgtcgctaagaagctcggtctcaaggcaaagttcgtcccaacgaaattcgactccttgattgctggcctggatgtcgacaaatacgacgtggtcatcaacgatatcgctgaaactgcgcaacgtaaacaaaaatacctcttctctacgccttatatctactctaaatccgaattagcggtcaagaaggggtcctcaattaacaagatcacggatatcaaaggcaagaaagttgcccaaacaacgactagtaataacgcgaccgatgctaaacgtttaggtgcgaccgtcacaccgaccgatggctttcaacaatcgatcgacctcgtaaaccaaggtcgcgtcgccggaacaatcaactcacgggaagcattctatgcttacctcaagcagaatccaaaggccagcttgaaattcattagtggtggttcagaaatcaaaacacaaaagattggcgcaattgtcactaaaaagcacgcctcactccaaaaacaactgtctaaagcgattcaagaactccgtcaagatggcaccttaaagaaactgtctaataaatactttggtggtaacgtcacaaaccaatagccatcgcaatctatttgatagcgtccagttgatagtcacaaaaagcccggaaaaccgggctttttgtgtgtgtcggcgtctttcagcgaccatcttttatcactcattgtgttgctaaaaaccatccgggaccatttacaccattgcttatgtcgtgaacccggtcagctaattcaactgatttgcaatattgaatttcatcttgccatgattgacttccaaccacatatatttggtgttcttaggcgacaaaacctcaatatgtgaatatttttgattgtgattcttcgcgattttttcagagcggctttgcagtgtcttggctagtgactgccacgaagcggtcttgccttgatcgacactttcaataactggcgcttgctttgatattcgcacacgcatggcaccaccattccaactcactttaaccttgccatattcagctttattcgttctgatttctgattgaatattggctgcaagcgtattagcttcccgagcctgatacaaattaaatccaatctcaaagacaatgactagcgcacagataactggtggcaaccaaaaccaccacgtccgtaagctctttttttgatgatgcggctgctttaaagtcgtcgtttccgcgtctttacgcttatcctcagcaactgtcggttgtccactgccgcatttttcacaatactgggcactttggggaattcgttcaccacaaaccacacaattcttcatgtccgtttccataattgccctccgtcataatattatcgataataattaactcagccatgacaattaactgtattaatatttcaatataatgattatatatcgaaatcagtcatttttctaggccttatcagatcagtatagtatcacccttgcgtaccggacagctggtattcgctgagcatcatgattttaagctttagtacgggcctatttcagtcaccgttagcaagcacgttttgcgtttactagtggctaaaggtagtttaccttttatcattattttaatatttaagtttgacagttagtttcacttcactgtatactactcattgagcaatactatacgacgtataatatagcaggaggaatagcaatggccattcaaattagttccgagttattggacgggtgcgttttagcctgccttaaaggccaagattactatggttacgcgctaacgcagcgcttgcaagccgccatctcggtgtccgaatcgacgctctacccagtgcttcgacgactcaagaaaaatgactgggtcaagacttacgatcaggcctatcaaggccgcaaccgacgctattatcagattacgagcgccggcctgacacaattgagtgcgattcaacaagagtggcaaacctattatttggccattaaccacttacttcagggggaggatgaaccatgaacgactacttatccaaatttaacgcgttactcgttcaacttaccgatgatgaacgcgacgaggtcgttgaattttatcgcgaatacttactagacgcggcaatcgccaattatgatgactgcgttgccgaactgggaacgcctaaacaattggctcggaaagtgttagccgattattcgattcgttttaacgaaaatctcaatgccaatacttctaaacggcaaaaatctcaagcaaccgtacgcacgatttggctaattgtgcttgctttattatcaacaccgatcacaattcccgcattaatagctattttagcggtcttctttgccttggccgttaccgtctttgcattcgtgattgcagcgggtgccatcttaattggcgtgaccatcctcgcatttgccatgctaacagccggcatcggtatcttcggccagtcgctatgggtcgcactattctacctaggtagcggtcttgctattattggtgccgagctattagttttaccactatttatctggcttattagcgttattctgcaaggaattgccaaaatcgtacaaaacctataccaccgatttgttaagaaaaatcgggcggaacgaggaggtcaccaccatgcgaaggacaattagagttggcattattttattagtcattggactgattttgaccatgtttggaatcgccaataacggtattcaaagcgtttattgggatcaaggcttccatatcgttcatcataagacgcggcgctatcacgtcagtcagctaaaagatgtcacgattgcaacggccaacaatattactattaagcaaggcacagctgctaatatcacggttaccgccacgcgcgccttaccaactgttacgaccaacaatggtcacgtcactgttacttcaacgacacacaacgccaaaaccgtgggcttcatgttcgataacgtcggacaatttgctgacacgacaataattacggtgcctaaaggaactactattcatcaaataaccgccaaagctagtcaaagtggtaacgtttcgttgcaaaacgtcaccgtcgaccaattgaaaagtcttagtacggatagcgatattaatttaacggatatcaaagtcaatcagtcgctgacgttgaccggcgataatttacggttaactcgtgtctcggcgcctagtctacaaatcaatagcgatccagatatcagcatcaccgacagtcattttaccaagactgcttcaaaaattataaccgctgatagcgacatccatctaaccaataatcagttcaaagcccttaagctaacaagtagcgaaggtgatattatgctcaataataatcgcatcactgaaagtttatccgctacagccagtgacggtgatattcgaataaccgcgccacggacaaccggtgttaaagctagcactagcgatggggacttgcatattttcaatcatctccagtccgatggcggtgattaccaggtcaaccaatcggcagccgtacaataccgactgacgaccagcaatggtgatattacggttagtgctagctagtccatgctagtactgcacttactcaaattttcaaaataaaaccgcgacttgctcatggcaaatcgcggttttatcgtacttacgtttaggatgctgttgcagtcgtcatttccggacgcccttgaatcgccagcagtgctgctcccgactgaatagactgattaggttctgattctatccgttgataatttttactatttgtcacaatcaccatgaccgtgtcatctaagttagcagcttttaacaccgttgagtcaaactcacctaagagatcacccttttgaacagtttgccccggtttaacgataactttaaagccttgcccttttaatgacaccgtatcaataccgatgtgaatcaacaactcaactccattattggttgttaacccataggcatgtcctgtatcggctacaacactcatctgaccactttgtggcgcacagacttttaccggcccctgttcctgtggcttaattgcaatgccgtcccccatcatcttagatgcaaagaccggatcgttaaccgtactcaaggcaatacttttaccagaaactggtgaaaatatcgtatcatctacaatctttggttgtacttgatcagattttaatatgtccttaggaatcgcaaacatattagtggcaataaaagccactgctaccgtcaataacgagacgaccgtataaatcagcaaatcacgagcattgtaaatatacatcagataagagggaacaacggctagaccatatgaatttgctgccacactcataacactcagtacgccagcacctatcccactggttaaaacggttacaaccaacggcttgaaattatagcgaatcaagaccccgaacaaggttggttctgaaacaccaaatagttgcgaggaaaatgcgccaataaaattagccttagccttttgtgactttgctcgtaaaatcatcgccaaagctacccccagattagcaaagccatacatggcttctaaagtaattaacggattgagcttggtagctgctaatagtgacgtttcgatggcaatcatcatctgatgaataccaactagcaccattaacggataagcggctccaatcaaaaaaccaccaattccaaatggtaagttaatcaacccttcaacaccactaatcatcacattttcaatccagtgtacaaccgggccaacccctaaaatcataataccaaaagtaactaacatcgttaaaaagggcgttaaaatttggtcgagaacgttagggacgtgtttatgaaagtaatgctccagtttacttccaagaaaaccagcaactaacgctgttaatacggatccttgactaccgataactggaatcttgtcaaaaagcataatcgctttcgctgtaccacccgcaactgaatacgcgttaggcagtgaaggggaaacgagcattagtccaatcacaataccgacaattggtgtacctttaaaatagcgaaatgtggaccaaacaattaaagctggcagaaatgaaaaaacagtccccgttaaaactgaaattactgtattaagacttgccggaatcgcggcagatgaagttccaaacaactgtaaaacctgattgttagtcaaagcactttgtaatcccaagaaaagtccagtagctgcaatcaccggaataattggaataaagattcccgaaagcattgccatgaatcgttgcaatggtgacttctgattatcaggagtcggcgtagtcgtcgtttcctgactataaattgcattaactaaatgtaacttttcaatcgcgtcatacacatcgttaacaacaccagtgccaataatgacctgatactgtcctgaaccgaaaaagactcccttaacctcatctaagtcttcaagcgctgctttatcaatctgcttaggatctttaacaacaaaccgcaaccgtgtctgacaatgagtaaccgattcaacattgtcaacaccaacaatatcaataatttttttcgcaagtacctgatagtttttactcatttgaattcacctcaaaaagaatggcttgatatggttccaacgtattgagtcgataatgtgcgtaattatttaatcgaggtcggccattaggtaacgttagtaataaccgttttgcgcttaagttaacatacacctgtacccttcgaccacgttgataagcaatcacttggtcacaatcacaagtaattggcctaaaatcaccgactattaaatcctgatttaaatttgatatttgccgtaacttaatcaatgactgataaaaatgccaaactgaatttgaatctaattgttcgctttgccagtttaccctatcatgtgactgttttggtgtaatccatggcttggcaccctgattaaagccttgattgacggaatcatcccatggatatggtaatcgcgcattatcccgggaacgagcatttacaaaggcaagtgcctcgcttgctgaatatccctcttcaatagcacgatcataattatcgtgactgctcaagtcgttaaacatggtgattgagtcacgccgtgcatttgtcacccccagctcttgtccttgataaataaatggacaaccgcgcaagttaaaataaagtaaggctagtgctttggcaccaatttcattccgataagctggtgtctgaatatatttatcaatactccgcggctgatcgtgattttcaaaaaagttagctccccagccgacattttgaatcgccagttggcttttaaaaattgcgcgccgtaagtccgtcggtgtccacttaactcgtcgataccactctgatccggatgcaatatcaatatctgcgtaatgaaagtcaaaaatcatcgagaagtaaccttttttaccaataaattgtccaagttggtcataactaacccccgaagcctctccaaccgtcaccgcgttagctggtttaaaagtagccgtgttcaattcagctaagaacttttcaataccaggtcgattttcagctttacgtttgactttacctaacccatcaacaccatcaggactaatgctggcaaaatcttgatctttttttatgaatgttattgcatcgatccgaaaacccgcaaccccttttgccaaccaccaattaatcatttgatagattcgtttccttagagccggattttcccaatttaggtccggttgttgtttagaaaagacatggtgataatactcatcctgacttcctggcaataacgtccatgacgagcctttaccaaagtttgatcgccaattattaggcggattgccgtgtgccccacgccgaataatataaaaatcacgatacggactcgtcggcgatttaattgcagattggaaccacacgtgctgatcagaggtatgattgataaccaaatctaaaatgacttttaatcctaatcgtttagttacttccatcaactcatcaaaatcagccatcgttccaaaccgagaatcaatagcttggtagtcagaaatatcgtaaccgttatcaaccatgggtgattgatatattggagataaccagatagtcgtaattcccagctgtttcaaccggggtaacatttggatgattccacgcaaatccccaatgccatcgttattagcatctttaaatgatgccggataaatttgataaaaaacttctttttgccaccaatttttttgcataattactactcctatatttggaatcgattccactttaatcaaaagaaaaaggcttaagcactttttcttttgattaagtctaagcttagatcaatcgttaactcaggtcgttgtaaccggcccaagtgatgtaatagctgatcgaccgccaattgagccattgccgcgaccggttgtcgaaccgttgttaatggaacttgggccaccgccgcaaatggttgatcgtcatatcctatcacggccatatcatctggcacgcgaaaatgttgttgctgtaactcatcaattaccccaacggccacctcatcagaatttgtaaacaccgctgtcgggcgatcactagggtttaaggacgctaattgcttccccaacgcttgtccatccgcaatcgtatgttgttgtgcgaaaacccagctattgtttacaactaactgctgctcttcacaaaaatctaaataggcttgcgtccgcgaacgtccatgatgcgtactgggaaaatcaccacccgtggcataggcaattcgccgatgaccttgatgatataagtatgccaaagcatctttagttgcctgataatgatttaaactgatcattggaataccaatatcagtagcttcttcattcaacagcaccatctgattagcatatgtcgccgacaattgtgccactagttgttgattttcaatggatgccagaatgacgccatccacttgttgctgcttgagtttatccagaaagtgttgttctgccaacgcatcatcatgagtctgcattaccatcacttgaaacccgtatccgtttaactcccgttccaatgcatcaaataactgtgcaaagaaggggttagagattcttgataccagtacaccaatcgtattagtgctctgcgcgcgtagctgactcgcaatggcattcggggtgtaatccagtttttcaatcgctgcctgaatttgcttcttcttagcaactgaaacactaggccgatggtttaaataccgtgaaacagtcccaacacctacaccagcctcagctgctatttcactaatcgttgtcatttaagctcaccccctatttggaatcgtttccacaattaatataacgacctttcaagtaattgtcaagacaaattggtttttcaaaatgaattcactaaaaacgtttgcccttaaaacatttagtccaccagtaaaaaaatggaagtatcctgccatttcgataacttcatttttaacattccagccaaaaaaatattccaagccagtgtgcacctgacttggaatattttaattactgattcagccttagtaatcgctataacgatgcttgatagacatcaaaccacgtcaataatagcgacacaatcaagataccaagcatcgccaccgcgtgccaccatttatttcggacaaatatcgcaatatactcacgaatgatcgcatccggtaagaagaatcgcgccgtccgcgcaccaataccatccgcttttagacctgcttgcttggcaaacatcccggctctaaaggtatggtaattatttgtaacaaaaatcgtgcgtggatttttaacagggccctgtgcaatcaattgcttactaaactgcatattttgcaaggtcgtcttcgattgcgtctccgcccagccatccgttgcaggaaggccatgcgcaatggcgtattccagcatggcttggccttccggaaccgtttcatcaccaccctgaccacctgagaaaatcatcacggcccgatgatgcgtcttgcgttgttgcttctgataaaagcgcagtccacgcatgattcgttgccctagcaatggcgagacacggtctccatctaacaagccagccccaagcacaataatataatcttgtcgcagacggggccaattgaattgataaatcgtcagcatcgtcagatagttataaaaccaaaaaccaaggtaaaaaatgaccagattcggaaataccgtcaaaaaataactcacgggctgcggcacatgactactcaacagattgcctaaaaatggcaaaatcagaatggccagtcccaagtacaaggtcagcatattcgccaacgtatgactctcatgacgccacatgatccacgcattccataagagcaagaaggcttgtaaggtaaaaatcagcccaatcaacaggatcagcaacacaaacaacgtcccactgataatgatcaaccagtggatattgctacctaaaattgtaatcgccagcatggttaaaaacgaatagaaaaatagcgaaaaccaaataccgttacctaggcgaaccttatcgcgatgataacgccaaccaaaaatggttccaaatatgagtggtactaaccagccccagtaaaacattgctggaactggaacccaaaccgctgcgtcattcacatcaatacccccgcattaagttttatttcagcttccatcataaaggactccccgcgggactgcaatcaggagtcattacttcaactgtttttgttcattatagaaattacggtaagctaaatagcacgcaatgattgaccccaaactagtcgctgataagagcatgaacgtgaccataatttgatacttaatggcccgtactggatcgacccctgcaaagatcaaaccggacatcatccctggcagactgactagacccacagtctttgccgaatcaatggttggtgacatccccgtacgaatcgcctcacgcacgatggcaatcgaagcgtcgagtagaccagcccctaacgccaaccgttcaagcacaccttgccgctggtcatgaaactgactattgaggctgcgataagccagcccaattgcgaccattgaattcgacgcaatcataccagaaatgggaatcatttgcgatggcacaaacttaatcgcaccagatagcacgaggacgccgagtgttacccccgtactaacaaaaatggctaataacgaaatggctaatgcatggtcaatccccggcccccgttttttcgcattccaagccgcattgaagataatgaagcccatcatcgccaacgttagccacaaattgttgactcggaaaatatactttagcaagtaacccacgataaatagttgtacaacagcccgcacgacaccaatgacgatgtccttatccaagccaagtttctgccacaaactaattcctaacgcgacgagcactaacattgccgccaaaaatagcgacgtattattaactgctaaattcatgcatgtacctccaatctgccagcaaccactttcgctaattgatctgccgcagcaatctctgtcgcgtcatgagtaatcatgatcgttgtcacgtgatcctgctcatttaactgtcgtaaccaggcgtgcacgatttgcttattattttcatccaaaccagctgtcacctcatctaataacaacacttttggtaagaataagatgttgcgaatcagcgcgacccgctgccgttcaccaccggaaagctcggtaatcggctgatgcagggttcgttcggacagcccaacattatttaacgccgttaccactcgttgcgtatccatgacttgcttacgaatttggtacgggaaagctaagttatctgccaccgtctcaccaaatagcgtcggctgttggaaacaatatgagacttgccgccgatacatgattgggtcatagctttcaatcggctgcccatcaaaaatcaaggtcccacttattttagaaatcatggccgcaatgatccgtaataacgtgcttttcccaccaccggatggtcccgtcaatgtaatatgagccccagctgaaatctgccaatcaacatcatgtaaaatatgttgatcagcgatttgataattaactttttctaaactaatcaatgaattcatatgcccacccccgattactaatttagaatcattataacctgactgttaggcgactttcaaacaatcctcctcagttatcctgtgtctttccacatgctataatggaggttaacacagttcacagaaaaacgaggtcaaaatcaaacttatgccacaatctaatcattattcgcaccaatcccgatcgcacaatgatcggcgccgacaacagccggatgaaaaagtgcaagcgaccgttaacatcggccagcgttttccactgaccattcggcgtttaggcattaacggtgaaggtattggctattacaaacacgtcatcaccttcgtcaagggcgcccttcctgaagaagtcgttgttgctgaagtaaccgccgtgcacccacgttacctagaagctaagattcgtagtattcgcaagcctagtcctgaccgggtcgatccccgcgatgcctatgcgggcgaagtcggtggttttgaattagaacacctcgactacccggcccaattagcctttaagcaagatttaattcgtcaagcactcgaaaaataccgcccagctggttatcgacactatgatgttcggcccaccattgggatgactaatccttatgaataccgcaacaaagcccaatttcaagttcgtttaattgatgggcacgtcgctgctggcttatataaagaaaatagtcatgacctagtcgacttaccgacctgttcggtgcaaatgccggcgacaatgacagtcatgcgtcaagtcgtggcttggctggaggaactccaagtaccgatttacgatgaagaacataattctggcatcgtcaagacaatcgttgtgcgtgaagcggccgccactggtgaaattcagctggtcttcatcacaaatacacccaagttaccgaaaaagcatcaattattgatgaaaatcgctgaaaaactgccaatggtcgtgtcggtcatgcaaaatatcaatgctggtaaaacttcattgatctggggtgaccaaacaacattactggccggcaaaccaactattacggaggagctagacggcctagtcttcgatttatctgctcgggccttcttccaattgaacccgcagcaaaccaagaaactctatcgcttagcacgcgaagctttgaacttagcgcctaatgagacgctggtcgacgcttattcgggcgtcggaacgattggtttatcactagccgacgtggctaaggaagttcggggaatggataccattccggcagccgttgcagatgccaatgccaacgcccaacgcaatcaaatcactaatgctcattacgaagttggtgaggcggaagtcttgttaccgcaatggttagcgagcggttttgcgcctgatgcaatggtcgttgatccaccccgtactggtttagataacgtcttaattgatgccatcttacaaagcgcaccggaaaaactcgtctacatttcatgtaacccatcgacgcttgctcaggatttacaagcacttacccgcggatatcaagtcgactatattcaatcgatcgacatgttcccacaaacagctcgttgcgaagccgtcgtccgcttcacgaagcgtcattaatttgccactcactgccaatcatatgagggggaatcatcatggcagctactgatagtcaaattgcattaacgatgacctttacgttacggccaccattcaagactcatttcttactattaaaagattacgtggcggatgttcgtatcccggctcgtgatgggatgctaacgacgattattgccaaaaacattccgctatcaccggccctagagcaactaaaaacgatttttgatgatgtccaaaacccagtttactggcgcttacacgaccaagccgttcaggaattcttcagtgcgcatcctgaacagcgaccggtcctaccaatcgacttgctgcaagtcatgctcaatacattatctgcccaaggtttgtccgatcaacaattaatgcacattatgaaagacgtttttgaacggctacaaaccaatgacttcaacggacaggcatcacagcgaattttgacgtcgttgaataataagtaaacgccaccatttatcgctgacttttataaattaggattagataacaccaagttgtctaatcctattttttcggacataaatcaatagcggtgaaacttcattagtcacagaaattcgcactaatactcgtttttatttttcttagccattcattaaatgtcagcatacgaaaattgtcttttcggttattggaagcaaacttgttgactttgaagttacatgtgataagctaatcactgtaatttttattgctacagcaatttgaaaggatgttttaattatgaaatacgccatcactgccgctactggtaaatttggtcaaagcgccgttagtacgctgaatgctaaagttggtgcagaaaatgttttagtaattgctcgtaatcaggacaaagctgctcagctgtttcctgataatccaattcgtaccgggaattacgatgatgtcgactcaatgacgaaagccttcgagaacgttgaacgcgtgctcttcgtttcatcacaacctggtggtcccgttgaccgggccaccgctcataaaaacgtcgtgactgcccttaacgccgctcatgttaaatttgtcgcctacactagttttcccaacgcacaggcagcagtcagcgccttagccaatgatcatcgggccaccgaaaatgccataaaagcgactgatattgcgcacagttttcttcgtaacaactggtatttagaaaacgaaatgggcttcttacaaagtggtgcccataaccaagaaaccttgtactgggctaataatacagctggctgggccttggaacgtgaatatgccgaagcggcagcaaccgttttgatggcagatgcccctcaagaagtgtacgaatttgctgggacacccctcacttatgccgcactcggtcaagcactccaagaagcaactggcaaccaagttaagattacccaagtcagtcaggatgcgtacgtgcaattccttgaaacgactggtctaaatcatgataccgctgctttgtttgcctcattccaatccccaatcaatgatggtgcgctggctgaaaagtcagccgacttagctcatgtcttgggacgtcaaccattggaagccagtgtagctattaaagaaatcttagcgcgctaataacgagctagctgtaagtttctcttaaatatcttctacaatacgaaaataggaagttcaacgaacatggcgttgggcttcctattttttaatgattcgtaaatggccttttaattagcgcgtaacatcagcaaaatactgagctaaggttagctgaataccattatgattattatcagttgttactatgttcgctgcctctttaacgggttgtggcgcattagccatcgcaacaccaatccccgctgtctggagcatcgcaacatcattaaagttatcgccaaacgcaatcgtttcagcaggggtaacttgatcatcctgtaataatttcattaatgcggctgctttagttacgcctgccgcaacgatttctaaataagtttctttcgaacgataaactgctaagccgctaaattcatcacggcttaatcgttgttcaatcgcctgaataatatctggatcggccatgatcatcattttatgcactggcgtcggcatccgttgcaaccatgtgcccaaatccgtgacatggggtgcataaccaattcccgtcgcttcctgctgttcccacgggccattagtagccaccaaccagttattattcgaataaatactaattgaggcagctggccaatcatgagctactaccgtttgcacagcttgtgctagtttagggtcaacggcttgctcttcaaaaacagttagtcgatcattcacatcggtcgtagccgttagcgcgccattataggcaatcatggtcgaattaattcctagttgttgtgcaattccaaacatccccttaggcgaacgtgctgaggccaacaccatttgtgccccccgtgcaaccgctgcttgaactcccgtaattgtagccggtaataactgtccttgactgtcgactagggtaccgtcgatatcacttacgattaatttgatcattgattttcctccgttaagttaatcatggctatgctaagcgtagacttatattatgtatccttatagattctactgtagcatgaatcaagtcataaataagtattccagaccatttttcattcatagtaaagtaaaagaaccgataacgttacttgttatcgactctttttacctaaaatatcaaatttttggccagggcgacattaccaatcgttgcagaaccattattagcaattcccgttaaaacaatcaaatgatctaagttcggtaattcaacataattgttattaagctgctcaacgtctcttctaatcactggaagttcagtttcgcttactactgagccaccaataacaattctttcaggcatgaaattaagatatgcatcaaagaccagctgtgcaatataataactgatcaacttaaatacttcattggttcgcttcaattgttcccccggtttgccagttcgagcctcaattgcgggtcctgaagccatgccttcaaagcaccgattttgatgatatggacagacacccttgaagttatcgcctgacataggtatgaccattgtatgtcccatttcaagatgagacataccacctatgaaatgattatcttggataacaccgccaccaatgcctgtcccaatagtaaagtatactagtgaacgcactgcttgtccttgtccaatcatatattcaccataagccgaagcatttacgtccgttgtaaaagtaattggaattttcaaagctgccctcaacatctgtacaacatccgtatgagaccaaccagcttttggtgtatttaaaatctgaccatatgtcggtgaatccaccttaatatcggctgggccgaaactcccgattcccaacgcatcgactggatttttcttaaaaaatgaaacacaggctgccagcgtttcatttggctttgtggtcgctactcgttgtcgcttcaagatacggtagtgctcatcagtaattgctaaaatgaacttagtccctccagcttcaatacttcccaaacgcatgagctatgccccctgattgtgtatgagcaaggtaaccatatcataaggctgaatcactaattgttccgaacatggttgagcctcttccagagcatttacctgaatgaaatgttgttttaacaagggggtcaaatcagcagccacaccagattcatttgccaaacggataacaaaactatttggcacagtataggccggatacaacgcgctaattgtgacatgtggatcgagtttcaaaaatgactcgcactctgagatagttggtaatgaatcatcaaattcaacatcccaaattttattgtctaatcgatttacaaataaattcaatttttgtaattgataactaacatcgggtgctaaccacttttcagcaattattgccaatttattttcattcaattgagacgtggaaactaacccaaactcaaatgtatttgctcctaattcttcggccaacggcgttggtgtcatctgatgcccaatactagttgtatcgcctgaagcacgacctggtcgccacagtaaattaggcttaccaagttgaccagtggttgccattaatgtgacataaaatgctttctttcctaactcgtattccttcattcctttagcaattaaatacaggccatcgctagccccttgcatcccgacaattttatcaaagttataaaggttaaccggtttttcaacaaattcttcttcccaattttccgcaattggtaaattacgtgttctttgaaagccgccttgaacttgcgcaactgcagtgtcactttcaattgctgtattaatttttaaccgtaatcgatgatctagaacctgattatcgacagttaaacgacctgccaatacattgtcaccatcagttaaagtcaacgttaattcaaatgcgacatcgtgcagctttggttcgtgactaatcctgtcagccaagccttctggtaactgccacttgccgcttaatcgcagttcttgccttccagctccaacataaatggctacaacgccggctaaaggcaagtcaacctctttgtcgcctcgaagcggtgaataatcgtacgtatcaccatcattacccgaatctacaatactaatgatgtttttgtaagttttcccattagtagttgcctgaaagttgccatcgacataattcactttccaactttcattttggatagccgtttgttgctcagactgtaattctggcaaagcttctgcaccatccttaaagtcaattacttggtagcccaacccatcaaactggactgcaacttgtacttgtaattcatagtaaccaggctcgtctttaaattcaaagcctttagccgtttgttgcatgatattttctcgcttagccacataatttgcacttaaaatagttgcttgatatttttcatcaaacataatgtttttcgatgatgttaagaaacggattttcttatatccattgaatgggcgtggatcagtattgaatacaagcacctgattggcatccagtttcaaccgttgtgcgattcttttcttgatatagttttcgataccgtctgcaatttcaaaaccttgtttgaatcgatggtcaatatcaatagcaacattatcagaaacactgccacccaaactgtcatgcggttgacattctagcaactttttccaaagtttcaaaataagacccttagacacatcgataccacatcttttggcgatgaccatcagtggctcaacacgtcgtaatatttgctgttcgagtttgaaattctgccgtttaatgcgcgaacgtactgaaccaattgtccgatgaactctagcataagttggataccgcaactcgccttgataatccggtaaatcgttgcgttgtcgtaatgttcgcataaacttcggataattgctgatcacaatctgattatgactatatttatttatcttactaatagtctcagatacgttatgaataatattcatttgatcgattcccgaaggcactaggaccgaattattttgaccctgttgactttcaaaatcaattcctggatctagacggtttgcaacgaactcttgtaagtttttcttcgaatccaatgcgatttgaccagtatagtaacctaacggaaaattagcagcatagacttgactatgacctagactgtgccatttaaaataaacagagtccatttgtcgcttaaaattagtgccccgccaaaaaataaagtcattaatgccaacttgatttaagagcattggcaattgcgaattaaatccaaaagtatctggcaaatagccaatcatcattggttgcccatacttttgtttggtatcgttgatgccaataactaagttacgaataattgattctgcatcaggtatcatcgcatcagtctgtgtataccatggtccaacaaataattgattacggttaattaatttctttatccggataacatcttcgggatgcatttcaacatactcatctagtattgatgtctgtccgtctaaagtaaaattagcttcaggatgcgtttctaactccttcaaaacatttgagaacagctgatcacttagcacctgtgcgtcctcagttgtaaaataccattctcgatcccaatgagtatgatttacaaaatgtgcttttgtcataaatgtatcgctccctgttattttaggtaacaaaagccgcactacggctctttaaccattatgcggctcgttttagtcaatctaagcttcaaaattaatgttaatgtcgtcctcattatcatcagtgacttgttcttcgctctgtgtttggttaaagtccacagccaatggtgccagtacaccgataatcgcagcgcaaacaattagaccgattaaataggcccaaccattcgtaatggtgacaaatccataaaccccaccaacaggaggaatcttagcctgagccccaagtaaaatcgtagtcgccgaaccagcagcaccagcaatcatattaattggaattaatttcaacgggttaactaatgtaaacggaatagcaccttctgttattccaataaatcccatgaaccagtcgcttcgtccagcatcaagtaattcatcagaaaaacgatgcttaaagaaagtcgtcgcaaatgcatatcctaagggaataccagcaatagccacattaacgatcattgcaggggtgtaaatcttttcagctaataaaacgtttcctgccatccatgcagccttattaacaggaccgcctaagtcagaaccaatcatagcgcccatgataactgctaaggtaatagcacttacaccgcttgtactcatttgtttaatccaggcgacaagtgatacattaatccaagtcagcggttgcttcaaaatgactcccatcaatattgccacaaccattgtagatagcagcggtacaacaactaatggcataatagattcgaacttttcaccaacatgtaacttattgtgacaccaacgtgcagtataaccagctgcaaacccagcaaccaaggctcctaaaaatcccatattagaactagatgctaatgagcccccaatgaacccggcggctaaagctggcttatcgccaatagcatatgcaatgtaaccggccaaaactaaattaactaagccaacaccaatccaaccaacggcttcaatttgtcccatataaaaccaaaaaccagttttatacgcatcaaaacttgtaattccaaaacatagacctatcaacttaggaactgcaactacgagggacccgccaataacaaccggtaacatatatgaaataccagacattaagtagcccttccactcagccaatattttcttcataactcactcctccattcttcattaagttcattttatttaacacgagcagcaaccgctttgctgaccttatcaataacagctttcggctttttaatacacatattaatatcaactcgaactgctggaatcccttcaaatcgatccatcttttcaattttttgatccgaaccaatcaataaaaactttgcgcttttcgcctcttcaactgtaatttcatttttaagtcccattgcaccctgttgttctactttagcttgtaaacctagttcctgcgctgctttttctagcgctttcgccgccattggtgtatgtgctaaccctgctgggcatgatgtaattgcaacaaaatccatatcagtcatcctctttttataaaattttttccgaactattggttaatacagtgtaaacatcctgaactgtttgactttcaagtaatgcttgacgctcacggtcatccactaatgcactcgcaaagttagctagaatctgtaagtgtgcctgctcactattttttggaactagcatagcaattacctgattaactggttggtcatcaaatgtcggccaatcttgaatgcttgttgtagagcgaatgaatagtacagcaggttgccgcagatattctgagattgcatgaggaatcgctataccgtcctgcattcctgttgaagcttctttttctcgttgatacagcgctttcaaaactgcatcttcgttatctgcaaagccaagttcaattgctttatgtgcaataaagctaaaaacatcctcacgtgttctaaaatgttcttttaaaaaaatatacttctgtttaaaaatttctgtcatatttgcatttccccttcactgctgtgctaatgtatcaataatttcttgagcattttgagcctttattaaggccgtcattcgctgcccatcttgaatcaaattatagaaataactgtaaatatcatccatttgtgtttcaaccgtgcgattcagggctacgaaaaatacaatatggacattttcgtgatcccatttaattccctttttcgacgtcatgattccaatcgttggttgcaaaacatggtcgatatcaccatggggaattgcaaatttatcgataatggtggatgcaacttgttcacgtgctaacgctgaattttgcatttgattatcaacatacccatacttttctagccgatcagttagttgaataatcgccatctttttttcagttgcctttgaatttgtaataataccgtttggacttaataatttaacaaatgcgttccgcgtatacttttcttgacgaatatcttgacttaacttttccaataagctgagttcttggtcattcaaaaacggactgacttgaataaccctcgtaccgctcatctttaacgggatagtcgaaataataatgtctgcagtcactgttgaagtcatcaactcattcacagacaaagtgccaacaatctgaacatccggtagtttgtccatgacacgttgctttagtaactccgccgtaccataaccagtgctgcatacaattgcaagctcaacatctggttttaagatctttcggcgctcaatgaacgattcaaagtgcagtgctaagtatgcaatttcatcctcagttagctgtaaatggtattgcttttcaatcgccatcgctaatgctagtgcttgatcaaaagcgacgggaaaatacgttttaacttgattacaatacggattcgtaatactaatgccatttttaatgcgaaccagcgccggacgtaagtgtagcgttagattacgtaataattgattatcataatccgttagcacgctacgtagccagtcgactatcgttcgttcaactaagccacttctatccagatcaatgtacccatcctcaatggccgcgacatgcatatttaaataagcaacttcttcatcgggaatttcacacttgaaggccacgataagcattttaactaatttgttggtactcgaagatattgccatagtgtcaaaattctgtgtcgtcgtttgagtaataaactcgccattcttaattcgctgaatcgcaatagttgtatggatcagtaaagactcatattgatattcatttacatcaacttttaaaatcttcacaaatttattcaggactttttgcatctgatttaaggtttgtttattgacatatcgtttcagggactgcggcactttaaatgtgcgtgtcattttgccagtctgttgattttgcttaatctcttgtccccaatatgactgtaatagctgaccaatcactcgacgaacatcactctccgaactattgaatttaacaccttctgtagtggccgtcagcttcaacccataatccatttttaaaacatttaaatcacgttccaacgtactacgactaataaagaagtggtcagcaatatcatctaataacactggtttagattgctgtgtcaagaatgtcataatgctaattctgcgttcttgctcactttggctattatccttcagtatcggaaactcagccaacagtcccttcgtattaccactaaaacgaataccctgtcctcttttcctaacaaggtgtacaccttgttggttgactaccttttccacctcattcagatacttagcaatcgtcttacgagatgtgcccgtatactccataatatcttgatagtgaactatcctttttgacaatatcaactcaataatcattcgtgtaagagttgctggtgaactattcggcgccaaatttatcactccctaacttttacaattcatatgataatgtaaccgtatacattatttaagctcataaaagtacacttgtagctagtgtacctttcataagttattattctttgtgctgtcggccatatacttgaagattgctttagaagtttaatctcgaatcctattgtgactaatattaccccgattttgcgcgttatcttacaggaagacaaatcatttactgaattaattaactattgatatcaatcataaaaaagcagcgtgatttcattatcctgaaatcacgctgctaagactatccaattacaatattcctcagaacagactagggtccgtcttaaaactacttaagtaagatgcaaattgaggcaatgtagaccg

SEQ ID NO: 14 - DNA, 54382 bp, Lactobacillus plantarum
agttttcagacggaccctagtaatgttcatgaattatctgattatattacttacttaaatattcgtgactcagtcaaaaaatcattttattcagcattggacgcgtaccaagcaagttaacaatcataattgaactcaaaaaccaacctactagcccagcgacgattgctgtggttgcaggttggtttattcgtgtttttagccttatttttatcgagatgagactcaaacgatacgaagatcgcaaatctgagccattttcaacgcttaatcaccatctagcttattgccaatgttgcttaataaacgcctcacgaccacccatttcttcgatttgataacggaatggattgcgtcgataaaagtcttggtgctcggcttctgcgggataaaatggcttcgcatcttcaatggttgtcacaatcggctcagcaaacttaccgctagccgcaagtgcatctcttgaagcagttgcagttcgacgttgagcttcactattaacaaaaattaccggtcgataactgtcaccacggtcctgaaattggccagaagcatcggttggatcagtctgacgccagtaaatttcgaccaagtcagcataactgattacatctgggtcaaaagtgattttaaccgcttcagtatgcccagtcgtgtggctggcaacttgttcatacgtcggattagcgacggtaccaccagtgtaacctgaaatgactgacttgatcccgggctgttgatcaaacggtttgaccatgcaccagaaacagccaccagcaaatattgcagtctctgtcatctaaattcctcccgtttattaactcaattatttaaataaactctgatactgaccataaccagccttttcaaggtcggcaactggaatgaacttcagtgctgctgaattaatacaataacgaagcccgccgcgatctcgtggcccatctggaaagacgtgacctaaatgtgagtttgcttgtgtgctagtcacttctgttcgatgcatgccaaacgactcgtcacggtgttcgttaagattagtctgatcgattggtttagtgaaggatggccacccacaacccgcatcatatttgtcacgcgagctaaagagtgcttgaccactaactacatcaacgtaaataccttcctggtaaaagttatcatactcaccgctaaatggccgttcggtcgctgcctcttgagtaacggcgtattgttcaggcgttagacgctgtcgtaattcaccttgctgtttatccattactatcagtccttccataattgagttgtgtacaatctaattacagtatttatcataccccaatctagctagaatgcaaaaaagaagctccaacaagtggtagcttctttttaaattaatctgtaaattaagcgttgaaggcgtccgttaattgagggacaacttgcttcttacgtgaaacgacacctggtaagcttaaccggttgttagcaatcgtcttaccaaaggctttttcaacaggttccgttgggttaccaacgactaataattccgagttactatctaagatattagtagccaagattaagaataaatcatagccgtcactcgcattttcgtcttttgcagcagattctaaagcagcttgacgcttgaaaacatcatccaagtcaactgtattgatttgcgcaacgcgcacggtcttgccagccatttcaaatgacttcgcatcggcatcgattaattccttttcagtcttgctgtcaaggttagtgcccgctttaagcattgctaaaccatacgtttcataatcaatatcagcaattttagctaagtctttaacaactgccacgtcagtttccgttgtggttggggactttaagagtaatgtatctgaaatgattgcagataacattaatccagctaacttggctggaatttcaatgtcattttctttgaacaacttgtaaatgacagtgctgcagcaaccaagtggttcagcccggtagaataatggttgggccgtgtcaaaaccagcaattcgatgatgatcaaccacgtgactaacagttacgtcagcaatgtcactcacactttgttgaggttcgttatgatcaacaagcataacactgtcaacttcatcactggccttagtaatcacccgtagtgctggttcatcgaagtaatccaaaacaaattgagtttcttcgttgggttcacctaatgcaactgcttcagtgtccgctcccatcttattttcgtagtatgagaacgccttagccgccacgattgcgtcggtatcaggattttgatgtccaaaaactaattccttactcattagcacaaaactcccttaaaacttatttttgattaatcttttgtaaccgtgaaatataatcttcggtccgtaagtaggcatcaaattcatcaaggaaattcttgattcgcggaatttggtccttatctttacggaagacaaaatttaagtcaaacttgatggctggttcaaatgacaacgtgtggagcttatcagttgccggattagccaccataaatgaatttggcaacgccgtgttagtattagttgctgccacaaagcgataaatctgttgtggcgtcgtaaaccgtgcgactgccgttggcaaatcagccaactggttcttataagattccttaaccacttgatccaagtaatagttttcaggatacgttacccatggattgagcgtcgtatctttgaacttgatgtgcttcttcttcgctaacttctcgtcacccgaaatgaatagcaattcgtcttggataatcttcttagactggtatggcttccagttcttgatactttcatcaggtaggtacatgactgccaaatcaatccgattattttctaatcgttcccaaatctctttacgcgtcagcatgtgcaacgaaataataacatttggattggcctcgtaatacttaatggcaaaattctcaaatacatggtcttcaattgaagctagcacgccaatattgattgttccttgagtagcactagttgtctgctggatttcatcagttgccttgttcaatacactataaatactgtgggttgcgttaagcattgtgtaaccggcgtcagagagacgtaactttttcccaacggaataaaataaaggggcaccaacggtacgctctagttttttgatctgttgggtcaatgctggttgcgtaattcctaaaatttgagctgcctgtgtgtaattcatagtttcagctagttgcaagaaatacgttaacgttttcgatgagaaaatactttcttgagttgtcttcatgaattttacctgatcctttcttcttatcgccatcttatgatatctataattttatacaagattcaaagtgaaagcaagcggttgttattggtaaataaagcttaactaattcataatcttttaccctgttataatattatcttaatcgaatgcccgttaacgtgcaagtattcgcattggaaactataccgttagtgggatcggatggatctgcatagaaacaggttccccttcagtatcagtatcaactacaaaagagccattagaataacgcgcactagtaggatgatcatcattcaagatcgaatggtgcttaccacgatcagtcagcacatcaagtgcaaccccatttgcgtcactagcaactaagacataatcagcgacccggtgtggattattttttaactcccgtaagacttgaacgccccgccgtgcacgacttgtcacgggtaaatctgccaccttcatcttcttgaatgaaccccgttgcgtaatcatggcaatcaaatcatcatctgcggcgattgttgcccgtacaatggcatcgtcgcgcagatccatagatttcacgccgaccgccttcgcaccaatcgttgggacctcgcttaaatcatagcgaaggccatacccatgttgcgttatcagaatcagggttcccgttggtgcagctggtaagtattcgactgttacaacggttgcatcgtctgacttcattttgatgaactggctggcccgagtcttataagttcgacccggcgtgtaatcagcaaaggccgtttgtttgatatagccgtcactagttgccactaagaattttccggtagctttaaggttctcaaaagaatagacccacgtgatgcgctcgttttcagccagcccaatcgtctgagaaatgtgctcaccggtatctttccatttggcgtcagcaatttcataaatcggccggtaaatgagatggcccatgttggtgaacatcattaaatgatctaacgtgctatttttagctagatagattggataatcctcatctttaagcccgttatcatcaggctcagacgctgaataagagcgtaagctggttcgcttgatatagccatcatggctaatcatgacaatgacgtcttcttgtggaatcacgacctcggtcttgacctttaattcttgaatttcattttgaatctcagtcaaacggctcgttggataggctttttgaacggcctttagttcgcgccgtaaaactttatcgagttctttaggctctgccagaatcagctgataggttgcgatagccttggccagttcagctgattctttttctagctgcgtcacatcggtattggttaaccgataaagttgcattgtcacaatggcttcagcttgaatctcagagaaatcgaattgactgaccaagttctgtttggcgttcttcttatccttgctaccacgaatcgttttaattacttggtcgaggatggacatcgccttgattaatccttgaacgatgtgttggcgatccatggccttctgtaagttaaattgggtccgacgggttacaacgtcccgttgatgttccaagtaggccgttagaatcgttttcaggccaacgtgttcgggccgttgatgataaatggcgaccatattgaagttataagtaatttgtagatcggtatttttgagtaagtaagtcagaataccttctgcattgacgtcacgcttcagttcaatcaccactgataatccctgacggtcactttcatcacgaacttcggcgataccttcgatcttcttcagaatgcgaatttcatcaatttttttcaccaattgcgccttgttaacttcataagggatctctgaaacttcaatctgtgatttattccccttaagcggtacgatcttggttcgcgaacgcacgacgatacgcccacggccagtttcataggcttgcttgatacctgctaagccttgaatgatccccccagttggaaaatcggggcccttgacaaagtccatcaaatcttcaagcgttgccttagggtgattcatcaggaataaaatcgcatcaatgacttcactcaagttatgcggcggaatttccgttgcataaccggctgaaatccccgttgccccgttaactaataagttcggaaagcgggccggtaaaacagttggttcgtactctgtatcatcaaaatttaggaccatatcgacagtctttttatcaatgtcttgaagcatttcaccagcgattttactcaaacgcgcctcggtataccgcatggcggcagccggatcaccgtccatggaaccattattcccgtgcatttcaatcagcggttcccgtaacttccagtcctgactaagacgaaccattgcttcataaatcgaagaatcaccatggggatgaaaattacccatgacgtttccgactgatttagcggacttacggaacgctttgtcaaaggtgttgccatcctgattcatggcgtataagattcgtcgttgtactggcttcaagccatcacggatgtctggcaaggcccgttcttgaataatatatttagaataacggccgaagcggtcgcccatgacgtcttcaagggttagttcttgaatttttggttgttcagttgccattttacgaccccctctattgttttagctgttgcgccaattcttcgtcggcttgctcatgtgcggatgagacggcctcgttatctagtaacgacccgtcttcgtccaaattaaagtggacgttactttcgatccattttcgacgaggttcaactttgtcacccattaacgttgtgacccgtttttctgctaaggcagcgtcatcgattcgaactcggactaaggtccgtttttcaggatccatggttgtttcccatagctgttccgcgttcatttcgccaagtcccttgtagcgctggagtgcatagcccttaccgaatgacttggtcttgagcgttaactcttcgtcagtccatgcatattccgtccgtaactgcttgttctgcttcttttgtaatcgatacagcggtggcaacgcaatgtagatcttaccagcgtcaatcattggccgcatgtacttataaaagaatgtcagtaagagaatttgaatatgggcaccatcggtatcggcatcggtcataataatgatcttgtcataattactggccttaatatcaaattcaggaccaacacccgcaccaattgtataaatcatggtattaatttcttcattcttgacaatatcagctaatttggccttttcggtattcaacaccttaccacgtaatggcaaaattgcttggaactttcgatcacgcccctgtttagctgaaccaccggccgaatccccttcgactaagaataattcattcttcttagcgtttttagactgcgctggcgttaattttccagaaagtaaccgttcctgcttatggcgccgcttaccgtttcggctttcatcacgggccttacgggcagcctcacgagcctgccgagctttggtggatttgcgaatcagcatttgagcaaattcaccattttccatcaagaagaattgaagttgttcactcacaatattatcaacaatcgttcgtgcttcgggtgttccgagcttttccttagtttgaccttcaaattgtaagagattttccggtactcgtaatgaaataacagcggataacccttcacggacatcggagccttccaaatttttatccttgtccttcaataggccaaccttgcgagcatattcattgaatgctttcgtccaggcactgcggaaccctacttcatgagtcccaccgtctggcgtccgcacgttattgacgaatgacaacaagttttccgaatagccatcgttgtactgcgcagcgacctcaacttcgacaccttccttagtgccgtcaaagaacataatatccccgagggtgtccttatcttcattgaggtaactgacaaacgccttgataccatcttcgtaatggaagaccagctcttgttgttgattttcccgttcgtcagtcagcgtgattttgacgcctttcagtaagaatgcggattcacgcaaccgttcagccaacgtttgaaaattataaaccgtcgttgtaaagatactagcgtccggcttaaaagtcattgtcgttccagttggcttattagtcttccctttcttttcaagggtaccgacgggatgacccccatctttgaaatgttcaacgtagcggtagccatcacggacaatggttaccgtcaattcggacgacaatgcgttaacgacgctcgcaccgaccccatgcagcccaccagaagtcttataaccaccctggccgaacttaccaccagcatgcaaaaccgtgaggataacttcaggtgttggaataccagaagcatgcattccaactggcatcccacgaccatgatcgacaacggtgatgctgttatcggcgtgaataatcacgttgatttctttaccatagccagctaaggcttcatcaacagcattatcgacaatttcataaactaagtgatggagtccgcggccgtccgtagaaccgatatacattccgggacgtttccgaacggcttctaatccttcaagtacttggattgaagaatcatcatattttgggcttttcttggccattctcacaactccttttatctttaaaaatctacctcaactaggtgcggctttcaggtaaccgtaataaaatagtcctaaaagccccaacctgtcaaggtacaattatgttaatttctaattgtcacttgtggctcttcatctgttagcatacacgttaacaattaaaatagcaaacacacgttcgcgttaaaagctatcttttaaaaattaagccacttactagcttacctcatgttgattctaagcgccagttcaatgaataaacttattactggtcacgactagttcttaaaatgcgtgattaatttgacagttagcgctttaaaggccctaaccacccgctttcaggcacataataattatcaaaaaatcattttattttcataatttgacacgcaatcatcattttttaaaccaattaatccccacaatcttaaaaagaatgctaaaatattgagtgattctattgcaggaggaaccaactttgaaaataataattatgctgatcatcgcctacttaattggcgcgattccttcgggtgtcattattggcaagtttttctttcacactgatattcgtcaagcaggtagcggtaatatcggaactaccaacacgtaccgggtcctaggcccgaccgctgggacaattgtcatggtgatggatattctaaagggcaccatcgcagcactacaaccgaccttgctatttcatatgaataaccggtataccttattgattggactagcagctattttaggacatactttctcaatttacattggctttaaaggtggtaaggccgttgccacgagtgccgggatcttattggcctacaactgggagttcttcttaattgctagtgccatcatgttattgttggtttacacgaccagtatggtcagtgttgctagtatgacggcttttccaatcgtcacgttgattgcaattttttactatcaggattggttgctatcactcgtggcctttgcattgaccctcttcatcttctatcggcaccgcagtaatattgcacgtatcaaaaacgggaccgaatcattggtacacttcggacttggttggcgacgtcagcaacgggctaaccgcaaataattatgttactttcaagaccatttcattactgagtggtctttttatttaggaacgggtaagctttggtgctgggtttgtatttttttgtttctagttaaagtaagatgatacaattctttattttgctatcttttcagaccacaataaaaaccggtcaaacctgtcgaccggtttcactaaaccacagtattttagttagaaaaagctaatcgcatatttagcatcaaacgtctggttcgctgcaagccggttaatgcccatcttatggcttaattgaccgtcgctatcaacgttatccgcaatgccccaccatggctctaagcacacgaacggcgcttctgcggggtatggtgaccacatgccgacgtatggtgcatcttcaatcgtcatcgctaccccatgatcatccagatcagtgtccaacattaacgtcgtctcgtgatgattcaaatccaaaatcagggcatcgtccttaaacaaatcccggctaagtgctaatggcttggtcaggtcgaagtcatccgcatttgacgcatcgttcaacggtgcctgtaatggaatatgcgcgtagacctttcgtggtgccacagtaaccttataatcagctagtgtgcccgccggatcagcgagtggtacgttaaatgctgggtgcccaccaacagaaaataacagctcttgattagctggattatgcacattgtagttaacggtcaattcatgatccgtcaacgtataaatcaaacgtaatcgaaacgcgtacggatacatctcccgcgtcgcacgactatcggtcaattcaaatgttgcttgtgtggccgtttggttgacgaccgtaaagtcattgtcgcgggcaaaaccgtgttgtcccatgtgataagcctgaccagcaacagtatactggtcatcctttaaacgaccaacgattggaaaaagcacgggtgcgtgccggccccaaaaagttttgtcggcctgccacatgtactcaataccgtcactcgacttgacactacttaattccgccccagcttcattaatcaaaacggtgaggtactcattctttaattcgactgtcatccgcgtaaacgcccccttgataaattttataagatgtaacgactaagatccttatcctgtgcaatgttaccgattcgctcgttgacatagctttcagtgattgtgacttcgcccatttccatgtcaggaccttcgtatagcaattcttccaagagcttttccaaaatggtgtgcaaacgacgggcaccgatattttgtgtctcatggttgaccttataggcaatcgtggcaatcgcttcgatagcttcaatcgtgaacgtcactttaatgttgtccgtaccgatcaaggcgatatactgcttaatcaacgcattcttaggttccgtcaaaatcttaacaaagtcatccttgcttaaatcgtctaattcgactcgaattggaaaacggccttgcaattcagcaatcagatcactaggtttactttccgcaaaggccccggaagcgataaacagaatgtgatcagtattgatgggaccatattttgttgaaatttgcgacccctcaacgattggcagaatatctcgttgaaccccttcacgtgaaacttcaccggaaccttgctgaccacccttagtaatcttatcaatttcatcgataaaaataatcccggtattttcagcacggacaatcgcatcatgataaatatcagcgttattgactaacttttcggattcttcccggactaaaatttctcgggcctctgagactggcattgtccgttggatccgcttcttgggcattaaggcacctaaactatcaccaagatcaatacccatttgaccaagcatgttattattacccgcggcggcttgctgggggtcatccatctcgatggtaacctctgagttttctaagcgccccgttttcaactgatcggcaactgataatcgttgattacgaacttcatcggtcacttcttcgttacttgaatcgtcaacgttgggggtctggccgttttgcatctggctaaacatgttcatcatgttttggaactcgttaccattgttcttagcctgcttcttttgggctggtactaataatttgacgagccgtttgtcagcagcctgcaccgcttgtgcccgcacaccagaataagcctgttgttttcccatctcgatagccacgtccactaagtcacgaaccatggattcaacatcgcgaccaacatagccgacttccgtaaacttagttgcttcaaccttcacaaacggggcgtgcacaatcttagccaaccgccgggcaatttcggtcttcccgaccccggttggtccgatcatcagcatatttttgggggtaatttcttcctgcatttcagcagaaagttccatccgccgataacgattacgtagcgcgatcgccaccgcttttttagcttggttttgaccaataacataattatcaagcgcggccacaatttgtttcggtgtcttattgatttcttccatgagcgtttcctcctacattacaacgtttctgagatcacattatgattggtaaagatatcaatgtcgccggcaatatggattgccgcttcagcgacttccttggcactcatatccttagcatgtagctgcattgcgcgagctgcggctaaggcaaagttaccaccagaaccaatggctaagacgtcgttatccggcgtgattacttcaccactcccagaaacaagtaacatgtcatctttgttcatgacgatcaacaaagcttccaatttctgtaacgcctggtcactgcgccattcctgggcaagctcaacggctgcccgttgtaaattcccagaaaattcgttgagtttcttttcaaaacgatcttcaaggttaaacgcatccgcgacactcccggcaaaacctacgacgacctgatcattataaatccgccgaactttatgggctgtccctttcattacgactttttcacccatcgtgacctgaccatcaccggccatggcgttatggccgttttggcgaacggcgcaaatggtagttgcttcaaatttcgttgtcatgttcagtctcctttgtcgattcccgcgttgcccgtgggaaaaattgacgataatcttgttgtaaatgttcctttgtcacgtgcgcataaatttgcgtcgttgacaaacttgtatgacctaacagctcctgcacggtccgtaaatcggcaccattattcagcatctgcgttgcaaacgtgtgccggagcatgtggggatgaatatcagccgttaaactacttttcttaacgatttgattcaagacatattcgattccgccgccagtaatggggccgccgtgacgattaataaacaccgtttggtgcgtttgaccatacttggccatcacgggctgccggcagacggtttcgtaatgctgaagcgcggtagccgcgtaccgaccaaatgggacgtaacgttccttgtcgcccttcccacgaatcaacatcatttttaggtcgtaatcaacgtcggctaattgtagatcgacacactcactcagccgaatcccagtaccatacaggacttctaataacgccgcgttccgggcccccatcacgctatcatccgcatagacggtttgaaataatacgtccagctccttttgatagaaaaaacggggtaagcgcgccgcgtgttttttgagttggacgtacacgaagggattcaatttagctaaatcattcttaaccaaaaagttatagaacgaccgcaagcttgaaactttccgagcaattgaattgcgggtcaagtgccggtcatataaatgacttaaatagacgttaacgtccaaccggtcaacttcagtatacgctttcgcgccgccatttgccgttaagaaatcattaaaagcttgaatgtcttcccgataagcagcagcggtctcttccgaatactgtcgttcaacccgaatgtactttaaaaagatggttaaataatccgtttccatgcaaaaacctccatacgttgctactttagcaaagtatggaggaaaacacaattatgcaccctgtcaatggggcgatattttagttgttaacggtcaatgtttcatctttaaaagtcgtcaggtcagccaaggcccgttcagaaatcgccgtattacgctcacgcttatcccgaatgcgctgtttgagttttggcataatgccaaagttggcgttcatgggctggaagttgctagcgctcgtatgcgtgatatagtgggccatcgcccccatcatcgtgtccgttggaaaaacgaccggttctaaaccaagtgctaagcgcgctgcgttggttccagcaacgatgccactcgctgcactttcaatatagccttcgacgcccgtcatttggcccgcaaaaaacaaatcgggccgttgctgtgtctgataagttggcgttaataatttcggtgacttcataaaagtattacgatgcatgacgccataacggacaaattcaacgttctccagacccggaatcagtgaaaagacccgtttttgttcgccccacttaagatgagtttggaagccgacaatattatatagatcaccagcggcatcatcttggcgcaactgaacgaccgcaaagggttgtttgcccgtcttcggatcttcaaggcccactggtttaagtgggccaaatagcatcgtttggcgcccacgttgtgccatcacttcgatcggcatgcagccttcaaagacatctgaattttcaaaatcatgcgcttcggccatttcggcgtgaatcaacgcgtcatagaaaacgtcaaattcggcttccgtcattgggcagttcagataggccgcttcaccacggtcatagcgtgatttgagatacaccttatccatgtcgatcgaatctttcgttagaatcggtgcggccgcatcaaaaaagtgtaagtcatcttcgtcgttaaacgcttgaatcgatttcgctaaggacgccgccgttaatggtccagtcgctacgaccgtaatgccatctgggagactagtaatttcttcattaataatttcaacattaggtaacgcggtgattgcagccgtgatttctgcagagaacgtatcccgatcaacggctagcgcaccaccagctgggacagcgtggtgttcagccgcttgcatcacgatcgaatccatctgccgcatttcggcctttagtaggcccgccgcgttggctaattggttcgcccgcagtgagttcgtgcacactaattcagcaaattgcgccgtgtgatgggcgggagtcattttgttgggccgcatttcatacagccggacattgacgcccatattagcaatatgccaagcggcctctgagccggctaaaccggcgccaattacgtttactgttggtattgatgccatccagaattcctcttttcttgttgtcataccattgatagtattgttgtcatcatacctgagaaactagcagaagacaactaatggcatcagcaaatcctgcaatgacatgtccaccgtcaagcttaaagcgaacattaatttaaacgggcgtttattttcccgataaaacacttgttaatcagtttaaattacgaattttatcaacgtattttcaaaaattgtacgcattatttgacaatacacaaaaaaagatcatccctagatgacctttttttcatttatttttgaacgttttcggtataatcgccattcggacaaagcacttgcttgccacctttgaccttcttttcgaccaggtaatggccatccttcgggcaatcacggccaaccggtttatcccaagagacaaagtcacaatctgggaagcgggaacaaccataaaaaatccggttcttcttcgatttccgctcaatgacctggcccttcttacattgcggacaaacgacaccaatttctttaacgatcggcttcgtattacgacaatccgggaaacgggagcaggcaaagaatttgccgtaacggcccatcttcacaaccattggcgcgccacaaatatcacaattgaagcccgctaattcgtctttgatttggatcttctccatactttcctcagccgttgcgacttctttagaaaacggcttgtagaaactatcgacgactttaacccagttttccttaccttcttcagtcgcatccaactgttcttctaaactggcagtaaagccgacattaacgacatccgggaagtattcctgaataatatcgttaacgatctcgccgagttcagtcggcacaaaccggcgcgcttctaatttgacgtagtagcgccgctgaatcgtatccagggttggtgcgtacgttgacggccgccccacaccattttcttccaatgctttgatgaggttggcttcagagtaacgtgcgggtggctgggtgaagtgttgttgcggatcagtcttcgataacttgaccacatcaccttcacttaaatctggtaagacgttattcttttccgtcttatcgtagatcttcgtaaaaccagcaaacttcgtcttcgacccgttcgcccggaattggacgtcattttggtcgatcgtgaccgccattgtgtcaagtacttcgggcgtcatctgactagccacaaaccgtgaccagatcagctggtataaccggaattgatccttcgtcaagtagtctttgatgctagctggtgtccggaagacggatgagggtcggattgcttcatgggcatcctgagcgccttctggtaacttgcccttgacaggtttggtggccgcatattctgcgccgtattctttatgcaagaattgtgacgcttcgtgcttcgcaatcgacgaaatccgcgtcgagtcagtccgcatataagtgattaagccgacgctaccttccttaccaccaacattgatgccttcatataattgttgtgctgccatcatggtcttacgcgtccggaaattcaacttccggttggcatcctgttgcatggtagaggttgtaaatggcggcgccgggaaccgtttacgttcttttttgacgactttgacgacattaaaatcgccattccggtctaattggcccaagattttttgcaccgcatcgttgtcatccaacggttgcttcttaccatgggttccataaaaacttgccatgaatttggaacgacccttttgaaattcactatcgatcgtccaatactcttggggtttgaacgctttaatttcattttcacgttgaatgatcaaatctagcgcgatcgattgcacccgaccggccgataacccctttttgacctttttccacaataatggactaattgagtaacccactaaccggtccaaaattcgccgggcctgttgggcatccactaggtccatatcaattgaacgcggttccttaaaagcgtttttgaccgtatccttggtgatttcattgaagacgacccggtttttatccttagggtcaagtcctaataaataggataagtgccaagcaatggcttccccttcacggtccgggtcagatgcgaggtacacggctttggcttttttagcctctttccgcaatcctttgatcacatcacccttaccgcgaatcgagatatagtgcggttcgtagtcgttatccacgtcgacacccatcttgctcttcggtaaatcccgaatatggcccagactagcgacgactttataagaacgacctaaatatttttcaatcgtttttgctttagatggtgattccacgatcaccaattttttagcgggtgttttgcttttccgcttggtagcagttttagttgcggtcttccgctttgccgccggtttggctttagttgtacttgcagccactcgatcagctccttacaggtttcattatcattattataaatatcagtttaagaaatccctgtaatcatatttcaaaaatttcgtgttgtcaaatttttggtaaaaactcttctattatatgtcgcgaatttaagactggtttggcccccgcaacgatcaattgattgcacccaactgaaaatggtgcatcaattggtccaggtaccgccagaacgttgcgattgttttgtaacgcgatattagcagtgatcagactcccagaatgggcctgcgcctcgaccacgataaccgtttggcacagcccggcaataatccggttacgagcaacgaagtggtatggttccggacccacccccagcgggtactcactgattagtaaaccgacctgactaatttgctgctgtaggtcacggtgttgacgggggtaactaatatccagcccggtcccaatcaccccgattgtcggtaagttaaaacgaagggcggtccgatgtgcaaaaccatcggctcccttcgctagtccactgacaatggtcaactttgccgttgctaacggtgccaataattgcgtcgtgacccgttccgcatacgatgtggcctgccgagcaccaacaaccgcaagttgacgtgtcgttagtaacgcacgctgcccgcgcaaaaacaacactaatggtggttgataggcttctaataaggccggtgggtaatcatcatccaagattgttaaaatatcaagctgcgcatggcgttttagtcgctgttgaaacgccatactttgccaatcagcggtaaaacgcccctgctgactagcagttaaatgggccaacttacctaatcggcggggatcagtgacgaccgtctgaacctgccgacagtgttgtaacacgcgtaccatcccggcatacccgatgccgtgcgctaaatgtaatcgaatcaataaacttcttaattgcatgttatcacgactccttaagttcgcccttgttgacattagtcgtcaacggaacggcttctttaaagagtagttacggatttagacccgcttagcatttcgaaccggtgaaaaagattggcgatgaatcggcgtagcgccgagactggccaacccggccaaatgcttagcagtcccgtagcccatattatcagcaaagtcgtacccgggatacacttgatcatacattgtcattaagtgatcccggacgactttggcgacaatactagccgccgagatgctcgcgcttttcgcatcgcccttgattagacgggtctgttcaattggtaccggcacctgcatcgcatcaactagtaaacgggttggccggacggacaggttacggacggcttgggccattgcgactcgggtcgcctcataaatgtttaattgatcaatttgttgggcatccgcaacgccgattcccacggcgaccgcttcttctaggatccgtggcatcagggccgcccgtttcttagcggttaattgctttgaatcattgacttctagcaaatcaaaatgatcgtccaagactacagcggcagttacgactggtccagctaacgggccgcgaccaacttcatcgatcccagcaacgtattgtccgccgtgggcccaaaaatcccgttctaaacgcatatgttgattaaaacgtgtcactaacaccgcctgtttttcagcttgtcgcaaatagtgttgataagcctgttgcacgcccttgcgaggatcggcttgagccgcggctagaagcgatgccgttggttggtcagccagtagccgtttaaaatccgcaatcgttcgttcaggcatcgggttgatcccccgttaagtcgagcgtaaaacgaccgagccggcccttgcgaatatctaagaggaaggccacgcagaaacgttcccagtcatcgcgcatccccgcatttttcgtcatcgcaatcagtaattccggatttggtaaggttaactgctcagccgtcaaatgataacgatcgactaagcgtgccgcgtagtgctgcttgaagaagtccaaggcaaacaaagcgacgtcatcgttaggatagatattttccttaatcgcacccgtgacggccagcttggtaccaacgacttggtcttcaaacttcggccataaaatccctggggtgtcgagtaattccaatttattggacgctttgagccactgttggcccttggtaacgcccggacgatcaccgactttggcaatttttttattgacaatatggtttaataaggtcgatttaccaacgttggggataccgacacaaactgcgcggattggccgattagtaatgccacgggccgcaatttttgctaacttgtcagctaacatgtcactagccgcttgcgtcatttgtttaccaatcgtacggctacgtgaatcgaccgcgatcgcaacttgaccctggtcttcgtaatacttgacccagtcagctgtcgcttggggatctgccaagtccttcttggtcataattaagaggtgtggtttttgttgaaccgttttttcaatttctggattccgggaagccactgggatccgggcgtcgaccaattcaaaaacaatatcaactaaatgtaaattgtcctgaatttgatgaatcgccttggccatgtgacctgggtaccattgaatatttgccattacgttgtgctcctttttctcgtgacgtgaatgccttcaaactttgatcattgttaaaattctttagcagcactggctgtcaagccgatgctgctagctccagtggcgacatgcttaagtgctttacatcaaccgccactaatgcgttgattcaacgaaatcgttggtcgctatgccgcccatgaactaaaacaccggacgcttgctagtccgggactggcatgatgtagcaatctatattttaccatgtttacaccgaccatgctttgaaaccgaccattgatctgctgcccaatacttccgcacgttaatttagctaaccggaacatcgaccccattttattggctgcaagcttgcggtagctgtcaattagctcgttagtccaagcacatcgcataaccgtccttagcgttaacgtccaccgatacgatcatacacacagttcacctactacaaatgcaaataagcgcgacgtcacagccttcatcatcaagatggccgcaacatcgcgcttgtttgatagccgtcagctaactaactgacgtgacttaatcccagaatttagctgcaatcttttgtccctgatcaatctttgcccactgctgagccgccgttaactcgttacctgagtcacacgaagcgaagccgcattgatgagataaatataactggttcttattcaaaatttgactagcttgcgtcagtaaccgtaacgcgcgatcttcatcatctaagatattggtcttactggataacaggcccaagacgacttccacattcggccggtcctcaagtaccttgagcgctgaaagatcaccggcgcggtcatcgtcccattcaaggaagaaacggtcgtagtgttggtcatgcaggaatttcttagcaatcgtattgtaactgccttctgcaaagtgccgactttcataattaccacgacaattatgcgtccaaactttcaaccctaattgatggccaaaatcaactaactcattattggtgttgacggctacatcagctaattcttggagactgccatttccagcaccaaagggactttgctgattatcactggcaaacacttcccacaagcagtcatcgaattggatgattttgccacccgcagcttgataatccgttaagaattctttatacgccccgagtaagcctgcatgcaagtcatcaacagttttgtaaatctggtcagggccatatagcttatcgatgtatccaaactcaacaaaggcgtgtgcgggactccagatcgttaatttaacgtcattaccatcggcttgtgacttaagttgctgataaatatcaataaaatgatgatgcttgccagaaagtggtgctgtgatttcaatgccaatatctttacgtgtttcaaaatcactgccgtcatgatcgcgaaaattataaccttcatccgcaataaaccgccgaacaccactaaacccccaaataaaatccaaatgccacattgacttcgtatattcgccatccgttagcacatcaatcccatgcgccttttcggtggcaatcaccgtcttcactgccgctgtttcggcagcctggtagcccggcaaagcctcataaaatgggtattgaatatcgtcacgatgttcgatttgatttttataagtaagtaaactagccgggcgtaagagtgagccgaccaattggaaatgtgtttttgtcataatgtaatcatcctccgtgtctgtcttaatgagtttattataacaatctgattaaaaaatagataagactgattgcattgatgatataataggcaatacctataacctaaataatttattcaatcacaccagctacaatcatgcgttaattagatactgaaaccagacatttctcaggaggtgcacttaatgcgtattcaacaattgcgctacttagaaaaaattgccacgactggctcgatcaacgaggcggccaaacagttatttatcagccaaccctcattatcccaagcaatgaaagaactcgaaaaggaatatcaagtacagcttttttatcgtcataaaacggggatcactttgacggatgcgggccgtgaattcattaactattctcgcagtgtcctcgaccaagttaatttactcaacgaacattttggtcagggaaccgttcgcaagcgtatctttagtgtctctgcgcaacactatgcgtttgtcgtgaacgcctttgtcgaattagtcaaggaaattggtggcgatacctatcagttcacattacgcgagactgaaacggccaacgtgctcaatgacgttcagactttgaaaagcgaacttggcgtcatttatcttaataagttcaatcagaccgtgcttagccgtttgattgctgacaaagacttaagcttcgtaccgctattcgaggctcgcccgcatgttttcatcggtcgtgataacccattaacgcacaagcaagaactgactttggatgacctacgagactatccctacctctcttatgagcaaggcgatacgagttccttttattttgcagaagaaatcctcagtacgctgcctcataaaaaacatatccgcatcagtgatcgggcaacgatcttcaacttgatggtgggtttaaacggctatacgatcagttcaggcatcatcagcagtgaactcaatgacgaaaaaattgtggcgattccactaaaagtggatgatgcaatgacccttggatacctgcgccataagaaaatcgaattgagcgctacggcccagcgctatttgacactattgaaacagcacattcaaggatatggctttgacgtttttaataataattgactgatcgacacatgacgtgactgaattcattttttgttaacaacatacagtggcgggttgttttttgcaatttgatcaaggctttaatgtccaaaccgcaatcgccttcactaaagcaggacacctaaaccatttaaacatcatatatatcctttttcaaaacccccgctgagtatggattaactcagcggggatatcagtttttttatcttaatttattgatgagatttcaacacactcaaaattcaatcaatcttgttcataataatatgcatttaaagtatatgttttaataggggtaatctgtaattcatatttttcaactaaatcagctaactcctgaccatcaattagtgttaccgtattatttccctgcatcgccttagctttagctcggttagtgaaatgactagttgtcacaaagataccatattcagcattaaaactatccatgacgcccttaaatttatcaatttcaggttcggatacctggtcctgcgtataccgtttgcactgtattgccacccggctagtacgaaactcgtcggatttaaaatagccaaagccatcgataccgtgatcagctgaacgtaccacaccacgatttttatcaatggtcacacccatttttgaaatcaatgctcgcgaaaagttttcaaactttccagaattgaatttttttaaacattcaattaaatcactcttccattgtgattcatctgcatcttgtcgcgactctggatcatcgattacgaccagatcctcatccctatctgccaacttgtcatcagattcctgcattgctgttaatttccgatgtactctttcacgtgtcttttgattccaatagttcgtaactagttgggtttgttcagaggtcggataatttgataattcagcagttctgccgatacttgtcagtgaaatttcctttccccattccatggaactaatatagccaactgtaagtagattttttaacccaaagttgaaatcgtataggaagggattatacgctcttccggtccgtgcactgactttagtatcatagacatcctcatacttcagattaacatattcatttgtagcaattgtctggcgtattatttttcgtgaggctgttccaccaagttcccgtagtgctaaaacgattgccttctctacattccaacgcttataactcatctcaaatgccaactttcaaatttaatgccaactattttttgacacagcaaactgtcaatattcggcttcaaaatttattctatcatgtttgaattagtcttgcgttgtgcgtttccccatctaaccaactaagatcacgaaaaaatacgacattcaggttgaatgccgcattttagtttggtttagctacttgtttgtttcaacatccaatgcatgtttggccgcaagcgcacgaccaaaatcagtttcatcaaaatgatcaatgatttgctgaagcgcggtcgcacttaaactggccccaaataacggactgccgggttcagtcataataccatccgccagtcggggatagctaatgggatcaaacccaagcgtctccacaaagtgggccacagttgctacggcttggggctcatcaccagctaccaatagggccttccgcgccggatcgccattaggtctggcgtcttcttgcagattatgataacccatatggttcagtgttttaaccagatggctccctttgaagtattgctggacttgttcgctggaggacgtctggggatccagaacttcttcccgtaccccgtctgtttcccaccaataattcatagcgtcaattacaagtttgccatcaagcgccgtagccgggatttgccggtaacgactcagcggcaatgctaaaataattaactcactgttggcgatgacatcctgattttccgccgcaattgcacccggaactagtgtttgaatcgttagttcaattttgcttactttgccagagcccgaaatgcgaacgtcatacccggccgccaatgccagttccgctaagacgataccaactttaccggcgccgaggattccaacgtttttgactgtcatttggtcgtcacctgcttcgcttgtaaaatagttttaacttgtggaatcacctgtgtcgcatacaattcaatcatccgttcacgttgagccgccgtttgattaccggccccgtataccaagtcaaagcgccccagccctagtgtttcaatcgtcgtcgcgatccgttgcgcaaccacggtcggcgtcccaacataaaacgacccgtattttgtttcacgttcaaattgttcgtgactcattggcgcccatccccgggtcaatccaatgcgatcaaaattagctttgatattttgataagccaccgtcaaggcctcatcctgatcatccgcaatgaatccatgcgaatgcaccgcaatcggataagctggctgattgaactttttagcggcttcgtgatacagtttgatatacggtttaaatcggtccgcccggccaccgatgattgcaatgatgactttatagccaatcttagccgcgcgaataattgattctggtgaaccaccaatcccaatgtaagtctcaagttcaccagtagctgtctttggatacacgtcttgattcgttaacgaagcccgaaacttacccgaccaagtcaccggcttttccgttcgcaattggtcatatagtgcgagtttttcgttaaataggtcatcataatccgtcaaatcatagccaaataacgggaacgattcggtaaacgacccccgtcctaacatcacttgggcgcgcccattagacagaccgtctaacgttgcaaaccgttcataaactcgaaccgggtcatcggaactcagcaccgttactgctgacgctaatttgatgtgctgggtcacggcagcggtggctgctaacaccgtttccggacttgagacactgtagtctggtcggtgatgttcaccaatgccaaaaacatccagcccatactgatccgctaactgaccttcgcgcacgatttggcgcaatgactctcccgtcgactgtaaactaccatccgcgttcgccacaatatccccaaatgtttctaacccaaattctagttgattaacatcaatcatcttaatgcccccattacttttattttacttacttttagtaagttattgatgttaatatatcgtattatctctttaaatgcaactgatagacacagcttgatagtcccttcaatcatgattaaaacaatctgccaattagatgaattccggttcggtagtaattcagcgatacaggcatcgcacagaataaaaagaggtattcaattagaatacctctccgtaactcatctgtaagttgttccgaaccaatcatcattgcaaaaatcaagtttacacacgctatctagccctgggcctgccgttgcgtctcatgacgttgtgcccataagttgatcactaaagcgacaatcattaatccgaacgcaacaatcatgatattttgtagtccggtgtgtaagatgccacgcatcatcggcactaggtgcgctggtagtcggcccgcccgactagcatcacttaactggttcatcatcgccatggtgattttaccatccgatcgtgccaccccactagtcagagcttggttcatgattagcccaaagatagccgtggtaaacgtctggctgagcatccgaatcaaataactaaacgaagtcgcaactggaatgtcacgttgatcagcgtctacttggaccttaacctgcagctcattaaagcaggccccattgccccaaccttcaaagaagccagctaagagtaagacccagtatggaagcttaacaccgccaatcatcaatggaacgaaggtcagcgtcaaaatgataatattgatcgtcaagacgcgatggggcgtcaagtgccgccgcatgcggggaactgattcactacccccaaaattagcaaaagcacttggaatctgcgtggctcccccaattaacgctgacgtccctagcaagccctgagcccacatcggactgtacgtcaaaaaggcaacgaacgcgccccaaataagcacaaataagacgaaatcgaccactaacggcgcgttcttaaacaggcggcccggaataaccgggtccacagcgcgacgttccacgatggttaaactgcccaacacaatgagcgcccccacgatcacgatcgcgacaatccataacgacaccatgccgatcagttcaataccaccaagcaaactgatgatcccaaccgccatcaataacgcccctgcacgatccattggttgcaagttatgttcccgcttaggttcttgatagaagatttgtaacagcacggctgagacaatcccaattggtacgttgaggtaaaagatccagtgccaagaccacacatcgacaatcacaccaccgaccatggggccaataatcgttgccatactaaagcaagccgagactagtcccagtgcccgcattcgatcacgcggattcttaaaaatgtccgcatacatgatgtaaggtaaggaaatcatccccccgttgccgagacccgcaacaccccgagcaataatcaaaaaccagatgttgggtgctaatccttgtagtaaggagccgacaataaagagtgccgtcgtcatttgataagctcgcttattaccaaagcgctcacccatttttgaccagatcaaggtcgaaactgccgttcctagtaagaaaacagcgacgatccacgccattaaccgtagaccgtgtaaatccgcaataattgctggtagcgccgtattcacattcgtactatcgataccagccataacgttcgatagtaacagggcgccctgaacaaaataaatggcccgtcgattcacaacaaaacttctttctataattgctaaacatctcgccagtcgttcagctaaaagttacctcaatgcaacccgttgaaattcactatttcatactgatcaattaacgcacaatttctagtataccgctttacccccaccgcaaggcaagtctaaatcttgatttaaattcatgatgaacaagactttccactgccgatttataaagccacccgtgacaagccatttttgagcctaattcgtagatccacctccatcttgtcaaagcttcgttgacggtaccgcattaaaattccgcaactaaaaaggcataaccgaaagccatgcggatttcggttacgccttttaaaatatacgaatcagctttgaactaatttgtcttttcaatcaatttcattgctgcatcgtaagcccgatcattatcactgatcttattagctaattcagtctcgatcttagtcagtgtctgtttatcgaccttgccattgaccgttaacttggcatgcttttgatactgcttgaccgcactggtggttgaatcaccaaagtagccattaacggttcctttaaagtaacctaaggcttgcaagtacttctggaacgtcttgacattgctattgaccttgtcagcttgtaaatcactgaccttgctaataaccgtcaagcttgcataactcggctcatcagctttaacatcaggtgtcaagcccttcttgttgatccaagtgccgtttggtgtcagccacttcgcgaccgtgatcttcatctcagtcttatcattaaaagtcgtcaccgtttgaacggtccccttaccatatgactgtgacccgaccagtttaacacctgccgattgatgcaaggctgcggagaagatttcagctgccgaagcactcccaccatcaattaagacggtcgttggcttcgtttctttaaagccaccatcatacttcttggacgccgtgtatttttcggtcgaaccatcgcgtgcttggacctgcatgatcgtcttaccattcttcaagaagattgaggccatcttcaaggcagccgtcatcaacccgccaggattaccacgcatatcgatgactaacttcttggcccccttcttatcgagtgccttcaacgccgtcttaaattccttagcagtattcgtcgagaaggtcgataccgtaatataaccgatcttcttatcgccaccgactaacttataatcaacggtcgtcactggaatcttagcccgcttcaaacttacggtaaaggtttgaccactgcgttcaatcgtcaatttgaccgtcgtaccgatcttaccacgcatcatgctaacggcttgtgtcaaggtcttaccggccactgacttgccattgaccgccttaataatgtccttcggtttcaaaccagctttcttagctggcgtaccagcaattggtgaaataatttgaacatagttgccagatttttgaacctgggcaccaattccagaaaacgaactgtcgatcgtgtcattcaagctttccgtctcgctcttgtccatgtactcggaaaatttatcacctaacgaattgaccatgccgttaatggcaccgttggccaacttattcgcattgaccggtttgtagtaattctcattgatcgtttcataaactgattcgatctttttcattgctttactagtctgctgcatactgctgagctgggcattgacttgccgaccaatcagccagtacgtcccacccaccccaatgcctaatgcgacgacaatggaaataatataggtccatagaccaacgcgtcgctttggccggggcactttttttatgtgcggattagtttgtttgggttcctctggcataccgaacgtcctctttcctacaaattaatttaagcttcacttgccaaataggcttgccacgcgtcatcaaagaccgtcatcgttggcaaataaccagcgttcaattccaaatattgtgagagttcgtgaaaatctttactctgctttggaaacgattgatccaaaaacgcattattggcaaattcggcaatggcatcggtactgtctgggttccgttgcgtcatcaagaatgtataaaatgttttatgcatgaattcactccttagtcactagtttttggaatatgcatttcgaacttgaactgattattcttcaaatcaagcttatctacactataacgaacatcatgtttaccaactaatttattcaagtagaggtcgattgtcttcttcttggcattcaacttgacccacttaggtgtcttgtaattattattaatataattaatcacaaagctgattggcaaggacatcgtcccgaccgataaattggttgctttcaacgaaatattgccgttatcgatgacacttggttgcatcgtgatcacaaacgacacgttctgacccagtacctgcgtcgttccgagcaaataagcgccggtagaccggaccacgaagcgatatttcatgtcttggcccttttgtagatcattcaaataataactcgcaagggcgtttaattgttttcgattcattgtaatcggcacactagccgcatccgtattgcttgcagccgtcaaactagtgctttcgctaggcgatcgtaagacctgggtgccgacgtaagcaccggtgccgacaatcaacgcaatcaagacaacggcgacccatttccaaacattgattggaccgtttgtcttcggatttttaggtgctgatgcctgcttgtttcgttgtgcttcccgcatctcattacctccctactttttgattaaccacgcatcatgggccatcatggtctgatacagtttggttgtaaacacacgatacccccgcttattgggatggaaattatcagcagtcgaaatcaaatcattcgtcttgttttccgcctctaaagcgccagtaatggcctttgagctggttaagctagttaaggtcgtggcactcgctgctttcttcaacttgcgaatctgggctgccgtcttgtactggccgtgtgacatggtccaattgatatccataaaatacgtgtgcttgtattgactaaccgtcgtctgtgtctgatcattccactggctaatgtagtgcgtgatcgacgtcacatttggaaagttcacataaattggattatagatgctaaagacaaaaactgacgcagtgccattcaaactttgtaatttattaaataatttagttagtttattcgcatataaagtttgcgctttagcaaccgtcgcgttatttttggccgtattgttagaagttagggacccttcgagcgtttgcaagaggtcgttaccgccaaccgtcacggtaatcacatccgccttggcaattttctgttgtaacactttcgacttattaatgcgtgctaaaatctggtcactccgatcaccggacttaccagcattcgtggtcgtcaccttcagcttttgcttagtcgtcaacgtttttttgatctgaccaacgtagccaccctcggactcatcgccgaccccttcggttaaggagtcaccgaccgcgaccaagttgattttcgccttgtggggcgtcttcttggcagtggtctttttagtcgttgttggggtagtcgtcgccgattcattttgcggatgcagcagataattgaccccgaaaaacaccccgaccgctaacaccgccatcactaaaatgattttgatggtttctttaactttggacattggcatccaacctttcttcaccgttgagcagtccatttaatcagagctaactcatctttgaacaataaaatggtcaccatcccctgttgggacgatcaccatttgccattagtgctcgtagacaagtcgcctgtgggacaccgctcactttacgctggcgcttgcgtatgatattccacggcaaacgcacccgggccaccatgggtcgcaataattggcaccgttggttgaacactgatcttgagacttggtaaagccgcttgtaggcgcgcccgatattcttccacgcgctccgtggcgccaacgtgagagattgcaacttcggcgacgttcggcgttgcaataatatcgtcgagaaccttatcaaaaaacttattaatcgccttaacaccgcgccccttcatcttcacatctagggtgccgtcatcaacttccaaggcaatcttaacattcagtagcgtactgattgcccccgtcagacgactgattcgaccaccagcaacgaggttattcagggtcattacgcccatgaatagcttggtatgggcctgagtcgcatgaatctgatcgatgaccgcctgtttgtcagcaccactctgggctaacttagcagcagtcaaaacttgaaaggccatcgcacggtcggtcgtccgagcgtcgatcacggtgacatcggtcttcgtaatcgaagccgcttgttccgccgtgtgcactgttcctgaaatggcttcgagcatattgatacaaatcacactcgcgccatccgcacctaacttatcaaacgtttcaatgaacgttccgagtgccggttggctcgtctttggtaaagatttagccgttgccatcttgtcaataaattcttcacgcgtaatcgtttcatcttccacgtaaatggtgccatcgatcatgacagtcaacggaatcacggtaatatcgtatttttttacctcggcatccgtcaaatttgccgaagaatcggtcacaatcttgattttcgtcatactttgccacgctttcttatacttgtaacgtttaaacgatcgttacaataaaattaatgctttcagtatagcagaaatctgcctgagtttcacggttgccactgaattaacgacggcggaaatcatcaaattcgtacggatattgatttttctcatccaccgtcccaatttgttggctcaccagctgccactgcgtgtaatccacggccggcatccaagtatcaccatcaaaccttgcgttgatacgcgtccgatataaataatcggccaccggtaacacggcttcaaacaccaccgcaccaccaatgacaaaaatcggttcatccggatgggcagccgcgagtgtttggatcgccgccacatctgctagttgatggacttccggtggcaactttaaatcagactgacgtgagagcacccaattggtccgccgtgggagcgggcgtttaaagcccgcaaaagtcttgcgccccatcacgacatggtgtccggtcgtcagcgctttgaaccgctgcatatctgctggtaaatgccagggaagctggccctggttgccaatcaggccattttgatcttctgcccatatcaatgcaatcattgcggcctcctaaatcgcgaccggcgctttgattgccggtgcgggatcataaccactgagcttgatgtcactcatttggtaatcaaaaatactgtcatgagccccacttaaagtcagctggggtgctggccgaggttgccgggtcaactgcgttttaacttgttccacatggttagtataaatgtgcgcgtcacccaacgtatgcacgaactcgcccactgctaggcccgtctccttagcaatcagatgtgttagtaacgcataactcgcaatattgaatggcacacctaggaagacatcgcctgaacgttggtagagttggcaagagagcttaccatccgcgacatagaattgaaacagagtatgacacggtggtaacgccatgttcggcacatcttctggattccaagcggaaacgattaaccgccgcgaatccggatgcgtcttgatcatttcaatcacattggcaatttgatcgatcgtcttttcctgacgcgtttgccagtgacgccattgcgcaccgtaaacgtcacccaaattaccatacttggccgcaaacgcgtcgtctgtcaagatctggtcatcaaaggtctgcatctgagcttgataaatcggcgcaaagtcaggatcatctagccggcggtgttcaaaattcgtcatatcagggccgtcataatcggcactcgtaacccaatttttgaacgcccattcgtcccagatatggttgtgatgttgcaataaatactgaatattcgtatcaccatgcaaaaaccatagtaattcgctcttgatcagtccaaagggaacttttttggtcgtcaataacgggaagccttgactcaggtcaaagcgcatctggtaaccaaacacactgtatgttcccgtgccggtacggtcatccttatacgtgccgtgttctaaaatggtgcgcgcgagttgtaaataactatcttctaacatgcgatcatcctttcaggcttctgcatactggctgaggtagtcccagcgatccatcttctcatcaatcgtttgttccgtcttagtcaattctttttgcaaatcagccaacttgccataatcactggcattggcagccatcgccgcttcgatctcactcttatggctatccaattgctcgataaccccttcgatcttgtcgtattcgagctgttccgcgtaagtcagcttgactttggctttcttggccaatggtgcggtcgagtcatccgtgaccggcttagccgtagtttttgtcgcagtggccttggctgcgggcttggccgcgtctttttgatccttcaaataactggagaaacggccagaatagcgttcaatatgcccctgaccatcaaaaatcagtagtttcgtgccgaccttgtccaaaaaatagcggtcatgggaaacggtgatgacggtcccggaaaaatcatcaaggtagttctccaacaccgttaacgtaccaatatccaaatcattagtcggttcgtccaataagaggacgttcggctgttgcatcaacaacttcagtaagtataaccggcgctgttcgcccccagataacttgcgaatcagcgtgccgtgcatcgaacgtgggaacagaaactcttctagtaactcagtcactgaaacatgctcgccctgcttattcaagaccgtctcaccgacatcttgcaagtaattaatgatgcgcttgtcgcccggaatcggttcggtctgttgagtataataggccatcttgacggtctcaccgatcgtcacggtcccactatcaagtggcagtcgacccgcaatcacattcaataaactagatttcccggcaccgttgattccagtgataccgatgcggtcattggcttggatcaacatcgaaaagtgatccaggatggtttgccgatcaaactgcaagctcgcgtcctttaactcgatcactttcttacccaaacgctgctgaccgagcgaaatatcaacatcgttatcaacttggagcgtattcaaattatccttcaaatcattgaaccgattgatgcgcccctgttgcttcgtgctacgcgcgggtgctcccgcacgcatccaagccagttcctttttgtacagctgctgttgcttatgttcagctaacacgtcacgggcgacccgttcggctttcgcttgcacgaaatcttggtaatttcccgtatacttatgcagctcgccaaatgacaattcaaacatctggttggcgacttgatccaagaaataccggtcatgggtcacgacaatcaaagcacccttataactagctaaatagctttctaaccactcaattgagtcaaaatcaagatggttggtcggttcgtctagtaataaaagatccggtgattgaatcaacacttgcgccaggcccacccgcttctgttggccccccgacatctgactgacggtctgcgtcaggtcggtaatgtgcagttgtgtcaaaatcgttttgacatcactttcagccgtccaagcatcttcttggttcattcgatcctcagcggccacgtaagctttttgggtcgcttggtcttcgggatgatcagcataagcggccaacgtttgctcgtagtggcgaatcgttcgaaagacttgctgactaccggccaaaacggcatcaatgactgtcagattctggtcaagttccggcttttgctttaaataaccaatcgtataatttttgggcatcaccagttgaccggcttccggtgccgtaatcccggctaatacgtctaataaattcgttttcccggacccgttaacgccaatgacaccaatccggtcatgttcattcacaataaatgaaatatcgtgaaataacgtcttctcaccataagttcgggtcagattttctgctcttaaagtttgcattgttacgatccaccctttttttacatcattaagttctatcttagctagaatcggcttaaaacacaactgacaaacgcgcaaatcaacgttaatatttcctaacgatcatcgattcgattgggtcgtgagtcacaaaaaaactcctgaggctcactcggccccaagagttgtttggcaacaccttattagttatgatcaccataaacatcaaagacggtccgttcatcatcaacgactaagtgtaattttccatcgctggctaatgagctcgtctgataaatgttgtcgataccatccgcatcccgtggcttgaatggcaagtaaatttgttcactaccacgttcgtcgccaaacaggatgtcaattttttcaatgtcttgataatgcgtcacccgttcaaacatcccacttgtcacggatgatagttgggtcgtgtccggatcgatcgcatcagcgtcaggtttaaattcagccttaaatgatttacaaggatgaatgatggtcatatggccacccttaattcgaccgtaactcgtcgttacccggccgatccacaggtcagagatatcttgatgatgaactgtccaagtgtcaccattccgaaaatgaaatttcaatgcttctaatgctcgttccattcaaatcacctcattgaattagtttcactttaatcgtaacagattcatagaaaatatcaatggttttttgaatccgctaccatccttgcaaaatcaagcaaagcatcctgctgatttgggacctgtttcatcaccacggcctgtaagcaagccgctagaatttgacccatcattggcccaggcgtcaccaatttagctttcaataaatcgccaccgttaatggccaattcatgcttgtcatggattggtaagctagcataagattgcaccaattgtgcttggtcctggccaaagcctaaaatcgtagccacctgattagccgttttcagcgcctctaagtccgtataaaagttctcctgcgcagttaactgaccgttgtgttttaacgccatcagcgctttaatagcggccgtcacgtgattaatcagctcattgctcgtcttccacgtctttaacaactggcgaacagccgcttcgtcagtccgttgcatggtccagctaagcaaggtccaagtactttcaatactcggcaaatgccaagctggaagtgccattaactgccgcagcatcgcttcttgatcagccattgcgggcatataacgatacaagtcagtggtcagcaagccggtcaaaccagcaactgggtgctgacccatcagcagcttctcccactcgacacgcgtccgttccacggcaattttcgccaacaacgccgcattatcggcaatcgcttgttcggtctgcgattcaatggtaaagcctaactgacttgcaaaccgaacggcacgcatcatccgcaacgcatcttcgtgaaaccgttcttcagccactccaacggcgcgtaagattccttgttccatatctgctaacccgtcaaacagatcaatcacttcaccgttagcagtcatggctaaggcgttgattgtgaaatcccggcgcttcaggtcctctttcaatgatcggacgaacgtaaccttatcagggcggcgaaaatcttggtaaccagattcagtccgaaacgtcgtcgtttcataaccattgccgtgatctaagatcatcaccgttccgtgctcgattcccgtatcaaccgtccgtttaaataattgtttgacttcagccggaaacgcgctggtcgcaatatcgacgtcatgtaggggcttgcccaaaatcgtatcgcgaacacacccaccaacaaagtacgcctcatagccggccgcttcgatcgtctcaataatcggcttagctgcttgaaactcagctggcaactgcgtcaaaatcatagtaagtgctccaaaccaacaaagagttcgtgatactggttaactttttcaaccgccactttgacaccagtcataaatgagatccggtcaaaggaatcttggcgaatcgttaacccttcaccagggccgccaaacatgacctcttcgtgcgccactagtccaggtaaccgaaccgcgtgaatccgcatcccttcatattcggcaccccgtgcgccaggtagagtttcagttgcgtcaggattaccttgttcctttggttgccgaacttcagcaatcttcttagcagtactgatagcagtaccacttggcgagtcaatcttatcgtcatgatgcatctcgataatttcaacatctgggaagtacttcgctgcttgttgggcaaattgcatgagtaagacggcactgatcccaaagttaggcgcaatgaggccgcccacttgcttgtcctttgctaatttttgcaactcggcaacttgttcatcggtcatcccagtagtcccaataacaggcgaaataccatggttaagtgcaaactttgcattttcataaacggcggttggaatcgtaaagtcgatccagactgtggcatccgtcttaatttggtctaaatcatgaaaagctggcacgtcttgacccttaaagcggtcgtcctcacctagattttgttctccactgcgcgcgtcatagaccccaactaattcaaaatcaggattatcaatgaccatctgagcagccgtactacccatccgacccttatagccggcaacaattacttttaccacaataaattcctcctcaagattaagctaattatattttagcagacaattgccaaattaggcaggagaatcctcgccgaacctgtttaaactgttaaactagccccattttgttcatgcccaatggctaaaacggtcccgctaattaacttgctactttgtgggacgatccacgtccgtcctataacactgatatgaataaaaaatagtgtctgactcaaagcgtagtcccgctcggtcgaacactatttgcttatatatttcggccgccaacaacacctggtgacgctaaattaacgtgtcaatcgtcgctaacaccccatcatgattattgtcatgtgacgtaagatacgtagccatctctttgacgggtgcaatcgcattttgcatcgcaaaactgtaatcagcctcccgtagcatttcaagatcattaccgttatcaccgaacgcggccgtttgactaggggcaacgtgccaatgttgctggagataagcaagcccggttgccttgttaacatgtggtggaatgacgtcaagcccattaccaccgctgacagtcgcacgtaaccggccagcaaattgctgattgatcaaagcggcgtgcgcatcagcatccgtggcttgccaactaaaagtcgctttatagatatggtcatcaattgctgatagcgatggcaccacttgcagccggctcaaatagtaccgcatgattggactgtcatcttggggccgaatatatgccccttgcttgccggagaccgagatctcagcaccagccagtgctggttcagtcgccacgtaaactaacagttcctgataaagcgccggctcaatcaagctttcagccaacacgttgccgtgattatcaatgactaacccgccattttcagccacataggtcaattcaccgttgatcccgtcaaaaacatcaatacaatgttgcagctgattgccgctcgccacaacaaagtgctggccctgagcattcatttgatccaactgggcctgaaaccgatggtgatcaaactgatggtcgtctctcaaaaacgtgccatctaaatcggtggcaattatagctactttcacgatagtaaacgcctcacttgaatttaatatacgttcattttaccaaaattgaaagtggtttcaataactttaggaatgaaactctcagcaagcggtgaagaactaaaggcctagtagccctgatcctcgtagtcttctagcatcgcaaccatttcaccatcatctggttcaatcgttagataattccgcaacgctgccacggcactgtcggccattcctgcttcgcggaagaaataaattgctggtttaaggaaatctttgttatgttcaaagaacggataagccgcttcgtaattatccttagccgcctgaaaatgatcgagccggtcattagagattgccaagttccagtagaactgtggatcaaactcattactttgcaaatattgatccaacaagtcgatattgtcttgataacggtcccgctgaactaacaaattagatagttccaataccgtggtcaagttatcagggtcaatactcaaaccttcccgcaaatacttttcagctaattcctgatcgtctaatttcaaggctaagcgggcagtttgcaagtacagctgctcattgtactggtcgaccgctaaaccttcttgtaaggtcaataacgccttgtccagttgatgaagttgctcttgggcctgggccaagtatggatacagggacgcatactgattgtcttgttcccgcagtttgtcgaagatatcaacagccttctggggttcgtttaattgcaaataagtgaagcctaattcaaactggctgtccggcgtgagcttggcaggcttgatttgttctaaatagcccaccgcctgctcaaagcgcccggactcagcataagccacccctagtcgttcaactaagttaactttagagatctctagttgtccctgcttgatcaagtccaagtagaagcgagtcgcctgaccgtagttacgaatcaagaagtaaaattctgcgagcgcaaattcgacaactggttcgtccggtgccagctgataggcttccttgagtttttgctcactgacttcaaataactcttgggtctggtatagatcggcctcaactaacaacgcttgaacgtatgccggtgagtctggcttaacttgttgtaaatagtcgagtgccaggtccgtatcgtcctcatcgatggcaatatcagccagacttgtccgtaagtcgtcctcatccggatacttagccagtaacttcttataagtccgttccgcttgctttaaaaagcccaaaccgtacaattcttcagccagactatacagcgtctggtcatcgtccttacgtaaggcccatgcaaagtgctttttggccgtatcaatttgcccgtttgatagtgctgcgagcattttttctgaataactcattacacccatcctttaaaccactaagaaacgactttatttagtcgccttggtttcatcatttattgcaatagtcagcctgatatcgtcacatgggataccagctgttaatcgcttgacctgacagtctatcataccgcagacgacagcaaaaaagccagtataacggtcgctatactggctttcatgtttgcatttcattaactgatatgcattatttaactgcgtcctttaaagctttccctggcttaaatgcaggtactttgcttgcaggaatttggatttcgtcaccagtttgtgggttacggcccttacgagctgcacgttcacgtacttcaaagttaccaaatccgatcagttgaactttttcaccctttgcaagagtgtcttggattgatgcaaagactgcgtcaactgcagcagttgcgtctttcttcgttaagttagttgccgcagcaacgttgttaactaattcagctttgtttgccatgtttgattcacctccccgttacagagtgaaggatcgccgtgctttttaacatcgttgatccagatgatcatttttgagtggtccaaaaatgagagaaacgataacaagcatcatttcttcatcaaagatagcataggaatgctgtaatagcaagcttttttagccttttcagcgaaaatagcgcaaaaagatgataatcgtttacatcaatcaaataatgtgctaaaatgctgattttacgcgctttagcctacttacgtcgccgttcaatcatatggatcggcgtaccactaaaatcaaaggcattccgaatttgattttcaaggaaccgttcatatgaaaagtgcatcatatcagggtcattcacgaagaccacaaaagttgggggttgaatcgccacctgagtggcatagtaaacccgtagccgcttaccattgtcactcggtgtcggattcatcgcaatcgcatccataataacgtcatttaaaacggacgactgaatccgccgcatatggttcgtattgactttcttaatcaacgcgggtagttgctccaaacgttgattagtcttagcagagacaaaaataatcggcgcatagctcaagtaaacgaactgatcacgaatatacgcttcgaattcttgcatggtgtggttgtctttcttaaccagatcccacttattgaccacgatgataatacccttacccgcttcatgcgcataaccagcaacccgcttatcctgctcacgaatgccttcttcaccattgatgacaaagagtgccacgtcactattatcgattgccttgagcgcacgcatgacgctataacgttcggtattttcgtaaacttttccttttttacggataccggccgtatcgaccatcacaaaccggtcaccatcctgatcagtaaacttggtatcaatggcatcccgggttgtcccggccacgtcagaaacgatgacccggtcttcacccagcaaggcgttgacaattgatgacttacccacgttcgggcggccaatcaaactgaaacgaatcgtccccggttcgtcctccccactttcttcaggaaagtttttgataacagcatcgagcaagtccccaagtccgagtccatgcgcacctgagatagggtacggatcgccaaagccaagggaataaaagtcatagacttcactccgaagttcagggttatcgactttattaacacccagcacgaccggtttgttcgaccggtacaagatttgggcaacgtgttcatcagcgtccgtgacgccttctttgatgctaactaaataaataatgacatcagcttcatcgattgcaatttcggcttgctgtgtgatctgtttaatgaatggggcatcttcgatatcgatcccacccgtatcgatcaaactgaattcttgaccaagccattcactgttggcgtaaatccggtcacgagtcacacccggtgtatcttcaacaatcgagatccgatcacccgcaatccgattaaaaatcgtggatttaccaacgtttggtcgcccaacaatggcgacgactggttttgccatattaattcctcctttaccctcgtagcgtcaggttcctgctacgagtctcaaattaattggtaacaccaactaatctgttcctaaaaaaatatccttcaaggcaagcttgaagggtatttttaatcaatcaatgattagttttcatcattgttgctttcagcattcttcaattcgtcaccgatcaaatcacctaaagtgaaaccagttgattcttcaggagcattagccgttgaacgttcgctagcagtccggttgtcccggttgttgttacgacgacggttattgttactccgacgttctggttgactttcgttgtcatcgtcagcagtttgtggcttttcttccaaagctttaattgataaagctaaccgcttttcgtctggacgaacgtctaagactttgactttgatttcttgaccaacttttaagacatcgtttggtgttgcaatgtgttggtgtgagatttgtgaaatgtgaactaacccttcaacaccagggaagacttccacaaaggcaccaaaactcgtcaaacgcttaactttaccatcaagtacagccccttgtggtgctttttcttcaataccatcccaaggttctggtaaggttgctttgattgataatgaaacccgttcgcggtcagcatcaacggataaaatcttaaccgtgacttcttgaccaaccttcaatacatcagcaggcttttcaacccgttcgtatgagatttctgaaacgtgaaccaaaccatcaatcccgccgaggtcaacaaaggcaccgaagttcgttaaacgagcaactttaccttcaacgacatcaccagcttgtaaggtcttcaaagcttcttcacgttgtgcttcgcgttgcttttcaacaacggcacggtgtgataagatcaagcgattttcgctaggttcaatttcaataatcttaagttcaagttcttggcctttataggcatttaaatcttcaacataatgatcatcaatcattgaggcagggatgaagccacgaacaccagcgtcaacgactaacccgcccttaacaacttgagttaccggagctttaatcgtatgacctgcttcgtattctttttcaacatcgtcccaaactttgcgagcttctaaccgacgatgtgacagtaaataactgccgttttccttgtcgctgccaattcgagaaatgacaaccaagtctaatacatcaccgactttagcggcttcgttgacatcgtcaacccgttgtgttgagagttccttcaaaggaacgaccccttcaacaccggtaccttggataccaacaattacttgtttgtcgtcgtcgattgctaagacttcacccttaacaacgtcaccgacgtttacttcttcaacgctgtttaaagcgtctaaaagttcatttttctcttggctgttttcgttttcactcatgcaaatttcctcctgtcaacaataactctaacctatatcatagctgaaaatgcaatgaaaagctagctaaaagcattaagttaatgcaattagattgttgaactttgtttttttgtaataattttggcaatggcagcaacaacttcatcgattgacattggcgtcgtatcaacaagtgtggcgtccgttgcttgtgttaatggtgacactttacgcgttgaatctttgtggtcacgtaattcaatctcagcctgtagctgagccaagggcgtgtcgatccctttttttacattttcggcgtatcgacgcttagcccgttcagccgctgaagcaactaaaaagatcttaacttcagcattgggcaataccgttgtcccaatatcacgaccgtccatcacgatcccacctgcattggccatctctcgctgttgctcagttaaaatcgtacgcacctgtggtaacgccgcaatcgtcgagacgttattcgtcacgtctggttggcgtatcgccgccgtaatatcttcctgattagcaaaaaccagttgatccggctcgccgggtttaaaactgatcttgagcgacttcattgccgtaatcacagccgcttcgtctgctaaatcaacgtgctgttgcattgcccagtacgtgactgcccgatacatggcaccagtatccacataaatatagccaaaccgttttgcaacgagtttggctacggtactcttgccagctgaagccggaccatcgatggccacctgtaatgcttgcttagccattaactaacccctcacaatctgaaaaaatcgtgtattaacggacacgtaaccgttgaccagccgaaatcgttgcatcagatgataacccatttaattccaatagcttatccactgagattccagcattcgtagcgacccgatagaccccttgaccggcttctaccgtgacgtacttagtccctgaagatgattctgaggagctactactactgctagcgctgctgtcgtcagtactcgcactttcttccgagctggcagcagtagaactagcagccttggaactggcagctttagagctagccaaggctaagctactacttttagcagccgcctttttcgacgatgcggccgccttcttcttgctagcagcagtcgatgacttactggcagcaacactggccgatgacttcttcgagctcgaactagcaacttgttcagtctgttgcggattattaagcgaattctttttcaccaagaaataaccaattggtgccaaagcaagcaacaatattagtacgactaacacggtcgttagcgtagagttgctactgtcttgttttcgtttttgagttcgcgataaattgcccgagtcatcccgatcgtcttcaaaagttttgtcccacggcttatccgcttgggatttgtcattatcatttttttgactcatagggtgttcctcctcaaaaaactttcaaccaatattgtaacataacccggaattgatttctttaagaatttggtaaaaacaattgagctaagtgctgatcccacgacattatcgtggctgttggctcatcatgcgtcgccatcagccctaacgcagccagcggtagtggttcaccagccaactgacaacactgatctgtatgggtaacagctggctcaccaaagtaagttaacatcacggtccgatgacaagttgtcgtttggacgtaactcatgagcgcccgcaattctcgttccttagctacttggcgatcagcaaaaatcgttgccacggtcgttgggggagttccttgtagccagtatgactgcaaaaccttactacgatcatcagtcggtggctgctgcgcttgataacggctataatcttgctgaatttcattgggagtcgcagccgtcaattcgttcaaattccgcaccaggttttcgtcacctggtgcgtacaacataatcgccatcgcctgctgaccatcacgacctgcgcgcccaatttcttgaacatagtcggccaaagtcgtcggtaaatgatagtggatcactaagcgaatatcagctttgttgatacccattccaaaagcagatgtagcacagatcacatccaattgtcctgccatgaactgctgctggatcttgaaacggtcatcagtcgctaagccggcatgataagccgcgacccgtaacgtggttgtcgttcgtagccattccgctatcaaatcagtttgccgcttggaagtaaagtaaacaatgactggtccgcgcgcacttgtcactaaatgttgcaaggtcgcgcgtttactagcttcatcattgacctgttcgactgctaagtaaatattaggacgattaaccgaatataagatttgctgggcatctggaacggttaattgtgtcaaaatatcttgtcgaacgcgttgtgtagccgttgccgtgagcattagcgttgtcggtgcctgtaaccgttgtcgaatttgaccaaggcgacggtagtcagggcgaaaatctggtccccaagttgaaatgcagtgggcctcgtcgataactaataacgccagttgcacttgcatcagcgctgtttgaataatgtcttgacccaacatttccggcgaaatgaacaagaatttaagctgccctaaatgattcaacagatactggcgagcaccataatctagttgggaggtcaaagcagcaacttgcttttcgccttgatagtttaagcgagccacctgatcttgcatcaaggaaatcagcggtgaaaccaccacaactagcccgggcagtgcggtcccgacgagttgatagatcaatgatttgccggtcccagttggtaacactgccaagacatcttgacctgctaataatttctgaatgacggctagctgcccggggcgaaattcatcgaagccatatttcgttttcaacagctcatataattcatcttctgacatgctgacacctcataatctgaaatagccgaaattcaaaaaaatctagcgtgggtagcgcagcttgggcctcttggaatgaccagtttgcaatgtcaggctgggctgcaaagatggtggccaactgctgagttatttcatgattcaacaccatttcaaacggaaaatcaggcgaccaaatcgccacctccaacaagtgctcccgtaccgtactcatctttaagtgccgcgtctgcgcaattgctgcaagttgctgggtcttcaagaaagcttggtaagtttgctcagcgctttgactgatggcactcgcttgagtgagcactgacaacaactgggaaaatggatcacgcgggtgtcgctgaatccaagcaatccattggcatatcacgtccgtgtgcatcaagctagcctcccagggttgtcgacctaattgtgccgctaattgctcattagtcagtcccggttcttgataccccgttataccttgaacaaacaccgttggcaactctgggtctgccaaactcgtcaagaaggcagtcaaggccgcatgaatttgctcgccaagttccaccttcgactgctgacgtagccattgtttgacctgggcttgaatccccggatcagtcgtcaccggataataatggcgatcatgatgtacgagttcggaaacgacttgtagggctagctgactgacgattctaaatcggcggacatcagtggtttgaaacacttcaaaattttggggcatgtataaagtctgtcggagtttggcttgccgatgttcccccgcctgcgttaattgccagcatcccgtggccgtactcgtcaattgaccgttttcagtcaatgccgcagttgctgccatgaaatcttccaagggaacctcgtggcaactgtcgagcaaatccaagtagccggcagttaaccccgcaaaaagcgtggagaccgtacggcgaccgcgcaagacattgaataggccctttgctcgtcgcggcgtcgtactgaataacaataaaacgtagtctgtaaacacgctaaggcctcccttaagtcttgctgttgtaattgttaattgcgcactaaatgtgccagtttttaaattaagtcgtgatcagcccaaatttacgtgcgtcagtgtcgctgacagtgacccgcgacaaagcatagcggccaacagctttttaatctttctaagccttaattgaagcttcaaattcatcaacttactgccacattaaagctcatggataaccatccgccaaccggcagtgtgcgtctttaagaatatcacggtggcaccaatataaaaaggcagtcaccctgcagttacgcaattagtgaccacccacattattttaacgacttagattaaattcggctcataagctgattatggttgcctaaccacttagctaatcgctgatagaccagccagaagacgttgcccactagcaatcccttgatcaagttaaatggaatgactgccactaacaccactgtattcagcgacatgctgagcttcatacccattacttgcaaatagaatggcagaacaaacgttaagttagccaacgattcaatcaccaccaggccgattgtggcgaccacaatcgccacaggcattcgccacttgggattgccccgatagtaacgaagtactaatgcaaatgctaaaatcaatactgccgtacctaaaaaactagcaaaagaaccgattaagtcatagatggcaaagcccatcatggccgaatgtaggagcagtttgatgatagtgatgacaaacgcgcccccgacaccaaagagaaagagcccaatcagaattgggatatctgaaaaatcaatcttcatccatggcgctaccggtaaaatcggaaactccagtaacattaaaatatacgcaatggcaccgagtaaggctatgcccactagtcggtgtaacgttgtatgttgcataacgcaccctcctatgggtcatcttcaatgaaccgcattaccatttgttcaactaaaaaagtccgcccgatcacactaactgtcatctgggggcggacttacttgcaacgcttggcaaataagctcgatcttctttataccagactttactgtcgactttggaattgcaccaaatcactatgcacacgcataggtcgcgggttattaccgccggtcgggaatcacaccctgccctgaagatgaaccaatatttatttttacaaattcattttaacggctttcgttcaaaaatgcaagcgctatcgttcaccttttaacttactaatttcaatcggcttcaatttacggtattcgcccggttgtaagctttgcaaatcgagaaccccataacgttcacgtttcaacttagtcactgggtgacccactgcagccaacatctttttcacttggtggttatgaccctcgtgaatcgttagttggaccagcgcattattcttcttgtgatcactatctaacaagttcgacttcgctggagctgtcttacggccatcgatttcaacacccaagcgcaattgcttgagatcagcattggttggtaccccttcaactttggccaaataagtttttttgacttcgtacttcggatgagttagccgattagcgagagccccatcatttgtcatgatcaacaaacctgaagtatcgtaatccaaacgtcccaccggatagattcgttccggtacgtcttcaaagaagtctaataccgttttacggcccttctcatcatgaacagttgtaacgaccccccgcggcttataaaataaataatacacgagtttttctgcattcaatggcacgccatcaacctcgacatggtcactaggctcaacctttacaccgagcgtggtgaccgtcttcccattcaccttaacgtgaccagacgtgatcaacacttctgatttacgccgcgaagcgatgcccgcttccgccattaccttttgtaatcgttctgccattattcatcctcacgttctgcttgtaatttatcctgaaatgcatttaaaaagaggtctgtctctggtgccggatgctcagcgtcacttaaagcagctaggtcaatcgctggtaagtcatccaaagactttagtccaaaataatctaagaacagttccgtcgttccgtataaaattggccgtcctggctcacttaaacgccccgtctcggtaactagttgtcgcaaaaccagcttttgaatcgttgatccactgtgtacgccacgaatctcatcaatttcaatccgcgtcaagggttgccgatacgcaatgattgctaacacttccaacgatgcttgcgacaaactcgtggtgagtggtgcttcaaagtagcgctttaacaccggcgccaccgcggccttagttgctagccggtaagtattcgccgttgataagatcattaaggcactgtctgggtcggcttgatacttcgtggccagttgtgtgagcatcgttgtaatcgccggcttagcaaaccccgtggcgtgctcgatttcggcgaccgtgatgccctcatcgccagccacaaataatagtccttcaatttgttcaatgttcgtcatgctgttcatcctgtcgtaaatataaatgaatcggactcagtggctcagcttgctgcagcgccacttgatcctgcttggttaattctaacacagccataaaggttgtcactaacatttcatcgctggcactaaccgtaaataggtcggcaaaatccagtccttgtggttgatgttgcaattgcgtcgtaatttgtgtcatccgctcatcaatgttgatggtttcagccacaaccgttttcgttagtggccgtacccgccgccgtttagccactaattgccgaaaagccgcttgcagatcatctaatgtaatccccgcagtcagcttgggcgcactcagatcagctggtactaacatcgcttcacgcgtaaaatgttgatggcgcgcctgttctttttctcgcaattcaccagcggcttcctgataaaccttgtaagccaacagttcagctacaagtgagtcacgaggatcatcgtcctcattatcttcgtccatctcatctggttcaggctgtggcaataagaaacggctcttgatcgtcatcaaagtcgcagccataaccaaataatcaccagcaatatctaattttagcgctcgcatagagtgtaagtaatccaaatattgctgcgtaattgccgcaattggaatgtcataaatatccatcttgttttggcgaatgaggtgcaacagcaagtcgagtggcccctcaaactccgaaatcttaatggtgattggttgttgttggttgtttgtcacgattacgctcccacgcgccaatgattggcgccatttctaaagttcccatgacccgttgtttgggatacaacgcggccaactcatccaacatttgatactggttggccgccgtccgttcctcgggtgataatgaatcgtgatgcagtagaataaagtcactgccgacttcaatgccgataataccacagaaatcgccgtcaccttgccgccatagtaatagttgatggtcttccgttgactgataccactgcatctcagtttgtagatgaattaggtccttaaaatctggaataaatgacagtagccccattgctaccttttcataatccttccgatatttaacgagcacggtattgcctcccttgactgcttgattccgcaccgcatctatgcccgcggatgatatttattataaacctcagctaggcgttttttcgaaatatgcgtataaatttgagtcgtcgaaatatcggcatgccctaaaagctcctgaacgacacgcaagtccgcaccattttctaagatgtgagtcgcaaacgagtggcgcaacgtatgcggcgtcacgtttttttcgatgccagccgccttgacttctgccttcagatttttccaaaccccttgccgacttaatttaccaccgtgattattaataaacaaatagctattccggcgtttggcagagacgagtttgggccgagccgtttttaaataacgggtaataaaatcaatggcaacatcaccgataggaataatccgctctttatcacccttaccgattgtttgaatcaatcccaagtctaagtgcagatcatccatcgttaaattaattgtctcgctgactcgcagaccggtcgcatacatcacttctaacagagttcggtctcgtaatcctaacggggtattcaacttaggcaccgctagcaaccgttcgacctcgcgtggtgacaatacttgcggtaaatgctgcgcccgcttaggcgtgtcgatttttagcatcggatcagtatcgatagcgtgcatctgtgctaaatattgaaaaaacttacgtaaactagaaacactgtgaatgattgtatttcgcgatttaccagcctcatctagatactgtaaataattcaataggacgtaccgatcaaccacccgatagtccgtgatttgctgactcatcaagtattcgctaaacgtagtcaggtcctgagaataactcttaatcgtattctcaactaacccccgttcaacacgcaaaaaatgcaggtaatcagcaagctggtcctgcattttttgatcaatcgtcggcttgctcatccgcattttccagtaacttgatctcgcctggttgttgactgatcaagcgttgcttcaagagattacccacagcgcgcttaaattgtgatttgctgataccaaagtaattccgaatatcatcgggatcactcttatcccaaaatggtagcgcgtggtcagcttgatgttgcaatgctgctaataacatttgggcatcatcgccaatttcttcgtatccccgcggcttcaaggacaaattcaattcaccatcgcgcaagaaaccaatgacccgcgccttgacgtgttgccccatgcgtggttcctgttcacgttctgacggatgaacaaagcccagatgattgtcatctgtaataaccgacgtaccggccatcttcaaacgaaaaacggtcgccatggtatccgtattcttaacttgagcccggtcatatggcttggcaattgcttcaaaatccgtcaattctgccagcgtcgcccatagccgttgcttattgtcacgggctaacttaacgtataaacgatcatcttttttaggccatagtcgactgatggtcggtaattcgtctaatgacaccaccaagtccttatttggtaaaccaacatcgacaaagacacccagatcatgccgcgtccggacaaccgttccccacacaaagtgatcaaacgaaatttccgggacgaaccgcgtcatctgcagatgatggtcttcattctcataaacaaaaccttcgtaaagcccgccaatgtgcaatggattctctggttcagttttatcgacccacaacgtctgtccatcaatctgtacgaagtatgcttcatcgttttcatcggttaccttcgccgtaaccactgttccaataatactatccatgtgataactcctctaatatatccgtctataaatatcaacggatggttcttttaaattactgtaagctcaaatgcaagacttgaataatgcaataggttataccagccgcaataattggcccggccgcgattcccttgagcaaaacaacacccataatggtcccgaatactaatgccacggtaatctctggtgtcgctgacaaaagcccgacaccgtgaaatgagagcactgaaaccaacactccacatgcaaccgcaatccagccaactggcgacttaaacgcatgccaaaggtcccgaaatccaatctgaccagtcgcaatcggaattaaaattgcgacggtaatcaccgtcacaccccaattgattcccttctgaccaatcgtcgtcagcaatttactcgtattaggaatcaatttgataagcaacacaaccacggtcgcaatttgtaaggactgattttttcctaaccatgccaccactaaaatcgctaataaaaataaccaactttccatacgacacctcacgtgttatcaattgtaactgaaaatggcccgaattacgaggggtgttggtcgttactcaccaatttcactatccccccctgatcaataaccgattcctgttctttaatttaggcgggaacagggttaaaaggtgccaaatcgtttggattccagctcgtcagcaaggttcgtcctattccgacttacggggctgggtgacaattgccggaacgtagccgacgtcgatttgagctcacgcagcaacccaccgcgtcatctcaaatacgagtcttattctaagccggaagcaacccacttccagctaagaataatttggctactgagcattgcctagccaacgga

SEQ ID NO: 15 - DNA, 53935 bp, Lactobacillus plantarum
gaaatgcctggaagtcggcttaggacgaaccagcaaaacaagtttacaccaactcgtatctatttccagcgggtttaagctggctgcttctgaatttaaaggaacggcacgttttaatcgtggttaatgctaaataataacgagcacaacatgttatcaatcatcagttcttagtggtcggtaaatccgttgcagttaatcgacgccgcttgcggaatttaaagtatccccaagcaacgattacgacaccgacaccggaaattacgtacggaccagttgagccccggccacggtcattttttgattaccaatattcggattggacatcgtaatcgtttggccggtcatcgttgaaatatcgaacttgctcaagtccactcggaattcagcaatcgaatgtgaaccggcttgagaaacatacccgttgccgaccgtcccgtactgatggccctcattgtacttaccacccgtaaatgagacagctttgaccgccccgtcactttgcgagctaggcatctcattggaccacacgtaatacttctgaccaccaatgtcgaaattataatccccgtaaccgggaacctgtccatacttcatcttgacataaacgtagacgtactttccgtcactaaccattgccatataaccgttataaccctcggtcaaagtcacgttcttccaatcattaaagttaccatcgattttaatgttgagattatcattgtcattggctgcattattgtccgtcgtcgaggacgccttggaagagaccgtgcttttatcagtaattaccccagctgagctagttgctgaggaactggctgcactactggtgctagtcgtagaacttgaactagttgtagaattcgcatttgtacttgaactggtactactacttgagctagttgaagtcgccgtaattgttccaacagtgctagtcgtagagtcactaccgatattcggattgaccatcgaaatctgcttaccactcgcactgtcagttaatcctaacttggttaagtcaatctgaaattcggcataattatgcgaaccgtcgttggtcacatatcccgtcccgacagttccatactgagtaccatcgttccatttaccaccagttaatgtgaaggacttgaccgttcccgagctaacactacctgaaatattcttagaccaaatataatacgtcttaccatcaatagtgaaattatagtcgccatatcctggcacagcaccatttttcatcttgacgtaaacattgacatactggccagcactcgtgagtgccgtgtaaccattatagccctccgttaacgtcgcatctttccagtcgttcatcttgccatcaatggtgatgttggcgctagcatgcgctgcggtcgtcatttcaggattgatcattgttgcccccgttacccccaaaacgagcatgcctaagatcatcaacttattaatttttttcacgatgatcacacctcccaagttcaataccattttaacgggtaacgaagaccatcagactctttttaccctataaactaatactatactctggataacaatttatcaatcattatttccatactaaatgaacccaataaccattaatggggcaactatttgagttggtgattaaacgactcctcttcaaaccgctttggacgatacagccttaggcatgccagtaccaaaaaagcacgccctattaaggacgtgcttccaagcaaccaacttacttgttcattttacgctttttagcttctttttcacgggagttcgtgttcaaaatgcgtttccgcaagcgaacatgatctggcgtaatttcacagaattcatcactattcaagaattcaagcgattcttccaatgtcaaatgcgttggcgtcttgattgtcgccgtcaaatccttgttagaagaacgcacgttggtcatgttcttacccttagtaatgttaactgaaatgtcattttcgcggctgttttggcccacgatcataccttcatatacttcggtacctggatcaacaaaaatcgttccccggtcttcgattcccattgtggcgtatgtcgtagtcttaccctggttgattgaaaccaaagcaccgttacgacggcctgggttccagttaggaataactgggaggtattcagagaaagtatggttcatgattccgtaaccacgcgtcaatgaaaggaattcagttgaataaccgatcaagcctcgtgaaggtgctaagaaagtcaaccgggtttggttattaccagtactttccatgttcttcatttcagccttacgctttgataaggtatcaataattgaaccagtatattcgtctggcgtatcgatttgaacagattcaaatggttcgcaacgcttaccatcaatttcgcgatagataacttctggacgagatgcttgtagttcataaccttcacgccgtaacgtttcgattaagattgacaaatgcaattccccacgaccagaaacgacccatgaaccaggttcgtcagtatcatcgactcgaagtgaaacatcggtttcaagttcagccttcaaccgcatttcaagttgacgggcagttacgaacttaccttccttacccgcaaatggtgaggagttcgtaccgaaagtcatttgtaaagttggttcgtcaatccgtaagattggcaaagcttccggattagctgaatcagcgaccgtttcaccaacgttgatatcttccatcccagaaacagcaactaagtcaccggcgtgggcttcattgatttccaaacgttgaagaccaaagaacccaaacaacttagttacgcggaaattcttcttactaccatcgagtttcatgacagaaacactgtcaccaaccttgatcgtaccacggaagacccgaccgataccaacccgaccaacataatcgttgtagtctaataaggccacttggaattgtaaaggttcgtcagagttgtcaattggtgatgggatcgtcttgatgatcgtatcgaagattggttgcatcgtatgttcctgcttagcaggatctgattcataactagaagtcccatttaaagctgaaacatagaccactgggaagtctaattgtgattcgtcagcacctaattcgatgaagaggtctaacacttcgtcaacgacctcttcaggacgtgcaccggggcggtcgattttgttaataacaacgattggtgttaggtgttgttccaaagcttttttcaaaacaaaccgagtttgaggcatcgttccttcaaacgcatcaacaacgagtaataccccgtcaaccatgcgcatgattcgttcaacttcaccaccgaagtcagcatgtcctggtgtatctagaatgttaatttgtttgtcgccgtaacgtacggccgtgtttttcgaaaggatcgtgataccgcgttccttttcaatggcattagtgtccatcgcccgatcgtcaatctggacatgttcgtcaagggtatccgattgtttaagcatttcgttaaccaacgtcgttttaccgtggtcaacgtgggcaataatggcaatgttgcggatatcatctctaaatttcaaaattgatcttcctttcatccttcaaaattctgactatcttcgacagcagaaatcttacatatattaatacaatccgccgttactatcaagtcatagcttcaacttgaaaccttcataacgacgttttcagcggctttcatccattgacataaaaaaactgtgacatatgggtcacagtcccactacttactagacgattgccaaaattgagcgttgtgcgcggtttgtcgctatcagtacagcacccgatgataacatattaaccgggttgccgtcaactctagacacaaccaagccaaggctttccgcgagaacgcgaccagccgcaaaatcccatggtcgcaagtatgacaggtagccgaccagttcgcccgctaagacctggctaatttgaataccagcactacccataatccgtggtcccagtgatttggcaataatcgtctgcatattgaagcggtcttgaattagtaacggcgcactcgcaccaaacagccccgcactcagatcaacatccgcgggtgcagccagcaattcaccgttaagcgtgacgccgacttcaggaccaccagcatataatttattcgccatgacatcaaagatatatcccagtgttggtttaccgtcaacatacaagcccaccatcatcgcaaaatgattacgctgatgcacaaaattcatggtaccgtcgattgggtcaacgatccagacgtgaccattcatatcagtaacttggtcgccggttccttcctcagctaaaatcttcgccactggatccaaggctcgaatctgacgcaccaaaaaatcttcattgctatgatccacgttagtgaccaaatcacgccgactcgtcttctccgcaaccgtcaagcgggtgcccatcttcgccaacacttgcgctctcgcagtttgcatcacgacttgcattttctgatttaactgtttcaccacattcgtttgcacgttaagtcacctagtctcggtattgaaatcgctgcttgttagtttcctgagctgcgcgcattgtttgataaatccgataacctgaagcagcctcataatcacgagccagtcgtttttcttccgacttagccggaacgaccgtcttaaaatcacgataggctgccaacaggtctgctgtagcgattgttccttcattagcggcctcgatggcttgataaaaggtcgtaaccttaatgatctcggccgtggtccacgtctcatccagtggatattggtaattatcattgtgtttaggcatcttcatccaactcccccgccgtgacccggtcaagttcctcttgaacctggctcgcaatctcagcgtattctttctgctcttcatcagatagcaccatatccgccattcgtttgattccgttagcactaatcagtaccggtgatgataatccaaccagctggtcgtcatcgactggtgtttggatatttgtgacggtaccgataaacggtgtctgggcgtaaaacgcattgagcacttgtactaatgctaacacactcaaggtctgattagtaacaatcgtggggtcgtcgatctgctccgtcgctgcactcatttcgtccatcccaaaactaatatcctggttagccaaataagtcatcacgggcgccggcccaatatatgaacgactccatgagatcaggtgtgtcgccgcagttcccactacgaatgcgcggacatccgccgggccgacacttaattgctgacgtagtagttgctccaataaacgactctgcggcaaagtacccaatccgaccactttagaatgatcaatgccactgaaacgcgcagctaagacacttaaaaccgcatcattgctaccagccaaaataatttttccgttaaaaccagcgcccatcgcatcattcacaaacgcgcgaaatagcggcaaagtcgcctttaaatcaccactggcatcacggtcgcttgccaatggcactaaatttccaataatcaagctatctgcttgcgaataatccggcttagcttgcgccactagtgtaaactgacgacaagttaaactcgctgttaccagtgcttggtagcgcggcgcttcttcagcacccgttgcgaccactaatttcactggcaaatctttggcaattgcgactaatattaattgttgtacgaactcgaataatccccgaataattactgtattaatcatttcaatccctccaaccttcgataataattgtacctgagctgtcaatgaattcaagtaaatgttaataaaaagcttactcttttgtaacatttttgcgtaaccaattggtccacttccccccgaagcaaacacattttgatatgttattaatatagaccactacatgctaaaaagttagcaatttgaataacaacatccgcatcaggttcaaaggcgtcacttacggatcagctgagtaatgattaacaagactgaccttcattgcgcctgacagcgcgttaagttacgtttttacgtgactatcttgactggtacttcggtaatccatactgactgcaacatcctatgtaaaataaaagtttgagactcacgcctcaaacttttattaagccatcatccgctttagatgtgcgttgggtaacccatcgcttcatccgccgcttcttgaactacttcacctagggtcgggtgtggatgaatcgtcaaagcaaggtcttcgacattcatcccaccattgaccgcaacgcttaattcagaaatcaaatcactggcacctggtccggcaatttgggcgccgacaatggtgccttcgtccttcgtactgacaagacggaagaagccgtccatggcgttcaacgagattgcacgaccattaccagcaaatgggaacttcgacgtcttcacctgcaagccggcttcttcagcttcagccttcgtcatgccaactgttgccaattctggatcagtaaagcaaactgccggaattgaaacgtagtcgttcgccgtcttcttgccactgattgcaccagcagcaactttggcttcagcaaaagctttgtgtgccagcgcagcaccggcgacaatatctccgattgcgaaaatatcctcagcggccgtccgcccctgttcatcaacttcgatcaagccgcgcttcgttaacttgacgtcagtgtattccaagcccatgtcgtcagtattaggccgccgaccaaccgtgaccataacatagtcagcatgaatctcagtttctttcccgtcgacagcgtaggtaaccgtaacgccactatcatcttgttcggagtttttagccatcgcattagtaatgacatcaacccccttcttcttaaagctgttcaagacaagcttgaccatatctttttcgaagttaggtaagatttgcggtgtcccttcaagaatcgtcacgtgagcaccgaggttggcataggcaccagccaactcagaaccaatgtacccaccaccgataaccactaattctttaggcacttcgggcaaattcaagccacccgtcgagtcaacgacccgaccactgaacttgaagcccggaatttcaactggccgtgaaccagttgcgatgatcaaatgtttgaatttataagtctgaccagtatggtcaccattcatcacccgtaaggtatgattatcatgcatataggcttccccacggaccacttccaccttatgcttcttgagcagcatttcaacgccaccagtcaaccgatcaacaacttgatggtctttccagtcctgggtcactttaaaatccaacaccggatcctgaatatttttaataccaaagatcttactgtccttggcttcttgtagccgatgaccagcactgatcaaagcttttgatggaatacaaccaacgttaaggcagacaccaccgatatattccttttccaccacggtgactttttggccgagttccgcggcccgaatcgcagcgacgtaacccccagggcccgcgccgatgatcattgtatcgcgttcttcagcaaaatctcctacaaccattctgacctcatccttccatcaaaagtaattctggatcatgtaacaattgcttcaataagttcattgcccgttgtgctgttgcaccatcaatcagacggtgatcaaaactcaaggacaacttctgcatcttaccaacaacgatttcaccatcgtcattgacgtaaggttccttaccgatacgcccaacacctaaaatggcaacttccggttggttgataactggggtaaaccagccgccaccaattgagccaatattactaatagtaatagacccaccactcatttcactggcctttaacttgccatcgtaagctttttgcgtattgtcagtaatttctttggcaattgcaaacaagcccttaccttcagcgtgcttaatatttggcactaacaatccacggtcagtatcggtagctaccccaatattgaagtagtgtttgtaaacaatttccttgtttgcatcatcgatcgacgcgttcaattctgggaattgttgtaaaaccgcaaccaaagctttcacgaagtatggtaagaaggtaagatggatgtcgcgatccaaagcaacttgcttgtacttcttccggtgtgccatcaacgcactcacttcaacttcatcaaataaagtaacatgtggcgcggtgtgtttactgttcaccatagccttagagattgccttccgaattggcgtcatcttttcacgcgtctctaattcaggtgtgtcagaaacatatggtttaactggtgttggtgctggtgcttcacttgcagccggagccgttgtcgctggcgtagctgccggtttagcacccgttgccgctggcgcacccgtgtaattgtcaatatcttgctttgtgatctgaccatgggcaccagttggcgtaactaacgtgatgtcaatgtccttatcacgtgcgtactggcgcactgatggcattgccaagacccgtttattaggattgcccgcagccggggttccagtcggttgtgctgatgttgcagcgggagtttcagctgcttcacttgccggggcttccgtcttagtagccgctggtgtttcagccttagccgctggcgcagcgtcgccagaaccatcgtcaatcgtgacgatcacatcaccaattttagccgtttcaccttctggaactaaaatatcaataactttaccacttactggcgatggtaattcttccaccgatttatcattttgaatttcaactagagaatcgtcttctttgacttcatcaccaggttttacgagccatgatgcaatttcgccttcttcaagaccttcaccaagctctggtaatttaaactcgtaagccattggataacttcctttcatgacagtctcaggtgactgtttttcgatgccgcgtcttgattaatagttcaagatttcgcgggtttttgcctcaatttcatcttcagctggtaaccaatcgtcttctgctaatccgaatgggtagaccgtatctggtgcgtacacccggccaactggggcactgagataaagcgcacctttttcagcaatcagtgaagcaacgttcgcagcaatcccagcctgtcgttgtgcttcttgaatcgcaacggcccgaccagtcttttgaacagacttgagaattgtttcttcatctaaaggtgacaaggtccgtaagtcaacaacttcaacggagatttcttctttttcgagcttttccgcaaccttcagtgactggttaacttgtgcactgtaagcaatcaaggaaatatcagtaccttcacgaaccacgtttgctttatctaacggaacggtataagcttcatccggaatatccgccttcattgaccggtataacttcaagttttcaaggaagaaaactggatcgttattccgaatagaagaaattaatagccccttggcatcgtaaggattagatggcgtcacgacccgcaaaccaggaatttgagctaaatagccttctaatgagtccgcgtgcatttctggtgtatgcgttccaccaccatatggtgatcgaatggtaatcggcatatgccgagtgccacctgtccggaaacgttcccgtgacatttgaccagcaattgaatccaaagtttcaaaaatgaatccaaggaattgaatttcagggattggccggaaaccttccaatgccagcccaattgataaaccgccaataccggattctgctaaaggagtgtcaaaaacacgatcttcaccaaattcggcttgcaggccatcagttgcccggaagaccccaccgtttttaccaacatcttcaccaaaaactaaggtcttttcgtctgacccgagttctaatcgaagtgcatcggtgatcgcttgaatatacgttttctttgacatgttacttcgactcctttgcttggaattccgtaatttgttgttgaatgttttgtggttgttcttcaaaaacattccccaagaattcggtcattttttgctttggtgcttcatctgcttgtttaacagcagccttgatatcttctttaacttgttcaacgtattcgttttcttgatcttctgaccaaacaccttgatcagtcaagtacttacggtaacgaatcaatggatcattatcgaaccaaggttgttcttcgtccttagtccggtaacgcttaggatcatccccagcattcgtatgcgggccaaaccggtatgtcagcgtttcaatcatgacaggaccgttgccagcagcagcgtattcccgggcggcctttgttacttcataaacagctaggaagtccatcccatcgacctgaacacttggaataccggcagcaactgctttttgagccaacgtcttcgcagctgtttgcttgcgccgtggtactgaaatggcataaccattgttttgaacaatgaagacggccggtgcttcgaaggctccggcaaagttcataccttcatagaagtcaccttgcgaagtcccaccatcaccagtataagtgtaggcaactttgtcttcggtaccgttctttttaatccctaaagccacaccggcagcttgtacgtattgagcgccgataataatctgtggtggcattgcatggaagtcttctggatattcgttacccaagacatgaccacgagaccacaggaacgctttgtaaacaggtagtccgtgttgaatcaattgtggaatatcacgataagcaggcattaaaacgtcggttttcttcatcgcggcgttactccccatctcactggcttcttggccctcagtcggcgcatagaatcctaagcgtccttgccgtgtcaaagcgttagaacgttgatgtaacgtccgttcccataacattaatttaaagaattcaacgagttgttcgtttgaatatttagagacaatttctggtttaattactttagcttgaccatccaatacttgcacgggctcaaagtctttcccaagtgcatcgcggatcgcaccaaaatcaacaattggtttttcgttgtccataaatgacacatccctttcatgaacgtacaaacgttgtgcatcgcaccgcgttcgtaatcgttttcataattacaagtctaatttaccattgcgtttcatcttttgcaagcccttccaaagagcgaaaagccggctttttctgtccaaatgattgtgaactatttaatttgtgcttaattctgttttcatctttttcataacgggcgctactttttggcgtaggcttatgataaactagatattaagtgtaaactgcgcgatcttaattttggaggtaattggaattgattaaaatgcgcgacattatccgcgaaggtaatcacacgttacgcgcggaagcaaagcaagttaaatttccgttgagtgaagctgatcagaagttggccaatgacatgatggaatacttagaaaacagccaggatcccgaattggctaaaaaatacggactgcgtgccggtgttggtttagctgcaccgcaagtcgacgtttcggaacagatggctgctgtccttgttccgagtgaaaatgaagatgatgaaccggtctttaaagacgtcattatcaatcccgtgatcatcagtcactccgtccaacccggcgccttaactgaaggtgaaggttgtttatccgtcgaccgtgatattgctggctacgttattcgacacgatcggattacgttacgctactataatatggctggtgaagagaaaaagattcgtctcaagaattatccggccattgtttgtcaacatgaaattgatcatcttcatggtattttattctacgaccatatcaatggcgacaatccatttgccgctgatgatgatttagttctaatttcttaaagtcatttaaaaaagcagtcctgaaatgttcaggactgcttttttggtgcactcgaattcaaccgacgcaaatcttccaaatactctaaagtggcctcattcatcaaataggcaatatctaagtggagctgtccgctgcgcagccacgcatcagtcactcgtaacgctggtccagcttcccgaaaagcaaccacctgattgtgaattgcgtacgcttgcaattcgttattgaataatcgccgaacttctggcaaatcggccgtgaccatgcctggtgcatctagcacgtactcaaaggccatcacaccacgcccccagacgtctgcgacgggcaccgaatgaatcgcccccgcaacctcttgaatcgtcatcgcatttgcgagcactttgaatgctgctaccatcgcactatcaaccgttcgttggccagcccgccgaatcttcaacgccgcacgcttcagcacttgccgtcgcagcaattcataaacgacgattgccattagtaccccaccaatgattgttaaccaactctgcatgctcaaccctcaattctttttttgtataatgattcacaattttaggaatttttcattttattacttatgtttagcatagcatgtttcatcaaaaaaaattcttttaaccgctctatttttgaagaaagttaacattgtatacacccatctcaaattatgctaaaatgtaagataattgttgtgtttacacaacctggtgtacggatcaaacttttatttttgctatctatttagattacttagtatctaaataaatcttgtttatattaaggagttttacgcatgatttacaaagtatattaccaagaaaccaaagaacggaacccacaacgggaaacgacccaatctttgtatctcgaagctgagaccgaagtagcggcacggaccttagtggaagataatacagatcacaacatcgaatttatcgaaccgttagaaggtaacttcttggattacgaacaaaaaaatccagagtatcacctaacggagttcaataaatgaaacggttaaacgtcaaaaataacgaaaccgctgtttttgcagtcggcggtttgggagaaattgggaaaaatacctatggtatccaatttcaagatgagattattctgattgatgccggaattaaattccctgaagatgaacttctcggaattgattacgttattccagactattcttatctagttgcaaatcagcaaaaaataaaagctttagtgattacgcacggtcatgaagatcatatcggtgggattccattcctattaaaacagatcaacgtgccaatctatgccggccccctagccttagccttgattaagggtaagttagaggaacacgggttattaaaaacaactgaattacacgagatcaatgaagatacggtgctcaagttccgtaagacgcgtgtctcgttcttcagaacgacccattcaattcctgatacactgggaatcgccgttcaaacaccacctggcacgattgtagaaaccggagactataagttcgatctgacaccaattactaaccagccgccgaaccttcaaaagatggcgcatctcggtgaacgtggtgtcttggcgctaatgtcagacagtactaacgccgaacggccaatctggacgaaatctgaacggtgggtggcgcaatcaattcgccacatttttgaacaagttgaaggtcgaatcatctttgctacctttgcttctaacatctcgcggattcaagaggcagcgcaagtcgcccttgaacatcatcgtaaaatcgcggtatttgggcgtagtatggaagcagctatcgtcaacggacgtgaattaggctatttaaacatccctgacgaagccatcgttgatgctaacgatttacgctccctccccgccaataaagtcatgattctatgtactggttcccagggtgaaccaatggcggcgctctcgcgaattgccaacggtactcatcgccagatttctattgaacctggcgacaccgtgatcttttcaagttcaccgattcctggtaatacgttaagtgttaaccacgtaatcaacgaactcgaagaagccggtgcgaatgtcattcatggtaaagtcaataacattcatacatctggtcatggtggtcaggaagaacagaaactgatgctacggctgatgaaaccaaagttctttatgccgattcacggtgaatatcgaatgttgaagattcacaccgaactggccgaacaatgtggtgtgccactagaccatagttttatccttgaaaatggtgatgtgcttgcctttacgaaggattctgcccgggttgccggtcactttggtgctggcgatgtctatgttgatggttctggaatcggcgatattggtaacgttgtgttacgcgaccgccaagtgctttcggaagaaggtttggttgttgtcgttgctaccatcaatttgaacaaaaaagagatccaagctggtccagatattctgtcacgtggttttgtctacatgcgcgagtctggcgatctaattaacgaagcccggcggcatgtcttccgtacgatccggcgcaaaatgaagtcggataaagcaaccgaagcgactatccgcaatgcgattattgacgacctgcagagtttcttatttgataagactgaacggcacccaatgattctgccaatgttgattatgaactaactacttgccggaacgatctcgttccggttttttatggtgtaagactgatatgaggtgtaattttgattgctgaatactacattattattaatgaactggcaggatctggtcacggtaaggtcgtttgggaaaccgtcaagccgattctagaacaacgacagattcgatttgaatatcgaatttctgaatatgccggccacacaattcggctcgcaaatgagtacgttaaaaccattcaacgacgaccaaacgtgaccccggtcattctggtcattggtggtgatggcacactgaacgaggccttgaatggtattatgcaggtcccacaagctgaaccgatcccgctcgcctacattcctggaggttcgggcaacgactttgctcgcggtctgggtatggcgactgatccagcaattgcacttgcacaagtactcaacaatatgcggccccgttcgttaaatgttggttatttccatgaaaccttgaaaaacgaacaccggtatttcgtcaacaacgttggtttaggatttgacgctcaaatcgttgatgacacaaaccgtagcaaaaagaagggccgtctgggtcgttgggcttatctcagtaacatgctggccgcatattcccaacaggaaggcttcccgctaaccgtacacgttaaccggaagcgagactattataagcgggctttcctttgtacagtctcgaacattccatactttggtggcggagttgaaattctgcctcaggctaatctgcacgatgatcagctcgaattaatcgttgtcgaagagcctcactggtggattatcctctggttgttcgtcttactgctactgggtggccgtcatctcaagtcgcgtttcgttcaccattatcgcaacgctaacttgcacttgttggttaactctgttgaaattggtcagatggatggtcaaattattgggaatcgtaactacgacctctacttgtccacccatccctacccattctggatcgacactagtatccatgaccaccactaactctactgctaaaacaatacaaattaacgataaaaagtcgttgcgaagatgctcgcaacgacttttttataggacccagattggcaattcatactacttgagcaccgtccacttaccggccagcaatgctaatgaccacttaattgactccccacccactcggctaataaaaaagactgctgaccatctcaatatggtcacacagtcagtcttgattaatcttagtcctcagaagcgttgattgcttccagaagcatgtcaagttgttcacatttacgagataagtgactcacccgttctttcaaatgcggataaatggtcacaacccgtgagcgatcctgttgccgaacggctagcgtccttaaatgatcgagttcggtattagcctcttgatattcttctagaatctcaaaacgattactcactgatagcacttccttatcacaatagatggtccaatttttcgaattgaaaaacgacaaacataatataccacaattattggtaagtttaaatcataaaattcaaaaaaatttaaataaaaatccccctaacacttaacaatatcgtgttagggggattagcaattaaaatcggcttacttaaccgtacctgcaaaacttggcatgaagtatgaactgattgtctgaacttgaacgttttggccttcagttggagccgcaacgtattgattatttccaatatagatggcatcgtgataagtgctaccacgactaccccagaataaaatatctccaggttgagcatccgcaacggaatgcgtcgtcacataagattcctgtgcaaccgtactatgtggcaaggtaatcccagctgcatgttggtaaacataggaaactaaaccagaacaatccattcccgaaagactcgcaccaccccaaacataagggatgttggcactagccaacttcagcgcaaggccggttacagaaccagtagctaaatcactcgttgaactagtagtggtactgctactattagtcgttgcggtactacttgcggtattgcttgcactgctagtggctgctgaagaactactctgactggtcgtgcttgaactagtcgctgccgagctactctggctcgctgtactcgtagttgatgctgcactagcagctgtacttgatgcttgactagctgtgctagtagcagtcttactgctagtactagttgcactcgcagttgaagcggtactttgactagtcgttgttgaactagcagctgatgaggacacgctactcgttactgaggcgctcgctgcaacactcttcgactgactggtagcagtcgaagaactagcactacttgctgatacggctgcactcgttgcgactgctttgaccggtgcatttgaggtcgtagccgttgatgaagcaatagagccggtcgatgatgatatcgttgacgtgctagtactgcttgctgagttcgcactgacagcatcctgacttgctgcactggtgctacttacaacgcttgcactcacacttgaaaccgaactcgcacttgtacttgaggtggaactcgcactaacagccgtcgtggccttggcagtcgtactcgtagttgacgctgcactagtagctgacacggttgttttttgactcgtcttagcggtcgtcttggtcgttgctcctggcacttgaatgttctgacccaccacaattaaatcgccagaaagaccatttaacgtctggagagcgtgaacagaagtgttgtacttatcagcaagcgcccaaagagtgtcacccgctttaacggtatatgtacccttagtagcggctttcttagttgctgacttagtcgtggcggtcttagttgcggatccaccaatttgtaagttttgaccaacataaattaaatcgatattaccatcagatgctttaatctggttaagtttttcaatactctgcacggaaacaccgtgttgttgagcgaggccccaaactgtatcgtttgcttttacagtgattgaggcagcattggcagcttggcctgtagcaagcaataaaccaacggcaccaaccgtactggctaggaccttgcccgttgtatgtgcttgtgacatttaattcactccttagtttttgaactcaaattaacagtaacaaaatcgtcttgtgactgaagattaagaaattcttaacctgcttttacaaatcataattttattgtagcacaatttaccaaaatacaaactagaatcgctcgtttttttacaaaacagtccggttattttaaaaaacgtttgccaatgccaaagcggcgtatttggctgttatagcaacgtttatgcatataaacggaatgttatcttttgattacttcaagtaattagttgcactgtttggacgagttacgctattcagtaaacgaacaaaaaagcacattaacctttttgtaggttaatgtgcttaaagttgcgagctagatgcgaggatcaaacaaccgatcaactggttgctgttcatgtactaatttgattgcatcacccaataatggaccaaccgaaagttgcaccaacttatcaaattgtttatccgctgggatctgaatcgtatccgtcacgatgactttctcgaacttggaagcctgtaatttagccactgcatcctgtgaaaagattgcgtgagtcgcacagccgtatacggtcgctgctcccgcttgtgctaaagcatctgccgagacatcgaaccgagttcccgtatcaatcatatcatcgatcacaatggcgacgcgccctttcacatcaccaataatactacttggcactaggtcatcatcatctgggtgtcgattatcaataatcgcaattggggcccccaatagttctgccatcttacgtgcccgcgaaacaccggcatgatctggtgacacgacgacgagattatcggtaatgccgcgatctttaaaataacttgccaagagtggggccgcaaataaatgatcaaccggaatatcaaagaatccttgaatctgtgcggcgtgcagatcgaccgtcaagactcgactggcccggtccttttccaataacgttgcaattaattttgcagtaatgggctcacgtgaacgcgctttgcgatcttgacgtgagtacccgtaataaggaataaccacgttaatttgactggcactagcacgtcttaaggcatcgatcatgatcaataattctaatattgtatcattgaccggttccgaaatagattgaatgacgaaaacttccgccccacgaatactttcttcgatgttgatctgaatttcaccatcactaaaccgctttacggaacttttgccgagtggaattccgacccgctgcgcaattttttcggctaacggtaggttcgaattcagggcaaacagtttcagtttggcataagattgatctgttgacataacgacctccataaaagttgtttgatgattttgctactttgattatagcagtaaccacggctaaaaaccgcacacaagcaaattttcttgcataatgagcgtcgccgacaatgtgtcgttcattgtaatttcagttgcaataaccaattaattatcaattagctacttgcagcatgaaattagctggcgtgataccattcatgccaatcatcggatcgattcggccagcgctgactagcgctggggtcaaaattgttggtccagcagactgggaactcggttcctgagttttttcagtggccgactcctcgtcagaagcaactttcttaaccgccgtcgctttttcgccggctggcattgcctctgcttggtcagtagtcgcaatagtggccgtttcatcggatacggtatccccgccaaagacttgttgtaaccgtttcgtcagtgtggtttggcgattaaccgattcattggtaacgctccgctcaaatgattgactatcacctaacaggatcagcatttgttcagcacgtgtcacggcagtatacagtagattgcgttgtagcatccgtgcaaattgtggtaccagtggcagaatcaccattttaaactggctcccttgagacttgtggatcgacatactgtacgctaatgtcaatcgattccattcattgcgttgataagtcacttcattttgatcaaaggcaatcgtgatctggtctttcttcgattcattgtgagaatcatttgccagatcgataccgacgattttaccaatgtcgccattaaaaacattatcctcgggtgaattaacgaggtgcaggaccttatcaccgacccgaaaatcttgaccgttatacgttagatgcttctgatgggcactcttcaacggattaaagattttctgaaccgtggtattcagctgatcgatcccggcagtgccgcgatacatcggggccagaatttggacctcctcagcactgaagcccttcgccttggcacgtgccacaacttgttcaacaatgtgattgacttgataagcgttgcaggcaataaatgagcgatccggttggttgacggcaaaatcggccggtaaatgaccatctttgatggcgtgggccaacggaataatactggaatcattgccctgccggtagattgtcgttaactcaatttggggcagttcactaaactgcaataaatcatgaaacacttgcccggctcctaccgatggcagttgatccttatcgccaacaagaatgacttgcatgtgacttggaatcgccgtcagtaactgctgaaacagtaccgtgtcaaccatcgacatttcgtcaataatcaggaggcccccatctaattccttactaggctcctcgggaccatcttcacgccccgtcaacccaagcaaccgatgaatagtactagctgggagcccagtcgtttcagccatccgcttggctgcccgtccagtcggtgccgccagcaggattggaaaaggcttatccttatactgattgatatctagtgcaacgtcgtgtaattccgcatagagcgcgactaagccacggataatggtcgttttaccagtccccggtcccccagttagtagaaaaacaggcgccgtaatcgccgcttttagtgcttcggtttgtgattcatcataagtaatgttgctagctcgaccgacatgctcgatagcatgatccacggcacgttcagacaatttttcatcattatcggcggctaacaaccgttgtaaatgttccgcaacgcgccactcggcttcatagaggccgcgcaagtagatacgattctcgtcacccacgattttattttccttcgccaagacgaccaactgatcagccagcttcgaaggatcaatttgaacattgcgagcattctcaagtagttgcaacgtttgattcagcaacggttgagccgtggtatacgtatcaccgttttccacgcacagctcattaatctcagtcaatagggccgcctttaaccggtcatccgcttggggatcaattttaagttgggccgcaatttgatccgcttttttgaacccgacgcctttgatatcctcaaccaaacagtacgggttctcttgaatcttagccaaagtgtcaccttgatagcgtgcatagatggccgcagctaaccgactcccaaaaccgtacgcattaagtccaatgatagtttgctccaaaccgttattgaccgtgagcgtgtcgatcaaagtcgtctgaacgctggcccgaagtccgattggttttaaaaccttcggatcagctaaaatttgatcaatggcatcttcgcccaaagtatcgacgattcgctcagcagtccgcttacccaacccaggaaaatcactaccagatagataggcaatcaagcctgcgcgtgtcgtgggcgtttcattttgataattatccgcttgaaactgaaccccgtatttgggatgcgtgaccgttttaccggtaaaacgatacgttgtctcctcctgaatatccgcaaaatttccagtaacaacgatctcatcttccgaccaatcaatgttctgttcagttactttgactaataagactttataaaaactatcggcactgctaaaaaaaacggcagcgactttaccgacgataaagtgtgtgaccggttcccgaccaatatcgtcggaaaataaatgtgcttgttcgtccgtcacggaaatcctcctaaattagtgattttgattatctgcttgtgcggctaacattttttcaatatccgttagctgttgctgatgacttttaaaatattgactgtccaatttctgcgcgcgttcaaaccaggtggcatacggtttccccagtaccattgcggtcagtccaaggttaaaagcagctcgcccagattgcgaatcaatcttatatgcgcgttgatagtaatccgatgcttgctgattattgcctaatgcaagtaatatgtctgctactaacaaattagcgtcaagttgttgtggacgtgcctcttgagccgtaatggcccagactagggcatgttggtaatcgtgttgggccattaaagcttgtgcactcattaaataagcatcctgttttagttgatcatccgtaatttgttgataatatggtaacgctttgtcataagtttgagcttgataatagacatttcccaacgcataacgcaggtagtcggctgcgggttgttggtggtcaaactttcccaacgccttcattgctaacgcctctgcctgttcaaaatcttgaccagccgttaataataccactagttcataataagcatggtagtcctcgggctgtgcatcaatcttgccaatgagttgatggactagtgcttgctgtttagctttgctaggacgtgatgtttttgccatccgaaccacttccttctatattaaatcgtatcagttgcatcgggccgccgtgataggtatgaggtgtcattccaatctaatagcttaaaatgttgaccacggtcacgcgtctctaaaattgttgttgacgtattcgacaagccaccccgttgccgtaacgtcgccagtgtcgctcccagtaatgagttgaccaaggcattcaaggccgcaccatgactaacgatcaaaacattgtcatcgcgacgtggatttgcttgaacaatttgcttaatagcgggagtcatccgcttcagcagttgttgaaagctctccccctgaatcgctgtcgggtcatactgatccggatgatttcgaaacgcgtcgaattcggccggatacgtagcttcaacatccgtgaaggccattccttccatcttaccgagattgaactcccgtaaacgactcagtaccgttatgggtaactctgattgtgtcaaatcattacgtagtgtcatcgctgtatcacgcgcccgttttaacggactgacatagatatgactaaaccgaatatcctggagcgccgctgccaattcatgaatttcttgataactagtcggtaataatggtgaatctccctgagagccttgatagcgcccctcaagattccactctgttttcccatggcgaacaaataatagttttgtcaattgcttacttccttactctagtgtcttgatttgatcttattttcgagcaatggcccctccaaactgaataacggttgcgatgattcagcagtatcattgcaactcatcgtcaatcgccgttaggccaaccctgttaatacttcaaatgacgtggcggatggtcgtgatacttcgtcacgctcgcaacacgtcttacgttctatattatgacagttttcagactgattttcaaaatctgttcacgaattttaacgatcatcacgctattatttgataaacacgatcagttgaccgggcatggtatcttttagccactaagtatgcaactgctacgccatactgccaatggctgttattcaccgtactactcagccgtaagagtaaatcgtcgtttttccaatctacttaataaaaatataattatgtaaactaaatcagccgaaccaagttcaactccagcattaccctgctttaacaaaaaagtggtaagtagctttgaaacactacttaccaccactaattattatgcagcgggcacaatcgccaaggtccaagtaataatgctttgatactcaccaggcgttgccaatggtgttgctggtaactgtaatgaactaggtgccacatcaaaagtttgactctgatgaccagtttgccggtaaacgctggttgtcgaaccatccgttggtatcgtttgattgagcactcccgtcgagtctttgagcattaaccgagccgtcttgattgttgtatttccagcagtaaagggactcagactcgccattaactgccagtcagccccaacagtccggtcatcaaccacggccaaccgatagtcattattaccgtcataaccgtcattagcttttacggccgtcgggtctgtcgccaagtcagtaccttgtgcgagtcgctgcaggtttaacgttccaaaattaaaattaggaacggcactcaatgataaccgcccaccactcttaactgttagcaaagcggcgttggtcgtcaccgtctgtggcttgccattgaccggatagcttagactcgcatagtaggccgttccatcatcatccgcattggtcggtaccttgaccgtataactcgtatccgtgacattgagggctgtagccttaccattcttgacacgataccaattgctaacagtcaccccctcgggcaatgctggtaatgtaaatgttgccggcgtcccttctacgaccgtcacatcttgtaacgctccaaccaaaattttgacgctatcactcagaccattagaggttccggtaatcgtgacagttccgtgatcatccgcttttccggaattatccgtggcggcatccgctgcggtcacattcccatattcatcaactgccgcaagtgacgggtcactactcttccaagtaattgaatccgttgcttcctctggcgtcagtgctgcatgtaccatggtcgtttgtgcattattgagccacgcgtcatcactcgtcactttgatgccagtcgttaccacccgggctggcgtgaccgtcactttcgcgattttggaccaataatcaggaaacgccccaacaccagagaaatcatactggacttgaaaataaagatgcgttgttttggtcacttgcggcgcattgaaagtataggttcgactattagtgccaatcttctgataggtttgcccctcatccgtcgattcccaccaaacgtacttgcgaccactcaacagacttgtcgccgcctcaagcgcactgcgctgggcccgaaccgacagcgttactgagttgccaccaatcacatttgaatcgattggctgttgtgaaaaaccgcccgatagattcaagcctaagacggaactcggtggactgcttggcgattggggcgccgttttggctgctaaggcactcgtgacgatacctaaaccaaccagcatacttatcaccattaggccacaagccttgatcaactttctcatcgttcctcactccttacgcgaacgccgctggccaaaccagtacgccgccattagaagtgctaagagaatgactagtgccactgcaccccacagccaccagttgacctgacgcggtccaaccagatgatgattatgttgttgcgtccgttctgcagtcaaggtaaagtcacgggtgaaatcccagacacgctggccgctcgttagatgcaattttagttggtacttccctgcggctaagttttgcgtgcccaacgcgacttgatagttaaaccagctattcggtgccattgatcctgatttaagttgctgcgtggcaacggtttttcccgtcgtgcgttgaataacgcgtgcttgaattttgagttgtccaaaaagtgtcggcgtcagattacggagtttggcaaagagtactggttgcccattggtgggcgtcactttgacttcatcgaggactaacttaactggaatcgtcacttgcggctgacaccaaagcgccaccgctgtaacctctgcatagcgattcttcaacataaaaccttgactcgtcgttggccgggccgcattggcggttggattggtgacaaagaggccacctaacacctccccttggaacccagacttgggaatcgtggtcttaaaagccaccgttttcgcttgatgagccgctaacttaactacgacgccacttgacgtcatgtcagtaaacgtcgtcgtggcagatgggtcatgccgcttagacggcacgtacgcgacgctgcctgcatctgaggtcgttgcgttgaccggtgttacctgcaacgtaattgctgatttaccaggattgctgacggagactctgaacgttgacgtcgttcccggcgtgaccttcatattaaagtaacccgcctgcttatctagttgatccttgggcagtaggggtgtcagaataaaacccgatgcgggtgtgttagatgccgcttgaccaggtaatgaccctaaaagcccgcctagtagcaatgccaacactaataaccaccactgaccgatttgtttccatcgcattctaaacacccccacttcacttaatcattgaataacgacgcgcgatgatcagctgaacctatgaagctgcttttggtgttgctgcagcagctgctggtgcattttgaagcgtccagtaaagcgttgctgtgtaagttccagcagaaatattggactgcttaccgacttgcaatgaactgctcgtggcagtcgtcgctgtatttgaaccttcaccactatctgcagcagcattccataacgtttgtgggctcgcgacccatccgtttgtcacttcgctctgattcaaactcaatgcggtcggcgcggcagtattagcattgtcagcgttacccttggtcatattcaaattcaatgtggccgagtcaactttagccgctcccgaactaaacggtcccatcccaactgtcaacgtccagccagcatgatttccccgaaagtcgctaacgtttaaattgccactaccattgccatcatagccactgcctcccgacgtattgctacttgttgcatttaacgttgtggcagcagatgcaatattcttaacgttggtcgaacttaacgcgatatttggcacagcatccaacgttaattcaccgggcataaccgtaaattgtgcattcgataacgcttccgcattacccgtgctatccgcaacataaccagacgaaactgtcgtcaaattgttgcttgctgttccgggtccggccgctaacgccgctaggggcattagcgcaagtgatagtaaagttgcgccaccactcaacccggtcattaatttaaaagttcgcatgttgcttcctccttctcaatcgactgcttttccagtcgcctgctaccatattagtttactaatcactttatgattccgctttcaccgtcctcttcccctgacgccaaccatagtttatcatgtataccaatcgaaactgtgggttatgttttgattcattaactttccatattaattaaacgcctggtgataaccggccacaacgtggatacccagtcacccttgtaaccaaaaaaacatcaaggcccgttgtccttgatgtttttacatcattaattcatttatttttttaacgcttcatctaacgcaataacgcccttaactggaccaaccacagtaatcacatcatggagggccatcatatccgtcggcttgggcgagacatcaatgtgtttctcgtgtttgattgcaattaccgtcagaccaaaacgttgccggatctttaaatcgatcagattctgattaacaaagttcggatccgtaatctcgattgcggccaacgtatactcatcacttaagtcaataaagtttaaaatatggttggaaaggatgcggtgggcaatgccctgacccatatcacgttccggaaatacgacttggtcagcgccgacccgttcaaggacccgcccctggtcgctagtttcggccttggcgatgacctttttcgccccctgctccttgctcaacatcgtcgtcagaatactggcttccatattattgccaatcccaataatcacataatcaaacgtatcgacgttcaaatcacgcaacacctgctcgtcacgggtatcagcaatcattgtctgtgtcgccacgtccattagctcgttaactggttcttcgttaatatcaacggccaaaacatcctgatgagctgcggcaagagcccgaacaacactctcaccaaaccgtcctagaccaaatacagcaaaactttttcgcatgttgcccacctaaccaatcaaaatattttctgccggataacggatcaagttcaccctagcttgacgtctggaaagcgcgtagagtgacgtgaagatccccacccggccaataaacattagcatcatgattacaatcttcccaatcaaagtcagattgggcgtcaatcccaaactgagtccgacggttccaaatgctgataacacttcaaacaaaacgtattccaacccgaagcccttcggaattttttcagtctgcgttaagatcagtgttgccactgtcagcacaatactagccaagaaaatcagcattagcgcccgattgatattctcctgactaaaacgacgatgactaaactcaacatcacggcgaccacgtagctgggcaatactttggaacatcaaaacgccaaacgttgtcgtcttgatcccacccgcagtcgatccaggcgtcccaccaacgaacatcagaatcataatgaccaataaactccccgcttgcaatccttgagtaggcattgtgattaaacccgctgtccggggggtaacacttaaaaacagcgtattgatcgttcggttgacccacgacattccggttggcaacagttccaagtcacgttcagtgatcaacaacaagacaaaaccgatgacaaataaactgaaagttgtgagtaaggtcagtttggaatttaaagtcagtcgcttacgcgtatggtacagcagcacgtcacgccaaactaaaaatccaaggccacccgcaataattaggatcatcgtgaccgtcaagacgtatggatcattacgaaagccttgcagactatcgccaaacacatcaaaaccggcattacaaaatgacataaccgcatggtatagtgacacatacaatccgtgacgccaaccaaatcgaggtacaaaatcaattgcgagcaacccaagaccgcctagctgaaagagcagtgacaaacccacgacatacttcataacgcttttagtatcactcaatcgttccaaattcagggaggccttgaccatcaactgcgtagagagaccgatctgacgacgcataatattaaagaggagtaccgcaaaggtcatgtagcccagcgcaccgacctccgaaagtaccagaatcaccaattgaccaaacgttgtccagtgcgcagcagtattgacgacggtcagcccagtaatacatgtcgctgatgccgacgtaaacaacacatcgatcaacgacgtgtgcacgtttgctggcgtcgcccatgggaggctcagtaagactgtcccaatcagaattaagataataaaaccggctaccattttcttagatagcgtatcaaaaaatttaaaatgtgctaattgtctcataatcattccatcccacaacagcttatcgattataaccaatcagtccgattgatcatactccatttagcttaatcaacctagtcaagaaaagcaagtccgacctaagctttgacgtacgccggccacggccgacccaatacatacaaaaaaaccgctaatcaagctcagcttgatcagcggtaaaccaattacgaactaaacatactgtaagacgcgctcatcattataagcagcgtcaatcataccggaacctaagcattcctcaccgttgtagaagacaacggcctgtccaggagtaatcgcccgaactggatcatcaaaagtcacggtaacttccgtgtggtcatcattaaaatgcaccgtcacaccagaatctttttgccggtaacggaactttgccgtcacgtggaagtcattacctaagtcttcatcagtcacaaagtgtaaatcggacgcctttaagtgggtcgcgtacaggtgcggattatggtagcccttgccaacatacagaatattcttcttcaaatctttgccgaccacgaaccatggctcgttatcctcgccatcaccaccgataccaagtccgcggcgctggccgatcgtgtaatacatcagcccggcgtgctcacccttcacctgaccatcgaaagtcatcatcttaccgggcgttgctggtaagtaatggcctaggaattccttgaagttcttttcgccaatgaagcagatcccaacggagtccttcttcttagctgttgccaagcccgcgtttaaagcaagcttacgaacgtcaggcttcaccatttcgccaagtgggaacatcaccttttgtaaggtcttcgaatccagctgacttaagaaataagtttggtccttgttgctgtcaacaccacgcaaaaggtgcatcgtgccatcttcatcatgttgtaaccgcgcgtaatgaccagtggcaatgtaatccgcccctaaatccatcgcgtaatctaaaaacgccttaaacttaatttctttgttgcagataacatcggggttcggtgtgcggcccttcttgtattcgtctaagaagtacgtgaagacccggtcccaatattccttctcgaagttaatcgagtaataaggaatcccaattttatctgccactttggcaacatctttataatcttcggtcgcggtacagacaccattttcgtccgtatcgtcccaattcttcataaacacgcccaccacgtcataaccttgctgcttcaagagcaacgccactacggatgaatcaacaccaccactcatgccgacaacgacacgcgtgttactgtgatcagtcatacttttcaccatcatttccaaaagattctggagaatccacgatttgaaggtcgtacaagtccagtaagttacattataacaaagaaaacgccggctgcaagccaggcgttccctgattagtccgtcgtgaggacatcccgttcaataaagttagctaaaatataccgtaattgttcaacagcttccggatgggcgtcatttttgaaaatatttgcccgttggacaccattgcccgttaccgtcgtcatcttaaacccagtcaaatccgcattgactgtcatcttcagcttgaaagccgcttgatagggtgaagtgggatccaaggaacgttcaaaactaaacgcgcccgagcgacctttcacaaaacccaaatccatcaacgtgtatttcttgaccgttggactcagcgtatacgtcttagtatccccatctagtttaaccgttgttgtgtatgccatcgtcacgccccctgctttttaataagcgctgcgtcgtcttcgtcagcaccgttacaaactgatccagatcggccttagtagtatagcgaccaaagctcaaccgaatcgactcgctgatccggggagagtcttcaccatacattgcaattaaaacgtgtgatagttctaggctccccgccgtacatgcggagcccccagaaactgcgacaccacctaagtccaggttagtttgcattgtataggtcgatacccctttgatccataagttcaaaacgtgttgcaagttatgctcaccgagggacccgttgacttcaaaatcaactccgttagccgttaactggtcaacgatgtattgcttgaactcacgatacttagcctgccggtgggctttctcagcggtcgtcagttcttgcacggccgtggcaaagcccgcgattgccgggatattttcagtaccggcacggcgcttatcttcctgttcgccacccttgacaaagctaggaaagttaatgccattgcgtctgtacaagaagcccaagaatttaggcccattgattttatgtgctgaggtggacaacatgtcaatatgatcccgttgcacatcaatatccaacaacccgtaggcctgcactgcatccgtatggaaccatgcctggtgatcctttaacaattcaccaatttcatggattggcatctgtgaaccaacttcattattcccggtcatgattgagacgagaatcgtatcaggacgtagtgccgccttcaaatcatccagactaatttgtccctgttcattcacgggtaaataagtaatctcaaacccatgttctgccaaaaaagcagtcgatttaagaatcgcttgatgttcgattgccgtcgtaataatatgcttgcctaaatgttggcgcgtccacgcggtctgcatcaccgccgtattatcactttctgtaccaccactggtaaagataatgtcatcgtcagctgcgttaatgctttgggcaatcacgtgccgactatcgtctaaaacttcacgggcggcccgaccgaatgcgtgggtgcttgaggcattaccaaacgtattcgtcatttgatccgtcatcgtctgaataacggacgctgccattggggtcgttgccgcattgtctaggtacacttgcttcattacatcatacttccttctaaataattcttagttattagcatcgctgcgatacatctgactaattttgcgccgcaaataatgcaagtaacatcgctgcggactgcttacccgcttccaggataaattcgtcaaaactaacaccggcattttcatcaccgacatcggacatcgcgcgaatcaccacatatggcgtctggaactggtgacaagcttgaccaattgcggcgccctccatttcactagatagtgcttctggaaagtgtgctaaaatcttatcggtagccgccttacctgcgataaattggtcaccggaaacaatcagtccagtcttggcattcaaaccggttgccttggccgctgccatgatttgctttacccaattggcatccgtttcgtagtatagtggctgttgtggtaattgaccatattcgtagtcaaaggccgtcgcatcaacatcgtgataagcagttgccttagctacgacaacgtcaccgacatgcaaaccagcgccaatcccacctgcagaaccagagttgatgacaacgtccacatcaaagttagtaatcattaaagccgtagtcataccagcttgcactttaccaatgcctgattgcactaagacaacttcctgctgatcaattgtcccatcatagaacgtaatatccttaatattaacgatcttttcgtcttgcaaagcgtcccgtaacgttttaagttcttcttccatcgcacaaataattccaaatttcatgtgagcctagcgcctactttctatggtgttaaaaataaaattaaaaagacaataataatcccaacgactagtccagcaatcgcccaattcaatttgcgggctagccgtttcgtcttggcttcttcaacagcccggttgttctcagcagcatacgcttgtcgggatgcactgggttcagccgttggtgattcttgctcctgagtatcgtgaccagttggctggctacgttgttgtcgatattgctgtctggtgagtcgatcatcatctgccactatgcttcaactcctaactcagggtgactttgccagtaccaaatcgccattacggttttggcatcctgaatctgaccagtctgaacttgactgacagccgtcgcgaggtccagcttgatgagcctaatttgttcgtcagggtcttgtgggaatgccgttgcaaccgcactcagaccggtagcaacgtacaacttcattagttcgtccgtaaacccgggtgacgtgtagaattgggcgactgcttctaagtgctgagctgtcaatcgggtttcctcatttaattcgcggacggccgcctggtccatggtctcaccggattcgaccttaccagctggaatctcgacggtcagcccaccggttgcagcgcgccactgttgttcaacaatcattttatgttgcgcggtaatcatcagcatcgcgacggccggctggtgtcgcacaatttcacgtgttgccgtcgtttgatctggtaaagtgacttcttgtcgttcgacctgtaccaacccgccttgataaaccaactgacgactctgaacccgttcctcaaatgtcattgatcaagaacccctttcagtgtctgctctctcaataaggataccgattttttagctcgattgcaattttcaactgggcgatttcggtaattttaacgaacccgcaaaaaatgggctaacgagcgaccaatttggctccttaacccatttttccaattcttaaaatcaagcggaccaattgacactaatcgccattaggcctttgcaaggttagcgacgaaatcttcataagcaacctgctcaccagtttccgttgcggtagctgggctgtagtcgccctgaagcgcatcttctaatggcaaagtcacgatccggacgaacgtcgcgttaccgatcaattccatccagtattcttcatcggcaccttggtgaacaacggttttgaccatcccaccaggattggtgacgtggatttcttgattaaaatcggtactttcttggtgtaataacacgtacatcaatgaggaagccgacatcgcagtcccacaagcattggtaaaaccaaccccgcgttcaaacgtgcgtacaaaaattgaatttggtcctaagacttccacaaaactaacgttgacgccatcagggaaaatttggtttttaccatcattcatccattcaccgatacgtcctaattcggggccaaccaacgtatcatggtcaacgaacgcaatcaaatgcggattaggcaccgccacagctgagaatttcaagtcagcagacagcgctggaatcttttcattaataattgtcgtcgcatcgttattcgcatgcatgccaagtgtctgcgcgtcgaaagttacgggtgaaatttcaacactgtaagctgggacgtgggccgcaaaatcagcaacggcctgcacctttaagtccgcatacatcgtctgaacccggaagtcttcctgactattttgcgtgcccaaataacgagcaacggtccgtagcccattaccgcacatgctagcttccgtcccgtccgcattaatgacccgcatccgaccaagtacttgtggatgttctgatttatcaacaaccaacacgccatcagcgccatcgtacaaacctgcgccgtcacgtttacaaatgttaattgccaattgcttcaaatccgcatccgataacggtgcttgaaattgtgtttgatccaataaataaaaatcgttaccagaaccgtgtaccttgatcattttcacagccatcaacatcctatctatataaaatcgaccttaatttaaactacttcattatcatactgactttttcatgaaaattcaattgcaaaggaccatttctcataataaccattcaaagtcctgcgcagcaactgtaaattcttaatagctcttaaatcttgcatctgaaaaacgcaatcagttttttacagctgtatctcaatcatcccggtgttcggatttactgactacttgataatccccacacgccagcacaaaaaagtgccactaatcagtcccgttcgactgattagtggcacttttcataagttatcaagactcacgctaaatctaattcagattaagcttccaaaccagttgttactgattcagggtagttttcacgaacgattgcggcgcaccgtgcacataacatcggataagcctcgtcactgccaacatcggtcttaaccattcggcaacgatcacaaacgtcaccgtcagcatggccaaccttgatggctaacgtgtcaccaaatgtttctgcgtctgcaggcgcgtcacttaacgcgtgtagatctaatgctgaaaccatcaacatctgccgaacattggtgctcaaatgatctaagaaggcttgcgtatcatcatcaacatacaaatccaagtgtgcttccaaggatttaccaatcaacttagcatcccgggcttcttccaacgcctttaagacgttactccgaagatccatgaaccgcgtccattgagccatcaactcgtcgctgttcgcataattttgaacagctggcatctcagctaattgcgcaaattcttctggttccttcaagaatggccaaatttcttcagtcgtgtgtggcagcattggtgtgaagagcttcgtcaaggcaaccaaaacatcgtagaagaccgtttgcatcgaccgccgtgaatggctatcctcggcatcaatgtacataatatccttggcaatatcgagatagaagtttgataaatcaaccgtcaagaagttgatcaacttcttgtagatatccaagaaatcataatgatcgtaatgatccttcgtctcagctacgaattcgttcaaccgtgtttccatgtactggtccacacttgctaaatcttcataagccacgcggttggtcttcggatcaaagtctgcggtgttgcctaacatgaagcgtaccgtattccggaacttcttgtaggaatcggctacttgcttaaagctttccattgagacccgaacgtcggaactggtatccactgaagcgacccacatccgaacgatttcagcacccatctgcttaataacatcagctggcgcaatcgtgttgcccagtgacttactcatcttacgaccttgattatccaacgtgaaaccttgtgacaagacttgcttgtatggggcatgtccagaaacagccacactcgtaatcaagcttgagttgaaccaaccacgatattggtcagaaccttcaaggtataagtcggctggatagtcgaggtatgagcgctctgccaggacaccttggtgtgatgaaccagagtcgaaccaaacatccataatatcggtttccttagtaaaggtaccgtttggtgaatgttcattggtataaccatctggcaataggtcctttgcgtcgcgttcgaaccaaacattcgaaccatacttgccaaataaatcagctacgtggttaatcgtcacttcgtccatgatggcagtgccatcttcagcatagaagattggaagaggtacaccccaaactcgttgccgtgaaatgacccagtcaccacgatcacgaatcatgttgtaaagacgctttttaccccactctgggaagaattcaacgtcatccatcgacttaaggatttcatcacgcatatcaccaacggaagcaaaccactgtggcgttgcccggaagataatcggcttcttagtccgccagtcaaatggatagctgtgttcgtatggcatatatttcagtaataacccagcggccttcaacttgtccagtgcgatcttgttagcgtcatcgtagaagacccccgcaaaatcatcaccagcttcagccgttaagaaccctttgtcatctacgggagcaaagattggcaggtcgtattgcttaccgatccggtagtcatcttccccataaccaggcgcagtatgcactagcccagtcccagaatcaagtgtgacaaaatcacctaacatcgttactagatgccgactattgtcaaaaggatgttcgcacaaaatgttttcgagttccgcacccttgaccgttttaagcacttgaacatcttcccaaccaaatcgttcggcattttcgtccaacaattcagccgcgagcacaaacttacgattttcaccagccggttgcacaacgacgtaatcaaaacttgcatcgattgtgattccttctgaagctggaatcgtccaaggagttgttgtccaaacaaccatataggtatcatcatctaagacacccttaccatcaatgacatgttcaccgtagaaggcggatggcgatgtcacatcatgatattccacttcagcttctgccaaagccgattcagaagaccatgaccagaagacaggcttttggccccggtagatcaagtgacgtttagcaaacgcaccaaagacccgcacttgagccgcttcaaattctggctttaacgttaagtatgggttgtcccattcaccagcaacgcctaagcgcttaaactcatcacgttgacgatcaacttgttccaacgcgtatttccgacaaagttctcggaattcattgtccgtcatcttcttgcggtcataaccggcttgctttaacttctgttcgattggtagcccatgggtatcccaaccaggaacgtaaggtgcccgaaacccattcatcgacttatagcgaacgatgaaatccttcgtgatcttatttaaggcgtgccccatatggatatcaccattcgcgtatggtgggccatcgtgtaagataaagcttggcttaccttcattcaatttttgccgttgttcgtagactttattttcagcccacacattttgccgttcaacttctttgaccggtaagtttccacgcattttaaacttggtcttaccgaggtttaacgtttctttaacgcgcatattctcactccttaaaatttttatcaaacaatcgccattggatttttagacacaaaaaaacttcgtccacccagggacgaagttatcgtggtaccacccaattttagaattgtttaaattctctcttagcatggttaacgtccatggaccggccacccttactcaattcaggatagcattcggagatgatctgcaactaactaagggacgactgcctttccattgccggcagctctctgggcgtattagttaattgtttgctgttctcctcaatacattcaattcgcttcaattgtgcctgacgatcgcctaattaattattagtgctgtcatcatcagggaaaataaccaccgtctgttgttggacttgatcgccaccgtccgcaacgggggtctcaccactcgttgcttccgtaatttcaacggttgcttctgagtttacgctcgcatcccccgagttgtcaaggttatcttcctttaaaacgtgttgaatttcagcataatcagccgtattcgtttcgctaagtagttgatcccaatccttgctcttaaccacttctaactgcgattctaacatcacttgcaagcgttgccggaagacccgcgtttgtttcttcaaatcatcagtttcaacggataatcgtttggccttttgagaagcttcgtcgatcatttggtttgacttgtcggttgcttcactcacaatgtcagacgcttgtttctgagcttcgcgggtgataatgtcggcttccttcttagagttcgtcttcactttatcagcagcttcttgagccaccaagatagattgattcaaggaatctttcaattcattgaaatacttcaacttaccttcactcgagtccaaccgttcttggaggtctttattttgcttcaaggtaatttgataatctttgataatttgttctagaaaatcattaacctcatcaatattgtaaccacgcagtttcgttgaaaactctttgttatgaatgtcatcaggacttaacaccattagaattcctccaatatctatttactatgaataatatttaatgttattcgcagccgcgcttttttggtctcaccgctaatttcggcaagtcggacacgaccgtaatggttcacactcagcatatctaacaatgctaactcgtaatcagctttcggtaagtcagcccaattcagccgaaccttagcaccttcgatcaattccttggcgtgatgccgcgacaagttgaacgccgccttaatgatactatccgcacgtaatgaactaaccgtcgtagtaactgcctcccagtcgtcttccggtgtgatcaccgccgacaatggtaccgctgttaagtggactttcgtcttaccaaaacggtcgatttgctcctcgaaatagctggccatctcggtttcgcacacaaactgccatgtcgttccgtcagtcacgatgtcaccaaagacatcacgctcgacgccggcattggcaagcgtacccagaatttgaccatgctttaaggtggcaaacttcacgggataaacaatgttaaacagtgtgatttgaaaatcggccacttcaggttcgtaatacaccgggtaaaataagatccgttgtaactcagcaccttcaaagccaccggatgcccgcatccgcacgtcgtctaactggttgaccagcgtttgcgcaatgtagatttgtcgcgggttcaaaaacgcagttaagattggtcggtactgatcagctacttgccgtagccaaccagtgacctgttcaataaatggggcttcactatcgcgaaaatgttgttttaagttatcattcacgatactatcctcgttattttaatttagtatatcaataaagttatcagataaaataggccactttcagctaattggagcactaacagcgcaatgatcggcgaaaaatccagtccggcaattgcgggaataaagcgccgaaaaatactgagaaatggttcacagatttgacctaagaattggcccacgcgagtattataagctcccgggaaccatgacatcaaaatgtaaaccacaatggctaattggtacagttgaaacaaccgactaataatcgtcactaacaggccactcactccttataatttgctcgtatcaaactgacttgtcgtacttccggaaacctcgtaattttcaggaatacagaggaaaatttcatcaccaatccgttcgatctcaccattgatggcaaaaaccgtcccggtcaaaaaatccacaatccggcgtgccatttcatcatcgacgtgatcaaaattaatgattacagcttgatttttcaataactgcgtcgcaatttctttcacgtccgaataaattttcggttcgaatagggcaattttgctattcaccgacttgcccccttgcattggaactacctttggcgtgctccgagtattggttgcagattcagtgggagccgccgcttgggaagcttcggtgggttcctcatactgactgtcagaatcaccaacaccaaaaaagttactaatgaatccggccatgtgcttgcgctcccttcaccgttttacttacgccggcgcttgaagaatggtggtgtatctagcgaatcaccactgttatcatccttactatcgtcagcttgtgagttgtcattaaagacatcaaaatcagttttttcaacattgttaaactcttgaccattgttgactggccgtgaattgttcggttcgcgccgaatatcccaattaccgaatgggtcgttagcttgggactcacttgattgggccgcttcactcgtcgctggctggtcagttggcgttgcgaacatgccgcctcgttgctgactagcttcactacgactaggctggctgtccatcttgagttcgcgttgcttctgatcgataccagtggcaatcacggtcacccggacttcatcaccaagactttcatcgatcgaagtcccaaagataatgttaacatcagtcgttgccgcttgggaaacaatgtcagaagcagcttgggcttcatacaaggacatgtcggggccacccgtgatgttcagcaagacttgttcggcaccatcgattgaaacttccaataatggtgaagaaatggcttgtttagtcgcgtccgccgtccggttttcaccactagcagagccaatacccatcagagcggaaccttggttttgcatgaccgtcttaacgtcggcaaagtccaagttaacgtaccctggtgacgtgattaagtcagagataccttgaaccccttgacgtaacacattatcagcttcttggaaggcttccatcattggagtcttcttatcaacgatttcaagcaaacggttgttagcaataatgatcaacgtatcaacgttgtctttcatctgagcaattccttcagcagcgttacgagcacgcttaggaccttcaaatgtaaatggacgggtgacaacacccactgtcagcgcgccggagtccttagcaattttagccacaactggtgccgcaccattaccagtaccgccacccataccggccgttacaaagaccatatctgagccttgtaacgcttctgtcaaggcctcttcactttcctgcgcagccttggaaccaacatcaggattagaacctgcgcctaatccccgcgtaagctttggtccaagttgaattttagtttcggcatttgaagtttgtaatgcctgcacatcagtgttggcaacgatgaattcgacgcctttaacatcttcagcaatcatccggttaacggcgttaccaccaccgccaccgacaccgatgactttaatattagcccctgagttctgggttgaatctaaagaaaattccatgttttttcctccgtcatttctatccgatattaatcaaagaagtggttgaagaagcctttgacccgttcaacagttcccttatgatctggatcagcctgttcctgtggtgcttgtggcgcagactgtttcttagttgcttttttaggttgtgctgcgggttggctaggtgctggtgttgtattagcaaattccaacgccacactggcacgagtatcaccggtaagtgcactcttaacgagtaacgtaacttcactcaaggccgcttgatatttgatgaccgctaacgcctcatcaaacgacggatgcctcaagcccatttgattaggcgtaaagacgcgaactcgcgttccaaaacgttgcgccgccaaatcagtgataccgggtaatgctgccaccccaccagttaaaacaatgcccccggggagctcgagcgcccgaatctcatccaagtgctgcttgaccttatcaaagatctggtctagacgagcctcaatgatttctgctaagtattgctcacttatttgctccggtgtactttgcccaacaacatcaactgggaaaagttcatcatccgaggcctgctgagcatcggcatagccataatcacgctttaacttctcggcattctcgatcgatgtattcaaaacgaccgagatatctttggtaatatactggccgccttcttggtcaacgtaagtatacttcaattggtgatcatgtataactgccgcagtcgtttgaccaccgcccatgtcaataatgatcgaaccaaaatcttgttcaccgtcattcagcactaaggaacttaatgccaagggcgcgatcacaatctgttcaatttgcagtccagccttttccaaagccttccgcgtattgtgaatgattgttttcggaccagtgaacagggtgccgtgcatttcaagccggaccccaaccatgccacgtgggtccttgatgccatcaaaaccatcgacgacaaattcatcggggatgacatccagtacttcccgctctggcggtaaactctgaactaacgcagccgccgcaacgttttgaacatcttcattattaatttctttggactcatctgccacggcaatcataccacgacagcgttcaattttaaccaggttagcgggaactcccgcaatcaccttttttatttcgatacttgctttttcttcagcttggcgtactgctgatcgaatcgtttcggccgccttatcaatatcgacgatcacgccacgacttaaaccattagaacgtgcgcttcccacaccaataacgttcatttgccctttaacacgttcagcaacaatgacttttattgaggtggtccctatatcaagtccgacataaattcctgaattatccataatagaggaacctcctagtattttacataaatattcaaggattcgctgacatatccagttattccttagtttaccatatcctaagcgcttttaaaaaggtcacacttagcattctatcaattattctgattcttgaacggataggagtatgcgcccacctcaagattgatgacacccttggttttcatcttcgccacaattcccggataataagccatcttgctagcaaaagtgctaattgttgcgtacacttcattaccgtcattcatgtaaagatgaacccgttcgggattagccttgttcggcgcaaacttgatctcagaaatattgtgtttgaccgccgatggtaacttagcgtactgtgcaatcatcgttgctaagcggtgaccgcttttaaagttggcatagatcggtgaaccgccaccgggttgagaataggtcgctttcaaaatcagcccattttccaaaattcgtcgatagtgttgaccagtcgataagtaacccgcgatgcgaatttccttaactgtcacccgaacactgttcaatccaactagcttagtcgtgaccttgccaatttgcggctgggcgcgttctgcgcgcttagtagtccgttgatcatgaccaatcacggaccataaggcaactccagggttgatcttagtcgccgtcttgacctgcgtaacagacaattgatcgttaccatgtacggtcaccgtctgaacatggctcagtggtgaaatgaagtaaccagccacaccagcaccgatcaggaaacagcccatcaagatcacgacccgtttgaaaagtaatcggcggcgctgagatttgagtttcggtaatttatcgccaattcgcaggcgtttacctgaccaactatggtgactcttttgcgctgcgcgatgattctcagccgcgtcccgttgaaatcgttcccagggtgtcagctgctcggggtgctcacgctctttgggctttttatgaaaaatggccatcacacccaccctttcactctagtctctgtgctacttaatcaccgtttctaaaacgtgtagtaactggtcggccgcatcaggcatccccagttttttcgcattagccgccatcgtctcacgatgcgtggtactttggagaaggccatctaatgcagctaccaaactggttcccgtcaaatcagcttccttaatcagttcagccgcccccgcattcacgaggctttgtgcattcttggtctgatgatcattcgtaacgtatggactaggaactagaattgaaggaatccctaaagccgtaatttccgcaatactagttgcacctgctcgaccaagaataaccgcgacttctggtagaattgctggcatatttttgatgtatggttcgattttaacattcggagctagcgctgtcgctgacaagccattccgaatcttttcgtagtgtacctgaccggtgacgaacaaggtctgatagtcacgtttgttcagttcaggaattgccgcgaccgctgctgcgttaatgcgcgcagcaccccggctccccccaaaaatcaacgccgttggaatatcaggatccagatcaaactgcgccaaagtgccactttttttaatattagccacttgttgggctcgaggattcccagtcatcacaactttttgagcgggaaattgtgatcgcgcactctcaaatgaaatggcgattttatccacaaaccgacttaggaatttgttagtgacaccaacaactgaattctgttcatgaatgaccgttggaatgtgcatctggctcgccgcgaaaacgaccgcaccactcacgtagcccccggttccgaccacaacatctggtttaaacgccttaatgtacttacgcgccgtaaccacactctttaaaaacaaatagactgttttaacattttgtaatgacaatgaacgcttaaagccctggatcttgattgttttaaaatcgatcccccgttccggcacaatgcggctctctagtccacgatgggttcccacaaactgaacttgcgcttcgggatcatgtgcttttaaggcatcgatcagtgccagtgcgggatagatatgaccacctgtcccaccgccagaaatcattaatcgcattagttttcttccgcctttccagttaactgttcgattgctttaataaatcggtcgccccgcacttcgaagttcgggtactgatcccaactggcacaagccggcgataacatgatgatgtcaccagcctgactatgttgccaagcaattggcacagcagtctcacagttgtccgtaaactcaatatcttgaataccagccaaacgcccagcgtccgccattttttcagcagtctcaccgaagacgattaacgtcttgacatgcgcctttaatgcgggagcaagcttttcaaacgtattaccacggtccaaaccaccagcaagtaaaatgaccggctgatcaaagcccttcaaggccatctcggtcgacaccaagttggttgctttggaatcgttgtaaaattgccggtcctgatacgtctcgacatattgagtccggtgtcgaacacccgtaaacgtcttcaagacttgaacgattcctgctgttggaacggcttgaagtttagcaacagcaatcgctgctaacgcattttcaacattatgatcaccaggaatccggatatcagcagcatccatgatgtactcatctttaaagtacagcttgccggcctcttcataggcgccatctttcgtattggcttgccgtgaaaatggcacgacggttgcttgtgattgcttactgagttgccgccattcttcactatcccaattaatgactagataatcattagccgtttggttcatggtgattcgcatctttgccttgacatagttctcacgtgagccatggtaatccaaatgcgtcgaataaatattcgtaatcaccgcaatatgtgggtgcaaagtttgaataccacacaacataaaactcgaaagctcagtcaccattgtgtcggccgccgtagccttttgtgcaattgctgaggccggcacgccaatattgcctgctacgtaagctttaccggcatttgtgcgttgattaagcatcatcgtgatcatcgtcgttgtcgtggttttaccgttcgtccccgtcacaccaatcaactctcccgctaggatttgcgatgcaagttcaacttcggtaataactggaatacccttttcctgagccccactcacaattggatttgagtatggaatacccgggttcttgacaacaactttaaaatcttcatctagtagtgacagcgggtgaccacccgtgataactttgattccatcactcaataattcctgtgcatccgggttctcatcaaatttctttttatcattaacggtcacaaacgcacctaatttgtggagcaaccgtgcggcattgaccccgctctttgctaatccaagaaccaaaaccttttggttacgatactgctcaaccgacttcataaaccaagatctccctataatgtttgtagatgatacctaaattaacttgttatgtggctgatgcaccaactcgtggtcatcagcaaattattcatggtgagccagtgaccaattccacgacataatctgcggcagacaacgcaaccatttaaagaacaatcgttgcgttgataggaatcagtactatttacttgtcacttacttggcgaccaccaatgaataaagtcataccgcaaagaccaattatgtacaactaactcggacaagaatgcccgagttagcaaactgtgactaaataatcgtggcaacactgattacggctgccactaaaccgatcgaccaaaaaacgatatcaatcttccactcgctccaacccttcatctcaaagtgatggtgaattggactcatcaggaagatccgttttcccgttaacttgaacgaggcgacttggaggataactgaagccgtttcaatgacaaaaatgatgccaatcaagaggagggatagttcatgatgcaataagatcgatactgcagctaaagcaccaccgagcgctaatgatcccatgtcacccataaagatcttggccggtttgtgattatacacgaagaaacctaatagtgaccccacgacggccaaacagaataacatcacattatactgattttgagcgtaagcaatcacggcatacgcaccaaaggcaatcgtggcctgaccagcgactaatccgtccaacccatccgttaagttgacggcatttgagaagcccactaaccagatgatggcgaagagcatgtaccaaattcccagcgaccagacccccaaacctggaatcctaagtgccattggcaaatgttcatgttgatagaccaacgttaaaattactgccccaatgacttgaccaagtaatttttgccaagcctttaaaccttcgttttgtttacgccaaagcttgatactatcatcccaaaaaccaagtgcaccgtataagaccaggataaacatcaaaatccaggtggttggttgtagctgatgttgccacccaccgacccataacgtggtgactaagattgcgataatgaacagtaggccccccatagttggcgtcccagattttttctcatgccacttaggaccttcctcacgaatcatctgtccttctttgcgggcgcggaaataccgaataagtgacggcattaacgcaaacacaataataaaaccactaattagggttgcaccccacactaataaactcacaacaattctccattctaagacttgataactacttcagtgtcacactaattgcctgcttagcttcgatcggattacccgcagtcacactttgcgtcttgacgtaacccgtcccgctagtcgtgagcttaacgcccgtcaacgtcgcaaaatcagccacttcacttgctgaccatccagataagttcggcatatacatctgcccgttggtaaccagaatgacgcgttgaccacttgaaacgacagtgccagaagaaatggattgcttgacgacccgactacccttaccaacaacgaccacgtcaagtccctgcttcttagcagctttcttggccgcgctagtcgacttactcgtcaaatctttcattttgatcgtcgtcgctttagtctcactcgctttttgttcttccaatgcccgtttcatcacggtatcaaaaatctctgccatgtcatctgacgcggaacttccgttaagtgtcggttgtttcatcgtaatgtacataatgtacttcggatttttagctggcgccatcccgacgaccgagtacagataggtgttgtcaccttgctcatacgtactcccgttgctgacctgggcagtcccagtcttagcagcaatgcgatacccgctgatcttatatgatgagccagtaccgtatgacttatataccacatcttgcatatgatccaacaccttgctggcagtcttcgaactgattggctggcttacaaccttcttcttacccgtataaaccgttttgttggtgttagggttagtgatcttggagataaagtacggctgtaacatcttaccatgattagcaatcgctgtgaatccacgaagcatctgcatagcggtcacctgaatcccctgaccaaaggccgtatccgcttgttcgattggatacgtaaattgaattgaaccactctgctcgttgtcaagaccactattagtactctcacgcaacccaaagcgtttaatgtacttcagccaagtcttggcccccattgcttgttctaggtgggccatcgccgtgttacttgaaagggcaaaccccttagcataggtaatattgccccacccgctcgtattccaatcaggaacggtattattaccgatcttatattcaccggttgggacggttacattagcattgtacttaccgctgtcgatcgccgctgccattgtaaagaccttcatcgtcgatcctggttcatacgtgtcttcaaccaacaaattacgccacattttagatagtccggtctttgtttgcgcattaaatgtcggtcgctgcgtcgtcgccagaatggcaccagtcttcgcgttcatcaacgttgctgtcattgacttaggtgagaccttagcgtttacttgtgaaactttagtttccagtaatgtctgtaacttactatcgatggtggtataaatattatccccatccttaaccttcttaccagtctcagtgctaccttgatatccgctcttcgtaatcgtcttgcgaccatcggttcccgataactgcttgttaaaagccaactcgatgcccatcgaccccgttaaccgcgtctgatcggtatccttctgactcttggaggtggtcagcccaaccaagtgggaagcaaacgtgccgtttgggtagagccgcgcttcagattcaataaagtgcagcccagccacattttgggcatcgatcttttccttagtcgtcagtgaaatattcttaccagccgtcccaaattcaatttggaacttacctgcgcctttttgcaaggtcgcgagggctttcttatagctgattggcaaatacttcgataagacacgcgccgccttcgcattatttttaacatacagtgccttgccactagcactttgctgatttttcgccataatggcgtagaccgtgtacgtgctagtatcttcagcgattgggtcaccgttggccgtataaatagtcccacgtttggccgtgatggtctggtcttccgtataaagtttcttggtggcctcgaccagattgaccccgttgacgtggcgcacaatcgcgatatatgaaaaacgaatgatcaaaacaccaaagacggcaatcgcgccaaaaaatagccattggccaaaaattctacgattttgttttggtgaccgtttcgaagtcattcgttgtttgttcttattcatttgtaaacattccttatgctaccgttgttcagcgataacccgtactgcttagcaattttatttaaacggctccgacttgaaagttcactgatttcttgtgcggccgacgtattttttgcctgcacttttgtgactttcgtttgcaccgtctgtaactgactttgtgcgttactcgttgcaatgttcgttgaaactaacataatggctaatccaaacaccaccaaactcaaaccaacacacaatactttttcaaataatgaaaaagcaactcgctgcgtcttgatggacggattcggggtcacaacggtttttgttttatgtaccggggtggttgcgccaggagtttgctgtggcaactcccgcgctaatccattttgggccattttaatcactcctttaattattcctgaatattatttattcgttatctttaaacgttcgatggctcgtaacttggcgctgcgagcacgacgattagcttcgatttccgcatcgctaggcacgaccggtttacgactgactaagcggtaatctggttgcatttcagctgggataactggtaaaccaggtggcagctccggcaaatcgctgtgctccttaaagatcgtcttgacgagacgatcttctaacgattggaatgtgatgacactgacacgaccatgaacattgattaaatcaatcgcttgttcgagcgaagtctccagtacgcccaattcgttattcaccgcaattcgaatagcctggaaaacccgtttagcgggatgaccacccgttcgccgcgctcttgctggaatggcattcttaataatttcgaccaattgccccgtcgtcacgatcggctgaaccgcccgttcacgctcaatcaaccgtgcgacttgtttagaaaacttctcctcaccatagcgatagaaaatacgaaccaagtccgcatagggccaagtattgacaactgtttgagcagttaatttctgactctgatccatccgcatatctaacggcgcatcatgttgatacgagaagccgcgggcagcatcatcaaattgtggcgacgaaacgccgagatcataaactaccccgtcaacgtggtcaaggccccgagcatctagttcagtcttcaagttggcaaagttacttttgatgaacgtgacctgaccacgttcaagataagtcgctaagttactttggttataatcgattgcggtttgatcctggtcaaagctatacaagtggccttccggacctaactgttgcaaaatttcacgagaatgaccaccgccacctaacgtacagtccacgtagatgccatccggccggacgtttaacgcggcgattgcttcatgcaaaagtaccgttgtgtgttcaaatgttgccacgcgtgcgcccccttcctaaattattattgttatttaaaaatcaatcaagttttctgcaagatcatcgaagttcgctgcggtctccgtctcaaactgttgccagtgttcggcaccccagatttcaaatcggtcagaaactccgacgatcacacattgcttttccaactttgcatattgtctcaaggttgcaggtatcatgacccgtccctgtttgtctaattcacattcagcagcagcagcatagaaaaaacggacaaacgctcgcgcatccttgcgagttagtggtaaatcatctaactgtgcttgaagcgttgcccaccgttcagcgggatagccaaaaatacaaccatccatcccacgagtaatgacaaacgaagtgcccaatagctcacgaaacttggcaggaatgattagtcgccctttcgcatctaaggcatgttcaaactctccgaaaaacatcttagacgccacggccaatcaacccctttcattaaacataattcaagtctaccacacccccccacttcctaccacatcgttttgttacttttccaaattgttaacaaaatatcaaaaaaagtcccacctaacgttagtttcgttaggtgggacttagtgggggacatttttacgatgttaaaaagaagtggctgccaagtgctaggatatagacgacgagtgtcaataattccgctccccgccaatagagcttaaaaaagcgccagtaaaggatttctccgcgttcaacagcttcaatcagtgttaaaccgatccccaaaatcattagggacaacacttcgtacggtgccagcgaactatccgttgcttgcagtgtcagaaagtgggtgaaaacaattaaaaatggcggccaaaaatccaacaatcttaatccatgtggccaaacgcggtgtgcaacccgtttagcacctaaaatgatcatcgagatggcggctaaaaataccagctgcccataccaagtggtccataaatctcgcatatgcgtacttgcctccccattagtgtcgggttaaattatagagattatcgttaaacttttcaatcatctgtgacagccctataataaacataaactattactggagggatgaccgttgttacaatactttaccactggtaaaaatggccttttgactacgccgaacgaccatcacgatcagccatactggatcaacgttgaacgcccgacctcaactgaaatcgaccaactggtcacacaatttgatcttcccaaagattacttaactgccatcctcgacgatgcggaggtttcacgagccgagcaattatcaaccacgcaatccagtcaaccaatcttaatcgtgatgcagtatcccaaactcacgacgagtaagctggggtaccttgaatttcaagtctatcccttcgccttgattttagtggatcaagtggtcatcaccgtcagtaattacccggctagttttattcaagactttgtgatggacccggcctcgtctaagctaagtctggataatcacgaagattttgtgctgactatcatgtggtacatcgagcacagttttgtgaccgcactcgaattgatcaaccaacggacaagcgccctggaaagccgtttgaatcaagctactcacaacgtggaactctttaccattatggcttaccaaaaatccttgattcgttttaaggccgcccttaatcagaacacacccacgcttgacgcggttgaaacttcgatcacccatttcaacgcacctaatcaccaatcactcaccgatgatattaagattgagacccagcaagcgagtgacatggctgaaacgaccaatcagattttgcagcaatatagtcaattagtgggttcagtaatttccaataatttgaatgatgtcatgaaatttctgacctcactcacgatggtgttgacgattccaacgattatcggtggaatctatggcatgaacgtcaaattacctggtgccggtctcgtccacgctttcacttggctgatgctaggaacgattattctttgcattattagtatcgaatatttacgaaaccatgactatttttaatttcaattgaaaaaaaactgattccacgttaaactatgaaagaattactcgtaaagtgtggtgcatacaaacataatgaagaaaaaatcaacttttcaaaaaattacgatggtcgttatctggttaatgatcatttctaccattgggtcattggtgcttaccgccttatctgggttaggtttactaaccttctaggttaaacaccttgcgaaccacgaatggttgcaatacttaccaagaaaaaagttacgcttgctcacaacaatgaagtgaacccacaagttt

SEQ ID NO: 16 - DNA, 53340 bp, Lactobacillus plantarum
acaaatttgtccaaaaattcgtattaaatttgcaatctaccttttaatgacttctagcttgttatgagtgttggctccaaagacattgaagtcagactgtgccaacaataaaaaagagcatgcttattagattatatcaatgcaagtatcattgatagattagaattcaataaaaatactaattgctattaattacgttgcttgtataccgtacgatatgtatataaaaaaactaccatcagaaacctgagtctttgatggtagttctaactgacgaacactaattatcagttcttctaaacgaagcaccaattaaccccaaacatcatccatatgcggtagttgcaataagccatcgctagtcgggtcagttgtgccgatggtctttaaatgccaagtgccctgatcgtccttggtcgcaacgacttttttgcgtttgccctcttgatttttgtagaagcagttttcactatccgcaccgatttcgcgggcgaggacttcgttggatgtgacataaccgtcattggtttgaaatttttcgatttggtcgaccgttgtcaactgttcatgaccacgacgataaattctttcgatgagtatcatcagtaaattccccctaatattgataaccttactaatttaatcatattttaccatacccggatatgcggcaaaaacaattctgaaatggttagcaaatttataagaattaaagttcgatacttgctaaaccaatggcaaattggtacactacttgtttaaagtctgctataataatagctagatatgaaaatatactaacgataaattaatttattatttaatcaatttcacattgtgaaggagagatcaacgacatgttaaaacgcacgaaacagtttctgcgatcaatacattatgactacgataaaacatatattagaccgctgatggtgcccgacagcgtttacgtgttgaaattcggtaaggaccatcgcaacaatcgggtggtcgttaagtacagtcatacttggaccgggcgaatcaaaatcaatgagatcgcggttcggttgcacaagcaaaagcacccgcggatctttaagcatgaagccgacatgattaagtatttgaataagcatctaaccaaaaagaccgcaaataatgattaaatgaacatgaggacggactagcaaggtggctagtccgttttctattaggggcgagtaaaacaagttatgacagcaatcgaacgatttttaagcacacgtacgacacctgaaattgcggcgagcctactgggtaaacagttgcacctacagacatctagcggtgtattgaccgcctggatcacagaaacagaagcgtatcttggcgcccgtgatgcaggagctcacgcgtaccagaaccaccaaacgccgcgcaatcgcgcactctggcaatcagcgggaacgatttatatttatcaaatgagggcctggtgcttactgaatattgtgacacaagctgccggtacgccagaatgtgtcttgattcgcggaattgaaccagatgtggggcttgaacgaatgcaacagcagcggccagtgcccattgcgaacttgaccaacggaccgggcaagctaatgcaggcgcttgggttagataaaacgttaaatggacaaacgctgcaaccggcgaccttatcattggatttgagtcattatcgccaaccggaacaagttatggcgactccgcgaattggaattgtcaacaagggtgaatggacaacggcaccattgcggtactttgtggccggcaatccattcgtatccaagatttctcgccggactatcgatcatgaacatcatggttggatgaccaggtgattgtcaagttaatcaggcttgttatataattgttactaagaaaaacgtgatagtcttaagcgatggcgcttggcgctctagctttcgatgggaggaaaatataaagatatgaaatggactgaagtaacggtcagtacttctaatgaagctgtcgaagcggtggcaaacattttaatggaagccggggccagtggcgtcaaaattgatgatgccttggattatcagaatttaaagcctgatcggtatggtgagatcatcgatttggcgacgattccacacgttaccagtggggcgaagatttctgcttattatcctgagacggtgtttgtaccggaagtcattccaacgatcaagcagcgggttagtcagctgactgattttgggttgaatccagcacctaatgaagtcagtatgacggctttatcggatgaagactgggcgacggcctggaaaaaatactatcaccccgtccgggttacgcgctatttgacgattgtgccaagttgggaacagtaccaaccagtgcaatcaggtgagcttgtgttgcgactagatcctggtcaggcttttggtaccggaacgcatccgacaaccaagctctgtttgcaggcgcttgaaactgtgatcaatggtggtgaacacttgatcgatgtgggtactgggtccggggtattgagtattgcggccaaagcgatgggcgtcggtgcagtagaagcttacgatcttgacgatgtcgctgtggcatcagctcaaacgaatttggacttgaatccagttgccaaagatgttcacgtggctgccaatgatttactagctgggattgacacgcaggctgatattatcgttgccaacattttggctgaaattattattccgttggtaccacaagcccgtcaaaacttaaaacggggcggctatttcattacctctggcatcatcgatgataagttccaggtcgtcatgacgacaattaaggaagcgggcttccaaattacacaacatacgcaaatgggtgactggcacggtattgtggcttatctaccaacagctgaagattagtgggggactgaaatgcaacgatactttttatcaacaccgattacgacaacgattgggcaaacgttcactatcacgggtgagacggtcaaacactgggtcaaggtgatgcgcgcacaaccgggggacactgcggaatttgttacgacgacacatcaagtcgtgctggcggatttggtgaaaagcgatggtcgaacagctacagcgacaatcacggccgttacgacgccccatgttgaattgccgttgccagtgactattgcttgtgggttgtctaaaggcgataaacccgaacagatcgtacaacgtggtactgaattaggtgcgagcgccttcgtgtttttcgatagtcagtgggcagtggctaaatgggcagcgaataagcgggcccgcaagttggcccgcttggcgaaaattgcgcagggcgcggctgaacagtcacaccggacgatgattcctagtgtgagctacgcaacggatttaaaccagttgttagcacacgtgtcatatgataccggggtcgtagcgtgggaggaatcagccaaacaaggtgagagcagccaactggtgcagacgttaaaaacgatgaccgcaccacaacgactgctggcgatttttggtcctgaagggggcttggcaccacaagaagtggcgacattacaaactgctggtatcgcggcagtgggcctgggtccacgaatcatgcgggccgaaacggcacccctctacttactaagtagcgtttctttttggtgcgaactagtgtaattttgcggtcggtggtgtacaataaataatcatagtcatttagcaataaagcgtaagcgagggagttagtttgacggaaaaaattcgtaagtttaatggccagtattggctgattgcgcttgtcgttggggtgatgataccatggttgctacgatttacgagtattagccggtttcatcagattgtatggctactctttgtagttgactttgtgctggcagcagtcgttggctggtggattcgtcggactgaacggacgggctggttagtctggctattcccagtgggctgttttgtcgggctctatctatttttcccaacgtatgtctattacttagcgttagttgatttaggcatatcctacttagcatatgggttaactggtccccgcgcgagtttgcgttaaaacggttgtcaaggcacgttgggtgggaacctcacgtgccttttattaaatagaatctttgtggaagtcgtggtgataaaatgcccaaacaacctacctggactgcccaggatgtcctggacatggttcaaaagtatatgaatagtgatcacgtcgcgttagttaaacgggcgtgtgattttgcaacttatgtgcataaggatcagtatcgccaatctggtgagccgtatattatgcatccgattcaagttgctggtatcttagctgaattgaagatggaccctgaaaccgtcgcttcgggtttcttacacgacgttgtggaagatactggtgttactttaggagacgttgaagaactgtttggtcatgacgtggccgttattgttgacggggtcaccaagctgggtaagattcggtacaagtccaacaaagaacagcttgctgaaaatcaccgtaaattactgttggcgatgtctaaagatattcgagtcatgattgtcaaattagctgatcgcttgcataatatgcggacattgcagcatctgcggcccgataaacagcggcgaattgcaaatgaaacgttggaaatttacgcccccattgccgatcgattagggatcagcacgattaaatgggaactagaagatatttcactacgttatttgaatcctcaacagtattatcgcattgtccacttgatgaattcgcggcgtgaggaccgtgaaaagtacatcgagattgccattcaagacattcaaaaggcgctccatgatctggaactaccagaagctgaaatttatggtcgtccgaagcatatctattcaatttataagaagatgcgggacaaacacaaacagtttagccaactttacgatctgctggcaattcgggtagtcgtggattcaatcaaggactgttatgcagttttaggtgcgattcacacacaatggaagcccatgccggggcgttttaaagattatattgcgatgcccaaggccaatatgtatcaatctttgcataccacggtggtcggtcctgaaggtaagcccctcgaaatacagatccggacgtttgaaatgcaccgggtcgctgaatacggggtcgcagcacactgggcgtataaggaaggtaaacgcgacgaggtccaagagactcagtcgggcaacaagttgaacttagtcaaagaaatcattgagctacaggatgaaagtaaggacgctgccgactttatggagggcgtcaagggcgacctctttagtgaccgggtctatgcttttacgcccaagggtgaagtgacagaattaccaaagggcgctggaccactggatatggcatattcgatccatacggaagtgggtaaccatacgactggtgcgaaagtcaatggcaagatcgttccattggattaccaaatcaaaaatggtgatatcgtggatattttaacgtccactagttcaactggtcctagccgtgattggcagaaattagtctatacgcggcgggcccgtaataaaatcaaacagttcttccgcaatgctgaccgtgaggaaaacatcattacgggtcgtgatttgcttgagaagcagctacgtgatttagagtttaatccaaaagaaatcatgactaaggacaaggtgacggcggtcgctcaaaagatgcactacggtagtgaggatgatttgttcgcggccttggggtttggtgacgtccaaccggtagggattgctaaccggttaacgagtgatgttcgtaaacagcgcgaggctaatcggcagcgtgaacgtgaggaggccattttggcagactctacggaagcgccagcgaagaagaaatcgaaagatcatcataatgaggatcaggagaagcaggatcggaagcggcaaaaggtctcatcttctggtggggtgattattcaaggcgtcgacaacttactcgtacgtctaagtcattgctgttctccaattccgggtgatgagattgttggttatattacgaaggggcgcggtgtttcggttcaccgtgttgattgtccgaacgttaagagcgcagaagcaaatggtgaacggttgattgatgttcagtgggagaatcccgagggtgaccgaacgaactacaattctgatttggaaattcaaggttataaccgtaatggcatgctcaacgatgtgttgaaagttatcaataatcacacgaaatttttgaccaatgtcaacggtaaggtcgatcacaacaagatggtcattattagtgtttcgttgggggttcgcaacttggaacatctccaacgaatcattgacagtctgaaaaatgttcaggacctttacgttgtcgaacggaaaatgttttaggaggcttctatgcgagtcattgttcagcggtcacagcaggcacaagttagtattgatgggaaagttcggggcacgattgaccacggtttcgtcctattggttggttttcaagatggcgatggtcaagccgaattggattacatcgcgcataagattttaaacctccgcgtttttagtgacgcagatggaaaaatgaatttgaatattcaacaagtcggtggagcaatcttgtcgatatcgcagtttacgttatacgcggagacgcgccatggtaatcgaccaagttttacagcggcgggtaatcctgaattggctagcaaattgtatgatacatttaatcagcaattagctgccagtggcgtgaccgttgcgactggtgaatttggtgccgatatgcaagtttccttggttaacgatgggccggtcacgatttgttatgatactgatcaacgttgaagtaaaagctgaaagaccaatccggtactttcagctttttggctattacaattattagcgggagtgaatgagatgcgtgagtttttatgggacctcgatggaaccttgttagatacttatccagccatggtccaagctttccaaaaagcagttgccgagttaggtgggactattccggctgatacaacgtaccagctgatgcggcaacagtcagttggttatgcggaaagaatggttgcggctcagtatggttgggattggcatgatttacgggcgggctatcaacgttgggagccacaattacagcatgcaccggccgcctttgcgggtgctcaagcggtgcttgaaaaagttatcgcagttggtggtcacaattatttgatgacccatcgtgacgaaagcgcacaagcctatttacaacgagcgggtttagcccaatatttcacagatgcggtcacggctgctcagccattcccacgtaaacctgatccagctgcgttgaattatttattgaataaacaccaggtcgactgtcaacgcgccgttatggtgggtgatcgcaacttggacatcgatgccggtcacaatgctgggattaccggatatttatttgatattgaccgcctgattacggtgactagtgccccggaagttcaagttacggatttaaacgacttattgacctttgtcgactagtctagacactcgaaatattgtgataactgatgattgtagctaaaaaattatatacaagcctcgcgacccgtacagctcattgagaggattcggtcaacggctggtccgtatgtttcaccaaacaggttcaggtgggccagtaaataatagagttggtagcttggtaggcggtcttgcataccgggcgcaaccgggtaggccgcttggtaggcctgataaaaatcagcatcaaaaccaccaaaaatcgtcgtcatggccagatccatctctcggtcaccgtaaaacacgtcgggatcgatcaaaacgggtgtaccggtcgtgtcaaataagtaattacctgaccacaaatcgccatgtaacaggcttggttttaccgtatgcatgtgggaatcttgcaacagttgttgtcgtaagcggtgataatgtatttcacgcgtttctgaccataaatggttctccttagccaaattgactaatacatctaaacgttgttgtgtatagaaagttgcccaatcagtctgccaatgattaattttcggtaacttgccagctgtgaagtcgtggtcaagaccaaattgggcgtggtgttgatgatgaactttggcgacagccgctcccagtgcggattgactgccagtcccggtcgctagccaatctaataagagatagccgtccgtggcaatcgtgccactggcgatgacacgcggtgtcttagtcactgcaccaagtagtcgcaatccagcgacttcgtggtcaaagaaagtaacgtcgttgtgcggctggacctttaaaaaatattggtgatgatgaagggtgatgatttgaaaggccgcgttgatgtcgccaccgctcactggttgcacttgctgaatgtcagtgagtggtagttgtgcgagccaagcttttgttaagtgcatgttaactcctccttgctgcgatgttaaatacggttaccatcactgtaacgcaattaattgttattaacaattagtggcgctgatccgtaagagtgtgaaatgaggttagacgtccggtacggagctaaagtgcaggcaaatagacggttatttaggtaaaccgcgtcagttgatatgcgattcatcgattgagtagtcgcgaaaagtggccgttatcccagtcactggaataacggccactttcaaagacttcatgctgactgcattattattgattggcgaagtaggtactcaatccggcgtaaaccgcgtgcgctacttcttgagggtactttttagaactgatcgtcttgaagtccgacttatcattaatataacccagttccatcaatacggatggtcgtgaattatcacgaatgaccagaaagtcaccgaagtccgttcctttactaggaattggcaaggtcgagacgttattgtttaacgccttggctagtgctagtgaggttgacttatgatagtaataggtcgtgatcccagaagccgtgtttttttctggtgagctgtcaaagtggaagctgatgaaggcgtctgcatgaagcttgtttgcgattgcgggacgcgcactcaggccgacgtattcatctgaatcacgggttaaaacaacgtgtgcgccagcagtccggagctttttagctacagctttagcgacccgtaacgtgtacgttttttccatcttgcccttgctcgagagcgccccggaatcagaaccgccgtgtccgggatctaaaacgatggtggcttcagagattttggtggttttagtcaactgactgttatgttcgttgactaaccaactagcaatccagccgaatttatgatccgcataacggacgtatagccaattatttttgcgtttcataatgtggaccttggtgcccttagacgtagcgtcctcgatcgcataactcatgcctggaccgctacgaatattgacgttggcaatgttaacagtcgcagtgttattagtcgctaatagcactacaaagccaatcactaggccgataaaaataaccgtgactgtgatttgacgccaaaattgttttaaaacttgcatgctctgtcaccaactagatttaagataattgcaatttgaagtgctgcaaatagtataccaaaaaaacagctgaccgacgaaatcttgagataattttaactagaatcgttgacttttaagtgattttcgtgtaactttaaccatatattaatcaatcgaccgcagagaaagtaagagcattgtacgccactataaccagagaccggtagtgctgagaattccggatagtgcgcaatgaggagacgcttttgaggtgaacggcagcgttccgcctgtgattacagacgttatcaattagtactcaaaaaggtggtaccgcgctaatagcgcccttggtaaataatcaagggcgctttttttgtcgattgcaatcaagggaggaactattaatgagatatcaacggcctaaaggcaccgccgacattttgcctggcgatagtgaaaagtggcaatacgttgaagcaacggctcgtgccgtcttcaagacttatcaattcaaagagatccggacaccgatgtttgaaaacttcgaggtcttctcacgttcagcgggggatacttctgatattgtaacgaaggaaatgtacgattttcatgacaagggtgaccggcacattacgctccgcccagaaggaactgccggcgtcgtccgggcgttcgttgaaaacaagttgtacggtccgcaagttctcaaaccatacaaggtttattacatgggaccaatgttccgttatgaacggccccaatcaggtcggttacgtgagttccaccaattaggcgtggaagcttttggtagtgaaagtgctgccctagacgttgaagtaattgcaatgggctataacttacttaaaacctttggcttgactgatttgaaactggtcatcaacacgttgggtgatcaacaaacgcgtgatgattaccgacaagccttgattgattatttggaaccacactttgatgaattgagtgatgactccaaggaacggttacacaagaatccattgcgggttttagatagtaaggcaccggaagatcaacaatttgtggccgatgcaccatcgattttagattacttgtctccggaagctcaagcgcattttgatcaaactaagacgtatttagatgcattagcaattccgtacgagattgatgccacgatggtccggggattagattattataaccatacgatttttgaaattatgacccactcaaaagcgttaggcaagggctacacgacgatctgtgctgggggtcgttacaacggattggttaaggaattaggtggccctgaagtttcgggtgttggctttggcctaggtgttgaacgactattagtgttgatggatgctgaaaacattgcggtaccaactgatgatcagttggacgtctatgttgtgggaattggcgacactgctagtgctacgactttgaagctggtacaggcattacgggcagccggttataaggccgaacgggattacttggatcgcaagcctaaagctcagttcaagagtgctgatcgcttgaatgcccgttacacgatgacggtgggcgaaaccgagctggctgatcaggtcgttaacttgaaggctatggctactggtgaggaaaccaaggttgcgatggcggacatctatcaagatgctcatcaagttttagataagtagtgtgaacggcaagtttgccgatttataaggaggaagcgtttatgaaacggaccacatatgcgggtctcatcaatgaggattatttaggccaaacggtcactttacaaggttgggtacaaaaacgccgcgaccttgggagtttgatttttattgatttacgggaccgtgaaggaattgtgcaattagtctttagtcaggaattttcagcggatgctttggcggtagcagatcagttacggggcgaatacgtcattgaagtgcaaggaaccgttgttaatcggaatgctgacgctgttaatgaccgcatgaagactggtaaagttgaagttgagattcacgatgccaaaatcttaaataaggcgaaaaccccgccattttatattcaagatgatattaacgtatcagatgaattgcgcttgaagtaccgttacttggacttgcgtcggccagaaatgcaacgtggattgaaaattcgtaatggcatcacccaagcagttcatagctattttgatgccaacgggttctatgatattgaaacgccgttcttaacgaagtcgacgccagaaggggcccgggattacttagtgccttcgcgggtctatcaagggcatttttacgcgttaccacaatcaccacaactctttaagcaattgctgatgggggccggttttgatcgctactatcaaattgcacgctgtttccgtgatgaagatttgcggggtgaccgtcagcctgaatttacccagattgatatggagacatccttcttaacggctgaggaaattcagtcctatactgaaggcttgattaagcaagtcatgaaggacgtcaagggtgttgacatcaagacgccgtttacgcggatgacttggcaagaagctatggaccgttttggttctgaaaagccggatgtgcgctttggtatggaactcaaagacatgggcgcggccgtttctaacgccggttttaaagtctttgataatgcactcgctaatggtggcctggtcaaggcgattgcagttcctggcggtgctgatcaatattctagaaagcaaatcgatgcgtacacggagtacgttaaacggtttggggctaagggcttagcttggatgaaggtcactgacgacggctttagtggtcccgttgcgaaattcttcaagaacgatggtgactttgaagccattacgagtgctgctgctgctaaaccaggcgacttattattgtttgctgccgacagtttcaaagtagtttctgacacgctgggttacttacggaccgcgattgctaaggaacttgacttgattgatcaagatcaatacgcttacctatgggtcgttgactggccattgtttgaatatgatgaaggcatcgagcgctgggtaccagctcaccatccattcacaatgcccaatgaagaagatgttcattacttgaatgatggcgaagatccacacaaagcccatgcacaatcatatgatatcatcttgaatggttatgaactcgggggcgggtcgatccggattcatacccgcgaattacaagaaaagatgttcaaggcattggacttcactaaggaacgagcccaagaacaatttgggttcttactggatgcccttgacatgggctttccgcctcatggtggcttagcaatcgggttagaccggttcgcgatgttattatcaggtaacgacaacattcgtgaagtgatcgccttccctaagaattccaaggcgtcagaaccaatgaccaatgcaccatcgcgggtttctgaccagcaattagctgatttggatttgaatattaccaatcccgtaacggatgatgaaccaaccgaataaaaatattaagagcgtccagaaatggacgttctttttaattagtgttaaatttatattaatatttaattggaggaattctcatggaaacagcaatttttgcgggtggatgtttttggtgcatggttcagccttttgatagtcaacccggaatcgacagtgttgtctcgggttatactggtggacacacgaaaaatcccacttacgaagacgtcaaagcgcatacgacgggtcatactgaagctgtcaaaattacgtttgatcccgatatcattagttacacggaattagtcaatatttattggcatcaaacggatcctaccgatgcaatggggcaatttcaagatcgtggtgataattatcggccggtcatttttgtgaatggtccggaacaacggcggatcgcggaagcgtctaaacgggcattacaggtgagcgaacgatttagtaaaccaatcgtaacggcgattgaggatgctaaaccattttatccagccgaggcacgccaccaacgcttttataaaaataatccagtggtatttgcggaacaagaagcgggtggccgcgctgatttcatcgccgagcagtgggccgatgcacctaaagtggactaagcgtgagttgctggtcatcgcgataggtgtgatctaataataactatcgtagcggggctcgttctggaaattagtcggattgattaatgggagtttgctgagaaacgtgagacttttagcagaatactgcaaaagaccggccgtttgcgaatcggcgtgttacaataacgaaagcaaaaacgtaaaggagcacacttaattcatggatgattttcagcagttatccaaacaccatcgtgatgttgtgaaagcgtcaactgcttttatatacgccattttagtttccattgccatgaactacttttggacgccggggcatatttattcttcaggaatcactgggcttgcacaattgattaatagtttgatgagcaagtttcttcccgttcagatttcaactgcggcgttactgtttattttgaatgttccaatgtttattattgcgtggcgatcgattgggcataagtttacgttgtatacgttcttagctgttacgctatctagtattatgatcaaactgattgccccagttggtttgacccatgaccccatcatttgtgcgatttttgggggtgctgttaatggtttcgggaccggaacggccctcaaaaatgggatttcaaccggtggcctcgatattatcggtatcgtgttacgccgtaaaacgggtcgcagtattgggacgatcaacatggcgttcaactcgatcattgtcattgcggctggctttgtttacgggtggccatatgccttttattccgcactcgggttgtttgtaaatggtcgggtcatggatatgacgtatacgcgccaacagaagatgcaagtgatgattattacgagtcgccctaaaacggtgattgatagcgttcaaaatcggattcgtcgtggcgttaccatcgtgcacaacgctgaaggtgcttatcaacatgatgataaaacgattttatttacagtcatcacgcgttacgaaatgggcgagttgaaggcggccatggccgaatctgacccgcacgctttcgttagcatttcagatacggtcaagattctcggtcacttttatgaaccgaagccttgatgaatttatcagattaaaagtgtttgcaaacaggactttcgggacttgtttgcaagcactttttaattaggcgttcggggacgacttttacaccactattaatagtgacccgactagccgaagtgtgggcatctgttatataatacaagcattgtgttattgctggatcataagtgcatatcagttagacccagagctaatgaacaactaacggggaacagacttgaaaaatagttgtttatatttagtggactaaggcagacggctcaagtaagttgacgctaatctgaactttttaagcgtaattgagctggcacatttttgattgtcacgtagggcacgctttaccaataattaatgatgaaatgaaaggatggccagtgtgaagaaagtaatttatgtctggctggtgcgagttgtatcgtggctagcgcactttagcaaaaatgatcaggtgatttatttgatgagctttgcggacaatttggattttattcagcagttgaaccagcgcgttcccgggcgcttgactgtttattacttgccgagtgcagccaccggggcggcacaactggcacaggcgggaattgtgacacggccgtttcatgattcagttcgatttgccttgacgggaattcccgtcattacccgggcagcggacgtttatcttgataattattatggctttaccgctggcttgacgcggcaggccccacaacgactgattcaactctggcatgctgctggcgcggtcaaaacatttggttggggtgatccacagacggcacagcggcccgcagatgatcggcgtcggtttcagaccgtgtatgatcagattactgattacgtggttggttctgagaagatgggaacgatttttgcagcgagttatcacgtcccacagacgcggatgcgggtcttgggatatcctcgttcggatcggtattgtaagtccgactgggtgatgcaaaccgcaacggccatttatcagaagtatccggcgtttaaacaacaggaagttattttgtatgcgccgacttatcgagccggtgttcaatttgcgttgccggctgattttaagcaattaaagttgcggcctgatcaacacttgattattaagttacatccccatttggccgagcaggaacgtgatttgcaagcccgttacccggacctagtgacattggtacctgagtttagtaccgatgaattgttgacggtcgctaatactttggtcagtgactactcctcagttgtgtttgactacgcgttgttaccaaattgtcaaaaaatcgttttttatgtctttgactgggaccactatgagcaagaagtgggcctgcaagctgattttagggactgggcgccgggaccattagtccggacggtggtggacttgaatcatgtcctagcaatgccgggtgcgccgttacagttaacccagtttaatcagttatggaatacgcgtaatgacggtcatgcgattgagcggaccttggcgtacttttatccacgggtgaccacaaccgcttagaataacttgacagatttatttggataatgagtgatcatgccggtatcatatgtatccggcaactttaaggtatgacaggaattagtaaacttgcgaaaaggatgggactacaatgcttagattaggttcacatgtttcgatgaaggcacccgacatgttgctcggatctgccaatgaggcggcaagttacggcgccaacacatttatgatctatacgggcgcaccccaaaatacacggcgtaaaccaattgacgaactgaaaattgacgaagcacagccgataatcgaggctcatgacctccggcagatcgtcgtacatgccccatacatcattaatttaggtaatacgaaaaagccgggttattttgagtttgcaacggactttctctatcaagagatccagcgtgcagatgccgttggcgcaacacaattaacgctccatccgggagcacatattggtgccggagcggatgttgccattgcgcagatcatcaagggactgaacgcggttattcggccagagcagcacgttcaaatcgcgctagaaacgatggctggcaaaggaactgaagttggccggacgtttgaagaactcgcacagatgatcgacggggtgacttataatgaaaagttatcggttacctttgatacttgccatactagtgatgccggttacgcgattaaggacgatttcgacggtgtcctgaatgaatttgatcatgtgattgggctggatcgtttgaaagtgatccatctcaatgattctaagaatcctcaaggtgctcacaaggaccggcacacgaatatcggtatgggaacgattggctttgatactttgaataaggtcgcccatcatccacaattgccagacatcagcaagattttagaaacgccgtatgtcggggaagataagaaacatcaattgccaccttataagtatgagattgcaatgcttcgggccggggagtttaatccgcatttgattgaagatattgaacagcaacgttaatgagaattgaacgataatcgctagtcggttgtcgttttttgttttagaaggaggaaaatgacgatgcaattgaaaaaacagcggctattagtgattggtggtacttcgggtttcggcatggcaattgctcgccaagccttacaggaaggcgccgatgtccatattatcgggtcatacggcggcgcacgtaacagctgccatcacccaattaggcccatcagaccatttgactggaacggcgttagacgcacaaaatctggcgcaactaaaaactttttttgcagctcagcccgcatttgaccacgtcgtctcaatgttaggtggtgcaatgggtggggggttcttggacaattcgattgcagcgattcggcagacggttgaagataaattttttgcaaatctgcaagtggcccaattagccagccaccatcttaaccaacacggttcgctgatttttacttcgggtgctggtgggcggccagataatgcctccggagcgattgttggcaatcaagccattaatacgatggtcgttggacttgccgtagagttggcgcctgactatcgcgtcaatgcagttgcaccgacttggacgccgactggtctttggcgccaactatcggacgcacaattggcggcccaggctgcgaccgtcagtgctggtaatcccttgaaacgcgtggcaacgcccgccgaagtcgcgtcggcgtatgtttatttgatgcaaaatgagtttatgactgggcaagtgttgcacgttgacggtggtgtcgagctcgtgtgagtgacacgactgatgattagtagctgacctaattaatgataagaaaaatgatgcaaaaaagcgcgcgctgaccgttagaaggtggcacgcgctgattgtcaggaaaacttaggcggcatcggtgagttggcaattagtgatactagccattgttagtgtcgtcagtattcaagctttcggtaattaaagtggcggtttcttcgattgacttattagcgacattgataactaaacacccaatctttttgaagatcttgtcggcgtattccaactcggctttaattttatccgtgttggaatacatggtgtcgggattaagcccatattggaccattcgctgccggcgaatatcgtttaacttttcaggatcgttagttaggccaaaaatctttttcggatcaactttccaaatttcgtcaggaatttgagcctgaggaactagtggcaagttggcgactttcaggttacgattagctaagtagagtgacaggggagtcttagaggtccgggagacacccagtaagaccacgtcggcctctaaaaagccactcggattcttaccatcatcgtaagtaaccgcaaattcgatcgcgttgatccggtcgaagtagttggtgtttaacgcgtgtacggtaccggggtgattggacggttggacgtgcgtaatctgtgaaaaagtatctaaagctggtgtaatgacgtcataataaggcaactcgtgcgcttcgcaaaattggttaacgatttggctgagccggcgatcgacaaacgtatgaaagatggcggcgtgttccttcagtgcctgcgacaaaaccgtctggagcagtgagtcggtgcggacaaatgggaaacgctgatagcgaatgtcatagtcggagaattgtgcagcggcagctaaggccacgttatgagctgtttcaccgatagaatcagataaaataaagactttaattgctgacatagaataacctcatttcggttcgataatagtcttagtgtagcatagctggcgggggatgaaaacgatttactgtccgaactgacgttgcttttaacgatttattttaaggaaattgtaaactttggttgacggcctttttcaatttatgtataatttactagaacagttgcgttatgtgtaagtatgcataatttaacggttactttttgagctcggagggagggaatttaacatggcaaaaacagtcgttcgtaaaaacgaatctcttgatgatgctcttcgtcgctttaagcgtaccgtttcaaagagtggtactttacaagaataccgcaaacgggaattctacgaaaaaccaagtgtgaagaagaagttaaaatctgaagcagcacgtaagcgtaagaaccgtcgtcgtttcaagtaattagtattgattactaatgacctaacgaggagggaaaaccaatgagtttaatcgatacactcaatggtgatctaaaagctgcgatgaaggcacgcgataagcaagccctcagcgttatacggatgcttaagtcagcattgatgaatgaacaaattaatgttggccatgatttaacggctgatgaggaagtaagcgtgctctcacgtgaactgaaacaacggcgcgaatcattaagtgaattcgaaaatgcgggtcgtcaagatttagtcgacggcgttaaagcagaaattgcaattgttgagcagtacatgccaaaacaattgtcggacgaagaagttcaacagattgttgctgacaccattcaacaagtcggagctactggtaaaggtgactttggcaaggtgatgggggcagtgatgccaaaacttaagggtcaggcggatggcaagctgatcaaccaaacagttaaatcattattgaattaacggttaaccggagaaacttttctccggtttttttgtttcttctggttgatcagaaatgcagtaccggttgttcagattaagtatcagcaatgggtgcagggactgatctaactgggcttacgttgattgatagcgtgccaatttaatcgctcgaaagaaaaatgctgttcagaaaatcgttgtcgaatgccgaggcgtccttgtactggttcgatgggggcttttatgctatgattaactaacaaatacctgctgaaatcagcgtggttatcacgctaactgcgggtgccattattaaataatggtgattaaatctgtcaataaaggagtccatgtttttgaccgaaaactcaaaatatgaacaaaaatttctcattgccgatccggcccaatcagtcgcgctattaggaccagaagacgcccacttagctttgcttgaggatgggttacacgttcaattgcacgtgtttggggatcaaatgacgatcagcagtgatgacgaggttgctgttcataatacgcaagcagtactagataatttaacgagtttaattaaacaaggtattcagattggggcgccagatgttattagcgctattaagatggtcaaccgggggactttggattactttaaagacctctattcagagaccttaattaaggacaatcgtggacggcccattcgtgtcaaaaactttggtcagcggcagtatgtgcaagccgttgctaaaagtgatattacgtttggtattggtccagccgggactgggaagacctatcttgccgttgtgatggcaattgcagccttaaaacggggcgatgtcgagaagctgattttgacgcggccagcggttgaagctggtgagagtcttggctttctacctggtgatttaaaggaaaaagtcgatccgtacctgcggccaatttatgatgcgttgtacgatatttatggcgctgaacatacgcagcgcttaatggatcgtggtatcatcgaaatcgcaccgctggcttatatgcggggacggacgcttgaccatgcgttcgtcatcttggatgaagcacagaatacgacgaatgcccagatgaagatgtttttgacgcggctaggtttcggtgccaagatgattgttaatggtgatatctcacaaattgatttaccacaccatactaagagtggcttgattcaagccgaacagattttgggcggcattagcaatgtcgcgttcgttaaatttacggcggatgatgtggtcagaaatccggtcgttgccaagattattacggcgtacgaccgtgtggaacaacgctagggggcacttatggatttagaattatacgaccaaacaacaacgggagcgcagccagaacagttgcaattgattcgggatttaattgatcttgctggtcagacgttaaagttacgggatgataccgaggtctcggtgaccctgatgaataacgatgctattcaaaaaatcaatgaacagtatcggggtgtcaatcgtccaactgatgttattagttttgcgatgcacgacgatgacgaggatgatttgattgtgatggatccggagatggcggcggaaatgccactaaatctcggggatattatgatatcagttgataaggttagcgaacaagccgcttttttgaaccattcggaggcgcgcgagctaggttacttggtcgttcacggctttttacatttaaatgggtatgatcatcttcagccagcggatgaaaccgaaatgtttacattgcaacgccagattctggacgcttatggcctcgaaaaatagaccagatcggctacaggttggcaaaaatcactcgttttggcagtcctggctacacgcgtggactgggcttaaaacggttgtgattgaagaacgtaatatgcgaacacaccttgtactgggggcggtggccttgtttgctggctggtgggttcacttgagcgttaacgaatggctgtggctagcattagcgatttttctggtcatcttatgtgaaattaacaatacgattgcagaaaacctgtccgatatgatcactgggcctaatttcagtcccctagctaaaaaaattaaggacattgcggctggggcggtagtgtttgccgcggcctttgccgtcttagttgggttagtgttgtttgcacctaaaatttggaacttaattgtcagttggttaaactagtaattggttaacgattggacaagattgaaaggaattaattatggcagaacaacaagcatttcattccggctttgtggcgattattggtcgtcccaatgtcggtaaatcaacactattgaatcgggtcgttgggcaaaaagtcgccattatgtctgacaaagcccaaacgacgcggaaccgtatccagggaatttataccactgcggatacgcagatggtcttcattgatacccctgggattcacaaaccgcatagtcgattaggtgactttatggtcaagtccgccttgtcaactttgggtgaagtggatgccgtactattcatgattaatgcggacgaacggcgtggtgccggggataactttattatcgatcgtcttaaaacggttaaacaaccgatttatttagtgattaataaaattgatcaagtccatccagatcatctcttggagattatggatcagtataaagacgctttgccgtggaaggaagtttatccaatttccgcgcttgaaggaaataacgttgatgaactactgacgaccttgaagggccaattgccggaaggaccgcagtattatccgtccgaccaaattacggatcatccagagcggtttatcatttctgaattgattcgtgaaaaggttcttgaattgactcgtcaagaagttccccattcaacggcggtcgtgattgattcgatcaaacgtcaagatgaagaaaaaattcacgttcaggccacgattattattgaacggtcttcgcaaaagggcatcatcatcggtaagggtggtagcatgctcaagaagattggctcgttagctcggcgtgatattgaacacttacttggggataaggtctaccttgagctctgggtaaaagtccaagagaactggaaggaccgtcaagacttgctagccagctatggctatcggcaagatgactattagaatcgctaggtgatccggatggcccaacaaatggtcacgaattttaacggcattttgctctttcgccgggactaccgggaacgcgatatgctaatcaagtttttaactgccgagtatggcaagaagatgttttttatccgcggtgcgcgtcggcgtggcttcaaaatggcggcggagttattgccgttcacgatgggggaatacgttggtgatttacgtgatcaaggtctctcgtatattaatagtgtcaagtcagtacagtatcttgaacatattagtcaagacattgctttgaacgcttatgccacgtacgttatgaacttaatggacgtcgcttttccagataatcaaccggtggggcggtggtaccaacagttgaccagtgcgctgcaactgattgatcaagatgtggcccccgcgttggtggctaacgtggtcgaaattcagttattgcaaccgtttggggtggccccagagttgcgttggtgtacggtttgcggtcgaagtgatttaccgttagattattctgaaagttacggcggtttgctctgtcaacagcactggcatttggatccccaccgcttgcatgctagtccagcagcgatcttttatctacgtcagttttccgtgttggatttggctaaggttcattcgatcaaggtcaaaccgcggacagcggcggagttacgccggattttggatgaaatctatcagaactcagtgggcgttcgattgaaatctaaacgcttcatcgatcagatgggcagttggtaccaaccgttggcgccccggaagaatgaggattgacaaacgaacgaccatcagctatgatgatgaagaactgaatagttaagtgttgatgagagaaggttaacggattcgacttacagtgagaccgtgatggtgaaaaacggtcagtcaaagttgttaattggcgctttcggagctttaataccgtgtaattaagctgctgaggttactcagaagtagggtggaaccgcgaaaccaatcgtccctatgtcgttattgtcgacgacaggggactttttttgtgccataagtctgggaatagcgatgcccccgtttcaaagccatcagccgttcagtcactaattttgggaggatactaatgagcaaaaagttatcagtgcaagagattatcttaaccttgcaaaagttttggtcggatcaaggttgtatgttaatgcaatcatatgatacagaaaaaggggccggaacgatgagcccctacacgttcttacgggcaatcggtcccgaaccatggaacgcggcgtacgttgaaccttcacgtcggcctgccgatggtcggtatggtgagaaccccaaccggttgtaccaacaccaccaattccaagtggtcatgaaaccctcaccagaaaacgtgcaggatttatacttacaaagcttggaaaaacttggcattaacccgctagaacacgatattcgtttcgtggaagataactgggaaaacccatcaatgggttgtgccggtgttggttgggaagtttggctcgacgggatggaaatcagccaattcacgtatttccaacaagttggtggtcttgaagttgatcccgtcacttctgaaatcacctatggtttggaacgactctcatcttacattcaggatgtaaactccgtatttgaccttgaatggggcgatggcgtgaagtacggcgacatcttcttggaaccagaatttgaaaattctaagtacgcttttgaagatagcaacgaagaattattattaatgttatttgatgaatatgaaaaggaagccaagcggcaaattaagaacggcttagttcaccccgcgtacgactactgtcttaaatgtagtcataccttcaacttgatggatgctcgcggtatggtttcagtcacggaacgtgccggctatttagatcgaatccgaaacatggcgaagtcgattgccaaggaattcgtggcgcaacgtgaaaaacgtggcttcccgttattaaaacacgcacaggaggagacgaaataatggcgaaaacttatttacttgaaattggtttggaagaaatgccggcccacgtcgttacaccgagtgtgttacaacttaaagaacgaatggtcaagttcttaaaggatgcccggcttgattttgaagatgttaaaaccttctcaacaccacgccggttaacggttcaggtgttaggcttagctgacaagcaggctgatgtgaaaaaagaagttcggggtccagctaagaagattgctcaggatgcggatggcaactggacaaaggcagcgattggtttttctaagggccaaggggcgtcaactgatgacatcgtctttaaagatgttaagggtaccccgtatgtctttgtacaaacatttacggccggtaaaacggcggccgaagtgttggcggccggaatcaaggatgttatcaccaagatgaatttcccaacgatgatgaagtggtcgacgtacagtttcaagtatattcggccgattcgttggatcgtgtcattattagatgacgaggttgtgccggttcaaattctggacgttgcggctggccgtgtttcacgaggccaccgtttcttgggccatgacgttgaaattgctactgctgcggactatgaagctgacttagctagtgttcaagttattgcggatgccgctaaacgtaaggcaacgattcgtgaacagatcgcagccttggcgaatgaacgcgactggcaaatcaaagttaatgaagacttgttggaagaagttaataacttggtggaatatccaactgcatttgcgggagattttgataccaaatacttaacgatcccggatgaagtcttgattacttcgatgcgtgatcatcaacggttcttctacgtaacggatgccgaggataacttattaccacactttgtttccgttcgaaacgggaacacggatcacttggaaaacgtggctttaggtaatcaaaaagtattgacggcacgcttagaagatgcagctttcttctatcatgaagatcaacaacactcgattcaagaatatgtggaacgactcaaaaaggttagcttccatgataaaatcgggacgatgtatgagaagatgcagcgggtcatggttatcagtgattttttggctgatcggtttggtttgactgagactgaaaagaaccaactccaccgggcagcgcaaatctataaatttgatttagtgacagggatggttggcgaattccctgaattacaaggggtcatgggtgacaagtatgctgtcttgaagggtgaagatccagcagtcggtcaagctattcgtgagcattacatgccaatcagcgctgatggcgacttacctaagtccaaggtcggcgcggtgttagctattgcggacaaagttgattccattacgagcttctttgccgttggcttgactcctagtggctctaatgatccgtttgctttgcgtcgtcaagcgtttggaatcgtacggatcgtacgggaacaaggttgggatttcccaattcgtcaactcgaggccgatattcaaaaggaattagtggccaatgatgctacgtacaacttagacttcgaaaagcaaacggcaccagttgctgatttcttaacggatcgcgtcaaacaatggtttaacaaccgtaagattcgctacgatatcgtcgatacggttatcaaagggagtcgtcaggatatccgtgaaatgttcaaagcagccgatgtgctgaatgcgcatcaagatgatccgcagtttaaggacacaattgaagcctttactcgtctgttgcggatcacggcgaaagctaagctggcagccggtgatttgactgttgatccaagtttatttgaaaatgaagcggaacaacacttgtacgatgctgttcttgaattgcaaaagcaatttaccccagcgatgagcatggaggaccgtttcaaagccctggccgccttacgaccattgatcgtcgattactttgaacagacgatggtgatgagtaaggatgaaaaggtgcgggataatcacttaaagcaactcttgacgatcgcccaaatgatcaacgtgatgggtgacttgaatcaattaatcgttaaataagcacggactgtggataatcaaaagaagttacagcaagcgcgctgtagcttcttttttagtttgctgacaaacaaatttgacaaatatgtctaataagggcaacttattattgcactgctgtcaaacttgtggtaatatatattctgtaaaagtttgcacgcacaaagtcgcatccaaatttcgtgatgcggcttttgattgcggcaatgatttggttggtttgtcagactttagttagtagaaatggggtggcaaagtggccaatcgaattcccgaggaaaaggttgagcaagtccgctcagcagtcaacattgcggattttattggacaatacgttcagttgaagaaggctggtaagaatttatttggcctgtgtccctttcacgaagagcgcacgccatccttttcggtcaatgagcaaaagcagatttttcactgttttagctgtggccgtgggggcaacgtgttcagcttcattatggatctcgaaaacttgtcttttccggaagcagtcgtcaaggtggccgattttgggcacattgacttgccggcgagctatacggcgcagtcacaaccggccgcacctaaggatcagcaacaagccgatctgttaaagttgtacgcggatagcgctaagatgtatcaacatattttagtgaatactgaactgggtgaaccggcgcttaagtacttgcacgagcgcgggctggatgatgagacgattaaaacgtttggtatcggctatgcacctgctaatcagctcttgttagatttttttaaagaacaccagaccgactaccaactactacggcagtcgggactgttcattgaaaatcaagcgggtgacttacgtgatcgcttcgttgaccgggtcttgtttccgattaaagacgcgagtggtcgggtgattgctttctcaggtcgaatcctcaaaaaatcacctaatgaacctaagtatttgaatagtccggaaacgaagctgttcaacaagcgttcagtattatttaactttgacttagcacggggccccattcgacaacaaaagtcggtggtgctgtttgaaggctttatggatgtgattgcggcttatcgttctggtattcagaacggggtcgcatcaatggggacgagcttaactgatgagcagatttacatgcttgagcgcgttaccgacaccttatatgtctgttacgatagcgatatgccggggcaaaaggcgactgatcgtgctctgaaattgctaggtggtaacagtcgccttaatctgggtgtaatccaaatgcctgatgggatggatcccgacgagtatttgcgtgctcaggggcaggagaagtttgtccaagtatttgaagatggtaagcaaacgcccactgcatttgaaatgcagtatttaaaacatgatttgaacttgcaaaacacgcccgatcaattgacttatttacaggcggttttgcaacaattagcacaactgtcctctagtgtcgaacaggatttatatttaaaccaattagtggcggagtttgatcttgataaggatgatttaaagcaacagttacgatcactggtcggtcagcaggccgttcgacgtggtggtcactcggatgaaccgcaagtagctccgccaccagcacctgcgccgctagggccacccccagccacggtggatggcagtacgaacagtggtccgttaagtcgggtagagaaagcggagcggttgttactgtaccgtttgttgaatgaccacgatgtttggttacaggtgatggcgattgctggttttcattttgttcatgattcgtatcaacaaatcttggtgtatgcggaggcttattttaaaacgcataatcaatttgatttgggcaactttacggattttatgacggattcagatttacagcctgtcgtcacgagtttggaatttatggacgtggccaatgaatcttccaaggaagagattgctgatctagtcaatgtgatcatgaatcaacagccgctggtagaacaaatcaacagtaagaaggccgagttaacggcagccaagcagatcggtaatcgtgatttggttcagcagttaacgttggcattaattgacctatatcggcaacaacagcaggtccaacgagctgataactaggcgtgaaaatgatatacttaaggttggctcggtattgcaaccgatcagctggtagatgcatactaaataggaggctactacatggcaaaggcaaaagcaacgacggaatacgacaaagccgttaaagcattaattaaggaatataagaaaactggtagcattcaatatgatgaattatcagataaattagcagcgccttacaaactagatgctagtggcattgataaattattacaaaaggttgaagatgctgggattagtgttgttgatgaaaaaggtgatcctgatgctcgagcggtcaaaagtgtcaaaaaagtttctaagaaggaacttagtgacgctggctcggcttctggaattaaaatcaatgatcccgtgcggatgtatttgaaagaaattggtcgtgtcgacttattaacggctgacgaagaagtcgctttagcactccgaatcgaacaaggtgatgaatctgccaagcaagaattagccgaagccaacttacggttggtcgtttcgattgccaaacgttacgtgggtcggggaatgcaattccttgatttgattcaagaaggtaacatggggctaatgaaggccgttgaaaagtttgattaccgtaaaggattcaagttctcaacgtacgcgacttggtggattcgccaagcaattacgcgggcaattgctgaccaagcgcggaccattcggattccagtgcacatggtcgaaactattaacaaattaattcgaattcaacggcaactgttacaagatttagggcgcgaaccaactcctgaagaaattggggctgaaatggacatgccaacggaaaaggttcgtgaaatcttgaagatcgcacaagaacccgtttcattggaaacgccaattggtgaagaggacgattcacacttaggtgacttcatcgaagaccaagacgcaacctcaccagcggatgccgcggcttatgaattgttgaaagaacaactggaaggtgtccttgataccttgacggaccgggaagaaaacgtcttacgcttacggttcggacttgatgatggtcggacccggacactggaagaagttggaaaagtcttcggtgtgacccgtgaacggatccgccaaatcgaagccaaggcgctacggaagttacgccacccatcacgtagtaaacagttaaaagatttcttggaataatcaccagatgatgacgtctgactaaccagctaaaggtgctgattggtcaggcgttttttttgcttatgtagatgttaaaacgtggtggacactgatttaagccgcaacccacgtcttaatgccatattgacgaaacgtgttcgggtccgatgagccttccgggtagcgacgcgatgagtttaccgctcaacgccttagttgggctaatcctcagtctcaagccgtctgaaccacacactctggcagtgctgagcattggccgaaatgccttccagttgggaaggtattcgaatggctgacagggatgtccccaacttttgctggcttggtcgttgctattttagagacagcaattttatcagtaactgtcagtttgataatcgaactgtgattcgttcattaattctcagtcaccatattatgactgagattccaaacaactgagaccacattaacgtttgttcaatgttccaagcagtaattgaattcggcgaccaattgcactaagttgagtggccgttcatctgtcatgcgagcaggggtcccggaggtcggaataggatgaacaaacactgatgaactggcaaccaaatttaagactcttttcagtaatttggcatactgtaatgatgtcgcactcacgtttgaggtaatcattttgtgccaggaatatgattgttgagttgtcaaactcaaattagtatgttagtgtactagttgtagtaatacacgtagtacacaagaccgaggtgataaaatgccgtttgcaactaatggggcaccgtattacgaacagttagttatgcagattaagcagcagatcgttcaggaagtcttacgaccaggggatcaattgccttcaattcgagcaatggcgtcagaaatgcaccttaatccgaacacggtcagtaaggcttatcaaatattggagcatcagcgagccgtgtacactgtaaaaggtcgggggacgtttgtgagtgaatcgagtcagattgcaactgattcgaatgcggttgatgatcttcagacgcgcttacaatcactgttaacggaagcacaatttttaggaatcagtgcgcagcaagttcaggcgtgggtgaccacggcttatcaaaagggggagtcacgggatgagtatccaagttaaagcattaagtaagcggattgataatcgtgaaatattaagggggattacttttacttggcagccaggtcgaatcgttgggttggtcgggcggaacggcgttagaaagacgacgctctttcggacgatggctgatcactatttggcggacgaaggcgaattagtgattgaggggcagtcgactttgcagcaaccatactgtcggcaaaaattattttatattgatacacaacgtcacttttttggtggtcgacggttgcgacagatcataacgacatacgcgttggcttacgatgactttgaccaatcgcaactaacagcgttattagcggccgagcatttatcaaccaaaagctactaccagcggttatcaaagggccagcagatgttatttcaaatcttgctagcgttagcgagtcacgtgccatatattattttggatgagccgtttgatggtttggatatcatcgtgcgcgagcggattgtagcctatatggttgaggaggtcgccgaacacggcgtcagtttcttgatttcatcacataatcttgatgaacttgacggtttatgcgaccaagtgctgtttttgcaacatcatgaattagttgctgattacgacctagaaagtttacgggcaacggcccgcaagtttcagcttgtttttgcagataagcatataccagcggttgtgaaagagcatggacagctgattaaagtttacggtcgggtcttagaagtgtactttgcggactacacgccgacaattgagaccgcgctccaacaaactcaaccattgatgatggccgtccagccgttgaccattacagatgttttccgagttaaattgggcgaccggcaagctgtttggggtggtgtgtagaatggcaactgtaaaattgagacggttatggtggcaacaaaatcggccttgggtgcgacttgtgacggcaacgtgtctgttagtgagcttattaatggcaattaatgtgacacatacttggcaggtggaacatgcccggagtgtacgtggtgaacggatcaacgctgcggattttgttaaacacccgaaagattataaagttgccggtcgtccggcggttagcctgcatgtttattatgaacatcttgaccagtttttttggcctggcgaatacacttctacggatcccaatcaggcagtgcgggcccaacaacccaaccgtttgtattatgttttgggactcgtcagcggtttgctgcttgcattctggggtcgtcgcacacaccgtttcgagtttatggctgggttaggtgttacgcgttggcaaatttggtggcaacagctgcggctcgggctgctattaatggtcaccgtttttgtaagtcaagtgatttattacggctggatcacggctgcaatcccccaagtttatcagcaataccgtaacggggccgccctcttgggaagtagtgtggcagtgacgatggtcagtgggtgcctaattatgcttgcttggctggtggggagctttaatcagcggttatggttagcaatcctgatcagcactctgacctggcgttgggcgtcgggaatgttaacgcggacaaatatgtggttgcggtggtttcacattcagtcgttgcctagtatctggttacatgttcactacggggtagcggcaatcatggcattagtgggcttgctgatgctactaggattaacttgggtggcctgtcatcaatggtcagcggatatcaccacattgcggcaacaatcgctatttaatggggttatcgccagtgctttgattagtttgagtattggctcaacacttggggacatcctactactgcctttgatgggaacaattgcgccgtggtatgaattggtcggaatcgtgctgactatgatggtaatgctcgtctatcgtgctggccgtcgttaccatcaactgggggaagttgtgagatgaataaaaaattggggcacttgattatttggcagcatgcgccacttctcattggtatgctgattttgtttatagcactgggggcgtggactggcttcagaatgaatcaacactggcaaatgctagatcagaatcatgacatgctaatttcaggtcttaaatacgaccaccggcggcaacagtatcaggatgtagatggcttagtagcaccttcgaaacagcagtacttgaatcaatatttacaagtttatcatgctgatcggcggggattattggcgaatttgcgcgttgggagtaatgttgaaccaaatgattttctatggggaatcagtattttagtgggcatagcactcattgccattccacgttaccggcatcagaatgagtggttacagagcttaggatttcgccgagcagctatttttggtgcgacgtttttgagctatagtttaacgacgatcattgcgtatagtttggcgaaattaatggttctgctggtgctggtacagaatattcccggaatttatttcgcgcaattcaattggtgggtctggggcggcaatgtaatcagtaccacgctcgttgcactgattttgatgaccgcttctgcattagtgttattggtcacgcctaacctggtgatggcaatgctcgtcggctatgcagtcgttaaaccaatcagttggtttgtattgatacggtcattcggtcaacctggtaattatttgttggcgttcctcaatcaacactggttgttgggtatcgcaattggatgtctagtctggggcttgggcgggatacttggtcggtatttgagcgcccagcaaaccacggagcgtaaccgccaagcgattttgttaccggcttggcgggtaccaatgctgatagggttgagcatcatactgactaaattgattaccgacgttatgctggcaccacagacgagttggtcatatgtagcagtagtttggtcagcaacattaattggtctgattgcttggatttatcaaccacgctggagtcgttacttttggcaagttgtgcgccagttacgctaatatgatgaaattaacaattaatcgataaagcatccagccggtcattaatcttatttgaccggctggatgcttttaaacgttacgggtttgaaaagaatagttggcaagcgttaagaataacagtagataggcgatataaccaatcgtcagcgtggatagatttagtcgggttaattgttgtagctgtggtgtttggatttgctcgcctagattgatcatgttgagcggattccactttaaccagctgactttggcgtataaataaaaacaaagttgattgaaaatggtcacaataaagtacccaatgatgccggtcagaatggctggtgttgaactggtgaatagggtgcccaatagtaagacgacactcattaaaaatagtagggtcagtcctgttgatagcatgttcagaccccaagtgtgccaaattgtaccgtaattaggtaagcgccgaaagaagctcaacttcagtccgagactcatgagggtgctaaagccagataagccaatcatcagaccgagtatcgtgagccatttgctgactaagacttgggtccgcgaataactgcgataaagtagcgctcgtaacgtgccattttgccgttcattcgttaaataagtgctgccaattgtgattgtcaaaaatagtatcggaataaagccgtagtcgttgtttacaaatgcatcatatggcgttagtagctgtgggtagtgagcggcatatatcgcaattatgaattgaaaaatcattataaatggaataaacagttgaatcacacgatggtgcattaattttcgattttcttgtcgtaacaatgtgaacattagattgacctccttagtggttgaccgttttcagcatggttaataaggatgattctaagtcttcagtgtggggttgaatccgctgtaactgaatctgattggtcaaaagtagttgcagtaatggattaagctgaaatccgggcgttattaagacacgaattggtgttgctgcaactaggtggtatccagcagaacgcaatagctgataagcccgttgatcttgattagttactaattcataagtggggcgctgttgggcaagaaacgccggcatgctcatattggcgatcagttgcccgtgatcaagaactaagacgtcattggcgacccgttgcagttcactcaggagatgacttgaaattaaaaaggtggtgccttgagcttgcgcccatagaattaaatcgcgtaattcttttgtggcctgtggatcaagaccattcatgggttcatctaagatgactagtgcgggctgattgagcaaagccaaggctacacccaatttttgccgcataccgagtgagtagtgtttcgttagtgtatcggcaaatgcttgcatgctaagtgcttcaatgattttggtaacgcgtgcggtacgattggcaccggttgcaaacagtgagagttgttgccggccagtcaagaatgggtagagtccgggatattcaattagggcgcccacagcgcttaaagcttggtgatggcatggcgcaattgactgaccatttaaataaatctgaccagtaaaggaagtgagccctaagattgatttcatcagtgtcgttttgccagcaccatttgcaccaactaaggcgacgatatgccccttttgaatggtgaaggtcagggcttttaaaatgtgctggtgactgaagtattgatttaattgcgtgacggtcagtagtggtgtgttcatattggaatccccctaaaccttaagcggctaataataaccacttcaaggtattttacaaacaaagtatactattaatcacagtgtaatagtgtagtattacaccatttaatataatcttaattattacttgttgtactcgttattatttagcaataactatggttaaaacgtcttgattttaaaattcagcaactgccggcttggatccaccggaaacagtttgagtttgcaccaattttcggtggattcttaccacgctaactggaggcataattatcagccattcgagtggttgaccgatgggagcggcagggtgacagtgctcagtagcccaagctgacgagcaggagtctgattgactgtcacgttttaatcatgattcatgtcggattaactaagtgcattaattattccattgatacataagtgctaatttgacaaactgacttaatctgacatattaattattagcgaaattaaaaacacggtctggtcggtagtccagacgcagcaacggctgtcagtaacctgccttccttggttgtccgaatttcgttagtgaaattaaggaggggttaatttgattaaccgatgcaaattaacggtgttttttgatcaacaattttatcagggtgtttttgagcgttggtcgacggacgggtatcaagtcgcccgagtgacctttgggacgcagaatcctagtgaaccccagattaggttgttaattcaagatcggtggtcaacgctgcaatggacgacggctagtgcggttgctcagcagcaattggttcgcgagtatcgtcgtgcggcacgacaatgtcgtcaacatcacgttcgattcaaaccgactagagcaatgcaaatgttgaagttagaacatcagcgtaacttggtaatgaagaagcggcagcagcgtcgtgcccgacatgaccatgctcagttgatacgagcaaagcggttggcaaagcatcgtgctcaacatcgtggccattagttgacgagacactcacttagctaattttagttaagtgagtgtttttgacagcatcaaaataaaatcaatcagttttgaaccgcttcgagatttgataccaatgattccgggctttgaggacggactattgattgttaccaatgaggcgttaattgcagataatcggcaaatcaaaccagctgcatcaatacggtcgcatgatttacagctcgtgactgagatggttgctagcgattgagttatattgcggatggttgctgagattgtgcggctcaagtcgattttcaactagcttgattctcgacacttgccacaaagagttggactgccgaaattggatgaagtgattaaagttatcttattgagggttgatgaagatgcagagtatgcgcttaagtacttaactgctggcaactgagacgttgatgactgttcagcataccacagaaggtaatcttgatttgattgctattagggtcaataaatggtccacctgcaacgactggggatccagcgctaagtggcgtttggtagcgatgaaaatgatcgacaattactacaacatgtaataacgagcatgtgggtccaaagtaaatcaattaggagaacaattaacggatagccgatgttcacctgcattagtggctgaaaaaattcgggcactggcagactaacgaattggcgtgaacacaagccaaaaaacacgatcactagccagtgaccgtgtttttgtttgataattctggaaattagttgttcgcgtcagcggctggtgtcatccaatcaacaaatcgatttgcatgttcggtaaagaaatttacgagtcgcccagttaaaaaggctgcaatgagggtaccttcccgaacccccgctaaagaatgagtaaagctgagtgccaggactagtgaaatgccaatcagaatgaaatcattataaactttgactttggcaaacttgagttgatgcatcagtgcgatggcgtttggaagtccttcaccaggcatgataatggcgtgtgaattgacttctaaaaagacacctaacgataagagcaccgttcccattaagacaagtccgagttgctcgatgtatgtttgattaggaagactatggaaaaaccgcacaaaagcatcgatgaaccaaccgaacaggctacccggaattaattgtaataagttttgccaggagaactgccggcgcaaaacgatggcttctagtagaactaaaatgaaaataaaagcaattgtcaactggccaattggaattgccgtaatattgctaatgacattcggaatacttgaaattggggacgttcctaataaggataatttagagagtgcgacgccagctgacatgcacaggataccaattacgaggactccaaagtgtttaatgaattttttcaatgacgatttcaatctcttttctcttgtaaggtgaggtaaacttgttgtaattggttcgtaaacacttgctcgttgacttctggatgagcagtgaagaagtcatgccaccagtcaatcaatgttttcttaatggcgatagcaatttgttcaccagccggtgtcaagttaattcgtagactacgctgatcggcaggatcacgaaaccggatgacgagttggcgttgctcaagttgacgaacagttcgagctaataaactaggatcgagcatcagactggcagccaagtccttttgagtttgggccgggtgatcgtaaacaaccagtaataagtcactttcggtcgcccgaatgttcagcgcctgtagttgggtgttgatgctgtttttggattcgcggtaaatacccgcaatatatttagttagactaaaatattcgatagtcagcactccttttttataaatagtggacaagtctattatttataaaaaaaaagaccttgtcaagtcagtcgtttaatgggtcacagttgtaagtcatagttaatagtggatatggacggccctgatcatcagttggttggcgattagtgacttggaaaccacggtgttcataaaattgacgcgcccgtgggttttgttcattcactgtaagcgttgtggcaccataatcctgaatactagtttgcagtaaggcggttccaataccagcgccactagcggctggggcgataaaaagcatggctactagtgaaccatcaataccgatgaaaccagttggggtattttgatcatccactgcaacgagcagttgtggaacggttcgtaatgctgtggggacttcgtgctcaatggttgtgatttcagcgggcgttagaaagtggtgactggcgtcgacggactgtcgccagagttgagttaattggctaatcaattgcggagttcgctcggcaggcgggaaagacttaattaacaatggtcgacctccttattttcgttgtgattgattaagtttaacataagagccggtgtcagtgccaaaactaatttaacggttggaatgacctttgaatgtattgaacttttgatggactaatcattttccaactggagaatggcggattaaagacatacatacgtaggcgagtaacaactaaacgaagtgaaatcacagttaatcagcgaccaccctcagttaggaatggcagatcaatcgacattgtattggctggctcgtatactagcgaaaagtggattggatgtgttggaatgaaatttgtaatttttggcggtgaattactggtgttagctgcctggctcatttatggtcgaacactgccattgagtttgcgtatcattggtgttattggaatcattatcgtttcgcaattggcacattgggtattgaaagcacggtaactagcgttattaattgtgattcaaatgagcttttgatgtaaatccagaagctcactttttgtctgggttattttctaaagaattatgctaacttatcaatactgttgaaataatgacatttgtcacctgatcattatgacaaacgcgactactcgacccgattacgttggcgtacactatagtcattaaaggaggcggggataatgacaccgttgattgaagcaactaaggtcgcatttagttatggtcaacagtcagttttgactgatattaatatgacgatcatgccgggcgagattgttggcttgattggtgaaaatggggccggcaaaacgacgttgttaaatttgttattaggaatcaaacgagttcagcagggccatctcaaggtgttcgggcaagcggccggtagcctggcggcgcgattaaagattgggtcaatgatgcagggtgatatgacaattcaaggcgtgacggtgcgtgatatgttaaggctagctgcggcacaacgtctgcctgaatttgattggcaagcattattagccaccttgaaactacaagacatagcccagcaacgcttgacggcgttatctggaggacagttacgacgagtcacctttgctttggcactggtaggtgatcccgatttgttatttttagacgagccgaccgttggcatggataccaatgcgcaacagacattttggcaacagattaggcgcttgaaggccgctggtaaaaccattatcattaccagtcattacctaccggagattgaagccatcgctgatcgaattatgttgctgaaggacgggcgctttgtctttcaaggctcgtttgccgtgttgcaaaaacaataccaacaagtggagattcgttgccaaacgagactgccagcggatcggtttacaaatttaacggcagtaactgcggttactaagcaaggcgacgaactacgcatgagtagtgaagacggtgacgctacgctgcaagcgatgatgcccataatcagtgagttgcatcaagtctcaattagtcgtgaatcattgacggatatttttgttcatctgacgaagggagtctcagcatgaaaattttaatggctcaactgagatttgatgcacggcgtttgattattcgaaacgcagcgtttcagttttttgccttggtgatgccagcagctttttacttgttatttacaaaagtaatggttaccggtggcacaacggctcaaatcgcactttttaatcggtcttatatgggcagtatgatcgtttatagtgggacgatcagtacgctgttcagtattgcccagattctaatgcatgatcgggaacggggactattacggtggctacggttaacgccacacggggtagtaccgtactatcgttcgattggcatgatgagtttgggaatgaatgcgttaacggtcgttattttaggcgcgattgcggtcgttgtgaaccacgttgatttaaccgtggttcaatggctagggatacttggaattgctctgattggtcaattaccgacattgcttatgggcgttggactctcatttttgaatcgtgccgaaacgttgagtgtcgctagtaatttaattacctttccaatggccattattagtggtctatggtggcccattagcctattaccaagctggctacaggtgattggtaaacgactgccaacatattatgtgaacgatttgttggtcaactggggcacccatggtacactaaaattaatcgatttgcttggtatcgggctgtgggtgtgcggcctattagtgattgttagttgggtgattcagcggggacttaaacgggggaatggcgttgttgacgcatcataaaaataaattgaagacgattgaatggacgagctacgtgtggctcgcctatttgccgtatacaattgcggcttacatacccgttaaatcttggcatgattggctttggctattgcttgttggtggttttcttgtgttgtacatcttggttgtcgagaagccacattggcgtgcagtgacgatgccagcggagttagttgtgacgggactgtttgcggtatttgcggctaacaattttatgatcatctttcccggctggcaagtgagctttttacttggtcgtcgtcctaaacgagaattttatggttttgctttagggtattatgcctttttaattggtggctgtatacgagactatttacaatatcctggtgtgtttgggtggcataatggtgacgtgatgggcttagtttttccattgttatcacccatactcgcgtataccttttcgtggtcagttgaacgacagcgccaactcaaccaaactaaccgccgattaaaaacaattgtggaacgtaacgagcgtgaacgaatcgcgcgtgacttgcacgatacccttggacaaagcttttcaatgattacactcaaaacggaattagctaaaaaattactcgtcaaagcaccggagaaagtggcaccagaattggacgaaatcgaacaaaccagtcgccaaaatttacagttagttcgcgaaatcgtcaataatttgcatgaacaatcgctcacagaagtcctattggcccaaactcgtaatctagcagcggttggtgtctggacgacgaccactggtgagacacaggcaaccaagtggccgacaacggtccaaagttgttttgcggcggtgttagttgaagccatgaccaatgtgatgcgccacgcacacgcgcacgaggtgcggattgattttgtcgagacggcaaaaatttatcagattaagctgaaagatgacggtaaaggtggaaccttgattcgtcagggcgccaacgggattgccgggatgcgaacccgcttgcaagctaaacagggcacctttgccatcacgagtagtcggcgcggcacccagttgatcttaactttaccaaaggagtagtgagtcagcatgataactttatacttagcagaagaccaaagcatgttgaattctgccttgacccaattactggaattagaagatgatctacacgtggtgggtagcgcagtagacggcataaacgcctggcaggagttgcaagaactgcaaccggatgtcgcaattctggatatcgaaatgccagggataaccggcttggatgttgctgatctattggacagttcgcagctagccacgaaagtaatagttttgacgacttttgcgcaacgccgttattttgaacgagcagttaaagccaatgtcgcgggatatttgttaaaagatagtccgagtgatgacctaattgatgcaattcgagctgtgatgaccggccgcaccatctatgcgcccgagctagtcacgaatatgttgtcagcagacaacaatccattgaccgaacgggaactagcagttttggtcgaagctgagaaggggttgcccacgaagacgattgcggccaatttatacttgtcagcggggacgacccgtaattacttatccgccatttttagcaaattgggggttcacaatcgattagaagcgattcgtgtggcgaaagctaatcagtggttgtaaagctaggctgtttgaacgaggggccaactaggtttgttttcatcaacacatatacaaatgatttggtgcgcgatataattaattgaacagtggttaatgttgagcccacttactaattacgtggcaaatctggaagaatggaagatccggtaagatgaaagtaatgatcatcggtagtacccacgctggtacggcagcggcacgcgaaattttaacacgtcatccggagacggcggtgacgatttacgagcggaatgataacgtttcgtttgtttcgagtgggatttatttgtacttaacgggtgtcatccaacacctggaagacatgttttacacctcgccgtctgacttgaagcagttaggcgctcaagttaagacccgccataatgttttacgaattgatacgggccataaaacggtgcaggtcgccaatatgcagactggcgaagtctttgatgacacttatgataagctgattatggcaactggttcatcagttattgtgccaccaattatgggtatcgatcatgagaaagtattactgtgcaaaaactacgagcaggcggaacaactttatcaatctctacaggccaaccaacgcgttgcaattgttggggccggatatatggggaccgagttagcggaaagctatgctagtatggaccaacaagtcatgttatttcattcgcattcacatattttgaataattatcttggcccccaaatggcggatgctgcaactaaactcttacaacatcaccaggtcgatatccacctcaatgaacgggtgactggattcgcaagcggttcgaatgatcagttgatcgttgaaaccgcgcagggtgattatgaggttgatctggccgtcgtttgcgcgggctttatgccgaatacggaattgttacgcgggcaggtcgctatggaccgccatggtgctatcttgatcaatgattatgttcaaacctctgacccggatatttatgcggctggggatgcttgcgtggtcaattataatcccacgggacagccggcgtatacaccattggcaactaacgcactgcgccaaggtgcgttggcggggatcaatgttttcggagatttacagccgtacatgggaacgcaagccacctcagccatgcaattatttgatcacacgatggccacaactgggttgacctatctagccgcgcaaagacgagaactaccagtacgacacgccgtctatcaaggcaattggcggccagcttatatgccgacgacggccaaagtcacgattgaactagtttataattatcagaatcgtcagcttctcggcgcgcaattctggagtcgtcacgacattgcccaagctgcaaacacgatctcagtaatgattcaaaatcagaatacgattgatgatttggcttacgtggatatgttctttcagccgaattttaatcaaccgttcaactatttaaatttggtggggcaactagccgtcaaacaagaatatcagcgaggcaatcaaacaccacgaattacagctcgtggtaactggtcgaatagtagtgataagcattgacctaacgtaaagcagcacaggcgcattaaatcacagacttgggatcatttcccaagtctgtttttatgccatccaaatgatgaaagcactgttcgtcatcccataattgttgaaaaagcttgacttacgctgacaggaaccctgtataataggttccaatcaaaggtggggatcaggacatgcaagtaaaagtgaaatggctgtcggggttgctagtggttttgctagtactggggctcagtggatgtatggcacaacaacaccgcatgaagtatgtacagtcaaatacgcctacgttatttttccacggtggcggtaataggtatcacgccgaggcacagatgggacaagcggctgaaaatgcaggggtgacaactagcgttattcgggcgatggggcttaaaaaagggcgcttcaggaattcgtagtggattcttgaagcgcccttttaaggctttaatgcgtcgtttgacagtcaatgtggcgattggtcaattggctgaggctggagccgataccgtattaagcttcagtgccgacgttgatgatgagcttaccagcactgtgactgttttcgctataccggtgggcggcttggagaccagccgtactaaacggaaagacttggtcgatgatgacttgtaagtgtccttcaacggcgagctgccccaagatggctaactcccggccgttgggttgtaaccaccagctggagacagtgggaccttgggatttttgagccgccgttggttgcccatcaatcgtcacgagtcggccagttggctttaagattgccaagccctcatcaatggcgtcaatggtatcaaagacggcatcgtagtctgtaaggacatcttgaatagccgtcgtgtggtaatcaatgacgtggtcagcgccgatttgcttcaacagcgtatggtgattggcgctcgcagtagtcgcaacctcggcaccgaggtacttagcaatctggatggcatttaaaccaaccccgccagcaccggcttgaattaagactttctcgccagcttgaatctttaattggtcatgaatgacttggtaagcagttagccccgctaacggcaaagcggcggcttgttcaaaagaaagactggctggttttagtgctaacttgtcttctttgactgcggcatattcagcgtaggtcccgcgccggccatccgcataaatgtctgggcgggcaaagacttcatcaccaaccttaaagttggtcacggccgcgccagcctcaacaatggtcccagcgacgtcccaaccaaggacaactggcattttccagtcaaacatgcctttaagcaacccttgacgagctttccaatcgatggggttgatactcgttgcctgaacggcgactaagacctcgtcctgatcaatgctgggacgttcgatagtggccatctggagttcttcgggcccaccgtactgattaataatgactgctttcattttaaataattcctccctgaaactgaataacctagcttagcattttagttgtgctcaattcaattatttagttcgaattagcgtgaattagatgcgcgtcgtcttcagcagccatcaattgggtagtgtgttgtggtgattggtgagagctgagtcgatactgttagtcagtaggtatttgttgctgcaggtctgtcgccagttgcgttaaaaaggttttggcggcttccgacaagcgttgtcccttagtccagactaggctagtgcgggcggttattcgaggtgttagtgggatgaaaatcaaatcggattggttcgtattgatgatgccatcaatccctaacgcgtacccgacgcccgcagaaactagtaacgaggcattatagagtaaattataagtggcgacgatggtgaatttgggcgtgctttcaccataccaatcctgaagttgattgatcgtaccgtgttgtgcagaaacaatgatcttttggccttcaagatcagctaagctaatgtaatcatggtcagctagcggcgaatgccgcggaaccagtaatccccagcgactttcgccgggcagatggataaagtttaagtcgtgtttgtcagttggttccgtgacgattccaaagtcaaagttcccggttttgaggttggttcgaatctgattcgcattactactcgtcacattgatcctgattttcggatactgttgttgtagtttcttaatcgactgagcaatcgtcaaaaaactgcgcatctcggcactccctaattcaatcgtgccactgatttctttggctgtattaatgttggcaagcgtcttatcggctaaggcgatgatttggttcgcctgcgtggcaaagtattcaccactactcgtgagactgatatgacggccattgcgttcaaatagggtcacgcccagctcatcctctaaatcctttaattgtcgtgaaattgttggctgcgagacgtgtaagcgttcagcagcccgactgatatttaactcggcgaccactgcttgaaaataacgtagaactcgtaattccatctaaagcacttctttctattacaattaagtataattttaaataccatataagcattcgacatggttgctgtcaagctttaagatgaaacttgaggttagtgcagaatagttggttattcagagaataacgtgtcaagcatcaaggcagggcaccatttaaccgaagtgctctgaattaagcaccactattttgccagaatggaggaatgttaacgatgaaaaaaagtaatcagcccgtagtgtcaaccactgtaaccacgatgcagtggtccagagcacagttagccgcttttagcacggcggatgattttcaagtctccccattttacagtgatgggcagacatacgggacaccgacctggatttggtcggtcgtggtagtgcagcaactatttatccgtgcttggaacggtccgcgctcacgctggtatcgatcggccgtaacccaaagggctggccggattcacttggccgagagcaatcatctggtgaattttgtgcccatttgtgatgaacagttaaataaccagattgaccaagcttatcgacaaaaatatgccggtagtccgtatttaatgccgatgctagcaagtggaccgcggcaggcgacggtccaagtgatgccacgaatatctaagaaaggtgaatagaaatgactaaaataatgattattggtgctaatggtgggattgccaggaagctgacgcaacggttattagcagaaactgacgatgaactggtattgttcctacgtcgagcggaacgtttagcccagtatcgggagcaaccacgggtcacgctgattgatggcaacgtgcttgatacggatgaacttgccacagcaatggcaccggtggacatagtctattccaatgttggtgggactgatctagcagcccagacgaagagcattttggccgcaatggcccgaactcagcggcaacggttgatcttcattagcgcactcggcgcccatcatgaggtgccaggaaaatttggcgcgtggaacgaacaagccattgccgatttcctacccggttttcgagaagcagcgaggttgcttagtgcttccaaactggtttatacggagatccgaccagcctggctaacggatgctgccgaaattgattatgaactgacaatcggcgcagaacctttcaaaggaactgaggtatcgcgagcgagtgttgccgatttagtctttaaattaatggtgcatcctgaaaattatcagcgtgtcagtttaggggttgataaacctggtacggcgggtgatcggcctaattggttgtaattcctgtcatgagccttaattgaatgctaaaataagcgttaacgctcagacgacatgcacgccgatgcggggtagcacaaatttaaatgacgaactaacagtgaatagattattaaatagaattcaggggaaagttattgaaaagaatacgattatgggggctgatagcaggcctgctgttattattagttggttgtggtcgtgcagagacgaccggggtgactaaaccggttacgactcagaggcatcgctacattccaacactgtttttccatgggtggggcagtagttaccatgctgagacgcacatggcagatgctatcgttaaagccggcaaaacaaaaactattgtacgcgcgatggttgctaaaaacgggacggtgactttgaaaggccactttagatcaggtgattatcgaccaattgtcgaagtgaactttgctaataaccggtcttcagattatccaaccgtgggccgctgggcaaaaaatgtggtggtggcgctccaacgaacttatggcatcacgtcgtttaacatggttggtcattccatgggtaatatggcgattacctattatctattggcgaatgcgcaaaatgagcggttgccgcagctcaggcaacaagtcgcaattgctggacatttcaatggtattttaggcatggacgacagccctaaccagatgacgttgaacgctgcgggacgaccgaataaattgcgaccggcctaccgccagttattaggattacggcgggtttatccacgtcagcaagtacgggtccttaatatttatggtgataagggcgatgggacgcattcggatgggtccgtcagtaacgcttcatcacgctctttacggtacttagttgcggcgcgtgcgcgttcttatcgcgaggttaagattactgggaaacatgcgcaacacagccagttacatgaaaatgcgcaggtcgaccggttactgattgattttttatggcccacacattaaagtggggcagtctgatggacaggcactggcgagttcgcatttttaaaattgacgctaaagaaactggggtagtcagctgacgtttgtcagtgattagcctagttttttggttgctaccaacttgtaatgacggggtattcgcgcttaaatagataaagactgattactggtaacggtgttggtcgtttgctagcgcgatcagagtggctgattatagtaggctattgatagtagttgcgcgtccaatcgattgtatgactaatgagggtcgaacaaaccaggtcattatggtgaccaagcaacggattattggagtggggggtagtggcggatgtttagttatgagcagctcgaaaaatataatgaaactgatgtggaaatttacaggtacgttattaataatatggatagggtcggctacatgagcattcgtgagttagctcacgagttgcacgtgtcgacctcgacgattttgcgtttttgtcttaaaaatgggttcgaaggttatcgtgattttaaacgggctcttaaaagtgaacaacaacagttgtccacctacgagcccaagagcgacgtcagtgagctagcacacttttttgcaaaaactaattctagcgcgtatgaacgtaagttgatgccagcgctcacgtatttgcgtcgagccacgctggttatttttgtcggcattggttcctcaggaagtttggcccgctatgccgcgcgctgttttaccaacgctggtaaggttgcgtttggacttgaggatagtaattatccagtgaatacttttgagattcacgatacggtcgtttttgcgttatctgagagtggcgaaaccccagaactaattgcacttgttcagcattttcaacaacgccggtgcgcagtcttaagcattactaaccagtcccaatccacgctagcgaagctttccgattggaatttttcatatcaattggctcaccagagaattaatggtaattataatataacgacccaggtccccgtggtctatgtgattgagaccttagcgaaacgactataactaaagaaacgaatcgtgacttgaatagtaacgattcgttttttaagcttggaagtgaaaggggtgcttaatgatggatgaacgacagcggagtttgagcggtcagacctatgatgcacacgcaccagtatttttagagctaaaacggcgtacacggcaacttttaagccagtataaccagctcgcctatgaccaaaaaagtgagaaacgtacgatattgcaggctatgtttgccaagattggatcgaatgtttcggtggggagcccatttatttgtgactacgggtgtaatatttcgattggtcagaatgtttcaatcaatatgaactgtaccttgatcgactgtaatcggattaccattggcaataatgtcttgattgcctcaaatgttcaaatttatacggctacccatccggtcgaactgcatgaacgtttacgtgcggactggcagccagatagtgatcagtatttttgccagacgttagcgcggccagtcacaattgaggatggctgttggattggcggtggcgtgattattattcccggcgtgacaattggtcggggatccgtgattggtgccggtagtgtggtcgtcaaagacattccagctaattcgttggcggtaggcaatccttgtcgtgtgattcggcagattaatcaaggtgaaccgcatgcttaagatgatcgcctttgactttgacggcacgctcgcgccgacgattccaatggtgattgacgtctttcgtcgtagcgttgcaccgtacgttgagcacgaactgaccaagcaagctatcgtccagacgtttgggctaaatgaggttgggatggtcaaagcagtggctggtcaacggtggccggtcgctttggccgccttttatcaagaatacgctcgcgcacatttacgggtgtcagcaccgtatccgggaatcgtcacacttttagaactgttgcagcagcaaggggtggcgctagctctgattacgggtaaggcggctaagagttgtcaaatttccttggacgtgactggcctgacgtcctatttctccacgcggttgtatggttctgattgtcaacctaataaagctgacaatctgcgacaattgatgcgcactaagtcgttagacgccgcggaactcttgtacgttggcgatactcgctcagattttgaagcagctgatacggccggggtgcaatgtttgacggcggcgtgggatcctaatcagccaattgttgaagccggcgatcagatcgtgtttacttcggtcgagcagttgtgggcctacttgcaacggcgacttggttgaagcagttaaataaacaggataattaataatcgtggtaacaaacaaattaaaaagagtggcgtgataagtcgcatcgttatataaggccaattaataacagggcatgactttagtgtttttaaagttacgccctgttattagtgttttttaatctattgatgggtgtattaggattatcagtatgtggtcaaagcgtaaatcagttgagacgatcgcagtcagttagaattaaatcttctaatcatagtaatttgcaaaataacctagtcgcacggcggattacgaccacagtgaaggggcaccaactggcctgcttatttgaatcgttccagtgctgtttaagcaattgcacgtgaattgtcaagcggtcacaccggtaatcagggtgaaattggttatgttgacgagcataactattatcaaattattcagcgcatgggtaaccatgtgcaaattcgaattgcgcgggcgaaataacgtgacgacacgttatgactgtctaaattttaaaaactaaatctttttgcactttactaaaatcttagaaatttaaaaacaacatgtatatctaatcttaacgtgtatctttaagaggagtctggtttgcaagtttatttttgaattaaacaaagataagaaactaacttgtattgaataagtgccattttcagggattttgcggtagccaatcgtgtaatattccatttcgatattttataataaattctattaaagtatgaaatatattgtcgacagaactagggtccgtcttaaaac

SEQ ID NO: 17 - DNA, 50637 bp, Lactobacillus plantarum
aatctcgggggttcacttcattataaataattgtcccggcaacttttttctgcactaatactcacccgctttcaatcgatttagtgaatccgaagtccaactcgctaaatgattggcaattggttcaaagccagcatgaacatgccgattcgtccaaaaatgcttatgccgaaaagtcttgtagatttccaaatcattgaccgtcggatgcggttgatgctcgatacaacgtaatgacaagctgatttttccagtatattcgtcaatatctaaaataataacatctacggcttgaccaacctttagatactcagtaatacttttaacgtatccttcatgacactctgaaatgtgaatcaatccctgatgctcaccatctaaggtgacaaaagcaccatatggttgaataccagtgactcgtccgtgtacccgcataccaattcgataattgctcacgatcataccatcctttctcattcattctatattgtcgataattctaatccccaatattataacctgaatacagcggattgcaaaatcgtaattgcaaaaaaagaaacccgcagccgcagatttctttcaaactaactaatcctcaattgtaattgtttcgatcacaacatccttcactggtttatcctgcataccagtctcagtggccgcaatcttatcaacgatatccatcccatcactaactgcaccaaaaacagtgtgccggaaatctagccagggcgtgccaccattgccatacgcagtcacgatttcttccggataaccagcttgcttcatctgatcactcatcccagcatctaattgtggcttttgaacgataaagaattggctaccgttcgtattaggaccagcgttggccattgataatgcccctcgcaagttgaaaacctcttgtgagaattcatcttcaaatggtttaccccacaaactttcgccacccatcccggtaccggttggatcgccaccctgaatcataaaatcaggaatgacccggtggaagataatgccatcgtagtaacccttctgagctaaaccaacaaagttttcaacactcttgggggcctgctttggaaatagttgaaccttaatatcaccaaagttagttttgattgttgcttttggtccatcgacctgacttaaatctaattgcggaaatgccacaaaatcacccgttttctattaagattatcttgataatacaagagaactcgattaaatgctagccatttgtaaggatttcttgcgattagcgactaagcatagtattttgactgattttctggtaacctagataggattaatttcacattacttggaggtaaccatgagttttttaatcgattttgtgttgcacattgaccaacacttagtcaccatcgtgaatagttttggaatctggacctacctaattctctttgccatcatcttcattgagactggcgcggtcattttaccatttcttcccggtgactcccttttatttgcagcttgcgcactcgccgctaatccaacctatggcttacatatctggacttttgtcattctcttcttggtggcagctttggcgggcgactcacttaacttctatattggtcatttcctaggagaacgcctaactgaaacatcctggtttggtagactgatcaatcaaaaacagctggcaaagtccgaaaaattcttcgaaaaacatggtggcatcaccgtgaccatcgcacgcttcatgccaatcatccgaacctttgtcccatttgtagctgccagttcgcgaatgaagtatcaacaattcattcgctacaacgttatcggctgtgtcctgtgggtcattctctgttgtggtggtggctactacttcggtaatatcccgttcgttaaggaacacttttcgatggttgtcattggaatcatcctggtttcactgattccagctgtcttctctgctatccgcgcacgctttagccatccaactgaaaacgaagattaatccaattataaaaggccgatcagctaataatagctgaccggccttttataatctaacttaaaatgcagtgtccactgtaaatactcttcattaatccgcttcacgtaacgcttgtctgccgatactgagtaagtaaaaaaaagaccactcaatcaggataaacgctagaacaaagcactgaccgaagaacgtatccggcaagaccaaaatgattcggtccaatagtggatcgaacaaccagtccgaattgcgaaataagatcttatggaacatgataaagaactgatcaaaattgatagccattataacggtcactactggtggtacccagagggctgtctgcatcggtaatactaaccgccacaattgttgatcacgtcgtagtcgctgccaaaaaaaatagaccacaacactcgtgacgataaacacaccgtaatcaagcataaatagattcttcacatccgcaaagtgaaccaacgcactcgtcgaatccgtaaaatcgttcatagttaatttgggtacccacggaaagttaagatatgctaacagctgatagtagttcgtcatcagccgtcccaatgtcaaattcacagttgcgcctaacttttgaccaaccgcattggcaaaatacaaccagctcgcgttgattgttacaattatcgtgccactcactaaccataagtataaactcagccactgagccgcatttttaaatttatttagccacaccatcgtctaggtcccattcgtccaaagaattgatctcattagttggtttgacggcctgttgtgccactagttcaggggtagagacaccggtatacaccaataaggagtcaatcccaaagttaattgccgctgagatatccgtcatataattgtcaccaaccatcacacaatcgtgcttatcgagaccaatccggtcgaccgctttctgcataataattgtctccggcttaccaatgtaagttgcacgttgttgggtggcccgttcgaccatcgcaattactgaaccagcacctggcactagcccccgctcatttggaagattagtatccgcgttggtgccaatgaacttagccccccgcttaattgccagcgtagcaagttcaaatttatggtaggtcgcatcatagtctaaaccaacgattacgaatctaggtgtgcgctcatcgaacttgaagcccttttccaacattgcacccttcaagccaagttccccgatgacgtacatcgttttatcaccatcacctgcaaggtcattaacatagtctgcagtcgctaacgctgccgtataaacattcgcaggactcacatgaatatcatgattgttcgctaagtttgcagccacatcttctggtgatttagtcgtgttattcgtgaccaataaaaaatcagtctgactagcctgtagtcgttcaataaaccgtttagcagcaggaatacgttcccgaccacgataaactgttccatctaaatcaattaaataacccttgtacttacccaatcaaaatacctctctctgttcctacttttgtcgaatcgtaaagtggcgtttaccactactctgcttcgttgtttgcgcttgcttaccattaccggccgtaactttcgccggttgccgccgcttttcagtaaacggtgcggccttctgcttagtggtgaagctatgagacttccgccgttgtttgctgcgactactgttacggttactccgcgctcgggattgccgactattagtgtttttctttccccgccgatcatccttacgtgagcgactggtacgcttaggtttaatgacccgttcgtttttaatgataaaataggcgcaaccaaaattacaatattcgtacagatagtcttggaccgccccaatcgtctgtgagcgctggacatctttcatatcatcacggaaaaaaccttttaaccgtaactgttcaaaaccccaatcaccgacaatataatcatatttatttaaaattgagctgtagcgctcaacgaacttgtcgaggtcaaacccttggcgataatcgtacacgatttcaaacgggtgcttgctaacttcaaagtgggtcttatcagttcgtaatccatgatacaaattgcgccgccgttccgcttgttgttcagctagttcatcaatatgttcgcgattcacattgacaccacctttctcttatttaaccggccatcgacgcattaagtaatcgccaacgaccgttcttaacatggcttcaaataatatctcagttcgaccactgatattaatggtcgggaaaaacggaatgaataaatcatgatctaataacgcaatctggtacgtttgttgccgattgaccggctgaccattcactagtaatgtatgctgtcccgttttccacgtgaggccctggtactggatataaccaaagacttgaccacgaaatcccattcctttaatcggaaatttgttcaaaaacgggcgaactaactccatctcatagactaagcgccacaatgcttcaccacttaacgtcactcgaataacatgcatcgcgtgaggtagcatggtatgtaaatcatttcggttgaccatgcctgcgggaagatcccgcatgaacaggccaccgttcaacatacctagatcagttttggcatagtccgtaatggccgctagcccgagggccgtcaaatcacttgcatggtgccaatgtggccgcagctgcgtcggcaccttcgcaacaacttgccgcgtgagtaacgtttcaccctgttgctcccagccagtaatcaacgtttcatcaccggccacaattggtaagctggccgtggcaacagtatgcgccgcggccgctttaacgtgatgttgatgatcaatcgtcagttcaattcgcccaatatactcaccgtattttccagctgccgctatcaggaccccatttttcagttcaccgttcaccagtaaatgatgcgtatgactgccaataacaacatcgatcaccggaaactgttttgctaaccaccgatcgacattgataccaaggtgggacatcacgattaagacatcatattgccctgcatattgtcgtaacaactctgggaatcgcgtcttaacactggccggcgtccaaccgttcaacgggtaagtcaacgtaaacggtgccgtaaatgccagcaacaagactcgtgtcccccgtgcagttgtaatgattttagctggtaatgcccactgcggcggtcgttgcgttgcagtatctgtcaaattatcgagaacaacatcaaagttggcgcggtcatacaaccggtttaaggccgcgtgcgttaaacccagtccttcattattgccaatcgtgaccgcatcatagccaatcgcgttcaataacgccacgttggcctgcccttgagtggcttctgagagtggatgggcacgatcaaccgcgtcgccgaggtcaaccgtgatcacatggcttccagattgccggcgctgctcacgttcggttaataaataccgttgaatacgtggccagttttcaaaatgcgaatgaatatcattggtatgcagaatcgtgacttgctcgtccacggtcaatcgcccctcaatcgttgtctttgttaatcctaaagcattcaccaaagtcggtcaagcactcgcttactggcgcttggcaaaatcaatggctttaccgtcaaccatctgctcgatctcggccagtgaaaatggcgttccaaagggcaccggatggtccaagtaatcgacttctggtgtatcgacacccacgttgatgttctccttgacgttgacggcataatgatgaatatgcccgtgcaaattgataatttgtttgacgatccccatcatcattgggtagtgcgtcatatagtattggcggtggtcgtacttaatcagtacccccacgtcgtgaaactcaaacttcggttgaccattcaactgtggatcatgagcagccaaatacttaaagaaggcccgtgaatcatggtttccctttataaaaatgattttgccatttaactgtgctaagagtgcaaaaacccgctcataagacaatttcgctggtcgcgtaaaatacagcgcaacatcgcctaaatgatagactgtatcctgatccgtcacacgggcattccaatggtcaacaatcgcttggttcattgtctctacatctggaaatagccggggcgcaaagtcgttgtcccccaacaaatcagcatgataaaaatgtgtgtcggacgtaaaatattgcatcgttcaaacctcttattcgtatatttacatttgtaacatcaatcggatgtgtcatgtctagcgaatttcatgacttttgcttgaaaagctgacttatccgttcgtcagcatatacccatgtcagtcattcgaatcctattacgactgtcagtcatcatatggcacactaactcggcaagtttatactaaacaaaccgtttccaccgagtcaaagctgacagttttggcacttactgaacagcacgtattaatcatgaaccattttaaagaacacctgacacaacgcgttagtcatttatcattgtaccgcgcaccgttctaaaagacactagaacagttttaagtttattgctttgtcagcactggaaccatgttttatgaccaacccatattcacaaatctagctaatatcgtcaaaaagtgcacttaactgcaatcggcagagttaagtgcacttcataaatcccattagttaacctacttgatagccaatcagcactcctggttattgctgactagtcgtgtgtccgttgacgaattcggtcactaacgatcttgacaatgtataagccaaccacccagaccgctgacacgagtaacgcgattaacgtttcaaacttcagacagagaacaacagcgataaaagctaagaacactagaatgaagtaatcagataacggaaacagtggcatctggaatttcactttagcctgactgcccgcttgacgtcgatacttgatatgtgcgacgacgattgcgccccaaataaagataaaacaagtagtcgatacactcgcaatcagcgagaagactttcccaggcatcagtaagtttagaattactgacaacccaatcaccagcgtcgagaaccataacgcattgcggggaacttggcgggtcgatagtgtccccattcgtttggcaaacttgcttttgtcatcatacgttagtgagaataacatccgcccggtactgaataacgcactattacaactagaagcggccgccgtgagcactacgaagttgataatcgcagccgctgaacgaattcccaaattggtgaatacttgtacgaacgggctgtgtgccgatgaaaagtattgccacgggtacatacacattagaaagaatagtgacccaacataaaacagaatgatccgcacgggaatatcattgattgctttgggaatcaccgtcttcggatcagccgtctcagaagctgtcatgccgaccatctcgatcccaataaaactgaacaggaccatctggaaggaaagcactaagcctttgattccgtgtggcataaaaccgccataactaaccaaattggttaagctggcgtggcccacaggggtcttaacgctaaacaagaccataccaatcccaacagcaattaatgccaagatagcagcgatcttaataatcgcaaaccaaaattcagtttcaccgaacgctgagacattaatagaattcaagcccagcaataaaatcaagataatcagccccggaagccattgcggtaacttaggccaccaaaactgcatatactcaccagcagcagtaatttcggccatcgcaatcgtgatccagcaaacccaatacgtccatccagccacaaagccggtcttatcacctaagtattgcttaataaaatcaatataagaatgcgtatgaaggtcagataacagtagttcacctaacgcccgcattaataaaaagcacactaaaccggtcactaagtatgcgatcaggatcgctggccccgccaagtggatagattgaccggcccctaagaacagtccggtcccaatcgtgccgccgatggcaattaattgaacatggcggctttttaagcctcgcgagagttgttccgtcgcaggctgtgaattttctttcgtcattatctttgcactccccttgaaattattatagcggccaaattcctagcattcaaaaggacacgcttaagaaaatcacacgattggactataccattgttcgctaacgaaattcatcttatgtacgcgtaagcgtttgctaacttgcatggctgggattcagctttgttagttgactaaaccagtgaacgctcccgctacgtgaataaagtgaaggcaacgcatactaacatgaataactttcacttcagcatctaaaaaagcacccggattttcatccgcgtgcctctttacaaccttaatcatattgaaacgatgctgatcactgattctgagccacgcgctcaacatcgcgggcaatcataagttcttcatcagtaggaatgagtaacgtccgaatcttcgcatcggtcgtactcaggtcccgttcgacaccactgacttgattcttagtcgggtcaatcgcgacgccaaagtaggtcaaccgatccgcgattcgttgtcgcatccgtgcatcccgttcaccgataccagccgttatcactaatgcatccgcaccttgtagctcagccaaataagcaccgacatacttaacgatccgattgacaaaaatatcaatagctaactgagcctgtgagtcctcatcataacgtgcctcgagctcctgcatatctgcagaaccagctagccccagtaagcctgactgcgtattcaaaatcgttaacatttcatcaggatcgctaatattaagctttttcatgagataagcaaccagcgacggatccacatcgcccgagcgcgttgccattgtaataccagctaacggcgtaaatcccatcgaggtatctagtgactgtccatgatcaatcgccgtaatcgaacttcccgcacctaaatgcaacgtaatcagcttcaacgtttcgagcggtcggcccaataatttagctgctcgcaccgcgacgtagcgatggctcgttccatgagcgccaaacttgcgagcaccatatcgttgatagtaatcatacggtaacgagtatagatagttaaccgccggcatacttgcatgaaacgccgtatcaaagacagcgaccgcgggcacatgtggtagtacccgcttgaaagcacgaataccgaccgcattagccggattatgcaatggcgcatattcggccagatccgtaatctgcttaagcacttggtcagtgattaaaactgaatcatggaattgctcgccaccggcaacgacccggtgaccgaccccagtaatttcatcatatgagtcaataattcgcaatttaattaactcatccaaaacgatattcacggcagccaaatggtccgcgactacggctttctcttggtaatgatgatcaacgccatagcgaatattgaccggtgaagttttgaatccaattcgttcaacagcgccctgtgcaatcacccgttcctgtggcatttcaaataacttaaatttcaacgtcgaactaccagcgttgatggcaatggtcttccccaaacgacacactcctagcgaataatattctggtcgacccacgcatcaatttgagcggtaaacgcttgaaaggcacgttgatcctcaaatgatggaaagtcgcctagtaatactttacctgcttggtgggcccgttgtccatgtttctgtaaaacaacaattgattttcgtgatttttcatcaagaaaaaggttagtcggcaagttcaacagaccttggaggtaagccgcagtgctcatccattttaacagtccttgagactcttgcgactgaaaaatcgtcgttggaacaaggaaaacaccccagccgcccggtaacaaatgagccatcgcttgctccatcatcaaatgatgaatgtaagaatgaccattcgtcgctttcgtttgaaaaccttggacacggtcatccaatgggtagtaccccactggcaaatcaccaattacaacggtcgttttcggcatgaccagggaatcaattgcgtcttgatgaaacaactccactgctgatcgttggagatccatgctcatcgcggcgattgccaactgattatcatcattatcgactccgtaaccctgaatcggacgtggccggtccgtctgcaactgatttatgaccgtagttaataagttaccagtcccgacagcaatatccaaaattgacaaatcagtcgtcgatccaactaacttagcaatcaagtatgccgttaacagtccaatcgaatctggtgtcatttgatggtttggatcaacgtgatcattatgaatcgcctttagtaaggccaactgaagcgcacgccgaattgtttcggcgtccaattgttttaagtcgatcgtttgatagagctttgttaaagctgccgtctgttccggatttggcttgccatcctcaacatgtacagattggcttaataaattatcgccagtctcaatgagcgcatccacgtaagaaacggatagttgttgcatcaaaacttgaactgattgatctaagacctgaaaaagcgtctcggtttctgcttgtgccagaatactcaccctcccgcaaaatctgtaatccttaaccatattactgattttacgcgttaagttcaagtcacggggttcactcaccaatcaagggagcgaattatgctgataagggtgctcataggattgtaaaatcaagcgatataacgtctggcgagactgaaaattaacgtatcgttgggtttcaaacgccccaccaattaacaataagctaatcaccgaaagcaggatcgttccgcgtcgcttcctcatctaccattgtcctccgatctggtaacagtaattgggcttgaaaatgaatccccttatcagtcgtcatcgtcagggtcaaatcatcggccacgtgaaattgccgaacgccctgcatcagattgatttcaccaccaccatagtggcgcaatccgattcgatgtaggatatgataataagtcaataaatactgtttgccggtgaccgtattaaccaaatgaacggcttttcccggcgtcagaccaccctcatcggaaatatggtccaccacaaaatggtgatccggattttcaagctcgtgaagcatcaaataccaatccactgttggcaaatccacttgggtgcgccgggccaaattgcgctgcccctgaaaaagtgtcgtcagcactacggccacgattgctaacgacacaacggcttcaattaacgtaaaaccgcgccgcctaatcatgtgcttgctccggtatcctggataatagctgctgacgttgccggtcttcatattgttttctggctgtctgaatcgcctgcaaggtctggcgttcatgtgactgcatcataatctctaaactttcaaacccaatcaaaccacccatcaatagccccagagcagtaatcgtttcaatcatcaaaaaacccattcgcgtctttaacatgtgtgactttataggccccccaccccatcaaagcattcagtttgattttctgcttcggctgtaattgcgacttgaaaataaccactgctagctgtggatgcccatttttctggatttgaatatcacgaccgcgctctgtttttaatgttgcaggcagtgggagatgccactgtgggccactgataggccgcccccgcttgccaccccaagtcacgacttccgtgccacgaaagctcacgacctggggctgacccgtcacactagcggttaaggtctgttgctgccacatcgtttgtaactcccgccagaaagcctgttccgcattctgttggcgttgccgtgtgggaaaacggtgcacagcaatcaccgccacactagccacgatcgccaagaccgctaccgtttcgattaaggtaaatccctgtcgcttaaccaccaactactttttgtggttgcggccgtaccggactaatgccctgtgacttagcctgcttatattgaccatcgttaatatatcccttgttccgaagttcttctaacattgcgtcgtcatccgtgacggtcttacccgtatcattcgcatacatttcagcctgattttgaacaacttcagtcagggcttcttgttggcgaccagccgcctgtttacgttgttgattcaaattgggcaccacgatcaacatcaagagactgatgatcgccaatacgatcaccatttcaattaaggtaaaaccgcgctgtggtgctgccgtttttttcatcaagcgtttcattaataatgtcattttaaaatctcccccattgattgatacatcggtaataacaaactcaagtatgtgccgacaacgacgagtgcaataatgccaaacatgatgggttgaatccaaccaatcatccggttcaactgtcgaatcaagcgttcgtactgcaaaattgcaaagtatagtaattcctgacttaactgttctgccggactctctttgccgaccagtagtgctaactcatcaggtaataatcggtcctcctggataattgtgactaacgaagtcccagtcagtaacgcctgttcgataacctgcccttgctgataaatcagcgccttagtttgaaagtgctgactgacttcacaaatgccacgaatccctaaaccaccagtcagcagcatacccgcattaaggcttaaatagtaaccacagtagtttctgatcaggggaccaatcaaggggacttgagccaaccactgatagcgccgccgaatgggtaatcggctaacttgaaggccaaccagcaataagcaaatcaccaaggtaatgaccgtgataccgctaaaccattgccaattcgcgattgtcccactaccattaccaccatgagcaagactcggtaaaatcgcagctttgaccgtgcctaaagttcccagcagtagaattaacagcagacaagggtactgtaacaaccgccgaatttggcgtccctgttcagcacgcgctcgcattaattgacctgcctgcatcaaggtccggcgtaattcaccatgagtctcagcaattaagaactggtaatacaagtccaccgcaatgtatggacgcagcgccatagacaaatcatcacccgcggctaaacgccccagcgcgggctgcaaggattgaaaggccggtccttctacatccaatgtaaattgaaaggcttgctgaaacgagaagccgttgcctagcaagtcggctagcgtttcaaacagcttcgcctgcatagcaatcggaagccgtttacgcttccttaagttgattggccgtcgcatgatcgagacggcccgctgccaattgttcatcaattaactccgcccacctttcagtcatcatttgcgacgttttgggccttgcatgcggtaacacgaccgtatcgaaaatcgtcgccacgctgccatccgtcactggtacgaggcgctgataggacattgcagttaaagcctgctccaaaacagcggcttccactcccaattgcgtcaaccggggaataatcccgtagacaccgcgcgcatgaatagtacttaaaactaagtgaccacttagcgctgcctgtaccgcaatccgagccgtttcagcatcacgaatctcaccaataataaagacgtcgggatggtggcgtaacccaaccttcagtaagtcgccatacgccatctgggccggcgcgtttacttgtagttgtaaaaattgtggttcataaatttcaaccggatcttcgatcgtcatgactagccgttggccacgaagctgccgcacaagatcatacatcgtggaagttttgccagaacccatcggcccggaaaataagatcaatcccgttcgtcgcattaattgactcaattgttgccgttgctgtgggaccaaatagctcaattttcgggccggaccttcatacaataaccggacaaccaacgactcacggtccaaaaagtcgccaactgccgagattcgcaaatttaaagtttgctctgccaatgttaacgtcatcgcccctaattggggccgccgatgatcactaatcgccatgttactacggtatttgatgtgattcatcaattgctgggccaactcagttgtaatctgagtaagtgcccgcaaactgcctgctgcttgcactaacacctgatacccttctgccgtgggtaaccaataaatatcactggcccgctgattcacggctgcctgaatgatttcgttcaactctgcttcaatcaccatttatcatggtcacgctcctttcaatcattagtttcgtaacaacgaccactttccacgaaaaaaatgacatttattttggcatcaaaaaagctgttccagaaataacaaattatttccagaacagctcgtcatcgcatattttcatttgcaatcctaacatacggcgttataagcgccccgatataaaccaattaaggcgttaggcccgctcagccgcttcaatgacttccttagttggaatcgatggttgcgcacccaatttttgaacagctatcgaagatgcccggttggcaaaccgtaccgcagcggccaaattactaaagtctggcattaagaccgaactgagtgcaccaataaaggtgtccccagctgcagtcgtgtcaacggcctcaaccttataagctgggacgaagccgtgctcagcaccgcgcatccagaaagcgcctttactcccaacggtaatgatcacgttagcaacgcccagcgcctgcaacttctgtgcaccctgaatcatcgattgctcatcagtaatgtgcacgccagtcaaggtttccgtctcagtttcgttaggaacaattaagtcggtcgtcgctagtaattctgcgggcaccgtcgtcgtagctggtgccgggtttaaaatcgttttttgcccagcggcctgagccaattcaaaccctcgaatcgttgctgcaatcggcgtttcaaactgtgcaatcaaaaaagtactagcgctaattgcgggttgggcccgttcgacatcttcggccgtaacctgctgattagttccaccatcgattaagatacggttctcactactactatctaacaagatgaaagctgagccggtactagccacattgctatgttgaacatattggtcattaacaccactattcgtcaactgctgcaccataaaggccccttcctgatcagtaccaactttaccgataaaagtcgtttgggcaccagcgcgcgcggctgcgatggcttggttagcccctttacccccaccagcgacactcttaccagtcagcggtagcgtttcaccaggcttaggaaaacgcttgaaacgcaaaatcgaatcaacattcaaactacctagtacggttactttattcatgattattcgtcccttcagtattcaactgctctaattttagcaaactggcctgttcgacgcacttgttttactaatattttaagcaataaaaaacgtggttcttgatttatcatcaaagaaccacgtcttttcatcattaatctgggtagttagcagcttcgtatacttctgatacgtcgtcgttatcttccaattcatcaatcatgtgttgtaacttttccactttatcagcaggaacgtccgttaggttttcaggaatcatggttaattcagctgtttccaacttgtaaccattagcttcgagggcatcacgaacggcagctaattgtttaggatcagtgtaaatttcaaacgcttcgtcgcttgattgtaaatcgtcgccaccagcatctaaaacgtccatcaacatcgtatcttcgtcggtatctaaatcttcgcgactgatcacgatgtaacccttacgatcaaacatgtaactaaccgcaccagttgcggctaaagccccaccatgatgcgtgaacgctgaacgaaccgccgcagcagtccggtttttgttatcagttaatgcgtgaaccagaacggcgataccaccagggccgtagccttcgtaagtaacttcttcgtagttctccgcaccggagccactacctttatcaaccgcccgtttaatattgtctttaggcatgttggcagctttggccttatccataactaaccgcaattgcgcgttagaatctggatcaggacccccggcttttacagccatataaagttcacgggaaatcttttgaaagactttcccacgtttagcatcttgggcgttcttacgtccttgaatgttatgccattttgaatgtcctgacatgtgtgactccttctttcatatttattttcagtttagtagataaacatacgtaaagtatgatagcaaaaaaagcgagcgatttcaagcactagaaccaagggcgtccaagttctgcgatttttattgcaaatctaatgaaccagtttcgttattggactctctttcagatttgaaatttcagtttgctaatgacaaccacaaccacgacaaactggtgttatggccgtaaatatgcgtaacccacagcttgcaagtccacgattcgcaccacaccagcgggaacgaccgtcacactggcaggaagttgggccgcagtcatttgatgactcaccatggcattatggcaagcatcaatctcaacttgcggtaacgtctgttgtaatggcttccaggcaccagttaccagcgtcgtgatagcgggcccgttgaccacaaccaccaccgtactagttggccgggctgccaaaaaattctgcacattgcttatggccgttgcgaccttagccggctcgtcgacatggactactaagttagtcattcgcttgtcctccctcgatcgaccgcagttcgagtgcgcgtagatagtgatagctactcaacatgttagcgcaggtcgcatccgtttcatccggcacttcataaatcatggtagcgtgcgggttgaggactggtaacacccgctgccagtcaatcagtccctgccctaaaggtaaactatcgtgccgcgtccccatcgaatcaaccaaatgataatgttgaatgagtggagccagccgcttcaaagccaacatggtcaattccatatcaccgtgcagcgcaatgaagacgtggctcaaatcacaaaccagcggataatgatgctgaatgatacgctcatctaactggggatcaccatacataaaacttgccgttaccccattttcaatcacgacatgtccactcgcctgacgaaccaaattatccaaccgctcaaagaccacgtcacgtgcaacctgcaaggactcatactcatcgatcaagcgcccactgtcgctaccatagccaccgtgtacgagcaccttgacatccaattccgtcgccaacgcaagtaactgggccgtactcgtttgtaggaattggtacgccgcagcttcacgatgtggatcaagcaattgatcaagatgaacgccttgataactcatagggtgatgaatcacaatttgctcggtgacagttgtctttacaaattggacagctgttttaagtgtctgaaatgcttccggttcaaagtccgtggcactcgtaaaaaattcaaatacttcgggccggtattgcaaacgatccattaattgtgcgggtgcttgggacgccttcaagcctaacttaatttttccgggccgtggccgcattattagttgtgtcatccgtttaactcatcctttcacgcattccaaaaccaaaaaaggcttggaataaatattccaaacctagtataacgctatcgttctaaattatgccaacgtcactagctggcagacaaccgaacttaatcagcagacttggttgagccccgccgaacaatgccgtatggcaaggtgaccgtcttctcgtcaagttctttatcgttcatcaacttagttaacatccgcatggcaaccgcaccaatatcatataatggttgggtaatcgaggtaatggctggacgcgtgatttgggtaataatcgtatcattactcgtcacaacttccaagtcatctggaacgttgatcccggattccatacttgcgttgataagaccagccgccatttcgtcgtccccaacgaataccgcagtagcgccactatccgcaatgactggttgtaacttccgcccagcatcatatgagtagcccgcttcataaacgagggcgtcgtcaaacggaatcttagccttggttaaggcccgtttgtaacccgtcagtcggtattcagcgttgattgattgtgacaatgagcctaaagccaacgcgatcttcttgtgaccacgtgcaattaagttagtgaccacttcttcaacagctgcagcgtagtcgatattaacgcttggcgtttcattgttcggatcaaccgtcccagctaaaacaactggtgccttggcccgtttgaattcagcccggagcttgtcatcaatatggttacccataaagatgaccccgtcaacttgcttagccatcaacgtattcaacacgttgacttcttgttcacccgcatcatcggagttcgttaaaatgatattgtacttgtacatcatcgcaatatcatcaatcccgcgtgctaacgccgcaaaataaatgttggtcacgtccgggatgattaccccgaccgtagttgaacgcttacttgctaaccctcgtgcaactgcgttaggccggtaatctaaccgttcaatgacagctagtacctttttacgcgttgcgggtttaacgttgggattaccattgacgactcgtgaaactgtggccattgagaccgccgcttcgcgtgccacatcataaattgttactgtttgtttttccatataaaaatagccctttcttgcttggtatcatatgttttcatccgttttcatgcaacatcaaccaatatagcaaaattacgcttccaatgcaacttaagattgttattgaaatcgctttcatgaaaataataccgtacttgttttcaaaatgcaagatttaccacacgaagattgttattttgggctcattattctcagctttttatcatcaacagcgctatactagtattattatctattattttatctaaggagtgtttgaattgacagattatacgaaactgcaacaagtccgtcaatggacccaagacaatcacgttgacgtgacctacatcagtaactttcacacaatttcatatttgactggttttgagagcaacccctacgaacggacgctagcactgtttgttttcgcggatgcggaaccatttctctttgcacccgctctcgaagttgaagcaatcaaggagatgggctggccttacaaagttttcggctacctcgaccatgaagatccatacgcgctaattgctgatcacattcacgcacaattgactgatcctaaagtttgggcctttgaaactgggaacttgacgttagaccgctttaccgcgctcaaacagcaatttccagctgcccacttcgataaggatctatcaccttatattcagcaattacggctggtcaaaacagctgatgaacttgaaaaactaaacattgccggtaaatgggccgactttgcttttgaacaaggatttgctgctgtcaaggcgggtcgcaccgaacaacagattgctgccgaattacagtatgccttaatgaaaaagggaattatggaaatgagtttcgacactttagtccaagctggtgaacatgccgccaacccccatggtgcaactaacgaaacccaagtcaagccaaatgaattagtgctattcgacctcggcgtcatgtatgaaggctatgcttctgatgcttcccggacaattgcttatggccaaccgagtgccaagcaaaaggaaatctttgacgtctgtctggaagccaacttgactgctcaagcggccattaaaccaggcatggcagccgaagatgtcgataaaatcgcacgcgatatcatcaccaaagcgggctatggcgaatacttcattcaccggttaggtcacggaatcggccaaactgaccacgaatttccttcgattatggctggtaaccacatgccactcgttgaaggcatgtgcttctcagtagaacctgggatctacattcccggcgtagctggtgttcgaatcgaagactgtggggtcgttactaaggaaggctttaagccatttacccatacgccaaaagaattaaaagtattagatctttaattaaaaacgtcaagagggccgtcacgacataatccgtgacggccctctttttttacctagcgttgactggtacttgcttttagtgttattccggtagcggatgttcggtttcatcatcagccacttcggctaacagtgccgccgtcgttttcaatggcagcacgtcacagtcaaccgcggcttcactccccgcctgactcgcacgccgataaacatcaatcttatgattgactttttgcaaattcaacaaggattgatggatttgcgcttcaacagcctggcgttgctcttcaaacattgctagccgttgatcaatcgttccatccccatcggcacaccaactaataaattagtgaatccaagtcttcatcattgaagacccggcggccctgcttatcacgcttcacaaagggcgttaagcccgccttatcataatagcgcagtgtataacttgaaataccggtctttttggcgaccgctccgattgaatacaatgtgattcctcctcaaaagcagataggacaccgagcacttgctcagtgtcctatcttatcgctgtcagcttacttggctggtgacgattcatccgttgtcgattcatcatcagacttcgcaggtgttgcgtccttagcaggtgctgattctggtacgggcgctgaagtcttctcgtcctcgccagctttttgataagcagctccaccatcaatgacgatatcttcatcatcaccttcatcatcttcgaccttagctaattcagaccgtaaactatccgtagcttggtcaagacttgagccaaagctttcacccgtttcctgcttagcggcttgatactggtcagcaaaatcggccacttttcgctttgtatcttcaaattgttgcccagcttcagccttgaagtcttcagcagcatcgttggcatagaacgcatagtcgattgcccgatccttaaaatcggcaattccttgctgtgctttagctttcaattcagcctttttatcatcatccatcttcataacggcggtagcaatcgctgcaccacctaaaacaacacctaataagaatccctttttcgacataattaagactcctcactattattttttgaacgtcgattacgatagacatcaaaagcggctttgccgaccttgcttgcgctggagaacttgctccgcttctcattgttcttgccaatcttggctgttaagtctcgagtcgcagcatttaagtcagagacgctctgacctaagtcgcccatcgcttgaaacgctggatcaattgttgcaactttgccgttaacatcctttaagagttcattggcatttgccatgattttttcagtctcatgtgacaaggcgtcaacatcatccgtaatattatttaaactacggttgacttcccccatcgttttagtaatccgcattaaaaaaatcccgataaagcatactaataataagaacgcaatggcggcaatgatgcccgcaatgtgtgtaatcatcctaaaattcctccttcaacagccatgatattaaaactagcatagcattgtctttagtataccgcaattaaaaaagtgcttacaacattcacccagtcacatttggtcgcaataacttgatcacggcttggttgcccgcgtcaaatctgataaactagtgaacagacaacaataacgagggtgaagatatgtttaattcaattaacctagcagcggttgacacaccgactaaacaagtttcggtgtggatgaagttggctaagaaaattgactggcaacaaattattattaatattggcggcaagctactcgaaatcattttatttattttactattttgggtgattgatcggctaggaaaacgcctgatccaccacttatttttaacgaatgctaataccagtgatactgccaataatcggatttcaacgatttttacattatcattaaatatctaccattacgtcatcatgttttttggcatctatgcggtactttcagtgttaggtgttcccgtggggacgttgattgctagtgctgggattttcagtgtggcgttaggtttaggcgcccaaggcttcgtcagtgacattgtcaccgggttcttcattctacttgaagatcagattgatgttggggattacgtcaaaatcgaaaccattgaggggaccgtctccgcaatcggtttacggacaactcaagttacgagtcccgatggcacgttgaactttattcccaatcgcaagattttaatcattagcaaccagtcgcgtaacgatatgcgcgtgctgattgacctctacattctcacaacgactcccgttcaagatctgactaacgtggtccgcgaaactaatgccgacctcgtgcctcagtatcctgatatcatcggtgagcccgacattcaaggcgtcacgacacaagccgatgggacgttggtcttccgagtacaattttacgtcaaaaatggcatgcagttcgcaattcagcgcgactttttggccgcctacttgaacgcggcccgagcagcgggaattcaactcccctcgccacgtttaaatatcgccccaacgcacaagtaagctcaaccaacacaagcccgcacagcggttgctcagaaatgagcgccacggtgcgggcttgatctttcatctgacaaatttcttcaggtgggaaccatgacgcacgttgttattgtcaggaatagttttagttattcccattcgcaacctaacgtgaccaggcgaaaactattgtgcggtcacaaccaaccattaattgcaacaacgctcggcattcttgaaactcaaaaacgtactgacacgtgttagcgcagtacgtgttgtaatttatttgtgtaacgcattccgatgagtcaaaaagctggtcatcgcattgaccccactcataatggcagccgtgtgcggcaccatgttttccgagtgcaacgaatatggactgtcgacccctaaccagaacattgtccctggaatctgatgaatcaaataaccaaagtcttccccagtcattgctggttccgtttcaataaagttgacatcatcatcctcctgcatgtacttgataaaatcagcagtgattgcgtcattgttctcaacgggataataaccaccttgattgagcttcaaatcgatattgcagtcataggcgagcgcaatcccctcagtaatcgtccgaacccgccgctgaatatgcatgttcatctcctgcgtcaacgctcggatcgtcccgtcaatctgggcctcaccggcaatcacattgccaatcgtgccagcagtaaagtgacctaatgtcaccacaccactttgaatcgggtccacgttgcgcgctacaatcgtctgcagctgggagactaacgccgcaccagcgacgaccatgtcgtttgcttgatgtgggtaagccgcgtgtccacttttaccacttaagtgtgcgtggatctcacaagttcccgcaaataacgtgcccatccggcaaccgatcgctccagttggtaaattaggattgtcatggaatgcaaaaatctcatctggcatccaatcaccatctagcgcaccactttcgtacaagcgttgcccacccgaggcattttcctcagccggctggaacatgaaaaccatgtcggtcgcaggtcggttctctgcaaagtagcttaggattcctagcgcgactgacatatgaatatcatggccacacgcgtgcatgacacctggatgggtcgatgcaaatggtaagcccgtattttcagtaactggtaacgcatcgatgtcagttcgataaccgattcgataatcatgctttaaaccactgactttcactaaaatcgccgtatccaaagtaggaatggttttgattgtcagccactcttgaggcatcttaccaataatcgacaataaataagcctgtgtttcatgttcttgtaagccgatttccggaatttggtgtaagtgttgataaattggaattagatcggtttcccgtaagaccattgtttatccctccaccattaaagattccgtaattctgccattaattcagtcttgctcttagtcttatcatcaatatctttcaacttacgagcaggaaccccaccgactacggtgttaggagcgacgtcttcaatgacgatcgcacccgcagccacaacggcacccttaccaacatgcacgccttcaagtacggccgcattggcaccgatcagcacgtcgtcatcgatttgaactggtttagccgaaggtggctctaccacgccagctaacacagtaccagcgccaatatgacagttcttaccaacaattgcgcgaccaccaagaatggcacccatgtcaatcatcgagccttcaccgatttcggcaccaatgttgatcaccgcacccatcatgataacggcattatcaccaatcaatacttggtcacgaataatcgcaccgggttcgatccgcgcattgtattgcttcaaatctgccattggtacggctgaattgcgcgcgtcattttctaattcataatcttcgatatttgcagcgttagcctttaagaacggttcaacatccgcccagtcaccgaataataccccagcgttgccactgaagaaagttttgatgcctgctggaacgtttaattggtctaaagcacccttcacgtatacttttacgggtgttttctttttcgcactgccaatgtagttaataattgattgtgcatctaattttgccatcggagaccctccaaaaatttatttagctttttcactagtggaaaaatccttctcaatcatatcatattgtttgccgatttcatgggtcagaaagttaaaactcttcatgaattcacgacgagtgacaattccttgaaaaatttgctgttcatcaacgactggaacaaacggattatcaatcatcaagtgtaacgtctcttcaacgtcatccacatcatgaaccgtcttaacttgtgtctccattacgtcacagacacgtttttgcagtaatatttcagtattcagttgatcaaaacctaacatttgttcagtaatcagtggcaacgatactaaaccttcaaagtgaccaccatgatcaagtactggaattttggaatacttgaccttcgttagtactaaaaacgcgtgatacaaattattatcagtttgaacgttggcaaccacgtccgccggaatcaaataatggtcggcgttacgtgacaataagtcctcaactggttgaattaacatacagcgcctccttcactaagcccatccctttattttaaccgcaaaagcactttgcacagccctaaaaatcagtttttttaccacattttaatcagcaaaatgaaattttagttctggcaccgcttgtagttgccgatcataatattggacgtcgatacctgcggctgacgttgtcacgatggcgtaggtgccaccgatacgtgcaaattcaccacgcggataagtaatactaccaggattaagcacgaccacgccgcctcgtcgttcaacacccagttgatgcgtgtgaccaaagaaagccagcttcgcattgtgcacctcagcattagctaatagatggtccaatcccatgttcacaccgactaagtgaccgtgcgtcatgtagactgtcacctcatcaatagttggattcacttcatttggaatcacggcatcgaaatccatatttccttgaaccgtgaacatctcttgaaaaaccgcgtcatcatgcggtaattcagaatcaccacagtgaaaaaaggcgtcgacctgaccgcggtacttatcaagcaatcgaactaacacgtcacgatcgccatggctatcactcactactaaacatttcatgctttcgcccaccattcatcgaatttagtcatcagttgtcgcaaggctgcaccccgatgactgatttgatttttttgtgctggcgtcaattccgccaaggatttttgaaacttacttgaccaaaataacggatcataaccaaacccattgtcaccacggggggcaatcagaatacggccggctaactcaccgttaacgacaagtttctcaccactgggtttaagggcaaccagggtcgtatgaaaagtcgcggtccgctccgcttcaggaacgccaccaaggttggctaacaacttggcattattcgcagcatcatcatgatcaccagcataccgtgccgagaacactcccggatcgccgtgcaacgccttgaccatcaagccggaatcatccgcaattgccggtaatccggttgcttcgaccacaaccgtcgcctttttagtggcattttcttcaaacgtgataccgttctccttaatttcaggaatatttggaaaatcagccaacgttttgatagtaatatcatacggtgccaacatcgcgctaaactcgcgcgccttattggcattgttagtcgcaatgatcaatgtttgtggtttagtcattcgcttcactccctaaatcaatatgttgtgcgtgaaagtccggttggcccaaccagttccgcgcgattgcttcgaattgatcagccgcccccgtcgtgtagtactcatccggataacgcttagtagaacgatcgttagcaatatccaagtaatcgagtaccgccgagacatcgttcaccgtttcggcaccagaatcaatcaaggtcaccccaggccccatcacattttgaataagtggccgcaataatggatagtgtgtgcagcccaaaacaagcgtatcaacgtcttgtttttttagttgtttcaacgtttccgcaaccacccgcttggcaaccgttgattgatactcattcgattcaaccaacggcacaaactttgggcacgcctgcgaaacgaccgtcgcagtaggatctttggttaagatagcatctcgataagcattactacgaatcgtcccctcagtcgcaatcacaccgattcgattacgatgagaagcttttaacgcagcccgcgaaccaggcgcaatcaccccaataacgggaattgacaactgctgccgcaacgccggcaatgccgctgcggtcgcagtattacaagctatcacgagcattttgatctgctttgctattaagaaatccgccatctgaaaagaaaaagttcgcacttgttcagctggtcgcggaccgtatggcaaacgtgcctgatcaccaataaaataaactgtttcgcgcgggagttgtttcaaagcttgcttgacgacagtcaacccgccaacccccgaatccatgaagccaattgcatgttcatttgccattttaaaatctccgttcactgaattctgaaactttattatggtcttttttgaaattgatttcaagccagaccaattgcgacgaaattgtaaagtttccgttgataaattgaaaaaaaccgacacattagtggaaacggggtataataatgattatacagtggctagagtaccacgattttttgcatggaaaggaattatcatgacgaacgacttttattctcaatttgcgggcaactcgatcaaagcttccatcctcagtgtggaaatcttgcgagatgccttaataccaaagttattgggtgatgacagtagtggcatcctttactgggcgggtaaagacttggcacgccagtttcctgtcgctagtgatgatgatcttgttaccttttttgagcaaaccggctggggtcaccttgtcgtgattacaacgacggatgatctaatcacgtatgaattgactggtgagccggtcgctcggcgtagcgccacgatcaaatcaccagactttatgcttgaaactggctttctagctgagcagtcagcgctccgcaccaactgtgtgagtgaagctaaaattacgtttcaaaatcgcatgcgactgcgcatctcagttacgattgatcacaatcaaccaatcgtcaatcacgatcccgcaacaccaatcgaaatcgtgcggcctcaagttgaacttgatgacgtacaacctgaagaagcacagtaaaaaggacggccacgtggtcgcccttttttgcaacgttaaatagttttccttatatagtcattattaacggttgtccccggtcttaaaaaagagcgcaaaaaaacgcgccgttcacttaagaaggcgcgttcgctagcgaaccattaatgaaataatggcccagcttattatagatattgagctaaagtttgttggatctgttccttggaatggtagccaactaaggtatcaaccacttcgccatccttcttaactaataaggttggaatgctcatgataccaaagttgctggccgtttcagggttggcgtcgacatccatcttattgaacgtcaccttgtcacccatctcgtcagctaattgttcgaccactggtgactgcatccggcaaggaccacaccatgtcgcccagaagtcagttaacgttactcctgaagccgtatccgttgtaaaagttttatcagtagttgctgcgaccattataatcggcctcctttaagctttatctgttactaatagtaagtataccagtaaccgggtggaacacaaacaatttgcctgcaatcaaagcgccgatatcgtgcacagccatgaattcgcgtcatcactgatctgcacctggcactcgtcactggttatttgaactgcacctcagtcgcaccattgccgccatgatttggcacagcaaagtgaaacgacttgacttgccgattagacttgagatagttggtaatgccttctcgtagagcaccagttcccttcccgtgtacgattgtgacggaaggatacccggccaacaacgcagcatcaatatagcgatcaacttgagtcatcgcgtcttcataacgcacaccccgcaggtccaagttcggcgaaacgtgactcgcgtgggcactctgaacagtagcacgcgcgcgttttggctcttctggcttaacgcgttccaagtcaacgtcactaatcttcatcttcaagatgccgagttggacttcccactcgtgtttacccatctgacgcatcaacacaccacgttgaccatacgatttgaccagcacgtcatcaccttcatgaaaatcatgttgggctttggcacgccgtaatacacggtttttcttgagcttaggctgttgctccaatgcattcaacgcgcccttcgcatcaatcaactcgttttctttgacagtcgccgtaccactcgctaattgtttcttacgcaaatcactaatgatagcatcggccttagtcttactttgctcaacaatggtgttcgcctgcactttggcatcttcgatcaactgatctttacgctgttgatacgcattgaattcgctcttcaactgccggtgcaatttttcagaatctgccacttgggttttcagatgcagttgttcatcttcaacctgtttgcgcttcgtcaccaaatccgcaatcattgcgttgaggtcttgactatccgtatccgtcaacgaccgagcttgatcaacaatcgcttgcgggatgcccaaccgctgtgcgatatcgagcgcattacttcgaccaggaatcccgaccaatagccggtacgtcggcttgagtgtttcttcgtcaaactccatactagcattgatcgtatcaggtcggttaaacccatacgccttaagttctgggtagtgagtcgtcgcaacgacttgggttcccttggccccaatggcatccagaattgcgattgccagtgccgcaccttcttgcggatcagtcccggcacccaattcatcaacgagtactaaactgtgagcgtcgatctgcgctaagaaactttcaatattttccatatgggatgagaacgtacttaaattctgttcgatcgactgttcatcaccaatatccgcaaagatctcattataaacgccaacgcgacttccggcttcaacaggaataaataatcctgactgggccatcaattgtagtaatcccagcgtcttcaacgtaatcgtcttcccaccagtgttaggccccgtaatgaccatcgcctgataatcagtacctaaactaatatcattggcaacgactttgcgaggatcaatcagggggtggcgtgcttgccgtagatagacttcatttttgggtgaaacggccggttcagtcgccttcatatcatgcgcataacgcgccttggcattgataaagtcgaaatgtccaagaatcgccgcattattaatgatttcgtcctggtaaggcgcaatcaagttggagagtgcctccaagatacgctgttcttcttgcttttccgcaacttgattttgccgtaaccggtcattcatcgccatgacagcctggggttcgataaagagcgtctgcccactcgctgattgatcatgcacgatgccaccaaaccgactacgattctcggccttgaccgggataacgtaacggtcgtttctaatcgtgatgattgggtcgcttaaatacttggcatcatggtcacgggtataatgacccatttggttacgaatctccgtttcagtacgacggatattgctccgaatccggctcagttctggtgacgcctcatccgtgatatgaccgtcaccttcaatggcagtagcgaggcgcttcgtcacatctggtaaagtaactaattctgcaacttcatcaaacaggtgtcgaatatcattctcaggggcatcttctagcaactcggcaaaaaagcgcgtgattgcgcgcgttgtccgtaacacccgcccaacttgcccgagttcactcccattcagggtcgcaccgatagctaaccgtttcatatgcggttttatatccgctaaacgagcgaccggaatgccaccctttaaacgatacacttctgccccatcgttggtttcatctaaggcccgttgaatatccgcaacgctggtcattgggtgtagttcattgagtgcttgttggcccgttgccgagactaagtatggtgctaattgttgttttacttgttggtactctaacgtattcaatactttggaattcactgatatccctccgaagttccaatgaattacgaaaagccgcaaaaaaacggacaatgcaattacttgtcggcatcatccgtttgcattttcaataattcagcttgtttgtcaacctgatctgaaatcgcattgaatgcgagcaacgtcgcaatctccgtatcagacaaatcgggggctaatttttttaattgtgccacttgctcattcatcatccgcgtcaccgtttgcatgtgacggtcagatgccgtgccaatgatcgtgtaagtacgaccatcaatttccgctttaaagcggcgcttgttagcagtcatcaacatcccgcttcctttcaataacaattaatattctagcatggttatcacaattatgcgacagttagaaccgtctcataatttctaaaaaagcccgcggacatgcgcccacgagcttaatctactttcgactattgcatgccaccgtcatcggctaagaaggtattcaaaacttgctcaaccatatcccattcgtcgtccgactcgatcagttgtaattcgccattgtcgccatcttcaggattaaagatgtaggcttgaatatcaacttcatcatcggccgcagcatcagctggatataataaaatataggagtgaccgaaatcttctgaatcaaacgtgaacaaaatattaaataaggtttcgttaccttcgtcatcaactaatgtgatcacatcattgtctttacgatcttggttttggctcatgttagttcctcgctattcttgtgtgagtttgccgtggcgatccaagtagttttgcaagattaaacttgcagctagcttgtcgatcacctttttgcgtttcttacgtgaggtgttagcttcttcaaccaacatccgttcagcttcaacggtcgtcagacgttcatcttcaaagtctaccggcaaatgaaaccgggctgtcagtaactcgccgtaatgttgcgccgcctcagcccgtggtcccaaggtattattcatattctttggtagccctaggacaaagcccccagcatccaattcttcaacgagttcagcaacccggtcgattccgaattcctcagcatcctcattgattcgaataatttcaacgccctgcgccgtccatccaaaagcatcactaatggcaacgccaacagttctggaacctacatctaaccccatcaacttcatgcatcaacatccttatctgcctttaagtaagacttgacaagttcctcgataatctcatcgcgctgatgcttccgaattaagttccgagcatcctttaagcgcgggatatacgccggatcaccggatagtaagtaacccacgatttgattaatcggattgtagcccttttcttgtaacgcttcataaactgtcgttaacgtgtcgtggacatccttaacgctgtcattatcgaagtcaaagtacattgttttgtctaatgaactcatatcaagcacctcccgctagtttccgcttctaatctattttactaaatgcccatatgaagtacaatcaatccactttgatgtaacacattcgtaataataacccggagaatgcagacgttttctgcaaatccatcccgatttacactgttttttcatatactgacatacccctgtttcgaatgttcgaatagttgaaattcaaaacaggcacaccctttgtaacccaatcttctacgagttaagccggtcacaaggtaccataacattaaaaaatcagtaccgttagaacggtctcgtcctaacagcactgatttaattgttattttgatagctttaacatagctaaccaacataaaaaacaggatgtgcaaccaaagcaatcagtcttattgttcggcaagccactcatgcgcagctttcagcgccgctggtagtccagcaggcttcttcccgccagcttgggctaaggttgggcggccaccgccgccaccaccaacttttggtgcaatggctttgatcaagtcaccagctttgatacctgccttgaccttgtcatcactaacagcaactaataagttgaccttttcgccaatgactgttccaagtaccagtacgtcagaatactgcttggtcttccaagtatcggccaattgacggagttgatccatgccagagacttcaatttgttgggcgatcaacgtcgtaccgttcacatcgtcaacttgatcaaagactgccccagcctgctgtttggctaagcgactttcgaggctggcccggttctgttgttccgctttgagatcggcttgtaactgactaaccttggctggcgtatcagctaacttcggtgccttgacttgagcagcaacttgcttcaaggtttgttcttcgccggcaagcagttcgaaagcttccttcgaagtaacggcttcaatccgccgcgttccagcgccaatccctgtttcggaaacaatcttaaatagccccaattcactactgttcttaacgtgggtcccaccatcgaattcgatagaataatcaccaattgaaacaacccgcacaattttgccatacttttcagtgaaaaccgcaattgcgcccatcttgtgaccagtttcttggtccgtttgaatagcactgactggtaacgctgcccagatcttatcattgacgatttgttcaactttagctaactcttcgtcagtcacttgaccaaagtgagtaaagtcaaaccgtaaataatcaggttctacaagtgaaccagcttgtttcgtatgttcaccgagaacgtcacgaagcgcctggtctaacaagtgggtggcggtatgattcttttcgactttgttgtggaatgccaagtcaacgttcagcgtataagtcgcgtcttttcgcattggtttcaacacttcaacggtgtgtaaatgctgcttgttgggtgcattttgtacgtcagtcactttagccaccatttcaccggcatcatctaagatcacaccacggtcggcaacctgaccacccatttcagcataaaacggtgtcttgctgaaaatcatctcagcttgaccactgtcgacgtgatcaaccagggtctcgtcaacaataatgtcgttcaaagtcccctgcacattcgttaattcgtcatatcccacgtattcacttggcgttttgatgtcgatcaagagactccgttggacgcccatggacttggcactgctacgtgcattgcgtgcgcggtcacgttgagccttcatttcaacttcaaaaccagcttcgtcgacatctaaatcttcgtcgccagcgtattccttagttagttcgaacgggaagccataagtgtcatataacttaaatgcatccttaccagctagtgtatcgtgaccagcctgcttggtttccgcgatcaagttatttaacagattcaacccatcattcaaggtctcattgaagcgactttcttctgaagccacgatcttttcgatatacgcactatttttgagcacgtcgggatagtgtgaagccatgatcttgccaacaatcggtactaattggtccaagaaagcttctttcaaacctaatttttgaccatgtaggattgcccgccgaatcaaccgccgaatgacatagccacgaccttcgttggaaggtaaggccccgtcactaatagcaaacgtaatggcccgagcgtgatcggcaatcactttgaaggacacatcgtcctgggcgttatcaccgtagtgcttgccatcacttaattcttccgtcttatgaataattgggaggaataggtcagtttcaaaattggttttcgcattttgaaagaccgaaacgacccgttctagccccatccccgtatcaatattcttacgcgggagtggttcgtaagtaccttcaggagtgtggttaaattgcgaaaagacaatgttccaaacttccaagtaacgttcattttcgccaccaggatagttttccgggtcatcatcagctaaattattgaaagcttcgccacgatcataaaaaatttctgaatcggggccagatgggccttgaccaatgtcccagaagttatcttcgactttaatgatgtggtctggtttcacgccagttgcttcccagaatttcacggcatccgtgtccttgggataaacagtcatgtataacttgtcaggatcccagccaaaccattttggtgaggtcaagagttcccaggcccaactgattgcttcttttttgaagtagtcaccaactgagaaattaccaagcatttcaaacaacgtgtggtgccgcgccgtccgcccaacattctcaatatcattcgtccgaatactcttctgtgaactcgtcatgcgggggttatccggcacaacggagccatcaaagtacttcttcatcgttgcaacaccggagttgatccataataacgttgggtcatccacgggaactagtgatgcactagggacaatcgtatgacctttttcatgaaaaaagtccaagtacatttgccgaatttcactactacttaattttttcatttaattctggcatcctctctatcattcttaatttaaggcaaaaaaacaccgttgctagcaaagacgctgttaacgcggtaccactctgcttgcaacgatgtgttcgtttacctcttaagctcattaacgctgagacacggactagtttgctagtcattacttctaggtagcatctaccccacaccgcactttttccagcaaccaaagtgtttcttgaccgatatgtgagatagatatgtccttactttgcaaagtatagaaaacttgcggcgacttgtcaatacaccactcagttattttgcattaatctatccggatgcacgtcaattaagacttacgatccttgcgttccttgcgggcagccgctcgttgttcgatgcggcggtccatccgcgccttatcgctgatctttttacgaatgcggcgtttgtaacccggcttgatctttttcttggactttttgacgtaaccaatcaaggttgggtccagtttttcctgttttggcccccgtttagcccgacgattacggtcatatgaatccacaatctcaccatcacgaatcgccttcggtttgaacttgatccccattgcttcaactgcactgaccttggcttcttcgcctgggctatataacgtaatcgcagtccccgccattccattccggccggtccggccaacacggtgaatgaagaattctaagtcattcggaatatcatcattgatgacgtgtgaaacaccttcaatatcaatcccacgggcagctagatcagtggcaacaacaaattgatacttcaattgttggacgtcgcgcataacccgctttcgttcacgtggttggatatctccatggatcattgcgaccgttaaaccttgttggcgcaaataatgggtcaactcttgaactcgttccttcgtgttagcaaaaatcaacacgagatacggttcaccaatcgtcagcaagcgataaataatactgtttttatcgtgactcttggtggaaatcagccagttatcaatagtcggactaatcacagattctactggaatttcttccataactggattgttcatgtacttgcgcaaaaatggcgttaatttttgtggcatcgtggctgagaacaccaacatttgtaaatcagcaggcattcggccagcaatctggtcaaccacgttcaaaaagcccaagtctagcgtcatatcggcttcatcaactactagctgagtcgcacgatgcacatcgagtgcctgggagcgcattaagtccagaatccgtcctggggtcccaataatcaactgtggttggtgccgatttagcttttcaatctgttcctgcttatcagtcccaccgacatagagtccaatgtgaatggctttcgggctgtgttggatcaactgtttagcagcagtctgaatctgataagctaattcacggctgggcgttgtgataactgcctgcacgtaacgttcatcagcattcagttgattgatcattggcagtaaaaacgtatgcgtcttaccactcccagttgctgactgaccgatgacgctgcggccagcagcaatcactggaatcaacttttcctgtaccgcagtcggtttgcggaaattgatgtcagtcagtgcctgcatcaagaacggctgcaatttaaaatcttcaaaacttgcggtcatatttaaacctctttctcataatggctagcgacttggtcgagttctcgcactaccgtttcaatttcttgttggtctttagccttggcaccgctcgctaatgcgtggcccccaccatcatggttcttggccacaccgttgattgacggtccctttgaacgtaaccgaatacggaagtcaccttccttttgttgaacaaaaatcgcccagcacttaaccgtatcaatacgcccaggtaatgggacaaccccagcagtactagcatcaccgattgcaaatgaatcgagaatcgcattcgttaaaataacgtaagctgcacccgaatccaactgtgtcagatgttcataaacgtaggccgacaaccgtgcgactggtaacgtgatggtatcttcaatacgattaacagcttcagcatccgcaccggcttccattaaggccgctgctgctcgcatggtactaggcttggtcgcagagtatagaaagcgaccggtgtccccaacgatgccggcatacaacaaccgagcggcgttagccgttagcgttaactccaccgcaaggggtgcgtaccaattataaatcatctcactcgtactggaagcatcaacgtcgacccactgtgggtcaccgaaagcgtcatcgtttgggtgatgatcgattttaacaattgtcttaccttgattccaaagttcaccatcaattcggggctgattagcggtatcaagaattaatactagtgcgtcttgatagtccgcttcggtaacctcatccatttgtcctaaccagtcaaaaccatggtactgttttccaggtgtcaatacccgcttcgcaggaaagctagctttaatgatagctgctaaccctaactggcttccgatggcgtctgggtcaggtcgctgatgacgatgaatgatgattgtttttgcttgtttaattaagtcaaaaattgctgtttggacggtcataaatgaaccttcttactctcataatttactggtggcgattaaactgtcacagtactccagtataccgaagaatccgcgtcgcgccaaataaattaattatcatttggataaagtggtaacgttaagttctcaaacgccagtggtgccaagccagttagcgtgatccctaacaggcggatgccagagttaaaatgatcatcgaccacctcttcaaaaatctcttcggcgtactgctcaaacaaggccgcgtcattaggtatgaattcaccgaacgttcgccgcttggtaattgtgacaaagtcaccgtaacgcaacttgagaacgagtgttttaccgtggcgctgatgcgattgcatgctagctgctaccaacttagcgatggccttcaagtgcgtattaacttccgtcgtcgattggagaaacggtccaaacgtccgctctttgccgattgatttccgttcacgtaaatactcgactggccgatcatcactgccgcgcactcgccggtataaaatatagcccaacttgccaaattgtttgattaggtctaattcagactgtgcgtataaatcctgtccagtcttgattcctaaatcgtgcattttaggtaccgtctttttaccgacaccccgaaatttctcgatgggttcacgtaataaaaatggttctgcatcctgtggtaatacgatcgtcacacccgctggttttcgataatctgatgctagtttggcaatgaatttgttgtaggagattcccgttgaacaagttaaatgtgtttgatgccaaatttcttgttgtaatcggtgcgccagttcgaccgcactatggatgtgtttcttattcgtagtcacatccaagtaagcctcatcaaaggcaattggctcaatcatctctgtatactcatggaaaatacgatgaatctgcgccgaaacttcgcggtacaacggaaagttgggcgtcttaaatactgctgttgggcagagttctaatgctttagcagctggcatcgccgagtgaacaccaaattggcgggcaacatagttagccgtcgtcacaacgcctcgcccacctgtctgccgaggatcatgcgcgatcactaacggctgcgtcttgtaggctggatgctcccgctcttcgatcgacgcataaaacgcgtccatgtccacatgaataattttccgactcgtatccacccgaataggcgcttcaacaattgactgtgccatccgccgcccctccaatccttagtactttcattatacacgaacatacgttcaaaagcgcgtttcaagaccaaaaaataagcaaaaaaaataagcggtcatcagtaatgatcgaccacttatggtgtaaacctattttgcttcagaatcagcattatcgtcggcggctgagcttgccgattcaacttcagaagtagcagctgattcagccgctgccccagattctggtgcaactgtcttagcttgtgcatcttcggctggagaaatcttagcaacagcgttcaaatcaaaaaccaagtagatgccatcacagtctaaagtaactgttttttcggtttcgttaacttcatcaacgaccccgtgcaagcgaccaattgtcgtaaccttgtcaccacgtttgattttgcttaacatttgttgatgttgttgttgttgtttccgttgtggacggatcatgaagaagtataagaatgcgaacatgaccacgataaacagaattgatgccatttgacccatttaatatcgctcctactctaattaaaagtttgactatctttaactttaacaaattacagtctgaaataccagtagcactaaaagtttttcgggtttttatcgttaaaaccgtacatttcaaagaagttctggcgaaactccagtaaattatcatccataatggcttgacgaacttgcttcattaagtgtaacaagaaatataagttatgataactcgtcaaacgcaaaccaaacgtctcgtccgccttaatcaaatgacgaatataagcacgcgtgaaattacgacaggtataacaatcacaattatcatctaacggggtgaaatcgtgagcgtaggccgcatttttgacaactaaacgcccatgggacgtcatgcaagtgccattacgggcaatccgagtcggtaagacacagtcaaacatatcgaccccacgaattgcaccgtcgatcaaggcatccgcagagccaactcccatcaagtaacggggtttattttctggcaatagtggcgtcgtgaagtctaaaacatgattcatctcagccttcgattcacccactgataagcccccaatcgagtagcctggaaagtccaagctaacaagatctttggcactctgttcacgcaagtctttaaagcccgcaccttgaacaatcccaaataagccttggtaatcagggtgttgatgaaccttcaacccccgctctgcccagcgacttgtccgggcaactgacttgctaacatagtcgtaactttcaaagaatggtgggcattcatccaaactcatcatgatatctgggccaagatcattttcgatttgaatagccttttcaggagataagaacatctttgagccattcagatgattcttaaagtggaccccttcttccgtaatatcacggtttttagccagggaaaagacttgaaacccacctgaatccgtcaagattccctttttccaattcataaactgatgtaacccgccagcttctttcacgatttgctcgcctggccgtaaccacagatggtacgtattcgataagataacacccgcacccatcgcgtctaattcttcgggtgccagtgacttaacactggcttgcgtcccaacgggcataaacatcggtgttggaaaggtcccgtgtggcgtaatcaattcgccaaggcgggctcctgtgtgtttttctttcttaattaatcggtatttaattgccggttccatatctgttcctccgtattaaaatgttgctaaactcaaataatgatagcacgaaatccagccgtgaaccagtcgcggcaattggcgtgggcacccacgtggctttagtcagtctgttaacaaagcgttcaaacgtcaaatagtcgcctcaagaatgcattttaacttcttgaagcgactattgacaatctttattatctccagagctaaaacgtcagcttgaaattagcgatacgcctcgtataatacggcattttaatattcaaccgtcatccgtttcaaaataagcgatctcgtttaaagccagttatactagtgaataaacatcgcatcgccaaaactgaagaagcgatacttttcatcaatcgcatgttgataagccttcaaaatcatatcacggcccgtaaaggcagccactaacatgaccaaggtcgacttcggtaaatgaaagttcgtgatgaacgcatcaacgactttccattgataaccaggtttgataaagatatccgtccaacccgaatccggcttgatttcaccatcaaacttactaccaatggtctctaacgtccggattgacgttgtcccggttgcaatgatgcgcccaccattttgccgtacttcattcaacgtcttagcagcatcttcgtccaatcgataaaattcactgtgcatcttatgatcatcgatattatcttcttcaactggccggaacgtccctagtccgacatgcagcgtcaagtaaaccaacttaatacccttgtcttgaactttttgtaagagttccttcgtccagtgtaaaccagctgttggcgcagctgccgagccattttccttggcataaacagtctgataacggtctggatcatcgagtttttctttaatatatggtggcaatggcgtttcacccaggctctccaaaatttccatgaagatcccatcgtaatggaactcgatcattcgaatgccatcttccttttcggccgttacggtcgccgtcaacttaccatcgccaaatgaaatcacggtaccgaccttggcacgcttggcaggtttcatgagtgtctcccattcatcaccttccgtattatgcaataataggacttcagcgtgaccaccagtttcaggtttaacaccatacaaacgagctggcataacgcgggaattattcataacgaccgcatcgcctggattgagttgatcaataatatcgtagaaatgcttatcttgcatttcgcccgtttggcgatccaattccaacaaccgtgaactatcccgttttttgattggtgtctgggcaatcagttcatgtggtaaatcataatcaaaatcttcaagtgttaaactcatgttgtgacctcttatctttatttattttctgggtatgggaatcccaaatgctgataacctttaattgtaacaacgcgtccacgttgtgttcgcttcaagaacccaatctggagtaagtacggttcgaccacttccgcgattgtatccgtttcttcaccaatattggccgcaatcgtagcaagcccgaccggacccccgtcataatactctagcatcgttcgtaagagcttattgtcagtctcatccaagccggcatcatctacgcgtaaatatgtcagtgatcgcgccacgatggcctcatcaatggcatcttgatccgccacttctgcaaaatcacgaattcgcttgaacaagcgattagcaatgcggggcgttccccgtgagcgacgcgcaatttcgtgggcacccgatggtttgatactcgtttgaaaaatatctgcagtccgcttaacgatatcttccaaatcagcaacttcatagtacgccatatgttcgacgattccaaatcggtcacgtaacggagctgacagcataccagctcgggtggtcgcgccaatcagcgtaaacggcggcagtggaaagtgtacgggatgggcggttggcccctgtccgaccacgatatcgacaaaaaaatcttccatggccgaatacaacatttcttcaacgattttcggtaaccggtgaatttcgtcaataaataagatatcacccggctccagttcattcaagagcgcaaccaaatcacctggcttttcgattgcagggccactggtcgtgcggatattgacctgcatctcgttggcgattaccatcgctagcgtggtcttccctaatcccggtggaccatacagcaaaacgtgatccaaggattcctcacgcttgcgggccgcttcaatatacactcctaattcgtgcttgacccgggcctgaccaatatactgggctaacgtttgcggacggagcgatttttctaatgacgcctcttcgtcatcggctttgtcaccggataataacttgtcatcgtccatttagttacctctcccatctacttcttcatcaatagtcgtagtccttcactcaacaaggtgttcgtatcggccccttgtgtctgactaaacgtctccaacttcttagtgaccttcttgacatccgctttcgaatagccaagagcttccagagccgccaacgcgtccgctaacgcgccatcaacagcaggagcatccacatcgagcgcagtttgaccagtcacatcaacgtttagatcgtttaatttacctttcaagtccagcacgatttgctgagctgtcttcttgcccacgccaggaaaactcgtcagataagtcgcattctcttgattgatggcttggatcagacctgcatggtcgttgttggccaaaatcgcgagggccgacttcggaccaattcccgaaaccccgagcaacttttcgaacaacgccttctcgtcagcatcaaaaaagccaaataggctcatgccattttcgctgacggcttgatggatatacatcttaactgctgttgggcccacctggtaacggtatggattagccgttagcactttataaccaatgccgctgacctcaatcaccacataaccgggggttacatcggtcacttgaccgagaaaatattcgtacaccgaaaaaactcctttaaataaaacgtatgtttgcttgctaaattgtaccacattttcacagtggcttaacactggtgcaccgataaaaaccaaattttaatgttaaatcaatttcacctcgattgacggatttcgttgcaagaaatgcttgccgccacgttaacgtcatgctatgctcaaagtcctagggaggtctcgctatgcaactcaaaccgtttaaagcggtgttaccaaccacaactggtcaaactaaaattcaaacagctgcgaccaattgggacagccaggatacaatgacgacaaccgaagccagctattactggtacgaactcacactcaacggtgttcaccagtggcgcttaattggcagctggccggtggatcaaaccgtgacgaccatggttcccggcacgatcaacacagtcctttacccacagcagcccgttatcgagatgttgattgacgactgggtcggtcattttgccccggtcgtcgaggtgacggataccgcgcacgtcacacatcgactctggcagattactgagtctgaggtcaataccgacatcacaacggccatggcacccgttatcccgcagaaaacgtggttgacaacggtcagcacgccactcgtcatgttagtctcaaccagtgaatggcaaaaattagtcactgcaccggtcattcccgaacaattaattgcgttagcgacacctcataattaaccagtcgtggctgttaattgtgaatttcgctatggcatacattcgtttgtgttccatctaacgttaaataggcttcttaggaatcaaagttaattcctaagaagcctattttaataccgatttactcaattaagattgtctgacacgtttgtgaagcccccaccagcaggcaatcagtatgctaatcacaccaccaataatactcgaccatatgccgatttttagtcctggtgtgtgatacgtcaaccgaatctggtgccggccggctgtcaacttggcccccacaaaccctttgttgacgacttgggtcctaacggtttgaccgtcaactcgtagctgccaaccagtcgaatacggaattgacgttgttaacacggttgctgtcttagtcagcgtggttcccgtaatctggttgttcgtcacttgttgatgcttcaacccactcgtctgtagttgccgcgtccgttgacgataagtcttcccaagcggtacagcgatcagtttagcggacttaaaatgcaaactacgaatgctcgtaaagttcaacgtaatcagcttacgcgcgtacttgctataccctaagttgattactgctgatgtccggggctcataatctgacatattcgtggtacccaactgactaaagctcgtcaagttatccgttgtctgagcagttaaagaatacccactagcgctcaaattgcccttcagaccatcgcgaacatcatctagataatcgactttggtatacggacgggccgtgaacacgttggtattttgactcgttgtcaaggcgtgcttgattgaggaacgccgataactgatgccatctagcacaagatagagttccgtatttcgatacttcttagggtgttgaatggtcaattggtacggtatctggtgcccctgcacatcactgaccatgctcgttaactcgtcggcattgttttcctgatttttctggactaacttttgattagctgcaatcaagttcaacacgcggtttgacggtgtcgtcaggccagttgccggcgtcaaactttctcgttgttccggcgttaatgtgatcgtatctgccggtaacttagtcaacgcgttgttcgacgctcccgttgcatgttgattgcggtaaataatcaccttgtccaacgtatccaaaacattcgtcgtatccgcttgaaccgtataagcgacgttttttccggtaacggttggcttgacagtcttaacaccactaacctgctgcgtagtgaccgcaccttgtaacaaggcttgctcgcggtcaactgcgttcaagcgattaaattggcgttgactaatctgatgctgctgtgtataaactaacggcaacgcattcttggattttaacaagatcgtgccggtatgattactcatgccataaataaacttgtccgcaaaaatcttcggttcgccagttttcatcttaacaacctcatatccggctggtaaggcttgtttcttcaactggtcctcacgtgcaaataaatatttaacacctaataagttatacatcgtcgtccgaccgtccaacgaaccgagtggcgagttcatcgcatactctgagttgcctaaggcctgactaaatgcccccacgtaaccattttgaactgaaaaatacgatccaaccgtgtgagttcctaacaccatcggcacatcactctcagccgaacgcatcgtatagtagttgggtgccaaagccgttcgataaaattggctagtcgtggttaaacttttttgcgcgccatcaaaataatttttgacccatttcattgccgcgccctgccgcaactgctcagtactattagaattagtattgatactcaaccagcccagtccgttattcgccaggttcagcgtgacaattcccagtaataacacataaaattgccgattggtcaattttaaggattgtttggccagcaggaccccaattaacgctaacaagataagatatgtcgcaatatcatgtttgcggatattgagatagaatccattgatcagccaaataatgacaagcagaccgccactaataccagccaaccattttaaatcagccgctgtcagagcagtgacttggtccataaatgccatcgtcgcataagcaaacacgagggttgccatcaacaaccatcgattagaaggtgttgaaaaaacgttgaatacggccgcaaattgaggcaacaaaatacccaacatcatcacgaccagtacccaattaagcacccaatagcgtctgaaatgacgtagtgtataaataattgcaataaagctaatgctactcagcccgagggtcacccagtattggacactgccaccattggtcaacagtcgattgggtaaattaacgtaataattgatgggataactcgtcaagccattcgcaaagttaaaactcgcacgcgttgccgtcaacatcgcgagcagcgtgggcactagtaagatgcctgccatcgtgacaccaagaccaactgccactagtaaccgccaaaataactgtccaaacgaccgcatcgttaaatggtcacgacgacgtgaccagaaacgcaccaaagcatagactaaaccgcccaatgcgagtaagtaagcaaaatagaagttactcaaaattacaacggcggtaatcagactgagtggtaaccaatgtcggcctcgtaagacccgttcaatcgcccaacacagtagcggaaaccaaatcattggtaacaagaaaaacgggtggtgcatcccaacatagaacgtatacgcggtaaacgtatacgtcaaagctccaatcaattgactgatacgtttgaacttgaactgccgactgaaacctagaaaagcaagtccaacgaagtacaatcgcagcaagatcaacgcttggtaggcccattccaaatgagcgcgcgaaacaaacgccactaaataattaaacggatcaccgaccacgtagtaggaaaaagtcgtcagttgatcggcccccaagccgagattccatgaccaactgaataattgttgtgggtggtgctgtaagatccgctgaaattccaataaaatcgggaagtgttgggcgatgccatccacttcccaaatcaatgtccggccggctaagaaaagcccactgtaagtaatcgtcgcaataaccacaaacatcgccgtataccagacgactagtggtatcttccgtactgtcttcaaatcaggtgcccctatcttgtaattacgtcgacaacgcaatccccatattttgccatctcaaacaatgtttctattttaccatgaacaatttcgtctcgtgatgttcagtttgaatcttaataaattcgtgattcacagctgtcccatcaacaactaacgccaatcccagttatctaaagtttcaatcttagtagtcgccggataactcccaaacaactgtactaaaggttgtaagccactcacagcattatcacgttgtaagttgatcgcagcgattgccgcttgatcatgacggttaggatcgagctcaaaaacagcaacttgctcatataaatttagcgtaatcaatttggcgtcccgcgcacttggatgcgcatttaattcccacagcgtcttgcgcccggccacgaacgtgggcgtggcctctggtaaatctgccaaaaaacaatatgccgaataaacctggcgataataaagtttggtcatatccaaaacaatcaactcccaatcatgttgagtggtccaagcacccgatacgcgctcaccactcattttaatcaatgatagctaactatttaaaccaattcaatctgaaattttacaactcaaattagtgtcacaaacgccacttccccaatcttaaagttgttttttagaccgcaatactggcgacaataaaagtgaggctgtgacataagtctctagaaacaaagcaggtctggaaaaatcttcgaatttttccagacctgcttttgatataatagaaaaccaaaaaagagcatcggtcgcacccgatactctacgaaattatcctcgaaaggacattcctaatatgcaagattattataacatgaatcaaaccactttgagtatcgccttggattaccaaccagaagagcatcattctgctcgttacatcaaccagcttgttgagagtttaaaactaaaatatgattaccagtttggccgtccgcgggaatataacctcggtgccatgttaaaactggtccttttagcgtacagctatggcattttcagcagtcgtaaaattgaacggtttgcccgtgaaaacaagccagctgggtggttaattgccgaccaaattccgtcctaccggacgatttgtcgctttagaatttctgatgaactggccactttgacaaccgatagcttatcacaactaactcaatatcttcgtcaaaatggcatgattgatgatgtttcatttattgatggaactaagatcctagccgacgccaacaagtatagttttgtttggaagaagaatacgatacgatttgacaagatgaatcgcgagaaactcgttgacctgttaggcgagcttcatgaagctaaaattgtcggtgaaattccggcaggatcagagctgactcccgaactattggatatcatgattagcaaggttgaggatcacttagtggtccttaatgaaaccgtggaagcaactaagcaggtttccccgaacccagccaaacagcaacgccggactgttaaatcacaaaaacgtaagttggacaaacgacgtgataaaatgcgtgaacaccaagcacaacaagcaatctatggtcagcgtaacagttactctaagacggactatgatgatgctaccttcatgcgggtcaaggaagatccgatgcaaaacggtcaattaaaacctgcctacaacgttcaaatcgccacgagtaatcagttcattacgggatatcggcttttcccaaatccaaccgacacacgaaccttacaatcgtttattgaacatttaaaggccaacaatgtgttaggtcacaccatcgttgccgatgccggatacggttccgaaagtaattatcggtacttggaagatgaattcggtcagcataccgttttgattccctacggcacaatgcttaaagagaatagtcgaaaatggcaaagtgatgaccgtaaggttatgaactgggactatcatgaaaaagatgattattttatcaatccgcaaaacgtccggtttaattttaatgcttatcgtcaacggactgataagtatggttttacccgtgactttaaagaatacattgccgaaaagtatgatgaaaatcatcaactaatttccgcggcactaacaccaaaaggatatcttaaaaggatttccgtgaacgaaaattgggaatatttcaaatcgaaacaacgagaattactttcatctccagaaactggtcagatttacgctcaacgtaagatcgatgttgagccagtttttggcaagatgaaggcttctttacatttcaatcgattctcggtgcgaggtttcgacaaggtcaccaaggaagccggaatcgtaatactggcgttaaatattatgaaactggtcacggtagggaccaactttaaaaatcaaaggcgtaagcgaatgggacgagaaaccgaattttggtttctcgtcccattcgctt

SEQ ID NO: 18 - DNA, 50196 bp, Lactobacillus plantarum
aaatttgcaatctaccatattggcaatattttaggcgtcgcacttggttctcttgcactatttacaacaatgagcatcgatgctggatatcgagttagtacttacttgccagcacatcctgcttggtttgcccatggtttaacctggtcctttagtgtttctcttatttgtgctttattaggctttgccattagtattattaaccgccctgcacactaagctaattcatttacaaacaaactcttaacaaccgttttaaggacattaacagtcttgaaacggttgttaatttaactagtacttgatcctgccaaagtattacctgctcagattcaattttcatggtattttttatattctaagtctgaatctaagaatttcttagataaagtttatggaaagtcgatagttaccacggcgatatgccggtaaactatagtcattcaattaaacaaaccaactttaaaaattaactcataaaaacagaatgactcacaacaactaaggagctatgtagatatgttattagatactgatccaaaaattaaaaatatcaccgccgttcaattggttaaggtgacctacccactggtgattgcaaaaactgaagatggcgaattcgttaaagtcaaactcagtgatgaacaactacaagatccattattctgggacacgttaaaaaacatccgccgttcgcaattatgggtgccacttggtcgtcactttcatcaactactctctaacgactggttaatgccagctgcccaataatcattcactgaccgccaccgataataacaactaaaaggagttcgattattatgaaaaacacattcaaaaaactaaccctaactttaatggccgccggaaccctctttgccacttccgtttccgcctctgctgatacgacgacaactaagcatgagacaacgtccaccacactcgtcaataaagtcactcgtgatactaaactcgcaacgggtgccacgactagccaaccgaaacatgatttaacaccgcagccaactaagcttgttgttaaatccacccaaaatcaagtgttagcaaccattgatgctagtagccagagtatcactaagatgaagtatctcactaacgcaaagtagtactgccacccttaatttccgccccgtcacttaagcccttaaaggaggccccgcgatgagtcagctgactaaggccattacccgccaattacaacgtcaatatgccgaaccagttctgaaagatctaaatggcaactggtataccggggccgatgttttagaagacctcgcactgtgtgaaactagtctgcaacaacagaacgtgcatgccggacaagccattctactgagccccgcacaagtcgtaacgattccgggattgttgctcgccagctggcaattgggactgacggtcaccctgacaccgcctagccgccaattacccgagctggcgcctcaaatctacgccgccatggtttattcccctagtcaaacgaaccagttagcaaccaaattagatccccatgaaatcagcgttttaacgctaattctcaatacggcgcctaattttgcttacctagttcacgaccacgctcaaccgttaacacgccgcagccaaccggacctgatactaccagccagtcaactccagttcacccagtcccagctacttaagatggctgagcatggtcaaactagcgcacacgttcacgatttatataaccttgagaccggattgctcccctgcctcacggacctcatcactgcgaccccgtttaccatcataccaactaagcaagactggccatccaaagtcagttaagcgccaattgccgttacgtgttagcactttgaatcggtatcttgcattgccgctgctcccgaaagacaaaatgagctttccaggaatccttgtaatccctagaaagctcattttaatgtttgcttatttaaccagaccgacagtctgtaaaataaggtaaatgttcaagataattagaatcaccgtcacgatccaagccgtccacttgacccagacacggttggtgaagttccccatcagcgcccgattactcgtgaacatgactagcggaatcatggcaaatggtaacgcgatactcaggaagacttgcgacatcgtcagcaaatcttcaattttcgcttcattgccatgataataaatcgcaaaagccaacaccggtgtaaccgagattaaccgagttagtaaccgttgtgcccagagtggcatcttcaaacggataaaaccttccatgatgatctgaccagataacgtccccgtaatcgtagaactttgaccagaggacaacagcgcaatggcaaagagcatactgagtaacgggctcgcaatcgagccaacgaccttactatcgccaagtgcattgtacaagtcaacgaaccggccaagatcacccttagttccaaagaacagtgcggcgccaagaattaatagcaaactattaacaacgaacgcgactgacaattgaatattggagtcgattgtcgtgaacttaacagccttggcaacttctttttcgtcactccggtcaacttgacgcgtttgtgagatggatgatcccaagtacaagttatgtggcataacggttgccccaacaattccgagtgctaggaatagcattgaacggttgctgacaatccgactagttgggacatacccctttaacatttctggaatattaggttgtgaaataataacttcgtataggaagacgaagagaatcaccgcaaccagcgttgccacaattgcctcgattttccggaagccaagtttcattaataataacagaatcaagacatcggcagtggtaatcaaaataccgacaattaatggaaatccgaataataacttcaaagcaatcccagaaccaatgatttcagcaacatcggtcgccataatcgctagttcagtaataatccagagaaaaatccccattccttttgacgttcgttcccgcgtcaattgtgctaaatctttacccgtcacaattcccagacgagcggccatggcttgtagcaacatggcaattaaacttgataacaggatcacagaaagtaatgcatatttgtactgtgatccacctgcgattgatgtgatccagttcccaggatccatgtacccaactgcaactagtgcacccggtccagtgtaggcaattaaggttcgccagaagctggcatccttagggacccggacactcccattgacttcgtccaagctcttactatcggcacccgttgaatgaatcgccttttcttcggcagctttcatcttagcgtgatccttcgtttttgctgatttcattatgaaaccctctcttctattggtttagaattcaggttgtggactactacgtgatcctcaacagtgcgtccccttaattgagcactcactttaattccaattggtagtatagcaccattaacctattagtcaactattattaattattactttggcatccctaaagcttgttatgacgcggtattatcatcttgtaaggggattctccgtgggctcaaaccattaactaaaaaatcactgagatagcgaatcaattgctcatcactcaaatcatccagttgtgggtagagaacctgttcgactaaatatcccccaatggttgaaaacaccaattgtaaaatcatgcgattcggccaatcaactaattctcgagcggctttcaagcgatccatcgcttcattcgcctgcgccaaaatgctaggtgagaccatccctaagacggccgctcgatcctgagcattattgaaaaattgggacaaaatgacggctaaggaggctcggttacgtgtgacaaatgcgacccgatcgcgcacaagggcgacaacaaatgcttgcaaagtctggttaggactatctaaaactgcctgatccaaagtgttcaacatcgttggcaaaatattctgcacaatcggctgcataatggcgtcgagaataccgttcttattaacaaaattatgaaataaagttccttcagcgacaccggcccgctctgcaatctcccgagtgccaacttcttcgtaacctttttctgcaaataagtcgagcgcggcggctaaaatttgccgttgggtccgggtaatacgaccatcctttcccaatgaagccgcataataggcctggatggtttcaatttcactcatgatgataagctccttttttgcagtaactgctcaattttggcatttacatcataactgattcggtcccccaaaacaaccatctttataaaagttacatcatcagcttaactaaactcgttaattgcttttataagtggatttatttataatcatagtaaccaattaagttacaggaagtgattatatgcgtgtttcaacccgctttagcgactcgatccatttactagcctacattaaaatttacgcagatactaaattaacaagtgacgccattgcccgcagcattgaaactagtccagtcgttgttcgccgattgatgagcaagcttcgacaagccggactaatcacaacaacgcccggtactgctcaaccggcactcgccaaacctttaagtcaaatttcactgctcagcgtcttctacgcaattgagggcgataagccgctactcgccgtcgatcctaagaccaatccggattgtattgttggtggcaatattcaaaccgttctgaaacaatactatcaagacgcgcaaacggcggccgaagcacggttagctaagactagcttacaagacgtggtcgataatattttagtggaacaagcaaagaaagatgcccacaaataagctgccagattagctgacggtgtacgattgcggaagccagcgcgcatgtcgatactaaagttataattcaccctgcaagccactccgtttaaatacaaacatgctagtatgtttatgcctaacttagacaaaaaattgcacttcagaatcaacatctgaagcgcaatttttttgttgaattatttcatctagtacaactttaataacaataaacggccagctcggtgcatattatccagcaatagggcgaaaagacaatattgcgctgttttcgacaccccatgcgtcacgaatctaccgcggttgctcatcttgtccataatattccggcttttcagcctggacgggatgggcctgtaaccagctaataatctggcggctgaggtcatccgtcattggtgccgcagctgctatttgtgctttagtaatttggttgacatgaattcccgcagtaattgtacagcttccaactagataacgctgaatccgcttggccattcgttccgaaataaagttatctttatggaagcgaccatcatggctgggaaacttaaccgtttcgggaaccgtgctggcagttagtgtggtcacgtcaccaatatggggattggtcccaccggtaacgacgatcaacaagtcatatccaatcacttggagtgttgcttgcatttgatacccggcctgctcagtcgtaaaagttgccatacttaatccccctcccaacggcgatcagtttcattatgaatatgaaacgcatctaaaattttcatggtttgatgattgaccagatcctgaatggattgcggatgattataaaaagcgggaatcggtggaataatttgggcaccgagttttgccaacttcgttagattttctaaatgaatcacgcttaacggtgtttcacgtggaacaatcacaagtttacgttgttctttaatcgtgacatcagcagcccgcgatattaaattatcaccgaagccgtacgcaatccccgctaccgtcttcatactagctgggacaatgaccattccgtcattcaaaaacgaaccgctggcaatcgctgcgccttggtcattagcccgataagtagcatccgcgagcgccgttagctgcgcgagcgagtaatcagtctctaactccaagttttttttagcccacgcactcattaccaggtgaacttcaacatctggccgctgatgtaacttttctaataagtcgaccgcgtaaatcgtaccggacgctcccgtgattcccacaacaattcgtttcatcctgacaccctcgtttcggcaattctacaattataaaattagtcatttacctgtctatgataccttgcaaaaatactacaaacaaatcaagtttagactaattaatattcaaaaatggaatattaattagtaattggcatgtcaattgaatctgttatgactacgccaacagcattaataaaagagtcatagatttcctcaaaaatttgaaaagatctatgactctcttttgtattagcaagtaaacaaacaacttgtcaactattcgttatttaactgaaaccagctcaaacaattgctctagtttcaaattctctaagagcagcttgattatactcccgccaatcaaaacgttcaaaacaaacctgttgctccatatctagcacaatcattagtgctgcatcattttgtacatcataatgagcaagttgaccgttctgagcggcacgctttccgtcaataaacactgcgtaattcgggtaactttcaacgtgtttaatttcaacgaatgcacgcccgttgctaccatttcccaaaacgatatctggattttcccaatcatctgagctagtaacccatttaccgtcaacttgggtttcagcatggaagattttcaatggctcttttacagtttttacatacttgatactgtccttggtctcaattgagagagctaaagtattcgccaaactatttggatttgctacggcatttttaccgctcagcaagccaaaacgtccgcccttgattacatcttgaataccagcaacatctgttccaacaaccggcttgtgtgcaagcaaagcttcaataatagcaagcccttgaccctctgtaactgatggcagtacaacataatcagtaaatgacacaaatttcattggatgctgcaaaaaccccatcatgaacaccgattcatctaatcctaaaccggaaataagttgctctacttccagtcgtattggaccatttccgacaatatataatcgcgtcttcggataattatcatgtactaacttaaatgcttggattaatcctaaatgattcttttcaggagacagtcttgccaccgtcacaaaattaaaataattctgatctacaggatgaaataattgagttgtaataattccgcttggtgtctctgttttagtaagctctatcagtgaatcaccattatccacttgttgctttacctcagataattctttttcaatttcggcgccattaactaaattctcaacccatgtaaacttagcagaatcagcatactgactcaaatcttctcgattttgtttatcagctgattgggaaactgaaataattttgtcaaaatattgatagtaagtaaacgtaacacgcagattcttacgatgcttgtatcgcccattaacaattttattatattcatcccacatagtattgtgtagaaagacaaccttttttggaaccggtgataaagcaaataatccagtaatagctttgttgtaaccaccaaagtcaataacttcgtatggcataaagttaccaaagatacgcctaaaattcagctggtacgttgccttcatcttattttggttaactaactttgaattaaatccgaagtggtagctagtgttctgattataagtatcaaagaatgttctagttgcccatgaaaaattaaaaataaagtgcacgctgccgggtaagcgattcatattatattctttttcagggcgcatccgcggataatcaacaaatactaattcatatttattagtgtcaaagtttctagacaaattaataatagaatttgtaatcccgttattatagaaacctccagcataaatcaataacttctttttattattgttgaaatcaagtcgctcaatcgatgacgactcttcaaacaatacttgcactgcacgatcagtcgcttgtccgtcatcataactcaagaattcggatttataatcattgtactgttgttcgtaagtcttggcccacgaatcaaagtatttttgattacagtcatcaagcaattgatcaaacttatccgtgaccagtcccggaagtgtatcaagcgacttgtaaaagcctcggttctgtgcgtaactatccttatcaggaacataaaacataacaggtcgtttaatcggcaaaaagtcgaaaaagatactggaataatccgtaatcaatacatccacaccacgtaacaatgtattggtatcaatggcatttgaaattaattgatcaccatatcccatttcaactaatttatcataaataaaataatgtacttttaaaaatactttgtagccagatgggacacgttcctgcaatcgttggacttcatttaacaactgtaaaatatcagcttcagtagtatattccacatcttttttccaagttggcgcatacaagattatcttttcagctggaagccccaagcgctctttcaacgcttgcgtatcctcggaaactagtgtccccagtaagttatcaactcgtggattaccagtaatataaacttcatttggaaaaataccgtttaaatcatggctcgtaattaaatgctcagccgtaaactgattaggcatagctaagacatcagctgccaataaattacgctgaatgttcttatggtctgccctacctgaacccttaatatctaatcccagtgtttttaagggtgtcccgtgccaagtattcagataccgttgcccatcccttttgataaaatagggcatgaaagaagtatcgttaattaaatactttgaggtagctaaggctttcatatactgacgtgattcgtacttaactaaatatacccgatgtctcttggtatccgccataatatccgcaggaattgtatctttgtctttgtatgcccaatagtacgtataatccggatattcttgtaccatcttttgatacatcgcatacacatttccagtcaaattgacagcatgatacgattccaagaaaacagccttttcttgaactttgctatgtttcacatagtataaataaacattaatttgacgaattgccggcttagttacaaactcccgaattggccgtgcaacaaacttacacgcgagtttgatggtattcatctttcccataatatatatcattactccttgtgcttgactacagtactctagccctaatggattagcctgtataattatttgcgttctgatctatgctagtaatcaacttcacaactcgttgactagccgttccttgctcccattccgtgaactgtgtccgaaatgccatcatcttggctgtttcgtttggataaccatcattagtcaagaactgatctaacttggccagaaaatcctgctcattggtgacaattggaccaggaaccttgttgtaatcaaagtagaatccgcgaacatcaccctgataatgcgctaaatcataaggataaaatagcataggtcgattcaagatagcgtaatcaaacatgaccgaagaataatccgtaatcaataaatcactaattaagtacaaatcattaatatcttcatccacacataatttaacattgtcctcaaagccttggatattgatcgactcagctactaggtaatgtggccgaataataagcacatcttccttattaagccttttaacaaccgcggccaaactaaaaggcaagttcattttatacatacctttgcggataaaaaagtcatctcgccaagttggcgcatataaaattactttgcccatcttattgccaacaattctttttttaatcgctgcaatcgcatcataatcctggcgctgatgcactaaccgatcgttgcggggatacccataatccaagaactggttgttaaaatcaaacgctcgtcgaaaaacgtcttttgaaaactgattgggtgcaattaaataatcccaccgtttactctccgccgtaaaattctgacgatactgacttgtatcggtaccaggcattgaaacttttggaatatcaatccccaggcgctttagcggcgtaccatgccaagtctgaatataggtcgttttcgcattcttcttcaaccaatacggcatccgcgcgttcaggacccagaattctgcaaccggtgccactaataaccatttggccgaaaagcgtggaataatattcaacttaggatacttttcctgggcttccacaaccaactgacgcttaacaccccagactagcttccaatctggatgcgcggtctgaagtgcttcgtaaacgtatagcgggttatccattggaactttaccattaaacgcctcaaataaaacaacgtgttttctcactgggcacacagtcgcaattacattgaacagtcggcgataaacctgactgataatatcttttaatgccattttattgaattccccgtcacacgtttatttttgattgaaattcaagtcttgcttaatcttagtcgttgagatttcaggagtccgtggtaaatagatgacttcagcgtcagtttgttcgcccacgaaatcaaatttaccagtccagtcatcacccattacaaagcgatcaatttggtataatttcacgtcacttactttttgatcccacgacttttcaggaatcactaagtcaacatagcgaattgcttctagtaatgccttgcgcttttcgtatgagaaataggccttcttttgcttgctgtcccagttgaactcatcggttgatagggccacaattaggtaatcccctagtgatttggcacgcttgagtaattcaatatgcccataatgtaataaatcaaacgttccgtacgtaataactcgcttcatagtaaaactcctcctaaaatttcttcgttaatctttattaaatcaatgtacacacctgaatgtaaacaaggctattatatcatgaaaagattgactacacccatcattatacaattcttaatgagccgcgctttgtatattttatattttaaaacaagcgaaatgcatatatcacgcaataacttgcccatattgcggtaattatcattgcaatttgtcatttattcactcgtgccttttatgtcgcaatccatataaattaccgagaagctaatccacaacagtttatcattaaaaccaaacattcaatgcgccacaccacgttttttggcctataattaaggtagtgtattaatgagggagggatgtctatggcaaaacgacgaatcacacacgacccacaccagtttgttaatactgctactgaccggcgacgcttacaattggctgtccaattagccttgccaacctgtgcgcacgtcttagcacgcaattttgcgcgttctagtgccagctcttactggctactaatgctaaagacgccggggacggctgccccgcgctttttgaccttgcggatcgcggatcatttgctatggctgacgaaccatgatcaattaaccattagttgggaggctggtaattttgacgccgttcaacggaccttgcgtcaagaattaacaccagccactctgcaacaatacagttatcaactcacgacaactgatattatgacactgcgcttgattctgcatttggaacaacatcagctcatttggttggtccaattagcacctgaaatcgctaaggcctacaagaatcagcattttgaccttcgtgacgactttggtcaggccaaattgttactaggcaacatgaataacagtagtctccaactggtgccagttaagcaaccagctttccaaaatcatcttggacaatacttcggccgcaatctcctattctcacagttcaccagccaccatctattgcgactattgcccaccaatcaatggattcgacccttgctaaaggtgttgccacccacaccaaatctggaacagcaactagcagtcctgtatggcaccgactttgtccgcatttatgttgaagcgattcgacaacaagcacgcttgcaagcgattagttcataaaaataagacccccgctacgttcagcaggagccttattttagttactgattattagtcgcttttaagttttccttaggacctaacaacttatccgaaaagccaaatacataaactaacatcgttgcaatcactagtgtcccgtaatgggatatcaaataaccataaaaatttgacccgatgccgacacccggggtgataaacgcggggaaaccgatcaacgaccctgacaaagcatagttattaacgcgtaacagaccggtcagtaagccacctagaccactcgcaatgctagcaacgacaaagacccgtttgtatttcaagttgaccccgtatagcgccggctcggtaacaccacaaaaggctgaaattgcagctgccagtgagatctcctttaggtgcttatccttagactttaagaagacggccaacaccgcaccaccctgagcgaccatggtaatcgagaggattgcattcaaataactgtgcccattcgtcgcaatatcattgatcacaatgggaataatgccccagtggagcccgaaaatgaccatcgtctggtataaaccaccaataaccaatcctgataaggccgggctaaaattatagacggcgaccaaactgttggccaagcccttactgataatcgtaattaagggaccgaccaccactaataccactatcgccaaaatcagggcttcgataatcggaataaagacgctccgtaaatacagcggaacaactcgttttaacccccgctcaacgtacacgcctagccatgcagccacaatcatcgggaacacggatgccgaatacgacattaaatgcgtcggaacacctaagaacgtgatttgggccgtggctcccttactagctgccgttatcagacttggatagataagaacagcaccgacaatcgccagcacgattggatctgaacctaactttttggcagcagtaaagcctaggacaactggtaaaaagtaaaacgttgcatcagctaccgcgttaaataccatatacgtcccactcgtgaccgccaagactttgaagcccgttaacgcggccaagattccttttaaaatccctgaacctgccaaaatgccaatcaccggaatcattgccgcggtcataacaccaatgacaccactaatgccattacgcacgtggcttagccaattaacgtcacttgatgcctcctgaaccggtggtactggcactccgtccgcaaattcaggccctagttgtgcgatcactgcatcaaaaacatcgttgactgccggaccaatcacaacttgatactgaccaccggcctttgcaacatcaatgacgccgtccaagttcgcaataaccgcatcgtgcgctagtgcttcatccttcaaataaaatcgcaaccgtgttatgcaatgaatcacgctattaatattttgctgcccgcccacattagctacaattgccgtggctaatgccgagtaacgcgtcgttgactgcggtaccgctgccactaccggtgacgcggttgttgtcactgttatcaagtgagccgttgcgacgactgcaccggccgcgacagcttgtggcagtggggctagcgtcaagtcagtgagtacccgctgagcgttcgtcacgacaatgatcaccgtggtcggtttgtgggcctgctcgatagcagctaaatccatgtcgactagtagtgtgccagccgtcacctcatcaccgaccttcacgtgaacttcaaacggtgccccattgagtgccaccgtatcgacacccagatgtaccaacacttcgaggccagtcgtagtcaccatgccaattgcatgtttggttgttgcgactactgtgattcgaccactaactggtgccaagatgtgaccagctgtcggctgaacaccaaatcccggccctacccttcccgccgcaaaaacaggatccggaaccgttgccaatgacaatacttgaccagtaactggtgctaaaatggatacttcatcgatttttcccataatcgtcatcccccatgtaaaacccttaacctaaccttcaaaaatccttaagacgaccgtctcacgtccaatcatgatccattaaaattctatcatcacaattagaccaatctccatcacttaccatcacttcgttagggcgactaaatatcaaaaacaagtatttttccgaatcggaaaaatacttgtttatcctaacgttgattaattatttgacgtcgccattaactaggcggttgcacctaagtgtcgctttttaggcgctactttaactgcatttgcatcctcatccttaaaaccaaacatccaagttaaggcgaaggacacgacaatcgtggctgcggatgcaatcaagaaaccataaaaactaaagtccaagcccttcggattaacaaaggacgtgaagccaatcagtgaacccgtaaagccccacatattgacattcatcaagccggtcaagaagccaccaactgccgccccaatactggcagtcacaaaggcccgaccatatttcaagttgatcccgtacatggctggttcggtaacaccacagaaggctgaaatcgttgctggccaagcaagttcttgaatgttagccagctttgactttaaggcgattgcgaatactgcgcccccctgggcaaccatcgtcgctgaaacaatcgcgttcaagtaactgtgacccgtcgttgcaatatcgttggccacaatcggaataaccgcccagtgcaacccgaagatcaccaatacttgatagaagccaccaatgattaagccagaaatcgcagggctcaaattgtagacccacacaataatatttgccaatcccgttgaaagcacagtaataattggaccaaggaataatagaatcgcaccggaaacaatcacaacttcaaataatggcacaaaaatcattcgtaataccgttggaatcacccgttttagccatggttccaacttacttgctagccaggcccccgcaatcatcgggaaaattgaatacgtatacgaggcaacgtgtaccggcaagccaaagaagttcgcgttgatccccattcctaaaagcgtactcgtcgctttaccacttgccatcgttacaatagctggataagtcagcaccccaccgatgattcccataatcaccggatctgcccctaactttttaccagccgtaaaaccgacgaagattggcaggaagtaaaagaccgagtcgcccatcgcattaataatcacgtacgttggtgcggtcgggctaactaaattaaacgtggtaagtaacgcaagaattccttttaaaataccagaggctgctaataatccaatgacgggaatcattgaacccgtgataacaccaattaaattactgataccccatttaactttgccccacggcgtcgttggccgctgagctgctgcggcagtctcagcaacagctttagccgtctccgaatcatttgaaaatcccggtccgatttgcttgatgatcgcatcatagacatccgtgacagcaggaccaatcacgacctgatattgaccgcccgcttttgctacgtcgatgaccccttttaagtcccgcacgacgtcatcattggctttactctcatctttcaaataaaaacgcaagcgagtaatgcagtgaatcaaactactaacattctcgacaccaccaacattagccacgatgtccgcggctaactgatcatatttacccgcttttggtaatcgattctgccgcttagcattaaatgtgttggcgttcagacggcccgtagctgtcacgtcaccggcagcttttgcccccgtaacgacgtccaacgattccaatttatcactagtgttagtcactgctaaaatcactgtggtctgacgattagcggcttgaatagcagctaaatccatggtggcaatcacgtcccccgcctgaacatcatcgcccgcggccactttgaccgtgaacggggcaccctttaagtcgaccgtgtcgattccgagatgcactaatacttccaaatgatcatcaggcgttgtgaacccaatcgcgtgtttcgtctcagccaccatcgtgacctgaccactgactggtgcaacaacctctccacttgaaggttgaacgccaaagcccagtcccatcataccggctgaaaagaccgggtctttaaccttatttaacgcaataacgtccccattgaccggcgacaaaattgttactgtttgtgcctttgccatacccattcctccattcttaacctaacaacagcgcaaccgcttgatagggttgcatcgtcaattgtgctgtgacattaacatcttgataattggaaagtaacacctgtgcaccgaccatttcttccggaagtgtcaccgttgttgactgaccataaaaattattaagcactaataacttttgttggcgatatgtccgccaatagccgaagacttgcggatcatctaagcgccacgattgatagccaccatccgcgacgatcggcatcgtttttcttagcttaatgagccgttgataatagtcaaaaatctcgccactagccaattcatgggccacgttaatcgtcgcctgattagtcggtgtcaaccacggtttaccagtagtgaaaccagccttggcactatcatcccattgcatcggcgtccgcgagttatcgcgcgccttggtcttaacgatcgtaaacgcatcgtgatgactgtacccactacgaattaaagcccgataagcatttaatgcctcaatgtccacgtaatcagccatatcgtcatagtccggatcagtcatgccgagttcctcacccatatagataaacggtgttccacgcaagaggtgaatgaccgtcgccagcatttcagcggacttgacacgataacgaccggcgtcaccaaagcgattcagcgctcgtggctgatcatgattattccaaaacaaagcctgccagccaccaccagctgccattccactggcccaactatctaataattgcttcaatcgtgggaagtcgaaggccattcgggaccacttccgtccatcaacataatccgtcttcaaatgatggaaattaaagaccattgagagttcgtgattagccggattagtataatcaacactgttcgcaacggttgttgaagacatctcccccactgtgacgctatctacatcctggccgaagcttgccgcgttcaattcctttaaataatcatgaacaacgggggtgtcagtatacaacgtcttgctagggacccccttaggtgcgtccaccaacttctcagctttaccggtaacattgatgacatcgaaacgaaaaccctgcacgcccttttgccgccagaaattgacaacggcggcacacgcttgtcgtacggccggattatgccaatccaaatcggcctgagtcggatcatataaatgtaaatagtacaaaccagtatcaccaaacggcgcccaggccggaccaccaaatttagattcccaattggtcggtagactaccatcagccttgggaggacggagatagtaaaacttctgatacttctcatcacccgccaaagccttttgaaaccactcgtgttcagttgaagtatgattaagaaccatatccaacatgaccccgataccatttgccttcagctttgcaacgagttcttcaaaatcagccatcgtgccaaacatggggtcaatatggtagtaatctgcaatatcgtaaccgttatcattttgtggtgagacaaaaaacggattaaaccaaatcatgtcaatattcaactttttgaggtagtcgatcttttcaataacacctcgtaaatcaccgacgccatcgccattgctgtcgtaaaacgacttcggataaatctgataaatcacttgttctgataatttcatgcgctatccctctcatgccagatcttatttcttagttcgccgagcaaaatcgcggaaactaaagcggtccgcccggtgtcgtgattccgtatactggaacgctcgcgcatccgtgaggctcgtcacgcttcgaacaactgccacataggcgcccttactaatagcgaggtgttcgcggtcctcatcagttgccggcgccatcgtaatttccttcgtcgcgtaaccgatcgtcaacccaagctgattttcaaaatacgcgtacagtgagtcttccgccgcttgcttgggaactttcggaacgatcgatttcaaaatataatccttatcaataatagctggttcgccatcgatcactcggactcgtttgatggccgtcactggcgcttccgtcaattcggtaccaagtgacgtaaagtcagcaaccggtaacgttgcatccggttgatagtcataaacaatattttgcgtcttaatgtgtaacttttcggctaactctttataactcacaatgccagaaactggaaattcatactgtcgatgctcaatcacaatggaccctttaccacgaattttttgaatatagccatcctcagccaatgtcgctaatgctttgcgcccagtctcacgtgaaatcccatatagctcacaaagttgatgttcactcggcaaataactcccgatcgggtaaacctccgcatcaattttctggagcaaatcttgataaactaaggccgctttattcacggcaaccacccctttgttatcgttttcatttatgaatatagacttgtttagacaagttgtcaatatttaagtaataacccaattaaatttgtagattataccatccagatcaagtctagacatgtctagagttcacaaaatccgagcttatatttcagtattcaataactgcttcataataagtgccagcacctatacagtattggttgaactagcaggatagtccgcaccataataaaaaatcgacattcgcagagcgctaacagcaatctccaaccaatgtcgattctatatctgatgatttcattaatattactattttcgcaataaatctttcgctttcattgttgctacttcttttttcatttttctctttcggttcacgagtgcatctatccagataccattcagcacggcttcgccaactaacaatacggttactattgataataaagagacctcttttgtaaaaaccatgtaaataataaagcctaaaaagccagctcccggaattgccccaaaccaccttggtaagtatcgatctaacatatagagcactgcaacgaccaacataccaatcagaattcctttaaaatcactcatgttgttcctccctaaagtcagtaataatctgttttgctacctctaacgataatttctcatcgattaccaatttcataaccttcgtttcaaacgtatttgcaccgttgtcctcaataaagttaattttttgaataatcgtgtttaaccgcattcgcacggttggataactcacttgataaatcttagcgagttgttttagagaacctgaggcaataaccaattgtttaacaaattcctgatcctcacgttctaaattcacaaaccagtccatagcattcctcttttttaatattgtttattaaactttaacattgtttattataatgtcaataaaaaagcatatatttgataactgatacaatccggagctattcaaataaagacgagtactctaatccaaaagaattacagtactcgccttatttagaatattaacgctactagtctcagtaaatttattagctgacctttagtgattcaatccaaatgcctgattatcactagcatccgcgctagctgcatcactagctgcttgttcttcggccatcaaccgagcgcgttcatgtttgttataccaaggtgaaacagtgaaagccaagacatcgttcatcagataaacggaactattaatgaacattgctagtgtcgccgaaccttgacggaacgagatgaaccagaggaccatttgtgctaaaccagaggcaatccaccagaaatactggttgttgtaacggaggaagcaaataacgccggccgttaaacaaatcgcaaaactaatggcatcgacccatggccggggatcatcagttaaggcaccaataagatagccggagatggcataaacaactaaagttgcgacaattgcgacgatccacgtcttacccgtaaacttccgaatctttgaaaccatgttgacgttccaattagcacttaatagtactggaatatcaagcgttacgacgtaggctaattgttccccaatgcttaaatagttcttagctgaaaaaccaactacgatgaagcaagcggcggagatgacgcctaataatccattgactgacttagccgcattaatggctaacacacaaagaacacccaaagtggtcccaataaatgttaaaatagacaatgctgtaattggcgcacttactaacgtcattacttgacatcctaggctaaaatagaatagatagtagttctgttgtggccaaccttttagttggtgtgataagaatttaaaataattactcaaaatcatgctcctctttccgttttcatatgcggttgtaggtgtctagttggccaaccagtcacgtcacactactacatgtagtgtttctgtttaaaacaacacaatatattgtatcattatcttagccgatgaaaagggtaaaattccaaatttatattgaattgtttacaattaatccaactgcgccccggcaatttggtatttttggcgtgctgatttttttatatttttttgatttcggcctactgatagcgttgtcaatatcaggtcaaaacaatgcgttttgtcgcaatacaatgcttgcagtatactggagaggaacaaacttttagcatcacaatataattaatttttttggaggaacctcatgattacgcttaaatcagatcgcgaaatcaaagggatgcaagctgccggtgacatcatggttggcctgtttcacgcccttgaagactacatcaagcccggaattacgacttgggatgttgaccactttgcctacgaatacatcgttgcacacgacgctactcctggcgaactcaactttgaaggttataagtactcaacttgtgtcagcgtcaatgacatgatttgtcacggctgtcctagtaaagatatcttggtcaaagatggagacttattaaaagttgataccgttattaactaccatggctaccttagtgactcttgccacgcctttgttgctggtacaccatcacccgaagttaaaaaactcatggaagtgacccataaagcgctatacctcggtattgaccaagccgttgttggcaaccgaattggtgatatcggctgggctattcagaattacgctgaaaacgaaatgggttacggcgttgtacgcgaatacattggtcatggtattggaccgacgatgcacgaaaagcctgatgttccacattatggcgaagctggtcacggcacccgtctaaaagctggtatgaccattactatcgaaccaatggtcaatattggtgactggcgttctggcgaaactgccgatgacggttggactgttcgcactttagatggcagtcttagctgccaatacgagcacacccttgtcgttaccgatgacggtcctaagattttatcatcattcgataatgattttgatgctaaatacttatggaataagtaatatcatttaaattataatcacgaacaatcccaccctagtttagtcacttgctaatcagggtgggattgttttagttattatcaacagcacgttcactagctattgtcagaataaaactagttatatgtgtcttggaaaacgtcttgattataagacatgaaaaactgatattggataaattttaacatctttatcctcggtcacaatcaactgattcaaccacctaatatatttattttaatgacaaccgtttggcaaaactaacgctgattcaataacgttctcagccaatcttcatcttttaccgcttattgcaaatcgtcattcaccacttgacgcgctcaaaatcatcttgtatagttagtcccaattaatccagaggaggatcagacatgactcaattaacaagtagtgctttgaataactgttgttgccgaactgcgcgcttatcgcgatgttcggcctgttaagcattgactttttgaggagtgtcatcctaaaaatcaatgtccagcatggctggatattgtactgggcgcgaggaattcattcgaattctcgcgccttttttgtcgcttttggcaccccaccgcagcgattggaggaatttatatgctcattcagcacgttcaagaacttatcggccacacccccctgatggcgttacccatcgaggttccaaatcacagtcacatctatgccaagcttgaaatgttcaaccccggcggcagtattaaggaccggctgggagcctatctgattgaagacggcttgcaacggggctgggttaacgccaagacaacgattattgaaccaactgctggtaacaccggaattggtttagccttagcaactcaagcgcaccacctacgtaccatcttagtcgtcccagaaaagttcagtatggaaaaacaagttttaatgcaagcattgggtgctgaaattgttcatacacctagcgaggaaggaatcaaaggtgccattcgcaaagctgaggcactagccgcaacgatttccaacagttacgtccccatgcaattcaagaatccggctaatcccgcggcttattaccacacactggcaccagaaattctggcggacatgcctgcacctataaccgccttcgtcgccggagccggtagcggtgggacatttgccggagtagcggcttatcttcaagcccaagattcagcaaccaaagccgtagtcgttgagccagaaggttccattttaaatggtggaccggctcacgcacatcgtactgagggaatcggcgtcgaattcatcccaccatttttcgatcaggttcgcatcgatcagacactgaccatcgcggacgatgatgcctttgcccaagttcgacacctagcccgtgaccacggtttactgattggcagttctagcggcgctgcgctagccgctagtttacaacttgccaccaacctgcctgccaatagtcatatcgtgaccatctttccagacagtagtgagcgttatctgagccaaaaaatctatacgagatgaggactttaacaatgaaatttgaaacccaattaattcacggtggtatcagtgaggacgccactactggcgcgacttcggtacccatctacatggcctcgaccttccgccaaacaaaaatcggtcaaaatcaatacgaatattcacggacgggaaatccaacccgggccgccgtcgaagcattaattgccaccctcgaacatggcagcgctggcttcgcatttgcttctggctccgctgccattaataccgtcttctcactattctcggctggtgatcacattattgtgggaaatgatatctacggtggcaccttccgcttgatcgacgccgttttgaaacactttggcatgacttttacagccgtagatacgcgtgacttggccgccgttgaagccgcaattacccccacaactaaggcgatttatttggaaacaccgacgaacccgttattacacattacggatattgctgccattgcgaagctcgcgcaagcacacgatttactgagtatcatcgacaacaccttcgcctccccatacgtccagaagcccctggatttaggcgttgacattgttttacacagtgcttccaagtatctcggtggtcacagtgatgttatcggtggcttggttgtcaccaagacgccagcacttggcgaaaaaatcggctacttgcaaaatgccatcggtagtattttggccccgcaagaaagctggctattacaacgtggtatgaagactctggcattgcgcatgcaagcccacctgaataatgccgctaaaatctttacttacttaaagtctcacccagcagttgctaagatttactatccaggcgatcctgataatcccgatttttcgattgccaagcaacagatgaatggcttcggcgcaatgatctcgtttgaattacaaccaggaatgaacccccagaccttcgttgaacatttacaagtcatcacgctcgccgaaagtctcggagcattggaaagtttaattgaaattccagccttaatgactcacggtgccatcccacgcacaattcggctacagaatggcatcaaagacgagctgattcgcttatcagtcggtgttgaagccagtgacgatttgttagcagaccttgagcgcgggttcgctagcattcaggcagattaagctggtgtttcagacggctcgtgccattctcaatcgtgaccccgccgcgatcaatttgcggacagttatgttgacctatcctggtattcacgcgctcgcctggtaccgggttgcccattattttgaaacacaccgtttaccattattggccgccttgctgagccaacatgcggcccggcgtaccgggattctgattcacccggccgcgcaaattggtcaccgggtcttctttgaccatggtattggtactgtcattggtgcaacggcggtcattgaagacgacgttacaattttacacggcgtcactttaggcgcacgtaaaaccgaacaatctgggcgccggcatccctatgtttgtcgcggtgctttcattggtgcccacgcccaactcttgggccctattacgattggcgccaacagtaaaattggtgctggtgcgattgttttagatagcgttcccgcccacgttactgcggtcggtaacccggcccatctagttgccactcaattgcatgcttatcatgaaacaaccagcaatcaagcttgattcttatcaaaactgcggcttagaataaccgtttgctcgtatcagttattgtgtcgacaataaaacgtacttataaaatcaaaattgattttataagtacgtttttacgttactttgaaaatttatttattatccacaattatttgacaaacttcgctgcaaattcgctgaattgcttaccagcaccagctaagaatgattgggtgccttcatttgtgatatgaccattttcatcagccaacttatcagtattaccgatgtacaattctggttgttgcatcgttggcatgtctaagaagaccaaggattgacgtaaaacatggtgtgctaagacgccagagataccagagatcgattgggaagcaaccaaagcaggcttgccgccccaaacactttgaccccatggacgtgaagcaacgtccaaagcattcttcaaggctgctgggatactacggttatgttcaggtgtgacaaagatgaacgcatcttgagccgcaacggcctgacgaaattctgtatattctacgggtgaatccgcatcgtagtcttggttatatagtggcaacttagcgatatttaagtacgttacttcagcgtcgtctggtaacccagcaacgatggcttcagcgacccctttagaataagaatttttacgaatagaacctacaattacaccatattttgtcatatcaaacaatcctttcaaaactaatttcttcgtttcacttactaatagtaagtatatcaagttgttgaaaaagtgcaaccattttagcctatcaattttcaaaatcacttgttcaatcgccaaaaaacgttgttaaatcaagacttacgctccagaaaaatattttagtctatgtctaattaccgacagaaaaggtcatcggagtatcaatgattccgatgaccctttctttattttcaatacacgtctaatcatcacgcgtttcagtgcgatatttgatcaactcttcgtttaaaccatcaaacatctaagaaatcttgataatcattatcaacttgttcaacatacgccgtggcccatttagccatggcttcatcaaacttcgccgaattaccaacgtatccccgaatcatggccgccgttggactttgcgcatgagcctttgccaaaatcattgcgcacgtatttgcataggcttggaattgaccccagtctagggttggaatatcgatggattccttcatatcccgaaattgacgaacataaaaactcttattttccatttggaaatagcctaggaacgcatccgaggttgcttgtaaaatgcgttgcgaactgacgatccgttgcccttccgtcaattccatggcggccgttaacgctggccgcgactggctcccgactttccgcgttggtaaagcttccttgatttgtaacaccatatggctaccatccgtacttgtcagaagaaccaagtaacatagtgacccaaaactcccgacgcccacactatgccgaataatatcagtaacttcatattgcgacaacagcaaagcgacatcggtccgtacgttcaataaatactcgctaattccggcctttagcccttgataagtttgccgatcaatatggacagaacggggcgcgttctccttaaattgccgttcaccgcgactattagtgaccgtaaacttacgcacaacttgttctgaattacgtttttgagcctttttaaccaaagatgcaattaaatcggccgtatcttcgggagcaccaccgaagttcaagacagcctgaacttcgttatcgcgataaaaacggtctaacgtcgtctgatcaaacatccgtttgagtgcttcccgataactcgcactcgccgcctgtatcaatttttcgaccttttttggtttaaagttagaatcacgagcagctagcaacacactaactaataaccgacgtaaatcccattcccacggatggacgccagcttcgtcaaagtcatttaagtcaaataccagtcgccgttctggtgacgcatagaacccaaagttaccaatatgggcatcgccacaaactacggcggaaatttcagtggacgactgataatccaaatcgtaatccattaactccactgatccccggaagaatgcaaaagccgaagcggacattcgttcacgccgcaatggtaatagttctggtaccagcatctcccgcacatgtttcagataatcactggcgtttcgcttcaccggtgtaaatgtccctaatttttcaaatggggtgacttggcgccgcgcctttcctagcgcaattaattcagcaaccgtatgatgttgtcgaatatgagttaaatcaagtggtggcatgagtatcaaatccttttatgatttactaattttattatagcgatatcttccaacgatagaaaataattcagctagttgagcccgcttctcgcgtcccaattattgaccagctgacgccaatttacaagcaattttcatgataaaacggcgattctagttgacgtacccctcaaagtcacctacaatttaagttataaatgataccgctttcaaaaagcgaggaggtcacgtattatggcaaattctgaaaaaacattggtcctagttaaacccgatggtgtcagtgaaggacacattggtgaggttatcacccggttagaacgcaagggttatcaaattgccgccttaaaggttattaaagcaaccgcggagcaacttcaacaacattacagtgagaaggttggcaagccttactttaaggaaatcgagacctacatgatggaaggtccactcgtcgccattatcgtaagtggtactggcgtcgtcaaagcggtgcatcgtttagctggtagcacccggcctgccgaagcacaacctggcacaattcggggggatttctctcatgaatatccagacggtattttacgaaatattatccatacctcagatagccgtgaaaatgcgcatcacgaaattgcaatttggtttcccgaattagctgtcaaagcacgaaaagcagacaacaaagtaaaagcctagcttcatttttaacatcacgattactcaattcgcaattactgatcaatggtctgaacgccattgcgtccagtaattgcgaatttgtatacactggatgttttccgtcacaacgttagtaaagcttccaaagataacccgtaaactggccccactaactgccaacacgcgccgaaattttcgcactaatcgttcgcactagttatgattaaaccaatcaactaaatggtttgggggaatcattatgcacatagtcgttggaccatatgtacggcggccgcgggctgtcaaatcggacccgcgcaacaccagtaaattttcgatgtttaattcgctacgacgaattgatgaatgcctagtcttgattaaacgtactggcacaccaggattaattgattcaactgcaacgttaggtttgaacctaacccacttaatgggattgaatgtcatcgtaactagtcgtggacgttccttcaccatcattgttcaaggtcggcagcggtcgttcacgctgactggctgtctcattgaagacacgctctacaacgccgttcacccagcacaaccagactatctgatttcactaaatcgccagctcattaccaatagtgatgacttaattgagcaactctatgaccactattagctggccagcatcacgcaccaaaggctaacccaccgtgtgggttagccttttaaattgccccatattaaatgatcagttgaacgactttaagcagtgtcgcggatggtttagccggaatcttcatcttttgaacggctggcattgctgtgtgaacattttgggcaaccggacccacttgcgagcgttgcctcgaacgactatgcgcaaccaatacagtattatccgcattccgcgcgtatatcacactattagtagcatcttgtaaatcatcactataaatctgggtcatttggtgatgatagaccgcgctgtgcggatcgtctggctgaattcgctgtccggccgcaattttgcggatatgtaacggggttgcctcgttgatgacctgagtccccttcaggtgtagccaaacttgtgcggcttccaccttagctgccggaaaatcactaagttgtggctgacggattgccttaaacgttgctgcggtactacgctgcagccgacgttgatgataggtccggcgctggcttgtatgccgttcaagctgcacttgttcccacaccaaacaagcaccaaagaggacgataccgacccgtaattcccaaatcaattttttcaatgattagcccccactttaccataattacgctacttaatttaacatggtcttagctaattatattggcaaagccggtaataatttaattattaatagggcagtcgcaccaactcgccatttctagttgcgcttccccttaaactattaacgatttctaacttgacagctaaactgatttattgtcaaaatcactatttaaatattttattttatgatggcaatacaaacactttgattatcgcgatatacttagacgagcattagctttttcaataagaaggcactactgatgaactcattcaagaacccacttatgacaacaccctatctgctagccataatcgccacactgacgatgctagttagtccactgacaacggttgttatatcagtactgatatggttgtcgggaattacgctggtgtggttacaccgccagcaacgatggctccgcttcttctacgcacccgtgtttttgtacacttttttactagaacaatggtatttctccccatcaacccagccactgacagaaacgattctcattaacctcgcaattcttggcattgccattttcagcacatgggcagcttatcaattacgtcataacgcgtaaattactcaccaagaaaaataagtcccccagatgcggtaaccgtttctggggggacttattgattgcttcaacagctaccgttaaataacgctcgttaggcaggcttcacttcggctagtttttgatccagatatttcttcaatgctgcttggggatgaaaaccaaccaccttttcagcgggctggccattcttgaatatcactaacgccggaatactcataatctcaaattgttgcgcaatttcctgatgttgatcaacgtcgagcgaagcaaatttcacttgcccatcgtacagttcatctaacgcttcaagcactggttcctgcatcttgcaagggccacaccaatccgcccaaaaatcaaccacagttaacgcggtaccatcagccaccgtcgcaaaagtcgtcttatcgactggttcgatcatatctaatcctcatttccaattgattttcgttctatcatagcatgttttcccacaaaattatgacttccgggtctgaatcacgtacataggtcacaaaatcttggtatatcggtgttctaccaatcaaaaattcgatataatagcgttatagaaacgatataacctaaaggaggaatttttgtgtccacacaaacaatcagtcccgaacaggactccgaattagtcgcttccgtcgccgctgaacaactcggtattaaagccgtgacgttgcgcaaatatagcaccatggttgaaaaacagcttaacgatgaaaatcgcttccgcccggccgataacagtcatcgcttatatacagccgctgatttaaaaacttttcaggcggccatcgaactcgccgaacagggcacaacgttagccactgcgctaggacgggcgtttggtgctaaggtcccgacatccaaacaaccggcggcaacgacgactcagtctgagaaatcagcgcctgcaactaccaccaagtcgcccctcatcacgacaaccaccgtcgatcccagcaaaatggcaccagcggccaagccagatggcccgactaatgctgagctctataagcagcaagaaatgatcatccggcgcttagattcactcagtgaccgcttaaaccaagtccttgaccaacttgatcaacaagccagtcaagcggccaaaccttggtggcatttctgggaaaagtagccatatgctggtcaacatacttgctcatcagacttacttcggtagggcaagcattacctaccatccaaattaacgtgtgctgccagtcttaaaaataagctacctacacgttcatcgttccagttaactcgcccagcgatggctgctatcaagtggttctttgtcaggcaagacgcaaaaggcgcccagaattaaatttctgggcgccttttgcagctaattaccatggcggttagtaattagtttttttatcgaactactttgttgcagctaagtgcttttcgtacgcagctttgatttcattaactaaatcttcatctttcaagtcagttgtttcgcgaatgacttgttcgattggttcatccttcaataattgttgtaacttaacactttcactatcattaggatagttgaagaaaaacatttcaccaactgtatcaactaaggcgctgtaatcgcgaccacgttccttcaattcccgaattgggcgaatgaaacgttcgttgaaacctaatttccgaattggtgtccggccgacccgttcaatatcatcagagatatatgggttttcaaaccgactcaaaatcttcttttgataagcatggtgtacttcaggatcaaagccccacttttgaatcaacaagtcgccggtttcacctaaaacgtgcttagcttggtcaacaacactgtcatccttgaccgcttcgccaatcgtcttgtagcccttcatgttaccagtataggctacggtggcatgaccagtattaacggagaagagtttccgttcaatgtatggttccaagtcgtcagcataatcaacaccctttaattgaatcttagggtttttcatctgggacttgtcgataacccattccttgaatggttcaactgaaacgaacaatggatcatcatgcttttgaagcggtacgatccggtcaacagcggcattagggaagcccgcattttggtcagcccaagcttgttcgtcttcatttaatgattcataaacggatttctttaatgactgactcccgccaatcatgttttcacaagcaatgatatcaattggtgtcgtattgttgttagcttgccgtaactttaacccgtcagcaattaatggcgcgatgaacttcaagatcttaggtccaatcgcagtcgtaaccatatcggcttgggcaatttcttcagcaaccgccttaggatccttaccgttgttaatacccttaacatcgtgaacttcaatatgtttttgaccttctgcagccaattcaatggtataaccattccgtttgtttaattcgtcaatcaaagtatcgttaacatcaacgaaagtaatcttaaacccgttgtcagccaaggtttcgctaatgaagccccgaccaatattccctgcgccaaaatgtacgtctaacatgctaatcaacttcctttaatagatttatgatttcatcttcagattgagcgtccgctaacttagcaacgttggcaacgtcgctgcagtatatggcaatctgagacaagaggttcaagtgttcaccgttcaacccagcgatcccgaagataaccgttacagtcttatcatcatcgttatcatctggattaccccagctcacacccattggtacttggaccacggaaatcccggtctttttaatatacttcatgccatcttcagtaccatgggggatggcaatgaaattacccatatatacggagacatcctgattacgagcctgcattgcatcaatgtattctggttcgacacaaccgccatcgaccaatagttgaccggctaagcggatgccttcttcttgcgtagccacttgctggttcaacgcaatcattttcttatctaaagcttccattgttttcacctacgctatttcgttagttcgttcaaaaatgctttactaattaattgataaagttgctggcgatcgccagtcataaacgtctgcgtattggcctgactttcaatgactagtgcgcttaacttacccatcaaccgattttcaaaatcgctgatattggcgggcccgagcattaggacgattcgctgcaaccgaatcgattggttgtccatactcttaaatggtaatggctggtcaagttcgaaaatcgcacaatatggtgcagtgacttcctgacttaacgtatgcaccaacgccaagttcgtattgggaataccgaccggcgccagtcctaagcggtgtaacaaccggcccgcaacttctagcggatcatgaatcaagttcgaatcaatatgccgcgtgatcttaactagcatctcggccaccgtctcatcatcgttgcgaatcggcgtgatagtgaaacggtctaagatctgtttagcaatcgtcatctgttggtaaacggtgtcaaaatccaagttgattttcgtcggctcatcaaccggtgaatcgatcactttggtgcttggaaaatactgatgaatatattcccgtaaggcagtgacttcgttttctagtaacagtgggctgacaacgcggtaattcaacttaaatcccggtaacgttgtcgtggataaaatcatgtcaaagtcttgtaaattaacttggcctaaattaccaatccgcgcaacctcgatagccgtgatttcaggtactaaccgcatcagtcgcgttttcaaaattcgcgccgtcgtcatcccattcgggcacaggaccaaaaccttgagtgcttggtgactcaactgttgctcatacgtactagcaaagtgaatcaacaagtacgtcaactcatcagttgtaaaatcctggtctttaaaaatcgttgcgaagccgcgcaccaccgccgaatacagcttaggatactgttcacggacctcttgtaactcagtggttggcggcacgggaccattaacaccgttacgttgtagggcaatttgcatatgtgccgtcaagttattcaacaagcggtcatccgtcccaaacgaccagttaaagttagtcgcaaccgcgtcaataaactttttgacccgatacgttagttgcaaatcataattcgatagcgacgcgtcttgatcgattcgaaacgtcaagcccttaatttgctgggcgagaaaatcaatttcagctcccgtcaccaccgtcttaatctcagcgggtagttgggtcataattgccagagcaatccgttgatatttcaagaaatcatcccgattgatcccgcgcaaatatgtgacccgacgttcatgctgtaaacgcattactcccgtcgtcaacgtgatgatcaactgttgtagctgaccatccggcaccgaagaaaagtactttttcttcaaacttcgcactgcttgataacagataatcaacgtttgggcgtccagtaagttcaaaaaatacgattgctcatcacttgctgatattgctaagccttggttcaacttcccgattgttttaaaaaactcgtagtcgttgatttcattattcaaaatggtggcaaacagattgcgaatactaccctcagtccccgccacctgaatcccccgggacttcaaccgttcaattgataagtcgtagtcggcgaatggcgttgctaatgccgtcaaatcgtttgaaatcgttgcaacgctcacatcaaagtcaagcgcaagttcttttaattttacggaatggcccgtcatcagtaaccgacaagctagggcgttttgccgcgtttgtgagtcaaacgccggtgcaatcttccgctctgctgtcaattggctttgaaacttggccagggccgtctgcgatccacttagttgaaagtgatgcttctcattaacaattttcaaatcagcattggctaataccaattccaaattactgaactcgcgataaattgttcggcgactactgttgagaccggtttcaatctgactcattgaaaggccggcgggattcgctagtagcagctgtagcaactcatcttgacgttgtgtaaacttaaccatgatgccacctcatacgataatggtaataatatcattttatttcaattctgataccatcttatcatatttaggtgaactcaatagatcgtcagtaattaatacttggacctgcgtgtaacgggtctttaagtttttagctgcttctgcacttgaaacaactaataaactattattatcagccaattcgtcaattcctaagttcttaacactcacatgcttgttggctttcttgacccgatccttcatcaaggacgttgccattgtggctgttcctaaatgaccatcgtggtgaacaaagacaatttcatcaacaacactcaaatctaagttagctggtaggtcgtcgggtgcagccgtcgttgcttgtggtgccgcggatgcaggtgcagcatcgctaacttgatcacgagcctttaagttaaccacaacttggtcatactttggactactcaagaagttgtcaacggctaaccgtaaggcgtgtggtgccttttgagccgcccgatcagctaattcgttttgcgtaatcactaataaaccaggttcgtctttcaaattgctaatcgccgtgttggtgacggacatgctaatgccagccttcttgactttatcccgtaataaggaagcccccattgcggatgatcccattccggcatcacaggcaaaaataatatggtcaacatctttgtatgaagcaatcacatcagctggttcagcgtcagtcgcactagcagcttcagcattgccactcttcatatcgctcattttaccttgagcagcggctaagtcatcatcactggtcgacttgtcacgtttcaagacaattgcggcaacgataaatgatgctaaggttgctaacgttaccccgataattaaaccaatgtagttagaaatactctttggtgacattaatagtaatgaaataatggaaccaggtgaaggtgttgaacgtaaaccaacgtttagtaaactgaatgtggctgtcccagtaaccccaccagcgataacagctaggaacaatgctggcttcattaatacgtatgggaaataaatttcatgaatcccaccaagaaaatgaataataatcgcactgggtgcagaagccttagcagtccctttaccaaacaaggcaaaggctaataagaccccaagacctggacctggatctggttcgagcaagaacagaattgacttacccgcactagatgcagcctgaatcccaagcggtgttaagataccttggttaatcgcattgtttaagaataaaatcttggctggttcaatgaagacgttggctaatggcaatagcttcatcttaatgatccagtcaacaccggcagccatagcagcacttgcaccagcaaccaatgggccgattgcaaagtaacccaggattgctagtaacatcccgataatcccagcggagaagttgttaaccaacatttcaaacccgctcttaatcttatcggaaatggcgtcatcccacttcttaatgcaccaaccgcctaaaggccccataatcatggcaccgataaacattgggattgaagaaccaacgatgacccccatagtggcaatcgcaccaacgaccccaccacgatgaccggcaaacaaagtcccaccagtaaacgctatcaataatggcaataaataatggaccattggttgaatcatcttagctaatccagcattaggccaccaaccaccagccataaagatggcggtaattaagccccaagcaatgaaggcgccgatgttcggcataaccatattacttagtgcactcccaaatttttgaacgcgtgccttaacgcccagtttctttttcgcaacaggagcgctttgggttgcattcgtatttacattttcactcattaggtaaagctccttcctttttcttaacaacttaatcatatccatcggggtaagcggtttcaagaacttctagttagacccgtggcacaggaaactgtgccacaattaaactcactaattcacaaagttaaaatttggcacagtatcgataaaaatttttatatcggcaataccagcagactaattaaactttcttcgtcagctatgatttaattttcacaatcaaattcaacattttatgcagaaaacacctggcaattctctcatcattttattatttaaatgattacgaatacgatttaacgttgaaatccccccgcaagctcctatacttataattaactaaggagtgacctatgtaatgaaaaaagacactgattgtaccgaaatattggttgggaaagctgctagcatggatggttcgaccatcgttgcccgcaacgaagatggctacggcccaattaatccgattaagtttattgtgcacgaagcccacgaccaaactaacgccagctacacttccgtaactaccggcgtcaccgttccgctgcctgaccatgcctaccgctacaccgcaaccccccaagccgatcaaagcgatgggcagtacgaggaagctgggatcaacgaattaaatgtcgggatgagcgcaactgaaaccactgccaccaatgcccgcgtactcggttatgatccgctcgtccatgatggcgtagatgaagaagccatagtcaccctcgttttaccctacattaaaagtgctaaggaaggtgtccaacgcttaggtgccctaattgaaaaatacggaactggtgaaagcaacagtatcgcctttaacgatcacgacgatatctggttgttcgaaaccgctggtggtcaccattggggggcagttcggatgcccgaagacacctacgcaattgttcccaaccaaaccgtggtgcaagagatggatctcaacgataccgacaatttcctaggtgccagtgatttagtggacttcgttgaaaagtatcacctcaacccaacacccggtcactttaatttccgtgaaatctttggtacccaaagtgaggcggatgcttattacaacactccgcgaacatggtatggtcaaaaactatttaatcccgaaatcgaacagaatcccactgatcaaaacatgccgctattccgacaaccaagcaaaaaattggctattgaagacgtccagttcttcttatcttcacactataacgggacgccttacgatccatttggcactttcgcttccggtaacgcccgtgaacaaacacgttaccggtctatcgcgatggatcgcaatcagtgctcatctattctgcaaatccggaatgacgtgcctgctaagcaagccgccattcaatggatcgcactaggtttcttcgcttacgccccatacgtgcccttctttaccaacatcaatgacacgccgattgattatcgcaatacaactagcacggtcagcgttgataacgtctactggttatcaaaaacgctctccgtcttgattgaaccacactggcatgaattttctgaaacggtcaatgcctatcgcgacgggtgccaatcatatgcccgtggccgggttgccgcaaccgacgcagccattaccggcaatccgaccgatttcttgaccaaagccaatagcgaaaccgccgccgaaatttccaaccggacccatgcgttgtttgatactttggttaagcaagggctgttgttatcgaaaacgacttgggaaaaaggacaaaatctataaaaaaatcatcaacgacgtgctactggaacatttcagtagcacgccgttttgtgtttttaattatcattgatatgctgatgtgctaaccgatacccatgctgctcacgataatcattgggagttatcgccacttcgcgtttgaacgcagtaaagaaactactattatttttatagcctaattcagctgcaatttgttcaattcgcttattagaaaatgccagcattcgtttggccagttcaatacgaataaatgttaattgttccgaaaagctcttgttgaacagtcgtcgacacagccttgaaaaataatttttatcatatccaaagtaacatgccgtttcttttaacgtcgcatctgcgttatgtgcgactaaatacgtaaaaatcatccctgattgcgtatcagcattaacatgtcgaatatttttaccaggaaaataagaatccgtaatcgagatgcgttcctcatgatgccgcaatagttccgtcattaacaatcccaccgtcatttctcgttgataatcaataaaaacatcttgcaaatcttgccgttctaactccgtcaacaaatcaaagtaccgttgggttatctgatttcgcaattggcgataaacaataaaccgcaatgtccgctcacccgcattcattaaatcatgaaccattgggttatctccgacaaccaccaagtttaatggcgtaggcgcatgcagacgttccgaaaaaacacttaactttactggtgcccccctattaataatattaattggctgcgcagatgaaaccattacaatatcatctggggacagtgccacgtactttccggctaatgttaattcagcgaaatcgtggctcacgataaagcgaatgtgaaactctgaactgcaatttggtgaacttgaaagatcattacggcgtagaccaataaaatcgctttctttcaattgataattgctatttaccgtatttatagaagccatcactatcacctgtcaatcccttaaaagatatataaacatattaataaggatattatacactatcaacttgtgcatattttagctttatactaactttgtaaattcgaataagggagtgcaactattatgactaatcgaacaattgatactgatgtcctcattgcaggcacaggtggtacaggactagccgctgcatacgcagccgtgacccatggacttaaagtcaccgttattgaaaagcaatcacaaattggcggtaacacaaaaatctcaagtggatttttcgccattaatagccgtgaacaacgggaagccggtatgcacctaacaactcaggaggccattacacaattagccgactacaatcactatttgtccaatggtaccctacttgcgcggatcgttaaccgctcggcagataccttagcctggttggaaaaaatgggaatggaaatcaaactcaacccaactgccaatacgactcagtttgcgcatcgtaataatgattatcgtgggggttcctatcatatgtaccaacataaagacgagagctatcagcgcatccaacaaacattaacgactgccggtgtcaattttcactttaatacgacctttactgacctggtaattaccaacggagcagtcactggcgcaacagccatgaccgcttcaggtgaccagctaacaatcaccgcccacgcagtcgttgtggcaaccggtgggtacggtggtgatcgtgaaaaagttgctcgaaccatgcacaccacgcagctaagaaccttaggtgttccaaataacggtgaaggtctggctgctatggttaaagctggcggtactgacatcgacagccatgcgctcattcatgctgcgcaactagctaaatcccaagtcactcaaaagacttctcagcaacaccttgctggtttttccggtaatccattaacccaattattattaacccctcaactatgggtcaacatgcagggacaacgattcaccaacgaagatgtggtctacgataccgttgaatgggcgaacgctgcttggtctcagggtggtcaatatctctttatcgtggatcaggccacgctcaatacattcaccaccaaccgcaatcgcgaagaagtttctcaagcaggaccgggcgcagcgactggcagtggtgactttaccgcattagctgaagaagctgtcactggtaaaacagcttttaaggggaactcactcactgagctagccactaatgctggtatggatccttcaacattgagccagaccgtcgctacttataatcaagctgtcgcgtccaaaaacgacagcgaattcagtaagcgcttgcagtccttggattattcaattagtgatggtcccttctacgccttcatctgccaagccgcctatcttggtacggtcggtggtgttcgggtcaatcgaaatctcgccgttttagatgacgatttcaaacctattcccggtctttatactggtggcgccaatgctggtggttactatgagggacacagctatcctgcatttgaaggccttgcctctggctttacttggacgtcgggccgaattgcaggaacaagtgccgcggcttacgtcaaagcaaagttcgccactgtcaactaaatcataaatccaatattgagtcttttatttagggggatgtccagcatggaaacaacaaaatcgatatcgggaccaggtaaaagctacgtttctaagacccggattggggttcttgcagtcagttcaatgggcatggcggcactcgcaattaccccatcctatgcagcaatcgcatccaatttttcactcagtaatacgagtgtccagatgttaacatcattgcctaatctatttatgatgttagcagggttgattattggcaaactaacggcaaccaagctcaatctcaaaacattaacccttagtgcggcaatcttagtaattatcggtggttttctaccattagccttccacacaaacttcatgtttttgttattttgctcgtgcttagtcggtctaggtcaaggcgcctgcaccaatttatcacaagtcttaatttctcaaatgctaccagaaaccgaacgccagtccactatgggtttaacaaccaccttcaccaatctcggtggtattgtcttcatcatgggtggcggccagctagctgcaacgaacggttgggtaaataattattggatttacttattctcagcacttattttgattgtgatcttaacattagtgccgatgcatccggcagcagtcaatgcagccaacgatcaggataccggtgaacaaattaagctcaacaaatacgtctttttctgtgccttctggggattctgcacgttactcttaaataatgttttgaacaacaacatttcactatttgttgctgaagaaaaacttggcgcaacctcacaagccgctctaacgtcaaccgtttcattaattggggggatgctatgcggcttgattgttggcgttatcggcaagcggttcaaatactcatccatcacaatctcgtttatcttatacggcctgtcctacctgttaatcggtcttggacattcgctatggttagcctttgtaggtagcttcatcgtgggtgccgcaatgagtatcgccatgggacaatttccatatttgatctcaatttcagttggcaaaaacagtgtttcgatggccctaggtgtgtacgtcgcgatttactcaatcgggggtgtggtcagtcctttcatcgttaatccattgactaaattagttgctggtatgagtattaacgtcttcgtagtcagcggcgttattgcgctgatcctaggtgtactatgtatgggatttcagttccagaaaaaattagtaacggcggcacaataaccgacttgaccgacttgaccgacacaattaaaaagccgtgtttcacaacgcaatcgttatgaagcacggctttcagttcatttttaacttaattaaaattaatacttcttgcttaacttgctagcagccgcttcgtcaatgataacggtaacgtctggatggttttgcaagatacttgctggtaattcaggggtatctgggccttcaatcatacccttgaccgcatcagccttgttttcgccgaatgcttcgagcaataagtgcttgctcttcatgatggaagctaagcccattgagaaggcttgcttaggaacatcattttcgctggcgaagaaccgcgcgttagcttcaatcgttgattcagttaaatcaaccacgtgcgtcgtaatatcgcgaggagtacctggttcgttaaaaccaatgtgaccattacggccaatccctaagatttgtaagtcaattgggtgttcgtcaatcactttgtcgtaacgcttaacttcagcttctggatctgaagctaaaccgtttggcaagaatgattccttaaatggcttgtcattgaataaatgagtttgcatgaagtatttataactttggtcgttgtctggtgcaatcccaacgtattcatccaagttaacggatgtgcagtcactgaaatctaagtcactattaacgatttctttgtaagttgtaacgggtgtcgaaccagttgccaacccaaatactttcgcaccattgtctaaagcattcttaaatactttgaaaccttcttttccgccggcagcttgatcctttactacgataactttcataattaactgactccctctttgtttggtatagtccaattgtatattggtctagactaaaattcaagaggtttgtctgaaatatttcacttttactttttgcaatcgttatcattgttaaactgtcaagccaaactcctttaataaattaattgtatttttcgataattttgcctatacttaacatgttcgtaactccgtggaacgtgagaaattccacgactagccaaggctgcaaagtcattggctatttttttgcgctcatacctctacgccaaccatttatttgttcacatttcaatcaaactatccaacatttacattgcaattggtaactgctaaaattagctttgtatggaagatatatattacataaagggagatgttaaccgcgaatcatgtcaagcaataccggttaatggccggattctcacaaaaagaactcgccagcaagactggcatcacccgtcaaaccctgagtttgattgaaaagggcacctataacccatcactgaaactctgcctcaacctctgtcacgcactcaaccaaacactcgatactgtcttttgggtcgaacccagttaggagatccctgccatgaaaaagattcgtgacgaacgtttaattttacaaaatttcaagaacatccgtaccacgttgttaattgaaaatagtgctatcttactgattttattttggcaaggctggcaaaaaaacaatcttcagaaagcctttacgtacgacaatccgttgtatattgtcctgatgattgccgtttttaccatgatcattttgtctgttaatgtcagcaccccaatagaagacaaacccaaacggtcatggcgctaccttggcctgtgggcactcattgaactaatcggtttcaccgccctattctacttcctgattgcgataaatcagccgttcattagtctgatcgctggtatcgccctgaccaccgtcactagcggtatcatgctgtatagcaaccacctgcgcgatcgtgattaacatcagatatcacctagacggtaccattctaatcacatttgcggtaaactattcccagaaattcaacggacacgaggtttttgctatggaaccaacttttaacaaaatgactgcgactggttaccatgccatcgaacaggaaattgaagacttaaagcaacaacggcccgagcaaatcagaattctggctgcggctgcggcactaggtgaccgttctgagaatgccgaatatagtagtgccaaacgggacttaggtcgcttagaaagccgcctgcgttatctcaacaagcagttgcaatacgcccaaatcgttcaaccagctgacaacaatcaactcgatatcggtaaattcgtgaccatcgaatttctggatgatcatgaccaaatcacctatcaattagttggaaaacaggaagccaatctcgaacaacaaaaaatctcattcacatctcccatcggtcaagcgctcgctaatcatactgttgacgatgtggtcactgtgaacgcaccgaacggggcttatcaagttaaggtaatcgcggttaagcgcgcgtaataaaatagttatgccaatcgattggaagcttatctttatttttttgaatcaaaaatacactttctgaagcgcatacgtgttaaaataaaggcagtaaaaaagccggtacgttaataccgacttgaatcaaggcccgctctaagagcagttggctttaaatttagataatcaaagaacagtcacccaataccggccaaagttttggggtggctattttttgtttctggagttccatacctgatacatcgctagtgcgatgctcaaaatgatttgcaagaaagcaaaccgaacaggtagagtgaccacggctgaaaacctttcctagtgtgggaaacgtatttgtcatactaccacgacctttcaagatgaaaacagccaatcgcccttaaaacatacctataaacatattttaccagatagtggctcacagctacacagttagcattttttatgattaaaaaagccaatcgctactgcaccatgcattgcgattacgctgatatcacaaaccaatcatcaacaagcagttgcccataaaaagatagcgacgagttatcatcacaacgtcgctatctttttatatcattcaaattaaaattcttggtacactgctggatcttgattattcaagcgaccatccacttggctcaaaccattaattgttgccatatcagctgcactgatttcaaaatcaaacacgtccatattacctgcttgacggctcggcgttgacgactttggaatcggcaaggtccctaactgtagttcccaccgtaaaatcaactgaccaacatttttatggtagtgcactgcaatctctttgagcgtctcattttgaagcatctcactggcccggccaaggggactccaatcttgcgtcaaaataccgtgtgcttgatcataatcccgttgtgcctgctggttaaagtacggatgtaattcgacctgattaatgacgggtaaaacacccgtttctttgtttaatcgttctaaatgttctggtaagaaattcgagaccccaatcgaacgaatcaagcctaacttctgggcatcaatcagtgcctgccaagcttcaacataatgatcttccttagggttaggccaatgaattagatataaatcataataatccaggccagctcgatataatgattcttgaatcgtattgatagcttccgtgtaggtgtggtggcgaccaggaagttttgatgaaatcaagagttccgaacgcggtactgacgaacgccgaaccgcttcaccaacagcaccttcattttcatagttaaaggccgtatctaataatcggtagccgcgatcaatcgctgagtcgatcacttgcacaccatgagcaccattcagtttatatgttccaaagccaattttaggtactgttaaaccatcacgtaacgtataagtttccaacttaagccacttctttcttttaaattaaacgatcattgttaaatttatcgttaatcttctgaacgatcagccaaggcatcacgaatcgctgcttcaaatgttgccggccgtgtcgttggggcatagcgttcgagcacacggccatcacgaccaatcaggaattttgtgaaattccacttgattcgaccatgtcccgccgcctgtttgaggtaagtaaataacggatcagcgtcatcaccattaaccatcacccgtttggtcatggggaacgttaccccgtagtgccgttgacaatagtcatgggtctcatcgtcatccgccttttcttgatgaaattgattggatggcaatcccaagaccactaggccctcctgctgatacttctgataaagttcttctaatcctttaaactgtggcgccaggccacagttgctagccgtattcacgattagcaagacctgaccgcgatattgtgacaagtcaagtggcgcaccactcatctcagtttctgtaaaatcatacactgattctgccatcgagatccctcctaagaatattaaccaaatacattgctttatccatagtaaaccacaaaattgtgacttttcatcatactttgctttagtttccggaaaattgattgcactgaatgtcattatccgttacactaaacgtatcattcatagcaactggggtgccatcacggctgagataatacccattgaacctgaatctggacaatgccagcgcagggagcaatgcttttatttggggaaccatcaattcagacttagccgcctgccaccgataatcgtggtaggcgttttttgtcgcttggatgcgtgaatgacaaactacttttgggaggatttaacaatgaaatgggttaaatcatggtacttgaacgatattattttactggcactaattggtattttctttggtgccatctttatggggactaattttgtttataacattttaagtgcggccctgacaccatttggtctaagcggtctggctaatgaactactacttggcttatggtgcatgcccggcatgttagctggctacctcattcgactaaagggttcggcaacgctaggtgagctcctcgcagcaaccgtcgaaatgtttttcggtggtcaatggggaatcaccacattgatttctggtgtcgtgcaaggatttggggccgaactaggttatatcgtcactggctacaaacactatgactggttaggcttaacggctgcggccgcaacaactactgtggtcacctttggctgggaccttgcccgtaatggttactataaattacagctatggctcttggttttatacgtggtcgttcgctttatttcgatgtttgttttcgggggtctgttaactaaaaccatcacggacctacttgatcgcagtcatgttttaaaatcaacgcattaatacactttataaaatggaggctttctcgaatggctagtatcgcgctgaataatttaacttacacctatccacaggcgtcgacacccattctggatcgcgttaacctaacactaccacggcaaagcttcatcctattgacagggccatcgggaacaggtaagtcgacgctcctaaagctgattgcaggcttactacccctgactccagattacggcaccattacctttgatggtcagtcattaactgctagcaccgctaatcagcgcgctcagcacgttgccatgatgtttcagaatcctaatcagcagtttgccatggataccgttgaaaatgaactaattttcgcacttgagaacttacaagtgccccgtgaccaaataccggcccgcttacttagtgcgcttgactttgttggtatccgaaatttacagtcacgactattaaatcatttatccggtggcgagaaacagaaagtggcccttgcaatcattgtcgctatggatagcgatgtcatcctactagatgagccctttgccagtgtcgatccgaccgcacgagccgtcttgttagaccgactcgtggaactacgcaatcaacatgggaagacaatcatcttggcggatcatgacctatcaggttacgaacagctcgtcgatcaagtcgtccaaatcaaggaccagcacttacagctcattgatcgcaccacctggtctgagttatttgcagcctttactgagcagccacaacggtcatggtcagcaccgcaacgcgttgaacgcccttgttttcaacttgatcacgtcactttacaggcaggtgatcgtcaactattagtaccgacaacgcgtcaattgttagcacaacacaatacgctgatcacgggtcctaacggtagcggtaaatccacgttatttgaagccctcgtccgtctgcacccctatactggcgaaattcgttacgaagggacacctatcgacaagctaaaacgcaaacgctatgctcgccacgtcgccttgctttttcaggacgctgagacccagtttttaaacatcacggtcgctgaagaactggctcaaagtaaacgctatgcgtgtggcgactactttaccgcagaccgtattcaaacggccttagtgcaactcaacttatccggtcgtgatgaacaagtcatctatactttgagtgagggacagaaaaagaaactacaaattctgctcatgttaatcatgcagtcaccagttctactcatggatgaacccttaaaagggctagatttgcattcgatcaatgccctggtcgcgttattacagaccacccaagcggcaactaagcagacgctgattattattagtcaccagttaaccggcctgatgccattgattgactatcagctacactttgaaaatcaccatttagattgggtggtgcgatcatgaatcctagcatgaaattattattactactcatcattgcgctagaaatttcattcacgacaattgtaagtttgaacgtggcactgattattctggcactgatttacctgctcggtcaccgaactcggcttcgaacattagggtggttgctactcattccgttgctaccagcaattggactttggagtacccagtacattaacggtagcggtgacaagactttgatggcctgggtcctgttcacacggatctatgcgtttgtttttacgggcgctacttttacgctcacgactgacgtcttacaattaaccgattcgcttgagcaaaactggcatttacccgccaaatttgcatatggcgtcctcgccgcgtataacttggtaccacggattcagcacgaagttcaagtgattcgggctgctggtctgatgcgtgggcaggtcctgtccttctggtcgccacagctctactttaaagcaattttggtctctatcaattggtcgcagaaccttgcccaggccatgcgctcccatggttttgtcgaagatgcaccccgcactcactatcgtcagattccactgactaagttggattggaccattgtgattagtggcgtcttgcttttacaagtcggcgccttcgtcattccgtggcgctagtggtatcattcactgaataaacactaaattaaaacaggttttctcaattatgagaaaacctgtttttgggtaatattccccacttaggtcgggtcacaacaataacaagttgaccttaattcatgctttcagccgatcaatttgttgccgtaacgcctgaatagcagctgtagaagacgtcgggtctgccattaattgatcatacttgaactgaagtactgctaagtcagcttctaccggttgcggcgctttaacaactttgtcaggatcaactaattggtgcgtctcgaattgcaacacccgagtagcaacggcctggcgaaacggttcatcatgtgaaacaaaaattacggttccaggataattttgtggtagcgtcaagaatcttg

SEQ ID NO: 19 - DNA, 49970 bp, Lactobacillus plantarum
gattaaatttgcaatctaccgaatatggctacttaatgatttttgcaggattattgtacgcctacgttaatatgctgacccaagatagtgagattaaattacggttggcccagtttgcgagtcacgacgctttgactgagactgagaactttgccgcttacacggaacatatcaaatatttattcgatgatagtgccaagaacaatctcaacttatcgatgatgatgttcgatattgatcactttaagcacgttaatgacacgtacgggcaccttgcaggggaccgcgttttgcaagaagttgccgccacggtcacaacggtcttggccgccaatgacgagaaggtcaagctgtatcgcaccggtggtgaagaattcaatgtcctgtttcccggttatgatctggctagtaccaaagtgattgtccgtcaggtctttgaagcagtcaatcatctcgttgttaagtatgaagacgaggaaatcaatgtgtcgatttcggttggtgtctcgacactgcatcaagccgatggtagtccgattgatttgtacaaccgtgttgatcagaacctctatttttcaaagcggcacgggcggatgcgtgttacggttgaatagtggctgagattaaaaataaataacgttgacttgttgagctcccggaataaaagccggaagctcttttttgctcgcaatcggtctgactgaaattgtaggcctaaccgtcattgcctgattgacgtattggggaaacatgatgtcaaatctacaagattgcttgagtgcgacattggggttatggtggccaatttcagctatttagtagcatcgttcgttaattgagtttacgaattaacgctaacagatgtaaaccttaatcgaaaccgttaattatgctggcattctagtttaattatggtatggtttatgttgtaaagataacagtcaatgacttaaactaattgacttacatattaaagaaaacaagttttttacgttacgtttgttaaggttatttaaatacgaatggttgccaatttataaagtaaggaagtgagaagtgtgccagtggtcattagctcattaattcccgtagttgcgccggttaaacgccaagtgatcaatgtgacgacccttgcaaatacggttcacttatatgggttactaggatttaagcagcaaattataccggcaacagatcaaattgttgcgccctttgctggggttatcacagccgtggcagccaatcaacggttaattggctttcgagcggccaatggtctggtgggctggctacgaattggacaattaaccagtgctttggaatcgcctacatttaagttcaacgttaaaccgggtgactgggtagttgctgggcagatgttggttgaagtgatttcactactgacacaacggctccaaccagttaaaacgacggtggtattgacgattagacatgcggttgttcgtgttcgagaacggttgctggcagcaagtaatcaagtcgatccgatgggaactgttatctcaggtattacgaccagtatggctggtaatcatcgggtcgcaacgatcgggccaccccaaggtaattaattgtttgacaataagcaatcgacgtcctagatacggggtgtgtctagacgtcacgcttcgacgcagcccattgaatgggcagtagtggctgaggtgtgcgttttaataacgcagttaggggcagtactggacacatgaacagtactggttcacaaggtcgccgtactaggaggtacggcgtcgctgatgttataaggtattaagattaagtagttgtgggtagcagtaattggtcagcgattaagttttggcagacttataagcacaactgctatcacgggtacgattaattgggtgctaacgtaagtatggttacctagtcaattaagtttcgttggtcaaaggttaggccggtattaccgagatggttgtgggggtataactacttcggcgatcgtttgatgtcgcgttatgttcaagataggtcaattatttggtttaagaacggatcacttgcttttacttggcagtccagtttatcatgacggtaaattgtgaaggagtgattcggcatgaattcagcgacatttaatcaaactgaattagcaaaatataatggtcaggatggtcaacccgcatacgtggcggttgatggtgtcgtttatgatgtaacgggggttgcagcatgggctggcggtaagcatcatggtaatcttgcggggcaagaattaaccgcagtcatcgacaccaaatcaccacatggacgtaaagtgttaacgggactgaccgtcgttggtcaatacgtgactaattaaattattgaagactggttgattgtgaccagtctttttttgtgtggatatgcggctgttgtgattgcttaaacgagctttcacaccaaaatttttcgtactgcgaggcaagtattgaccaattttaggcggctgtttgtgggtttgagacattgtgtaaaataagtgcgtgatgataatcgatattccaagtaaacgaatagataacaaaaatactaacttatgattagttaagacctgtaatggttgctggcacgtctattgacagtcatccactgtttatataacaatacaaaataaattatataaagagttgaatgttgtatgaaaaagcgtgaaaatagaattgaattaaaggaaagttaataaactatattttaggtgggtaaatgatggagcgaaaacggacgaattttaaaatgtacaaaattggccgtcgctgggcgtttgcatgtgccgttatcttgacgatgggcacaacaacgctggtggctcgggctgatgatggaacgactgcaacggggactgatacggcatcaactagttcaagcacaaccaaatcagtcacggctaagacacaaactttgaagactgcggccacaactgaagcggatgtgactaaccaaaatcagccggttttagataccgatggttcgaattcaaagactgctgctggcacagtggctggtactaaggcggcaacggatactgatacaaacgctaccaccaatttggatgagacaactagtgccaatactgaaactggttcagatacgacagctggttcaaagacggcaaaagagacgaatgcgacaaccggttcagagtcgacaaaagagacgtcgaccataactgattctgccactgcaacggctgcgcggacaacaaccagttctaataaaggtgcgactactgactcaactaccagccatgataccgcggcaacggctactaaaactaccgatgctagttctaagattgccggtacgacgactagtgatagtgtagcccagcaaacgacgacaactaaagaccagtcgacgacaactgcaacgccccagaccgccgcggtggcgcttagtcaagctgtgacccatgcaaacgatgccgttgccgatggtggtaatgtgacggacgattatccggatctacataacatgctcggggtttcgtcccaattccatatttttgcacgggaagcggaactacatgcccatacgaatgggaacgttgcggtgcaaaacttagtgggcaacgttaactttgggacgaacattattgaagaattattagataaagatatttcgtatattcaaaatatcagtaatattgctgggagttcgtttgtttcggctggtgagacgcggagcaataaagtcatctttggcgaaaatattgagattgatatttcgaatcctaatcggccgatggtcaacggggtctatatcgaccatttacttgcctctgaagtttatcaagacaaagatggtaacgtctatattgattttgacaaagagtttgctaagttggaacaattgagcgctagtcttagcgaagcgtccgcgaacgtcacctatacgagtgacagttttgaagatatgaatcagcgggtcatcgatgtgacggatatgcaacctgatgcggatggacacattgtgatcaatctgtcagcggatgttttaaacacgagtacgccgctgacaatcaagggactatcggcagatgcggatggtaatacggtcattattaatgttgatacggcaggtgcgaccaactatcaagttaactcgcagatcaaaatcatttatgatgacggtacggagcggaataataaagaaactgaagactttggtgataaccatttgctttggaacttctatgattcaaccgcgagtgacaagttagcaactggtgtcattagtgtcgaccggccattccaaggcagtattttagccccagcggcggaaattgatgcaaatcaaaatattgatggcaacatcattgctaataaagtcaacgtgaaggcggagacccatcgttgggatttacaggataatgttgataatgaaaatgatccagaaccagttccggactatgagaaaccagtacatccaggtattgatgccgaattaccggatggcggcgagggcgaagagccagaatacgacaaaccggtacatccaagtatcgacattgaaatgccagatgatggcgatggggaagaaccagaatacgacaaaccggtacatccaagtatcgatatcgagatgccagacgatggcgaagaagaagaaccagaatacgacaaaccggtacacccaagtattgatatcgaaatgccagataatggcgaagaagaagaaccagagtacgacaaaccagttcatccaagcatcgatgttgaaatgcctgactttgacgagattgaggacgaagaagaagctgaagacgcagaagaagaatttgaagacgatattgaagatgaaatcgaagctggtgtgacgccagacgaagttgtcgatcaaatcgaagaagaagtcgacaatgaaattacagctgactgggtcacggacgaaactgcgactgaattggaaacggcgtttgaggaagttcaaaaagaaacagtggttggcgatcagattaagtatgaggaaacactgatcaacttgattgaccgggcaatcgcacaagctaaagcgcatcataatacggcgttagtagcgcaattacaagctctacgaactaaggtggctagcgcattggcagtggctaaggggcaagcattaccacggactgatgaagcgccaagtcagatgattagtttagcgggaatcgcattagcaagtacattagtattaggtgctgcagcggttagccggcggaagcgtcggtattaagcttaaaattgtattttgaagcaactgttgattcggcaagtttaatcttgcgaatcaacagtttttttgcataaaaaagtcactaaaccaaattggtctagtgacgctcaattctctctactccatgaccgacctaatctcttgaccccaaatgcgccactagtgaaacgtggtataaatgctaacccccattagcatttatgatatttattataaataattcagcacattagtcaacttttattcgaatatatttttaatttatgttgaaacttattcacagataaatttaattcaccgactgaattggtctaaagtaagtaaccataataaaaagctggatggtccggatgaccattcagctaagtaatgttggtaaggtttaattacgaattaattcattgaagttaaattcgttcggaataaagtgggattcagtgtattcaacctggcgtccttcatcgttaaatgcgatgctaatcatattaccgacgcaattattatcaccgagcgctagctgagctttgtcgagttcggtggcggattcgactcgtagcattcttttaacgacagcaattttcagaccattttttttgaagtgttgataaattgagtgttgggcgatggtcttagtcagagtgggagtgcgctgggcgttaaaatagttaatgtccagcactgcccgaataccgtctacgatccgaacccgttgaatagcatacactggaatacccacttcaaaagcggtatgtgtgctaagcggctggtcaacgattcgttgctgaaaggccacgacctcggtctgataatcgaggtggcgctccgcgttgaggctctgcagaccgttgagattatttaaagccagattgaattgctgggtttgtggcgtgtgctccaataagaccaccccgcgccccttaacgctgtaaactaggccgtctttggctagttgtgcgattgccttacgaacagcatagcgactgctatcaaattctgtaattaattcgtcttcaatgggtaatcgcatcttaacgctgtagtgtcccgcgagaatgcggtcctttaaaacgtgatagatgtcgctgaatgtttgtttccccattttaatacccccgctcatcatataattaatttaattatagcaaataatagtcattagcgagtaaataagcgaataaatatcgatatttattcgaataaaaattgacaagcaatcatgtgaccttctataatgaaagcgaaatcaagtcggtaatacgggagtaggagggggaacatatgcaagttgaacagcgcacattaaatactgcggcacacccatttcagatcacggcgtattggttagaccaaattagtgattttgaaacagctgttgattatccaatcatgattatctgcccgggaggtggctttacttatcattctgggcgggaagaagcgccaattgcaacccggatgatggccgccggaatgcatacggtggtcttgaattaccaattaattgtgggagatcagttcgtctatccttgggcgttgcagcaattaggtgcaacaattgattggattacgacccaggcgtccgcgcaccatgttgattgtcagcggattattcttgccgggttttcggctggcggccacgtggttgcgacttataatggtgttgcgacccaaccagaattgcgcacacggtatcatttggatcattatcaaggccagcatgctgccattattttaggctatccagtcattgatttgacagcggggtttcccacgacttcggcggcgcgtaatcagattaccacggatgcccggttgtgggcagcccagcgcctagtcacaccagctagtaaacccgcttttgtctggcaaacggcgacggatgagttggtcccgccaatcaattcgttaaaatatgtgcaggccatgctacaacatcaggtcgcaactgcgtatcatttatttggtagtgggattcatgggttagcgttagccaatcatgtgacgcaaaaacctggcaaggacaagtatttgaatgaccaggctgcaatatggtcacaattagcattgcggtggttacaagaacagggattgttagctggtaattattgaaaataaatctgggcgatcagtcgtgcttcactgatcgcccgttttttgtcaacgatcctgacaccaattaattttctgcggtataataatacgaataagcttattaagtaagaaggagcgattgagatggcaacaaatcaacacttggtcattatttccttagatgcgttaggatttcgtgatttacgcgaacaccaagcagaattacccgttctgagtggattaatgactggtggtacttgggtcaagtcggtgacgggcatttatccaacactgacatatccgtcacataccacgattattacgggacagtatcccagcgtgcatggaatcgttaataatactaagttacaaccgacacgccgttcaccagattggtattggtatcaaaaggacgttcaagtaccaacactatatgatttggcacggcaaaagaagctaacaacggcggcttttttatggccagtgacggctggcagcaagattatatataaccttgccgagatctttcctaaccgcatttggacgaaccaagttctcgtctcgttgaaggcgagttcaccgctcttcttactcgcgatgaatcataagtatgggcatcttcgtaatgggattaagcagccccaactagatgaattcatcacggcttgtgcagtcgatacgttaacgaataagaagccgaacctaacgatgattcacttagtcgacatggatagtatgcgccatcgctatggtgtgcgatccagtgaggccatggcagctttacaccggctagaccggcacgtgggccagttgattgacgcgactaaagctgcgggcacgtttgcggataccaactttgttattttaggtgatcactatcaaattaatgtggatcacatgattcatttaaatacgttattcgctcagcagggctggttgaccgcacgtcaagatcagacgtttgaagatgactggtccgtgatggcgaagacggcggacggctcaacgtacatttatacgcgaccggaatttgaccaattggatgaattgaaggcattggttagtcaggttgaaggtgttgagaccatcattactggagaggcggctgcacgtcgtggtgcggaccccgcttgtgcgttgatggttgaagcccaggaaggttattattttactgatgaaagtcgacggccaactgtggttgaacccgtccatccagcgacactcggccaaccagaccgttaccacggggttcatggatatgacccgacgaagcctgattatcaaacgaccctgttattcaatggaccagcagttaaagctggtgggacgattgaagcagctaacttagtcgatgaagcgccgacatttgcgcggttactcggattgagtttcgatggccccatgccgggacattgcctcgatggtattttcaaagactagacaaaaaagagagagaggaaaagcgggcggacatcagcaccactaatattgtggttaatgctcgttccgcctccgattgcgatcagaggttcccgcgaagtaacttaatgaaatttaataaacagcagtggggttggatcttttacgattgggccaactcgggctatggcattattgtcacaacggcggtgctacctgtttactttaaggcagttgcccaaagtagcggtgtgacaccggccaatgcaacggcttactggggttatgccaatagtattgggaccttactagtttcgattttggcgcccgtcctaggtgcactagcagactatccccatgccaaaaaacgaatgctcaacatcttttcgatactcggaatggtgatgacgctagggctgagtgttgccccgactagtgcctggaagtggctattaggtatttatattttatcaattatcggttattccggtggtaatctgttttatgacagttttctgactgacgtggcaccaaacgatcagatggatcgattgtcgtcatatggttatgggtttggctatctcggtggtgtcttggcgtttatcctattcttggtcttacaattaaccagtggttttggtcaattatcaagctatggggtcgcacggtggagttttgtcttagccgctgcgtggtggattatcttttacattcctttgttgaaaaacgttcaccaaaagtacgcgttagcacccagtgcgcatccggtgcgttcaagttttcaacgggtatggtcgactttgaaacacattcggaattatcgcgctgcggcgtggttcttggtggcgtacttcttctacattgatggagtcgacacgatctttacaatggcaacttcgattgggatggatatgggaattacgacgaccacgttgatgattgtcttgctggttgttcagctagtcgcgtttccgttttcactgctttacgggtggttagcgaataaaacgtcgacccggacgggcatcttgcttggcattgttatttatttaggtatctgcttgtacgcgttgcggttgaatagtacgacggatttttggattttagccatactagttggaaccagtcagggtgggattcaagcgctcagtcgttcgtacttcggtcgtttgattcctaagactagtgggagtgagtttttcggcttttacaatattctcggtaagttctcagccgtgatgggccccgtcctagttggaatcgtgacccaaatgacggggaagtcaacgattggtgctgcttctttaagtattttatttgttgttggattagtgattttcttggctctaccgcatttgaaccagaccaagtcggtttaagccagggtttgtttaatatcatgtaaaaagaacttcttctaatttggagaagttctttttacgttgctcaagctcagactatcatgagctataaattcatttccgtattccgctgtaatacaaaataaatgacaagccaacacaatacgcgctaattataacaatctgaaaggcatagctatcagcaagccttgggtcagttaatcagtatgtgtgattaagaaaaagtctgttccagtctggcataatctattgccaggctagaacaggctttcggtgttaaagatgtttgtgagactgatgcgattggcgataagtctgggcttgcttagtgcgaacggtacgaattgcaaataacgtattatcaatccgggggtgatgatgtgtttctaagacgctgacttcatcaagcaattggttgccaatttgccagtcgccaaagtagagattccagatgccaagccagaattgttggctcaaccgcccatcccagtttaactggtgactgtcgatggcagtgaacttggttttcagattttgagcggattgaaaatcatgaaagttcaatttagtttgaaatagtgatccataaaaatcgagtaagtcgttgctgacgtgaaagggatcgccccaagccgtttgataactggcacaattggcggccatacgggttgtcagtggtgttagtgcggccaaaccgtcgatggatgcaataattggaattagaacgggcactaattttagttcctgcagggtccaagtcttggcttggcgcaggtgatcaaaagcgggctgggtcgtggttgtcacgccgactgaacgatggtcataggatagcatcaagatgctggcataactggcgatgagttgttcgtaggcgtgggggctgtgtcgatgttcgcgaatccaagtggctagggcgagaaaatttagcgtttcataagcgtgacgaattgtccaaagggcctggtcatatgctgatggctggtagttttggtgtatgaatcgtaactcgtcggctgaaattgctaagttatccagaattgcaaagagtttactggcgccaatatcgttggcaccactctcaaagcgtgaggcgaatgagcgcgagataataccgctatacacttcttgttgagttaagcccttacttaatcgaatctgatgaatagtttctccgatgtttgtcatctagcactccttaatgtggcatatatgcaacctacttgctgattgtaccacggtaatgacgagtaagctaagtccattatcttaatgggagatgggttaatgctgactttattaaaaaatcggaccctccaaacgattgctagtgcaaatttttttacgacgctgggggtgagtttgttcaatatcattttactcacgtacgcaaagaattttccaaatccacattggtttgttgccatcgtttcggtggtgacagttgtgccgtacgttttcgggggattaacggggcgactcgctgatcagacgcgccgaaaaactaactggctgattggcactaaggtcgttcaagcagggttatatcttgtcctggcccaagtgattactaagcaaacagtggttgttttctacgtggtcgttgcgattaactttatttcggatctactaggacgatatggtggcagtattttgacgattgctattcaagaccggattgggcctgacgatcgccaacaaatgatggggcttaatgcgagcgtaagtacgcttgttgagccactgggtcaaacactaggggtcttgattatcgcccagtggcacgattatacgttagctggaatagtgaatgcgatgacttttattggagccgctagctgcttgttggccggacgttcagcgattcagtcgactcccaaagttgctggacgaccacgacatattgaggcctggcctgtgattcagcgagtgatgctgacgacgactagaatgggcgcagtcagttatctgggtattctgatgattttaaacgtcgcaacgatgagtattgatgcgattttgaacttaatgtttattgacttggcgtcccgcatgcccgtgagctattcggtcgcaattttaatggtcaacgtggtctttgttaccgggagcgtattgggtggcattactaaaaatacttggtttgatcggctctcgttgtttcaattgttactggcagcgattctagcgccgatgctgacctatgtgactttactagtcgttccacaactaatcttgattcttgggggcatgtttgcagtgggcttcatgagtggcaaactggactcgaagatgttcgccatcatgatgccacaaattgacacgcacttaacagggacggtctttggtaccatcagttcgattgtgacgttggcggcacccgttggtagcgtcggcatcgttttattatataacttagttggtgcgacggcggcgtgttcggtgatgattggtgtgagtgcgctggcgtttatctgggcagtgatggcgcaccggcagtgattaattgttaatcttttgttattgatatttcaatttggcgttaggatgtggctatcagctttgtgatgacttacgaatggatttagtgaaatgcagtgctcaaaaagacatcttgggacggctgactaactgaaatggtacattaaggaaaaggacgttagtttcgtccgcttcattggcactatctcagcataacaaaagcgtgtctaacccctagcaagttgactagctgggggttagacacgctttttgattaaatattcgataagaccgttgtgatgaatgaggtcggtcatcagttcattggttaaacgtggaatagggccaaatgcgtcttcaaatattgccctgttacactagttggattttgactaacggctaatggggtaccggtggcgacaatgttaccaccgttgataccgcccgcgggtcccatatcgataacgtaatcagcgttggcgattacgtcgagatcgtgttcgatggcaatgacggttgccccttgctgaatcagttggtcaaagactttgacgagttgctgaatgtcgagcgggtgcaaaccgactgaaggctcatcgaagacaaagagcgttcccgtttggcgtttgccaatgcgggaggtgagcttcaggcgctgagcttcgccacccgagagtgccggcgtactttcacctaatagtaagtagcctagtcccatatcatgcagaatctggagtgtattagcgatggcggattgcgctttgaaaattggtagggcctcgtcaaccgcgagatctaaaatatccgcaatcgaatagccatgccatttgacggtcagcgtctgtttattgtagcgcttgccgtggcattgggggcagacttcggtgatgtctggcaggtattgcacatctaaggagatttggcccgtaccaccacaagttgggcaagcacccgcagcgacgttatatgaaaattggctagcggtccaaccgtttgcttgtgctgctggggtggcggcgaataattggcgtagatggtcgagaatgttggtataagtggcgaccgttgaccgtacattcttaccaacgggcactgagtcgacggtaacaacgtgtcgaatgtgaccattgtcaaaggccttaacgtgggttgggagtggtcgctttttagctgtggcaatcagtgctggaatcaaactatctagtaccagagtcgttttaccagcgccgctcatacccgtgacggtcgtgaaacggtttttgggaatgcgcgccgtaatgtcttggatgttaaagtgatgagccacttcaatagcaagggccccctttttccagagcgcatcgtcggttaatacggggcgttcacgcagcgtggcagtaccggtgagaaatggcgcaattaaggactctttgtcctgcttgatggctgcgacagtgccttgtccgacaacggtaccgccgtgcttaccagcccccggaccaatctcaataacatcatcagctgcactgataatactagtgtcgtggtcaaccaccacgacggaatttccttgggcgactagcccgcggaaagctttgattaggcccgccacgttagctggatgaagtccaacggaaggttcatcaaggacatataacacgccagtcgtggcgctacgcaaagtgcgtccgagctgaatgcgttgtaattcaccagttgacagggtcgcgccggggcgactgagtgtgaggtagtcgagtccaagttcttccatgggttgcaggctgagtagcaattcatcaacaagggattgtccaagatgatgcatcttagtaggtagccacgggacaatcgtggccgcaaaatcatgcaaggcggcgacagtcatatcactaaccgtcgcaatgttttgaccatttaattcgtagttaaacaactgaggattgaagcgtgatccgtgacaatctggacaagtatcaaacttgtaaaagcgattcagccgagtaattgcccgttcatttttggtcgtcgccatactatcttcaacggcggcaaaggcgttctcgtagacagcgttgtccatgtgaaagattttacctttagcgcttggaatgttgatggcaacggtttgcttaggaccatgcaatacgcgtgttttatcggcttcactaaggtctttatacggaatatcgatgggaattccaatttcgcgtgcaacgatcggcataaagttacgtccaggcaggtgccaagaagcaacggccccttcttcgatagtttgattttcatcagcaataatgagtgccgggtcaatttggcgaacttggcctaggccaccgcaagtcggacaggccccacctgaattgaaggcgaaatcttcggcgccgggcgctctgaatttggcgccacaagtcggacaggtgacgtaaccatcattttcagccacatcgagcgttggtggcatgcggtgaccattggggcaaactgctgagctgagtcgtgagaaggctagccttaagatatttaagctttcagacatggtgccgacggttgaacggacgccgggaacctgggggcgttggcgtagcgctaatgcagatggtaagtattgtactgaatcaacactggctttgccgacctgattgattcggcggcgggtaaaggttgacagggcgtttaagtagcggcgggccccctcagcgtacaggacgcccattgcgagtgatgacttaccggacccactgcgaccagtaatcgcaacaaattcgttgagtggaatgtcgatatcgatattttttaaattattgacgtgtgcgcctcgcacttgaatgtgagtcggtaacgtggtttgtggcatgactaaaacccctttcgtgtcactttatatgctacaacaaaaggacggctttgcctaagaaaacggtggcagtatctcgcgccccacgaccgggggagtatgataaactagggctaacgattattggagggggcgatggtgagatgtcgaagaagcgacgattaagttggctgagcgtgctcggactattggcaggattttgttggtggtttagcttagcaatgcgcgcggctgcggattatgatattgaccaatatcaagtcaatgtagtcattcaacgtgatggtagtgcgaatgtaacgcaagcgatgacttatcaatttgatgatgattatcacggggtatttaatgttcaagatttgaaaggtattcagggggcccagttggaaggggtcacgacgcaactgaatggtgggaccacggtgacggcggcgccaagtgaaacgggggccaacaacacgtatcagttgacccaaaatgctgaccggatgcgtgtcaagctctaccggcaagttcaagaagatgataagttacgggttgtctatcggtatcggcttacaggggtcgtaacgaactatgcagacacggccgaactgaattggaaagtgattggtagtggctgggatgtaccactgaataatgtcaaaatcgtgattcagttacctgccaagaatgtgagcgcgttacaagcctggacgcacggaccgttgagtggtcagacgaaagttgagcgcgcggcaggccgggtgacgatgacgttgggacataatcccgcgaaccaattcgttgaaagtcacctactatttccaaccacggtcacggcgacgaatacgcggacgaatactgccaagcgaaaagcgacggtccaaaaacaagaagctaagttggcacaggaagctaatgaaaaacggcgacgtaatcagttactgcgtcgcgttatctttggtgccgcggtggctggttggttattggtcatgattggctatctttggtggctggctcgtcatccggctaagccacatcagcagccgattcccatcaatcattcatttgacgtgccaccagtaacaccagcagttgctgagtcattgtgggcacagcggtcgccgaatacggatgccttaacggctgagattttgcgagcagcagctaatcacgaaataacgattgaaacggttgcgggtcaccgaaaaccggatgtgcggttaacgcaattgaaaccagtgactaactcatttttggctcactgttttgataaaatcgcggttgacgggcagttcatgttaacggatctcaaaaaatatgggaagcgtgataaagctggtcggttgggcaaatggtttagccgctggcagaccgaagtagaccaagacgtggcggtctatcaagacgaaactaattatcggcttcgtaatcaatggctgatggcagcagttgtcgtgagtgttatggggatgattgccacgggtgctgggttattagttagtccgaaggtcgtgaccctgatggtgattccagcggtagtggccgcggtggctttctggatcggctggataattcaaaggcggcggattgccatcaatactgacgcaggcttggaattacgtaatcaaatcaatggactacgccgcatgcttaaggatattgggcactttaatacggcccaagtcggtgatttgattttgtgggaacaaatcttgccatacgccgcggcttttggactagccaatcaagtgactaagcaattggcgattgattttggtacggaagcattggctacggggatgctcgtgtattacccactcttctatgcgaatggtgggctagacttcgatttgtccggtgcaatcaacgatagttttagtggcgccttagatgcctctggaagcgctagttcggcgtcgggtggttcaggcggcttctccggcggtagttctggtggctttggtggtggctccggtggtggtgccttctaacaaagtatcagaaaagacttgtactttgcgggcataatcggtaggctaaggggtagaaaaggcttacatgaaatggatgattagtaatgacgattaaattaatagcaacggatatggatgggacgtttttaaatgatcatggtgattatgaccaggagcggtttgccaacgactatgcggcgctacagcagcgcggtattcagtttgtgattgccagtggtcaccaagcggcggaactagccacgacctttagtgcttaccctgaaatgtggttgattggtggtaacggcgcggaactgtggcaacgagaagcgggactcaaagctgcgacgttcagtccccaagcaactcagcaagtgttagcggccctggcaccgtatcctgaattacaagtggcattgtgtggcacccaaacggtccatgtgttggcgcacgcgaacccgcagtttgtagctaatatgcgtgactactattaccaattagagacatgtgcggatttaaccacagttactgatccggttgtgaagttcgacgttatttgtcccgcggcaatgacggagcagttagtatatgaacttacccctaagctcgctggcattgccgtacccgcttcaggtggtcagggcagtatggacttgattcagccgggaatgcacaaaggccgcgccctcaaacagcttggtgaacagttgggtattctgccggatgagatgttagtttttggcgacggcaccaatgatcttgagatgtttcactatgcgacccatgcggttgcaatgcaaaacgcgcctgaaaatgtccaagccaatgcgacagcggtgacaggtaccaatgtggacgatggtgtattggattatattgaacaacatattttgagttaacttttgtgagaccagtattttgctaacttgggttacttggtgtgcgtgatgatcgtcaggcggggctttggtcgcgcaagcctgttcactagacacggttaaaactggtgtttacgggtggggttaatttagtttgtttatgaaaatgataagatactttcagaaaatcacgtatggttttgattgccaaacgagctgaaagcatgctaaaattaaagttatataattaacgacacagaggtctggaaggtttgtttaattccgacctcttttctatcggacaatttcactttaaaaaagaagaggtaatggaatgctcaccgtaaataatgttagtatgcagttttcaacacgtaagctttatgaagatgtcaatttaaaattcacgccgggaaactgctacggcgttattggtgccaatggtgctggtaagtcgacgttcttaaaaatcttggaaggtaaattacaaccgactgctgggacggtctcgatggggcctaacgagcggatgtctagcttgaatcaaaatcactttgctttcgaagatgaagaagtgttagcaactgttattcgtggtcacgaaaagttatacgaaatcatgactgaaaaagatgcgttgtatgccaagcctgattttagcgatgaagatgggattcgggccgctgaattagaaggcgaatttgccgaaatggatggctggaacgcggagtcggaagcggaccagttgttacaaaaccttggtatcgatgaatcgatgcaacacttgaagatgagcgagttaactgaaccgcaaaaggtgaaagtcttattaggtcaagcgctgtttggaagccccgacgtgctattactggatgaaccgacgaacgggttggacgtccaatcaattagctggttggaagactttttggctggttacgaaaagacagtcattgtcgtttctcatgaccggcattttctaaatcaagtttgtacccacatgtgtgatgtcgactttggcaagatcacactatttgttgggaattatgatttttggatggaatctagccagttagcggccaagttgcaagcgaatgccaatgccaagaaagctgaccaaattaaagagttgcaagaattcgtggcgcgattcagtgccaatgcttcgaaatctaagcaagccacctcacggaagaaacaattggagaaaattacgttggatgatatcaaaccatcatcacgtaaatatccgttcattaagttcacgccagaccgtgaaatcggtaatgaccttgtgaaggtcgagaatgtctccaagtcgattgaaggcgttaagattcttgataacattagcttcacgctccgtcccaatgaaaaaacggcgttgattagccgcaacgatttggcaacgacaacgctgatgcaaattattgctgggtcgatggcaccagatagtggcacggtgacctggggacaaacgacttcgcggacttatttgcctaaagatattaatgaagaatacgcgggtagtgaattgccaattattgattggttacgtcagtttgcatcgaaagaagaaagtgacaatactttcttgcgaggtttcctgggtaaaatgttgttctctggtagcgatgttgaacgaccagtgaacgtgctatctggtggtgaaaaagtacggggaatgttatcaaagatgatgcttagtcgggctaacgtcttattattagatgatccgaccaaccatttggacctggaatccattaccgcactgaatgatagtctgattgattttaaaggcgccatcgtctttacttctcatgaccatgaatttattcaaacgattgccgaccacattgtcgaagtgagtgcgaaaggcgttgttgatcgtggtgatacgacttatgatgaatacttggcccatgaagcaacacagggccgggtgcaagatctttattagttagtcgtggaatccgataaatctaaacaaaatcacgtgtgagcgtcccccaatctggtatgattaatgcatatcagattgggggattttttatgacgccagaaaccgaacaattattacgacgctggtacatggggcagctcatcgtgttatttggcgcggcctttattcaactatttacgtttgatggtggtgtgtttttcccagttggtggtatgcaattgctgatatggggactgctagcatggtggccagctgccgaggaggatcaagcacagtggtggcgtttgcgacatgttaattattatgtccaaacagtactgcagttcacactcttgccgattttactggcgaacctcgtggcttggttaagtcagctgtcatggttagacgagcagggattgattgctgtggggatggcttatttaatggtcgcattcgtgccggtggcagtggtggtcactaaaccgatcgaatctgtgattggccggattgcggtcctaattacggctatttttagtggcgtcgtcagtgcgcagcagacttttctgattttaccgaatctgcaagcaccatcagtattcgagatggtcagtgatactggtattttaggcgccctgggctttgtgattgctgttggggtcttactgcggggatggggattgacgggcccatcgtggcggtttaatcgtcaggcccaaactagtttagtggttgggctgatcgtggtgggaacggcttttagtctatggaatgcctttagtgcgggtggttcatgggcgacaacgttcacacattgggacttccagctacggtcagcgacttggaaaatgtttttgagtgggttagaaccgggaatcgcagaggaatggttgtatcgttttgccgttttaaccttgttattacaagcttttcggcatcggcgtcaccaactcgacttagcagtgtggctaagcggtgggctatttggaatgtggcatattacaaacgtttttgcgggccaacccttgtcagccacggttgagcaaatcatttttgcagcgacactaggctggtttttagcctcgacgtacctgtactcaggtagtatcttgctgccgatggtgatccatgctgctattgatattttgagcatgatggcatcaggtagccagacaatggttaagccggatgcgttcgaatggcaaacaatcggtgctaccgtcattatttttgttggcataacgatttatttcttgaccggttctcggcgacaagttattcaagcacatgtcaatcaacggctttcagttcaataaaggccgactgttaagaccatagtgggcgactttgttcgttaaagataaactgggtgtccgtagccagagacgattaagcaataccaagctaacttttagttggtttagaccagttgtaacatttttgtaatcttcgtgttatctaaacgcaatgctggctcgctatactaaagacaaagttatgaagcaatacatacgctttgtcagcggatttaggttgggagccggatcgatttactttgtcaggacattgttaataagcaattattgatagtgataagtagctcagttagctgaatcataacgtttgacaagcatttatacctctcgggatgggctgggtccatgacgaggcacatacacaatggcaagcttggggtttgcaagtcgatcagagaaagggacggttggttaccggcccttttattgtggttaaaatttgcgagaattggatttagaactgcgcccgatttgaagcggtaggaactgcgatgctggcacaggtgactttgccaaatcattgagagtggaacgaaataatttacatttgccagtagattattataattaacgaatcaataataatttggagatggcaatttgactcagtttgaaacggaacggttgatattacgaccaatgacagcggcggatcatgatgcgttagcggacatgatttttgatccgcaggttgtcgcttatttacgttaccgacgggttcagagtccggccgcgttcgagcaactgtttacgacgcactttttggcagacacgaccactgtttttggcattgaacgtcgccgtgatcatcaactgattgggttttatgagtttcatggtagtggtgcgactggtgaattgacgtacgctttaagcccagctgcgtgggggcacggttatgttgcggaagccggcaattgtttgatgcattatgggtttgaaacgctgaactatgagaccatcgaggctcactatgcgagtgccaaccctaattctggccgagtgatggctaagatgggcatgcaagcggctggagaactgcacacgtttaccagtgataaaggtgaagtgatccacgtcatgcggtacttactgaccaaagcaacctggcgccaacttagtgcttgacctgaaacgcgtttcagcagctatactaaaattgttgcgacagcttgcaacacacgcttaagacttatgaccaccattctttcagccagaatggtggttttttagctgtcgttgtccctaagtgagctaaagtcaaggacggccagcttcggttcgctggaaaaggggccgtttaatgtaagtttatatgtccacgaatgtgattgttgttagggtggtttttcgatatagtagacctatgaattgagagggcgtgatcaaatgacggcaacaattacaattcgaccgcttcagcgcgcagaattaacgacgctatggcaactaggttttagtgatccaaatgcggagtggatgcgctggaatggaccgtattttcatgaccaactaccgactcaaacagactttgagacaattattggcccccgtgattggttgattcgaccgcgtaactgggtcatcacacgggatggtgtgattgtcggcagtgttaattggcactttgtggatggttccctcaaacgctggttagaggtaggcatcattatctataatcaggagcattggggtgagcatattgggcgcaccgcgttgactaaatggttgacccacttattccaagaggagacgactttgccgcacattggattgacaacgtggtcggggaatacgcggatgatgcggttagcggaagccgtgggattaaagcaggaggctcggattccacaagttcgttattggcaagggcagtattatgactcggtcaagtatgggattataaggaatgactggcaagtacaaaaagattaaaagaaaacgtttgttccccttgtgaaagtacggtatgatagaaccgtacttaaaaaagacggggtgaaagagaatcatggtgaaattaatgcgacgcgttggcatagcgggtctcttgagtttgagcttactgttgggtggttgtagcttgttaacgtctggtacggatacgacgagttcgacgactagtcagcagtctgaatccagtcgtaatcaaacgaccagtatgactggtaatacgcaacaaacttacaaacaactggcaaaaatgacttatcaatcgggcagtgctgcggccatcaaagttaatagcggtaagagtacgctggcagcgagtcagtggaaaaattctaagattgattacggtaatttagattcattgaatcggacaaccacggacacggcttacttgagcaaggccaatttaggacggtctgaaggacggacggcgcaaacgtggagcccaactggctggcataatcaaccgattaccgttaatggtaagcgggtctatccgcaaaatcgcgggcacttgattgcttacacgttatcctttaacttgacgtctaatgggcagtatcgcgctggtgaagatggtagcttagataacccgaaaaacttggcaactcagacggcctactcgaatcaaaaaacgatgcagatttatgaagatcaggtgcgtacggcgttagaacaaggtaaaaaagtcatttatcgtgtgacgacggttttccgtggcaatgaattgatgcctcgtggttactggtcgcaagcagtctcaaccgatggcagtgtcaatttcaacgtctatatttggaacgttgagcctggcgttagcttcgactatgctactggtcgtgggaaagcggactcggcgatgcaggttgctggggctgataaagtcagcagtagtcagaatacaagtacgagtcgctcgtctcaatcgacgaccactagtaagcaagtcgagcgcgagttggttaagtatggttacaaatatgtgaagaaggcgttgaattaagcggcaagacagtcatctaggtcagcataatgggcacggtcggctgttaaacgtcgttgtttcatacaacaatttaatctaaatgtcctgttttacgacaaaaggttcaaagtaggactagcaaagtttcactgagcgattatactgtagttattcgagttacttaaccgccgttaatttgctgatgtttctgtcattattaacaagtaacgcgatgtcttagatcatggggccttcccaaacacctatgattttccatacaacggctccggctcccaaccggacgttgctatcaatcgttttgattgctagtactaattacccttggagacgtctgactgcgtggtcaggcgtctttttttttgcgtcaaatgcgacaaaaataataatttgtcgcgtttatcgacaaagtggatttaggtgttgcaaacggattaaaaaagctttatcattgatacattcgaacattagaatataagaatataggaggctaatcgcatggtcagtagtgaagaagcactgcaagaatttcgagaaacaattccgatctttgaagtcttagccgatgaacggcgtcaacaaatcatgattgaactttcgcaacacgcgcagggcatgactgttggtgaattaactgaacggatgcatatttcgcaaccggccgtttcgcatcaattgaagacgttaaaggaacgacactttgtcgcagttgaacatcaggggacccgtaactattatcgggtgacgtttgacgcgccactaacgcaagttgagcatttgattcacacgcttaaggcggacttggaattgaaaccgtacttgcactaaactgcatgaacaccagcaatcgttgcacggggatgcagcggtgtttttatggcaactatattcttctattcgaatataagaatttaaaaacggggtgatggtaatttcaattcgtacggagctggatttacagcgggcgatgtaccaattgttggagcaacgttcaatctcacaaattacggttgagcagatctgtaagcaagcatttatacatcgcagtagtttttatcgttattatacggataaatttgatttgctcaggcagatggtgatgcacacgttagatgaactattggctgctgagcgaactgatacggttggttcggcaattatgtcgacgtttatcggggcgcacacgcaagttttacgacatttattagtgacgaacaatgagggtgacaatacccgttctcaacaagtgatcaatgactgttttgtcacggtcgccgagacgggtgcggatgatcgggtttttgcgatgattcgccagtcgcagcatcccgatttgacggcgtacttagtcagtggggtcgtcacaagtattgtccagtggctcaataacggtcatcgtgatggtcaggcgaccagcacgcaggcgatgattcaggggacgcttgcgacggtgttttcacttgagcaacacacagtttaattatttgaaggaaggtttcaggttgtgaaaatgatacgcgacgaatggcggtcaattcgtcatagcaaaatactatggatttcagtttcagtcatgattttgatcccgtttttatacagcatcttcttcttgaagtcggtgtgggatccatacggggatacgcaaaacttaccagtggctgtcgttaatgaagataagtcagtgaactatcaaggcgaaaagtttgcagttggtaagcaagtcgtgacgaatttaaagaaaaataacgatttagattggcactttgtgtcggctaaaaaagccaagcagggattgaaagaccggaaatattacacggtcgtcacgattcctagcaatttctcaaaaaatgctacaacgatgacggataccaatccgaaaaagatgaacttgcattatgagaccaacgaatcgttgaattatattgctaaagtcattaccgatactggtgtttcacgagttaataagagtattcgggcgcaagtcactaaggcctacgcattagcaatcttcaagcagattcggactgccggtaagggctatcaaaaagccgccgatggggccaccaagcttaaagatggtggtgttgaactgcaggatggcttgacgacgtatacgacgggtgttcatacgttgaagaacgggacgactgagctgaatacgaaagtgcagcaattacctgctgggattgctaagcttgctgatggtggtagtgcgttgaagaccggtctggatacgttgaatagtaagaccggggcgttagccagtggtgttagtcagttatcagatggttccgggcaggttactagtgggcttggaacgttgaatggtaagactggtgcgttggctagtggcgtcagtcagttgaaagatggttccagtcaagtcacaactgggctgactacgttgcaaggaaaagtcgtcccaatggtgagtggtgtcagtcaattgacaaacggctcagctcaagtttctaatggtctacaacaacttgactcaaaattaccgacaatgcagattggatcgcagtcgattaccgaaggattgttaacattaggaaataaagccgggacattagctggtgctgttaatttgttgacagatggttcaggcaaggtcacgactggactaaagaatttgaatgacaaaaccgggacaatcagtaatgcaacgggacagttagcagatggatcccaaaaggtcaaagtcggagttgccacatatactgatggtgtttatcagctgacgactggtttaactaaattagatggtcaaactggaaaattgtctagtagtgtttcgcaactttctgatggctcaacagaattggctagcggagttgcagattatacagcgggtgttggtaccgccaatgatggtgccagcctattgaaatcaaatactactaatttgagcagttctgttaacgatttaacaaccggtgcgcaaacagtcaatgccggtgttagcgatttacaaacaaatagtgcgaaaatttctgatggactggatcaattgtcagccgcagtaaatgattcagcgactaagacaaaaatcgaaactttgaagacagaaatggcacaatttgaacaggcattggcagctagtcaaaaagaaattgctgctaacacgaagagtagtaataataacgatgctttaaataccgcgttaaaatccttatcaagtaacgtggatgctttaagtacttccaagtcgccaacgcaagctgatattacgtcacaaatcaatagtaaaatagatggtttaaagtcgtcacagaatttaactgatacccaggttgcggcaattaaggaaagtctaaaagatgttggacaaagcacgacgactactactaatgcgcaacaagttcaaaatttgcagagcagcctatcaaaggtagagtcattagttgcggagaacacctcggcaacaagtaattctaatgctgacttagtaaccgagtacggaaagattgaagctgggatgaataccattatttcagacattagttccacgacttcaggaattagtcaacttgccagtggctcagaacaattaaccactgggctgaagaagctgcaaagtgggactgatggtttaagcaatggattgacagaattaaatatgaaagtccctggattagttagtgggattgagtcgttatcaacaggtacaagtaaattggcttcacagtcagctctgcttaataaaggtgctaataatttgagtactggactcaccacacttaatggcgcggttccagaaattactggcgcaataggccaattgagtaatggtagtcagcaattgaatgctaattcaaatgatctgaaccaaggtaccacacaactggcgactggtgctgcgcaactgaatggtggaattccaacattggtttcaggtgtcgagcagttgtttagtggttcccaaacggtcacgggtggattgaagacagtcaacggcagtgttcccgcaatgattaccggtataaataaattgagtactggttctcaaaccctcactaatggtattaacacagcacaagggggagttagtcaattactagttggttctaacaaaattacgactgggttggtaactatgaatggcaaagtccctgagttagtcagtggtgtccaacagttgcaagttggctctggcaaggtaacaactggtttagttaaccttaatggacaagtgccagttctggctagtggtgttcaacaactctttgccggttcaagtaaggtcacaaatggtttagtaacgttaaacggtcaagtaccagtcctagtaagtggtatccaacaacttgacaccggtgccggtcaattaacgagtggtgtcagtcaattaaatgacggggccacccagcttgacaacaactctgccaaactcctatccgggacaaagcagatcaagaacggtaacaagacactcgcgacttccttacaagaaggtgctgatcaagttaacgcgacaccattaaagaacgcgaatgcgaaaatgatggcggcgccaactaagacgtcctataaagactacacgcacgtgccaaactatggtcatgcgttagcaccttacgtcttgtcactggccttgtatgttggggcaatcgtcttcaacttcgcttatccaattcgacggattgcggatgacgacggcacgccaacacaatggttctggagtaaagttgccgttggtggtcccgtagcacttgcgatggcggtcatcgaagcgacagtgttattagttgctggtttgaaaccaatcagtgtacctgaatactacttgacggcaatcatgattgccttagcgtcaatgttcctagtcatgttcttatcgatgctattcgataacccaggacggttcgtcgcaatggttatcttgatgctacaacttggtggttctggtgggaccttcccgatggaaattaccaacaagttcttcaacgttattcacccatacttgccattaacgtactcgattcaagcgttccggcaagccttaactggtggttggggtagtggtattttctggtcatcaatcgttgtcttagcaggaattacgattgtgtcgctgggattactgtgggcttccatggtcttcctcaagcaacacgatatgcaagttccagccgaggctgaaattcagatgaaagctggtaagtaattactggtaatcatattatcgcgcttccaagacgaaaaaccgcgtcttgggggcgcggtttttttctcgaaaagggttaaattttaattttactgataccataattcgaagacattacttttttctacgagtgagcgcaactaatgaataactaggcacatctaatcgcgtaccaggccaattgtgcggcgataaacccgactccgatgctatctccaaggtatctgattagtaatttagccgctgccttccacgcctttctttggattaatccttgaatgcctccgcgtaataatgcttggaaagtttggtagccaatcatgtccaataattgatttttcatacaggaccaaaaacttctagtttgaatacttatttagcttgccttggttgaattgcaaatttcgcttgtattcatatttcattatctcgttgatatgctgcaattggttctggttattggaaccgtattttgatactaaagcgttcacatctaagtttgttgctaatccagtctggggatcataccgaatgctatttgatacatctgctaattcttgagcgatacaatctatggcttgttgtgacgatgacgtcgtattggcagaaattttcaaagttatggtagtagatattaggatactgctcaataaaataatgatcaaagtaaatttgtgaatgttagcttgactggtataattcattggacttcctccttattccggtagtgtacatttttgaattgcgtatgtataataagacaaaacgaaaccggtttcaatagatgggagtaggatatgatggctgtttttaaatcaagtttcaaacaaagcatgattgtttttggaatatcagttatttatttttttgttttacatggtggatatgatcttctcacacaatacaaatattggtttacagaatactgtgctaatgttttgggtatttccattatttattttgtaatgtcactagttttcaattatagcatcataatatggaaactctattttagaaagcattgagatagtaatctgcttaatagtgtgtttactgacgctagagtacgcaaaaaggcccaggtcaaagaaaacctgagccttttcgatgtagatttaaagcatttaaataattaatctccaaaaatgcagcaatcaatccactttcaatacactttgacgttatggtgattcattcaccaatgctagaaatattgatctgagcgatatgtaatcgttcttgaataatcatatcagtaatttagtagaattatcttgggacatattggacacatgctttcaattggttgtgatcagcttggttgcagcatggcgcaatatgtccttttatcatacataaaaatggtgtcgatggataaaattcatcaatattttaaagctaaatatctgaaaaaatagatgacatatgattatcctatgctatcatataaggacaaagtataataccggtaaaaattggggaacgtattatgaaaaggggtagtttaactgtgttacgtgcactatcgttatcggctgtagggctgattgtgtcaatttttttccatgttgtaaatgccaactcgagtacttttacagagcaaagcgttacaactgaacaaaacgtgatttatgacaaagatggcaatcaggttccgctatttgatgcatcatctcaagaaccagttatcgaagaccggggcccgaaacaaccaacagccgtcaagcgattgggtaaagggcaatcttgccaagtaaataaattttctggttcaagaatacgctatggcagatatatgggtggtgtaactggaaacgctaagaacgttagcttttcagaaaaaaagggtgcttttacagggtacattactgatcgtcctgatctaagcactgtggcacagtattttacagcaactccaagtggcggtccttaccacgccgccttccatggtcttctttactttgaggctgacaatccagtacctggtccaaactattttatgcaagttcactaaaaccgtaataatttgcccgcaacggtataaagccgactatgcagtcagctttatgtatttatccaatacgcgttgtgctagttactttgtcatgaaacaattatgacagctgactttttccggttgttatctgaaagtattaaaatcggtgctaatgtcttgccagtggctaagcctaagtttgacgatttgctgaatgactagaataacctatctagaaaataatagtcgattgctgcattcggagttgttcaggtgttaaaaaggtaactgccaaaacgaaaatgttgtgcggttggtattagtgaagttaggcgttagttggtaaatggttttttatatggtacaagaaaggctcgggtacgctaacccgggcctttttggtatagtttcaaagtattaaagaattaatctctaaaaatgcagcaatcaatccacttgcaagactaacgttgctaccagtcaatcctagttttgccctgcttcaagtcgtttaacatgcaaaacactaaccaaaatggcgatcgccaacacgaataatagcaagaaatccaacttgctccccataatcgttccagttacggtggaatgatgaatttcatagccggcaattacagcggacataatactggtcccgattgaaccggcgtattgttgcatcatactgaacatcgagttttgatcggatttttgaggcagagggacgcgggtgctaccatccgaaatcgcagtcccaaaaccagtattaaagccgacgcgtagtagcgcgtaaatgacagccatgatgatgactgtgaaataatcggttgtcagccagaataatagtaaggcggcgctcgccatgatggcactaaatgttaataaggtcgttgggccttgtttatcgtaaattcgaccggcgattggcccagtgatggcgccgacgattgcgccgggaagcatcatgagccccgccgtcatggccgaagccccaaggacggtttgggcgaaaagtggcaggacgaacgataacccgatattaatgaattgtaaaccaaagtaattaaatagccgaagtcgcaagattggcaatttgagaattgaataatcaatcagttggcgacgccccttgatggcgtacgtcaccattgcaccaatcatcacgatgctccacagacaccagaggccgaagttcggcgacagccagccgtgagttcccgcgttgttaaacgtgaacaacagactagtgaaggtgatggctaaaaggattgcgcccagatagtcgaattttttatcgccaacacctaaggccttccccgaaatgttgaacgcccctaagattgccagtaatgccaataacggtacgataccaacgaaaattgcccgccatgaccagacgctagttaaaatcccgccataagttggtccgagagccggggctagagacacgatgacactagctaaaccggtataagttcctagttgattgcgagggacgtaagtgaaaatcaactggaacatcagtggaatcgaaatcccagtggctacggcctgtaaaaggcggccagttaataatacggagaaattcggcgctaaccaacaaagaatgcccccaagcagacacacgagggcggcaaataagaataagggcttggggttaaaccgctttagaacataggccgtggtactcatgacaatggttgtcagtaataggtaaccggtcgtcagccactggacggtatctagtgaaacccccattgttttaatcagcgtggggaacgtcacattcatcgatgtttccacgagaatcccgacaaatgagagtaaaccaacggataagattgccagtttggtttttaaagtgacggtacttggttgggacacaatcaacactccttataaaaataattggcgtattttggacagctcaccaagcccaatagtcggtggtaaaaatcagtaatctgaatttttacgattgaaagggacgatcgtaatgaccgtcccactaacgtccccagtttaagcttattttcaatctggtgcaatcactttgcattagggatggaacttatcattaaggggtttgcgcgaggtatggtattataaaaagttgtctaattaaattttaattaaattattggaggtgcgctgtgagtatatttttgaaattaggctggtattttcggcgtgaatggaagttgtacctcgcgggggtgcttggactagttttgactgccattatcggcattgtgccgccccggattattggggacatcgttgatgggattaatcagcacagcttgacggcgcacacgctgacggtctatttagttattattggtgtggccgccgttggtcagtacctggcgcgttatttatggcggaatgccatctggggtggtgcagccggccttgaacgaacgctgcgggaacgactcttttggcattttatgaagatggatgcgacgttttatcagcaataccgtaccggggacttgatggctcatgcgaccaatgatctcacggcggttgaacgggtcgctggtggtggcattctccaatttgcggattccattattactggtgggacaacgctgattgcgatgatgacactaatcgactggcgactgacgctgattgcggtggtacctttcccattattagcggtcgtgtcacggtatttgggtaaaaaaattcacgtcgcgtttcgtgcctcccaagccgccttttcgcgactgaataataaggcgcaggagagtatcagtggaatcaaagtgatcaaagcgctaggtcaggaaaaggccgatgttgctgattttaatcaacagattgatcagacgattaagatcaatcggcatgtcaacgtactcgactcgctatttgatcccgcgattaccatgattattgcgttatcttacggcgccacaattattttgggcgggttgtacgtgacccacggtgtcatcacaatcggtaacttggtctcgttcgtcacttatttgggaatgatggtctggccgatgtttgcggtcgggatgttattcaacacgatggaacggggaaacgcctcgtatgatcgggtcatggaattattgaatcagcaaagtgccattattgatgccaaacggggcattgaacagcgctcgcatggtgatattcagtatcaaatcaagcagttcaattatcccgacgatgcaggaaccagtctgagtaacgtggactttactttgaaggcgggacagacgctcggaattgtcggacgggttggtgctggtaaatcaacgattatgaaactgattttgcgtgaatttgatcagtacgagggccacattacttatggtggtcacgatattaagcagtatgcgcttgatagttacttaccagcccttggttatgtgccccaagatagttttctgttctcgaatacgattcgcgaaaatattcgttttgccgatccgactgtgagtcaagccgttgtggaagcggtcgccgccaagagtgatttgagtggtcagattgccagcatgcccgctggttacgatacccaagttggtgaggaaggtatctcgctatctggagggcaacgccaacgactagccattgcgcgggccttactcatcaatcctgaattgctgatcttagatgatgcgttatccgcggttgatgccgaaactgaggcagaaattttagctaatctaaaggcagaacgagcagacaaaacgacgattatcgcggcccaccggttaagttcggtgatgaacgctgatgaaatcattgtgttggatgccggtcacgttgttgaacgagggacccacgcgcaattaatgacgcaacacgggtggtatcagaagatgtttacgcgccaacaattggagaccaaagtggaaggagcggtgcaataatggcagcacgtcaatcggtatgggcacgttccatgcctgttaaggaacaactcacggttattcggcgactattgccgtatgcgaaaccgttcaaatggttttttattgcggccatcgttttttccggtctgattagtgtggttaatatctatctaccgcgtgtattacagacctttattgatcattatctcaaaacaggacacgccacggtaccggtcatgtggtactttgcgggcctctatttcttcggcatggttgtgcgcgcgttgatgcagttcgtacagaacttcagtagtacgatgggggcagaatatatgcttgaaaatgtccgtcgacaaatgttcgccaagttgcatcggatgggcatgcgctactttgatcaagtccctggtggctcaattttgtcacgcctgactaacgatacgatgtcgttttccaatttttgggcgttgtttaatacactatttaccgccttttttgcggtgatttcgtcgtttgtcgcgatgtatctcaccgatgcgcagattgccttgtggttattggttttcatgccttttttggctgtaacgatttggtattatcaacggtatagctcacgggtttaccggcgaatgcgggaacggctcagtgagttgaataccaagttgagtgaagcaattactggaattagtgttattcagcaatttcgacaagaacaccgtatcaatggtgaatttgatcataccaatgatgcctattttaagacccgccaagcgatgatccggacgaactcattattattaagtccactgatcgacttgttttatgcgttagggacggtcatggttctgggaatcttcggggttcgtggactcaatggttatgtggctgccggggtcgtttatgcgttcatcacgtacctgaataacttctataatccgatgacgtcgatgatggataatttgtcagactttcaagatggcgtcgtcgccggatcacgggttttacgggtcatggatgatccaacgattgccccggcccaacacgccgatcctacggctaagattacgcgcggtaagattgaatttcggcacgtcacctttgcctatgacggccagcatccggtcttaaaagacgtttcattcgtggctgaaccaggccaaacggtggcactagttggtcagacggggagtggaaaaacgtcgacgattaatgttttgatgcggttttatgagtttcagtcaggagaagttttaattgatgatcgcgacattcgtgagtatccggctgaggaattgcgacagaagatggggttggtcttgcaagaaccgtttatgttttatggtgatattaattccaacatccgaatgtttaacgatcagatttcagatgaacaagttcaagcagcggcacggtttgtaaaggccgatgacttcatcaacgatttacctgagaattatcagtcacgcgtcattgagcgcggggccagttattcttcaggacagcggcaattgatttcatttgcgcggacgattgtgactgaccctaagattttaatcttggacgaagccacggcgaacgtcgatactgagaccgaagagatgattcagactggtttggatcggattcaggagaaccgcacgacgattgcgattgcccaccgcttgtccacgattcaaaatgctgatttgatcctggtcttaaatcaggggcaaatcgttgaacgcgggtccaacgatgagctattgcaacagcatggttactactatgatatgattcagttgcaaaattccgctcacgtcgattaaagtgtggtatgctcgatttaaattaattgaggtgatgccgaatgcgtcgaaaattatcgttaatggtcgtgatgactgttattagtacgctggttaaagtgggctggcaattaatcttagcgcgccatcaagcgcctaaaaagttaaaaattaaagtaaaactgaaataaacattgtcgtcgtgtcggtagcgatgcttacggcgattcaatcagttgtcatgaccgaccgttctggaaaaggtgtaacttctagaatggtcggttttgtgttgaaaaattgagttggcggaggtggtcgcggtgagttgtggtggtgcccacaaaaccggtttatcagtggttcgtccttaaaatcggtcggtgacactcactgcaggatgtggcctggtatgcttgcaatcgtgctgttcatttttggcccaacacctggagtacggtgccacgcttggatgtcgccaggcacattgaaaataatgattggtgactaataacggtcattaattcctaaaacgactggatgacggataactatacggaatggttataattgattatttgaactaggtattttactctgccaacggatcgcgttttaataaagatggtaatgagttaacgaagggagttgtgatgcaatgcaatatcgacaattaggaacatccgatttaaaagtctcgtcgatcgcacttgggtgcatgggttttggtgcggggactggaacggcgcttaatcagcgctcgtgggcggttggtcaaacgcaggcgaaccaggtacttgatcgcgcgatatcactggggattaacttttttgatacggcgccggtctatcaagcgggtgcgagtgaacgtgtcttgggacaaggactaaagaaatttcagcgagatcaattggtactggcaaccaagtttacgaatcggacaacccaagaaatcgaaaatcatgtcagtgggcgtgaacatgtcttgcggtcccttgaccagagtctacagaatttacagacagactatgttgatttatatatttatcatatctgggactggttaacaccaatggctgaaatcatggctgggcttaatgaagctgttcaggccggtaaggttcgttacattgggatttctaacgcctattcctggcagattgcgcagatcaatgcgctagcggttcgttatggttatccacaatttgtctcgatccagagtcattataatttggtctatcgcgaggatgaacgggaactgttcagttatgctcatgagaacgatttggcaacgacgccgtatagtccattagctagtggccggttggcacatccttttggcacccagactactcggcgacaacaggatacgtttgctgataccaaataccaagctaccagcgagatggatcaaccaattattgatcgcgttgaggaactggcccaccaacatcatgtttcaatggcggccattaatttggcctggctacaacaacgagtaacggcgccgattattggggcaactaagccgcatcatttagatgcagtggctgaggcagcggggttggcgttaactgcttcggaaatacagtacttggaaaccccttaccaaccccatgacttggagggcgtgatggcacttaaccggtcacgaactaataattggaatcagtattccggacagtaagcgaacaagttagttgacttaacgtgcagttgaagtaatacactgatcctatcgtgcgactaaaggtccacgtttcagtataaaggagttattgagattaaattgaaaacaatcacacaacagtatttaacgggcgagcgggcactctttaaagctcacgaccttgaaatcgacaatacaacgtttgctgatggtgaatcaccactgaaggaaagtcgcgatgtcacgttgaaacagccaatctttaagtggaaatatcccttgtggtacagtcaacatgtgactgtggatcaaggtttgtttgagacaatgtctcgctctggcatctggtacaccaaggatattacgattacgaatagtacgctacaggcacctaagctatttcggcgggccagccaagttaagttagcgcacgttcacttttcagatgcggaagaaacgttatggaactgccaagatattacgttgaatgatgttcaagcagctggtgattattttggaatgaatagccagaatattcgcattgatggcttcaacctcgtcggtaattacgcctttgacggtgctaagaacgttgaaattcatcatgcaacgctgatgaccaaggatgcgctatggaattgtgaaaatgttaccgtttatgattcacaaatcattggtgaatacctgggctggaattcgaagaatattcggttcgtcaactgtacgattgagagcgatcagggcctgtgttacatggataatgttaagttggaaaactgtacgttactcaatacggacttagcttttgaatattgtcgtaacattgacgctgacgtggtttcaacgattgatagcgttaaaaatccgcttagtggtcggattcatgcgcaagccattggtgaaatcatcatggatgatcctgaagtagatcctcatcagaccctgattagtgttgaccatgaaagccgtgcgccccatgccgtttgattttgagaccgtacttaatcggcggcacacgaatgccgttaagtgggacgtcgcggataatgaattgccgatgtgggtcgctgacatggactttgaaacggcaccagttatcaagcaagcgttgataaaacgcgcccagtttggcgtcttcggttacgaagaagtccccacggcttactatgaagccgtggcagactggtgggcaacggaacacaacttccgtccgcaaattgagtggttgatgttctgcaccggcgtcgttccggcgatttcatcaattgttcgtaaaatgacagcgaccggcgataacgtgttagttcaggctccggtttataatatcttctatcattcaattgaaaacaatggccggcataccttgagtagtgacttagtggcacgtggcgcgtcgtacgcgattgattgggacgatttgacgacgaaactagccgatccgttgaccacgatgatgattttgtgcaatccgcagaatccaatcggcatcgtctggtcacgtgcgacgttgcaacgccttggcgagctgtgcttgaaataccatgtgctagtcgttgccgatgagattcattgtgacttgacccttaacggtcacacgtacaccccattttcatcattgactgcgccagtagcacataacagtatcagctgtatctcgccaagcaaaactttcaacgtggcagccttacacgcggcaacgttgattattcccgatgcacacgtccgcgcattagtgagccggggcatcaacaatgatgaattggctgaacccaattcgtttgcgattccagccagcattgcggcctatactgaaggccatgactgggtagccgcattgcgaaccaaactagctgccaatcaacgtcaagttcagacttacttgactgctgagttgccgcaagtcaagttggtggaagcccaagcgacttatctattatggttggatgtgcgtcaagtgacaaccgacagtgcggctttggctgcttttattcgccaacgaaccgggttgtttttatcagcgggagatgtttaccgtggtgatggcaaccgcttcttgcgactgaatgtggcttgtccaacgactaccctgacggatggattggcacgattaaaagctggtattacggcttaccaacaagttcaagcatagttgacgcgtatggggtgcaattccataatgatttcgctaccattaagataagctggtttggtctagatgaccgctgacagtccgtgataacggaccagataagtcggttaattcaaaccattattaaaagatgaggtggaggatagttatgaaaattggaattattggtgccggtacggtcggcacagtattagccaagacctttgcgcgcggtgatcatcaaatcaaattaagtcggcacagtggtgcggctagtttagcaacacggcgcgccgagtttgctgccaatgtggcttttgtagaagttgctgaagccttacaacagccgttagtcattcttgcagtgccgtttgaacaggcgccggcagtattagcgcaggtcgccgattataagcaacggatcgtggtggacgtgacgaaccagtttacggctgactttaagaaaattaagacggccccgttgactggaagtgaagtcattgctcgtgcagctaacaatgcccgggtcattaaagccttcaatacgattccaccggagtttatggatgggcacgttgatgggcctggaaagcgggtcttgttctatgcgggcgatgacgttgctgctaagaaagaattcgctgcgctcgtccggccgttgaatttccgccccgttaacttgggcaagcttcggcatggcggcagtgtcatgcaagttggcggtggactaggtaacacacactttgttcagattgaagaatagtggattgtaaaaaggggttcacttttgaaccaaaatagctagtgctgaccttgtaagaaaaggtgtggctagtgtcactttgattgggccgtgcggtgagtatcaattgacaggtgttcctgccaatcgtcgccgcgtggttaaatttgaatcgtattatgggtcatgaagcctgattcttactgtgtcgtaactgtaagaatggggctgcatggctttttttaattgaggttaattattgtttatacggtttgatgaggacaatggtattgatacgagtctagtcaattaactccgcccacttagctacggaaatatccgataggcacaataagaggaacgtgaaaattcttatgtctttacgctattttggttaaataaaagtgtgaacattacctgctttatatcgtatgagatgcagtgtgcccattcaataggctttgcagattatgttaatgaatttcgactatacgcacaatacatattattatatttagccacgggtgttcttagttcccagctatctatatactagatcaagcaatgatactttcaactattatcgaaatttattggaataatgcaggttttccacttacagcgcctgaatttaatctccgctgtcaaagcaggtgcatgggcaataacccttgtctgacctgatgaatcataatagtgttattcttcaggcgtataatcatttattttctaataccaaaagcgttgtgcttcatttcaatgagaaatctagacacaacgttttttattaaatactgctatctaagctaagatacttaggtgacttcagaaaggactttctaaattaatgtcttcatattcgaatgagctgctcatgctgatttctcgatcgatgctattcaaacaagttatcatacttttcgcttatggttgcttgtactatttggtaactcattttatagataaaagaattcagcataaaaaaaatttcttattgaaattaagcctagttaaactcaaaaaaagaaataagacaaggtgggaaaaaatacgattgataatgcaactgttcttactggcatcgataccggtcttagtctttagtgaactcgtgctaaatactgattaccagtacatgcttttggtttcttctattatgaagtgtgttggtttcatttcttttgtaattgcgtttgtggatagtttgggtccaataaaggagatgcagcagttgattgctggcgcacaaagcagtgatactttagacagtgataaaaaggcgctagcggtgacgagctttaaaaaaattagatggatgctgatattatatcaggtattaaaagtacccttgcttgtaattttttgagcttaagtgttgattaccggcgcgacggcttcttttcataaaaatttgaatataactcatttttaatcccgttcctttagctattcttctcgcacgttaattgatagcaagcgtcaagtcgattaaatctgaaaatcttatcacctgagaagaaagggcacgttttgacagattacccagatgaactgctattagtattgtttcacggccaaatcttgaattaagcaacgacaactgttttatatgaattacttttcttgctgattcgtcaaatggtctttttgttgattggaaatcaaggtaagcagattattgagttaaaagccgtcgatacaactactccgcataatacctaatatgttacctaatatgttaaatagttcagtttttaagatacgttaggcctgcgcgcagagtttgctgattatttttgcgtttaagctgttaataacagtttttgcagttgcttaaagttatccacagtgtaagttggggcaattgttgtgtcgttatgcacatgctgtggattgtaccagatactaggtaaatgggcggtggccgctcccgcgatgtctgaacgcaggctatcaccaatcatgacggtattcgtggcattcatgtctgggtattggtcatgaatagcgctgaaaaagtgtgggttcggcttggcataaccgatactttcagagatgaagatatgatcaaaatagggcgtcatatgggcacctgccaagcgactgagctgggtgtgtttgataccgttagtgccgacgagtaaggtcagcccagcgttggtcagcgtgcgcaaaagttcgtgggcgccgggaattacctgataactgtgcgctaataattggtcgtattcttgttgaaccgcaggaccgtcaacggtgatgcccagtgtgcctagaaagacttgaaatcgttggtctaacaagctatcacgatcggcaccttgttcgatttgttgccaaacagtttcgttataggcctgatactcattttctgcacggcgaatatcagtgatgccatgatgctgaaagacggctgcgaggttagccgcttcagcgcggtcaaagtcaaggatggtattatcgagatcaaaaattgcgtattgcatggaaccactactttcaataggtttatttaaaccatcatacagcaattttgaatggtgtggtatgcttaaagtatcatacttaaaaggaagttaaacatggaaatcgataatgacccagcgtatcaacaaatgattaatggtgaattgtacttagaatcaccaatcctacagcaacgtcggcgagacgtgcggacgaagttaatgcaatataatcagattgctgacaatgatgaccggaatactaagatgaaaagcctcctacgttcagccggtgaccggttcttcgttgaaccgacctttgaattcagttatggcgtcaacatccgtatcggcaatcatttttatgcgaaccatggggtcacgttatgtgatgaaggactcattacgatcggtaatgattgcaaattcggtcctaaagttggcttgtacacgcctgctcatccattagatccaactgtgcggcggactgaagcggaacggactgcaccgattacgattggtaatgatgtttggattggtggtagtgccgtgatcttacccggagtgacgttgggcaataacgtgattgtgggtgccggggctgtcgtaacgcattcgtttccagataacgtcattgtagtcggtaatccggcgcgtgtcttgaaacaaaatgcaccgcagtcataattgacaattatgctcaaattgatgaaaataagggtgtagtcagattatcagagaatggggagtggagccatatgtcagagatgagtcctaaggaatttaagcacatcttagtcggcgttgatgattcggatgacgcgcagttagcgtttcggtatgccattaaccgggccaagagtgacggtgctaagttaaccatcgtttcaattttggaacaggataatatgaacgtgtatgaagcaatgagcaaagattttgttcatggccaacgcaaggatttggaagaacacgtccagcagtatcagaagttggcccgtgacttcggggtgacggatgttaacgcggtcgttgatgaaggtgaccctggtgaaaccatcgtgaagacggtgattccagcgttgaagcctgacttactagtcattggctcagttgccaagcatggtgttcgtaaatacttcggttcgcaagccgcatatatggcaaaacatgcaccgatttcagtactggtgattcggtagtgataagatgaattttgattgatcaggccttccggttatggagggctttttttgttgtgtcttgagtatcattttccggcgatggtgttgatgatgaataatagtggttgtgtcttgaataccgttgttatcaaagcagtgttcatttgagcaaatcagatgtttgctagcttctatgacttcgtggtaaagtgaccgtgacatgtcgttgggattaactgaaaattaagttgtgatggaaaggtgtgctgatagatggaagtgagtattcgtaagattggcaatgctcagggaatcatttttcccaatgaactgagccttgaagtaggggcacgttatagaattgagcaaagtggtccggcactgattatgacaccaatcaattcggaactttttgctaatccagatgattgggtgggttttcgtgacagtatctcccaagcagaccgtgaatgggaccagttagctgactcctaaaatggttagtgacaggcaattatagtgttagttacttaaagcgcatcagttttttgatggtactagtattctgatgatgttaaataggattgttcagtagggcgctgggcaatccttttttattgaagcgactctttttgagggattgttttaacaaagagtaaaggaggttaagtataacggataaaaaatagtcattgcaccacacgttagtggcgacagtacaaagaggacggcggcttacatttgatttttacaaaaaacaattagagatacaattaatatcagaaaaccaggtctagcggtggccgatttcctgatattgcttttcataagtaaaacttatcaatgtgggctgaatttgaaattggtctaaaagacgtttgcttgtaagatatgacttgtaagttaaggtgaatcaaaacaagtaaagaggtcaatgaatatgaataacgaagtaattgtgcttttcggtgccggctcaattggtgaagcaattgttcgacgtgttgctgccggtagaaatttattgttggcagactataatgaagcaaaattagttgaaatgaaacaacacttgacggaagctggatttaacgttaagaccatccaagcggatctttcatcacgggaatctattaagacagtggttgctaaggcacaatcgcttggtaagattatgggattggtcaacgcggctggcgtttcaccatcccaagcgagcccagagcaagtgctcaaagtggacctttacgggactgccgttttgttagaagaatttggtcaagtcatggctcccggtagtgcgggaatcgtcatttcgtcccaatcaggacaccgattacccgccttatcacaagcagataatcaagccttggctatgacaccgactgaagaattattggatttaccaattttacaaccggacgtgatcaaggattcattggcggcttatcaatatgcgaaacgaaccaatgttttacgggtcgctgccgaatcggttaagtggcaagctcgcagtgcacggatcaacacgatcagccccggtattatcatgacaccattagccgttgacgaattgaacgggccgcgtggtgcgggttacaaaaagatgttcgagtcaatggttacgaagcgtccaggaacacccgatgaaattgccaatttggcggaactcttaatggatcgccgtggtgcctttatcacagggagtgatttcttggttgatggcggaattaccgcacaatattggtatggtaatgtttcagaagttcgtaacaatggcgtccagaaatagaattttaaggagagtttattatgaaagcagcaacttttattgaaccaggaaaagtcgaagttaaagaatacgacaaaccaactattcaaaagccaaccgatgcaattattcgggtgctccgggcctgtgtatgtgggtcggatttgtggtggttccgcgggatttcacaacgccaagcaggttcaaccgttggtcatgaagcaattggaattgttgaatctgttggttcagccgttaaagatgtacaagcaggcgatttcgtgattgcgccgttcacccatggttgtgggcactgtgccgcttgcttagccggttttgatggggattgcttaaaccaagaagctggcggtaacggtggctatcaaggtgaatacttacgctttaccaatgcaaactgggcgttagttaagattcctgggcaacccgaagattattctgacgacatgctgaacaactttttagccttagctgacgtgatggcaacgggtttccacgccgcaactagcgcagaagtcaaaaaggatgataccgttgttgtgatgggtgatggtgccgttggtttgagcggggtgctttccgcaaaattgcttggcgctaagcggatcatcgcaatgagtcgccatgaagatcggcaaaagttagcaaaagcatttggcgccacggacattatcgctgaacgtggtgatgaagcagttgccaaagtgatggctttgaccgaaactggggctgacgcggtacttgaatgtgtaggtactgaacaatccgttgacacagcagtcaaagtcggccgtcctggtgcggttgttggtcgcgttggggtcccacaaaaggctgaaatgaataccaataatcttttttggaagaacattggcttacgtggtgggattgctgctgtaacgacggatgacaagcaagttttgttagatgctgttttgacggggaaaattcagcccggccaagtctttacgaaacggtttatgttagatgatattcaagctgcgtacgaagcaatggaccaacggacggcgattaagtcattggtcattgtcagtgataaataggaggaaaatatgaagaaagttttaattattggtgcaacggggactattggcggtgtagttcgacaaacgcttttgaatgaaaccgataatcagttaacgttgtttgctagaagtgccaatcgattaaagactagtgagcgtgaaagtgttatcgctggcgatgttactaaagatagtgacttagacaaggcgattgcaggacaagacgttgtttttgttgccttgagtggttctttaggtcgctttgcccaaaaaattgttgcggcaatggaccggaataaggtttcacgattgctgtttattacttcaatgggtatttatgatgaaattcccgcttcggttggtgctagtggaaatttaagtagtaatccaatgctacgcacttatcgggaagccgccgatgttgttgaagcttctgatttgaactacaccctgattcgtccgggctggtttactggtggtcctgttgattatgaaatcacgaaaaaaggcgaaccatttggtgggcatgatgtctcaatcaattcaattgcggattttgtcaagaatgcgattgtcgataatgattattatgcacatgatagtgttggactaaatgcaaaataatattcaaaaggtcattggctagattgctagtggcttttttcgtttataagcatggtagggaatcggttcaggttctgctgcaaaacatttctcaaattgttgattaaggttatactaattaaaataatatgacaaatttgaacattcaaagataattttgtaaaggttgaggtgccattaatgtttcaacagatgcagtattttatcgcaatcgttaataatcatagttttactcaagcggccgtggactgccacatttcgcagtcagcgatttctcagcaaatgaaggagctagaaagtcaacttggtgtgaagttattgaatcggaaaggacgcagctttgaagttactgaagcgggtcaatacttttatagtcatagtcaggatattttggtggatgtggaccaacttataaagaaaaccatcaaaattgaaaagaatgatgaggtcgagttgcgggttggctatttaagaagttttgggactgccgagtttttacaaactgtttcgaagtttactcaggagtttcctaaagtgaaaatcaaaattagtagtggcacgcacgaagaactctatgaattattacagacaggaaaaattgatttgaatttttctgatcaacggcgggccttatccaatgaatatcaaaatgaatttttgaccgctagtgagtttatggttgccgttaacaattcgttgccagttgaggcacaaaaaatcgacgttgctgacttagtggatattccttgtattttgatcattgatggcaatcagcaagtctcagaaaaggagtactatcgcaatgttttaggtgtcaaaagtgagtttgtgattgctaaaagctatgacgaggcacaaatgttgatcgcgtctaatcaggggtatttgatcatcaatcagcggatgagaacacaattagataaagatattgttaaaatgatttccttggttaaaggggaccgaaaattgatcccaaattgcaagaacaaatt

SEQ ID NO: 20 - DNA, 46569 bp, Lactobacillus plantarum
taattttacaatctaccaaatctttagataataatatagcttgtggtgcaatggctgcattctcttttattattttgagcattaagttaggccagaaccatgaattgatttttctaattcatggtgttacttttgctttgctgacgggcctaggagttagtaaatgttttgatttttttagagtcgaagtcaataaggacgataatgattatcaaaacgctttaattgcgacattgacaaacatcaagcctattctctgtatcattttttgtgttttaattttaaaaatattaaattttgaaattgattcaaatggaataaacgctcatctgcatagcataattcaaacagccctaaccgataatcactacagtttgataccagtgttactaatactttttctaagaagtattagtaaatttatggggattaatgcggattttctttttagttttagtacccgagcgcaattggtaaatttaaatcgtgctttgaaatttgcacatcctgttgctgctgttcatccaactgcttactcgacgttatattcttgttttgcccatttgggtggcgatggcatgttactcgcattgataattgtcgtgctcatcataggaaaaaatcaacatttgaaaaggttattgacttggtcgttcataccgacgttttttaacttctcagagccagtgatggttggctttccaatcatgtatatgcctatttatctaattccttttataatgagtcctttagtaacgacagtcattgcttatccgtttttaaagtacaatattgtcccagcgcctgtttatccagtgcctaatggtacgccaggactgttgaaagcttttattgccactgggggcaacattccgaccctactattagcacttctttgcttagttgtctcttgttttatatatttaccgtttgttaaagcagagatgagactaattaatctagagcatgcgaaaattagatcttcttttaaaagataaattttgaatttgtgagtctagaggataatagacggagtgattaacttgcgaatctcaaaaaaaattattatttcaataggcctattatgcttccttatgacgttaatttttttgtccgataaatggactaaacagaatatttcaaatttgaagattcaacgaaactcagttactgaacccatagttttggttccaggaagtaatgcgacacaatatagatttgatccgcttataagagacattaataaaagggaaaaaacacctcattctttgttaagagtgttagtgcataagaattatacaatttcctatagtggtgcaataaaaaaaggtgaaagacaaccctttattgttattgcttttgaagataataaagatggttttaaaaatataaagaaacaagctatctggttaaaatacgccttaaaatatatatcacaacaatatgaatttcgaaagatttcattaattggccattcgaatggtgggctgattatcacgtatgcacttgaacataatttgactagccattatctaactgtacaaaaggttatgactattgctgcaccgtacaatttgaacgattcttctgttagaagtgagactgagttgttagaaaacttgattgcaaacagaaaatatattccaaactcaattgatatgtattctttagctggcactcaaagttatagcaatgacggcttagttccgttgtacagcgtattggcgggtcgctatatttaccaaaagcaagttaagcattatacgcaaataactgtttcgggtgttggagcggaacattcggacttaccacagaaccaacaaataataatggccattgaacaatatattgaaaagtagaaattttttctgctttttcctttaattacttatcctaatttatattctgaaatagttcggatattatctgttttatgttattttaaaaaaagtacaagtgcagttctagtcaataattcatatcttgcaagaaggtaagcagatgaataagcataacttctcaaataaacgtagctatgcaaaagcttacagacagtgcatgcgggaagatattctaggtcaatatgcggtagctacgttttggtatctgtattaaaagaaaataccatgatgtgtgatacgtgcgatacacgttttacatggatccttttgaacgagaaagaatgattgttgttcctaatactttcaaagaaattgacagaagggtgacttttgcagacccgttaaaattttcagaccatactaaaggggcacagatggacactgaagggtatggtatttaaagaagtgaattggaaaaattgaggggattgaatttatagactgtcattttagaatgaggcgcatggctacagttgctggcagcaaaactgtcaaattggtttcgggctgtattaaaagaataccgttaaccagttctactaagaaatttacaggacacatggtggagcctacaggagtggttgaagtggtcatgaattagctggtgcccacaaatatagggctcaacaaacctgacaaaactgtcaaatttcgcgtgttaacgtgagcaacagacataagaaggtctgatttgccttgagcacgtcggcagcattcggtggaattaactcatcacttatgctggggctagcataaaaagagtagcgttcatcttcttgatttgaacgctactctattattttaaatgccgaactgtttaaaccaaagagggtaaataatgaatttgaatatttatgatctactactatattgatatctttttctacttttgacatcgattgaaagtgcgaagtttaaaaaaattatatatccaggcgacgtaatcaggattagcgtttttaatttaaaaaaattgggtagattctttttagcagagtgtgaaattaagaaagataatcaaatctgttccagaatcaaacttagttgtaccaataaacaatagttgttttgtattaatttttggattgaaagagtgatgtaattaaacttgtatcaagatcagaaatagatatgctttgagtatttaagacacgccataaaccaccagcacaaaaattaaaaaaattgaattgctgggttgaagtgagatgttgccaatcagaattttcggttaagttgacaatgtccaacagtttgagtgcagttaaccgatgtaatgtgtatgagaaaaagtcggaattttgtaaaacttgtaatcgatttttgttgccaagccaaaatttgaaaagagcgtcgataaaatcatttaaacaaagtattggtgtttctttcaatatttcgataaagtcatttgcagaattatccaaaaagccctcaatgactttttgtgtggatgaataatgacgataaaaagtttttctagatactcctgactttaagcaaagttctgtgacagtaatactttcaagtgcttgtccagtctcaattaaatcaaatagctgttttaccaatttagcatcagttagttgatattgttcttgtggcatttgctttatctcctttcatctttcatcaaaatctttttggaaagataaattatcatttattgaattaaatagtggcaaatcagggatatgctggacacaccacctgatttaaccactattcatgttttaaattcgtcttttctgggttcaggaggtttaaagaagccgtacgtcttatgctaagctgtctttttttcgtttcttaatgagggtagatgcatacatggcaaaaattgaagctataccaatgtacagcaagctcaacattgaaggtccagtgattaatgcatctgtaatatacatttggttaagaataagatcataggcaaagcgaattggcgtaatatcataaacataattatgatagaagggactcagcatttgcggaatgaaagtaatgactgccattgaacctatccagataataagtagtaatggccatccttttagtccaagcaaatcgagtacagctgactgcagtagatagaaaacaaatgatataccaccaatcatcagtaggaattgttttggatcatgaattggcacagaatagcaaacttttgtgaagaagtaaactgatacagcaatcgcagtgacaattgcgatacccgaaattaattgacttgtgacactagttaatgagaggcggccatcagtacgtttcttctcattcttactatggtctcgccagttcagtaaactagcaataagactaccgagccaacagaagatggttactaagaatggcgccataccacttatttctttagttgaaactttattgcgtttgataagagttgtgtgaattggtgtttgcaatttagaccagtcctgaggagatagtgttagtcctgacttatttgcaacggttatatattcgttagaaatcttctgatttagatgatcagtcatctttggaagtgcagtagtcaaaatagttgcaaccgtcatattacttccttgactgacgtataaagagatttttgcttgttcgggggtcttcttggttaatgaatttgctaaggctttttgttgttggaatggggccgtcttagcagccattggcgttttaactaccagggcagctagcttctgagttatgattttaccttttaaatagtctgtttgctgattgatagctttagtaaatcccgaatgaatgacaacagccccgtagtattttccggatgcaaagcctttagtgagttcactcgtgtgggttacattgacccatttaatttcagcgcttttcttatggctctctttccgtaatttcttaacaacattcttagcatcttttcctttatcgtttactactaacgctaatggtaaatgacgaaccttaactgtgctcctagctccaacttgtgcgaaggcaaataatccgattaatatagtggcgactaacatgctgatccagatgctttttctcttaaacacgttgaacattttcactacccccttttttatgctacgggtagtttatattaattttgaaatgaaaaacatggtcaaattaatatgatttgtgtcttaaggctacaaatggcagccatatgagccataaggttacagaattggcaaaactggtaatggaggaatcgatatgacggattttagaataaaaaaaactgacgacgttatcatcaaatcatttgttgacctagtcatagagaatggatttgacaacgttactgtcaaggatattgcactcaaatctatgattagtcgtaaaactttctatttacattatgaggacaaatttgcactgacagacgcaatactacaagatattctaacgtggcttgatgagacattgaaaaagaagcgattactcataaatcaaggaattggcttaagtaacgcagttggtcaattagaaccggaacttagacaattactgatgtgttggagcagaccaataaacgcaataatgacaattccacaagctaagatgcaactaatggatggtcttaaagatattttaagtaatcatttacaggcagctctcacacatccaaagtcagatttggaaataaatgttattggtggcatgatgttagggatgataagatattacttacaaacaaatgacttcccatcaagcaaagaaattcatcaattatcagacacccttaatttgatatttggcgcgtagtataagtcagtcacatttctgtccatttaaagtggtattttgctttagtgattaagcctgattgtgaaatcttatagcgttttttattgggattaatttggcgcctaaattatgactatacgatgttgtacaattgctttattagtataaacttcatattgtaagggtcgtcgtagatagaaaaggcattttatttggcgttattagttatagcgccagtaaaaaaacaaaactggaatttaactaatttcgataaaacggcgtctcactggcaatggtcggaaagttaaacagtgagaattcactggattggtgcggccaatgagccacaaaccacggtgaaaaaacaagctttttagggtcaacagataaaggtatgacacggcgtatgctaaatgagggtcggtattgagttttattgtgagaaaatgcttgccgggtcttactcaatttgtcataccatagtatagttaaggacaaacgagttaacgggagtgacaatatggactgggaagactattttccaacggcaatcgctgaacgtgggtacgattattacttacaggggtatgtcactgatttaaagcggaccaaaacacaaattacggcaacggttacgggcacgcaggactatggcgtggtaatcactctcgctaatggtgactttcacgatggcgcgtgtgagtgtccgtatgccaatagtcatccgtattgtaagcacatggcggccgttttgtaccaagcgacggcggctgacaaacctgccagtcaacatccagtttccaaagcaccaactagttgcgacagtcttgaacagactgccactaagctggttgagcgggctactgatcggcaagtccgggactttttgagtgtggtgttggcccatgacaagcatctcgtccagctgttccggacggtcatgggtgagactaatgttgtgacagatttacctaaatatctcgcgagtgttgatgatttatttgacacaaacgcggatggcggtggctttatcgattatgacgcggcgacggatttcggtgatgaggccttaactttcctaaaagaagaggtgcagccgttggtcgatcacggcgagtatggtttggtatttcaaatcttagcgcatctgatgcttaaaatcgaccacgtcgacattgatgattccgatggtgagattatgatgatcatgagtgctagtgacgacttgtgggaagctgtcttaacaaaagccgacgcggatgtgcagcagcaggtgtttgattggttatgcaaacaattaacgaagtcgttgaatattattgaagatacgcttgacgatttattattcacatatttcaagacgccagcgtttattgatgcaaagctggtgtataccgctaagcggttccgtgcggtgcaaaaacacccggatctctgggactatgactggcagataaaaaaatggctaaagcactatttacaaatgatgtctgcggctcatgtgcctgataagcaaattattaaattttgtggcgctaacttggcgataccgcaagttcgcttgttttatagccagttctgtcttcaacatcaagatgaggcgcacgcggtccaattgctaaaggatggtaaaaagttggtcacggacgatcccagcatgttagcggaacttagtcgccaactaaaggacgcttatcagcaattaggtgaacagcaattgtatcgtcaggaattatggcaattgttgactgaatatgcgccagcggatgagatgctattttcagagttgaagcagagttacccgaccacggattggccggcgattcgcgagcaactgttgacggcgatcgcgaagaattccaatgtcgatttgaaaccactgtatgtgcaagaaaacttattgaacccgctattaaaagcggtcgtggccgcggacggactctgggatttacggacctatgagccgttattgaaaccacgtttttcagatctgctgttagcgaaatatgatcatgaagttcggaaaatggctactactactggaactcggcggaagtatcaacaattagttggcatattggaacggatgctcgcttacccggctggtaaatcgaccgtgcaggcgattgtacatgattggcagcaacaatatccgcggcgttcagcaatgatggatgagctctcgcggctaaactggtaattgatcgttagttggcgcagcaatcgcgaacagagttaagtcgcatcgctaagtttaggatcggttcctaccccaaacttagcggtgcttttttcatagccaactgcgggcataataaattgtctttgggccttggtcatcctggccaagataaaatggtaggacattagtttatttcaaagttattaatagctatccgtactcagggctgaccggtggctgtcattgaccctgttattcaaaataaggctaatcagtcatcgaatcacaattaagtttaaataatgaccgaattatcatcttggaaccggtataataagccttaagcgaccgaactgattaaccatagggtgtggatatgcgctgttggcgtcattcgtggtccggccgttgctacgaataaattagcgagtgatgtgaggacgtgatcagtaatgaatattttgattattggaacgggtaaattggggtatgaagtgtatcgtcgagtggccgtgatgccgcagcaccacgtgactttgttggatcatcaccggcatgagcatgatgtctcgttagccacgcagttaatcggggatgcgagcaatgttgatgatttaaaacgcgcgctgcgagggattgacgtcgtattctcaacggtgggcattacccacgcggcgcagtttgccacggcattggtgcaagcgatggatgcagttggggtaaaacggctattttggacgacccagtttcaaatcaactacgatcagatttcagaagcaatgtacaccttagcccgccgcgagtttgggtttagtcgtgaagttgagacgacctatgtggcggggcaaaaggccggggctgcagttatcaggaatagtgatttggactatacattgctagcctgtcattttttcaagtacaatgatgaagcggatcagttaattgttgaaccagctggaaatgctgttagcggtgggccacttagtctattctcattggcgacattgatcaccgatatgttggaacatccacaagattatccgcaacgtgagctcatgatctcagctcggccaggcgaaaagtaacatcagttctggctgattaacttgaattgacaacagtagtactcataaaatataagttttgatggcgatagctaagttgcaccaacaggtaactgggctatcgccatttttgtgctaagtttcaaaacttacgactgttaccagtgtactaatgtaaattggttctatttttctgagccagacggtacaatatttgtaaattcatcaaaagattgaggagatgggagcaatgtcacaatggcaacaagattgggcttaccaaaagtactgggtcatggcacactcacagcagcattataatgccatccgacaattagctcggcacaatgattggtcagctgcaaaacaggaacgctaccaacaattattagcagaagccgaacaaattacgccaactaaagccacgttgacaacggcttatcagcacgtctggggctattttaaaaagcggtgtacgctggccgagaagcaacgttacctgaatttactaacgaatttaaccccggcacacgatcagcttgggccgttcttgtggcagttaacggtgaagtacgaagtggcctatttgctggcgtcacgcttgctgcgtgcgtttgatcagcatgaaaatcaacggtgattcgtataacatttatattatttaaacaataataaatatgaaaaaacaatgaattttttacgattacttcgttcaggtctttacaaagttatgaataacctgctacaataataaacaagttataattatcataataaaaacactaatcaaggaggcgaaataattatgattaaattgtttacgcaagcaggatgtaactcatcgcgaaaggcccgccaatggttccgggatcatgatattgcatttgaggagaagaactttagtagcgcagcccctactgttagtgagttaaaacaaattctgtgcctaactgagaatggattggaagatattatttctacccgttcacaaagttatcccgcaattgctgataagctgccagatatgtcattcaatgagacgctccggctgttatgcgaacaaccccagttgttgcggcggccaattattgttggtcgtaataaattgcaagtaggctttaatgatgatgatattcgccaattcattccccggcatattcggcgactgaattttcaacaaaccttagttggattggtggatatgtaatgataggggacttaaagtccaccatattgtgaaaatggtaattactaggttgatgtaaattaatgttaatccgacgctctttttcataattgttgatgccaatagcggcctaacttgattgaaagacgtcataaagaaacaaaaacatcccggctagcagacaggctagtcgggatgtttttggcgcttcagcagtcatttagtcgactgtgatggtagtggaagatgccattagctgtgccaactgttcttcggttgtccggttttgggacaacggtggcaagttgtcgagcgtaaagtaggctgtttgggcgacctcaatgttaggctcaaattggccatcagtaatttcacaagcaaagaccaatttataatactgaaatggttggggaatatcgacacgtagagcagtgtcaaaaacggtgatgagcccctgaaccgcgacgtgacggccagtctcttcccacacctcgcgttgcacattttcagtcggcgtgtagcccacgtcagcaaagccgcctggtaaggcccatagtttcgttttaatatcttgaacgagtagtagctgattaccatggcgtatcaagccgcggacgtcgattttgggggtgatgtagccggaatcctgagtcagagcagtcgttaagtcagcagttgatatgttggaagtggcggccatttgttgaatcaataaggtttgtaacttttgatagcgatctttgtcgaacgggtcagtcgtgtaggctaagccactttgaatcagagctaacattgcccgttgagtggttaatagtgaagatggcatgttaatgatcctcctctaaaggtaaataagtttatcaggtgcaatcttagtagctaggttatccggtagtggctgatcagtcacaaagtaatcaaaatcactgagagctagcaagttgaagttgtggctgacgttcaccttggtgtggtcaaacaacagcactagccggtcgctttgggcgcgtaacgtttcctttaaagcaatatcagattcgtaagcgtaataaacgccgtctgcggtcaacccagcgcaactcaagaccgtggtcgtaaatcgaaatttgtgtagtgctagaatgctgtcagcgccttgaacacaccgttgttgtgcatctaatgtgccacccaggatacgcgtttgaaaattgctatgtcgtaatgcctggtcagcaatgtcaagggaattcgtaacgatcatgccggggtgcttggactggagatattgtggtagacaggcaacggtggttgagatatctagaaataataacgcatcatttagtaaatacgaactggcagtgtgggccagggctcgtttagtttgcagtaagtcatcatcccggtccaggtattgatctagcttattaaacgtattcggccgactaatgccgccgtagtttcgttcagccaaattatgagctgcgagtttgacaatatcgcgccgggcagtgtcgcgtgaagtccccgttaattgcataatgtcttttaaactcagtgatgggtggttttttaattcatcaagaatcaatgttaagcgtgttttttggttcataattgatcaccttaagcttttttaagtgttaaacacatactaacttattttagcttaaatagaaagccaatgacgtcaattaatgaaaacggttgaattaatcggcgttgatgttgtggttacgccttgaaacccttaaaattaagctaattagtggcagggctacagcatacctacgaaaggatggttcagatggaagtgaaaaaagtggtcattgttggtggcgttggtggtggtgcttcggcggcggcccgcgtgcgtcgattggacgagttcgcccagattacaatttttgaaaaggggccggatgtctcattttccaattgtgccttaccgtacacattcagtgatgtgattgaccagcccgatgacgtgattttaaagacaccgatgcaattcgagcaacagtacaatattgacgttcaagtgaatacaacggttgtcgccattgatgcgcaggctaagacagtgatgatcaaacggcaaggacaggtagcaacgacgatcgtcccatatgatacactgattctttcacctggtgctcgaccgatactacccgcagtgattgcgggaatcgaccggcccaatgttaaaacggtccgcaatgttcaagatgtccgaacgattcaagcgtatctgactgaacaacacgttcatgatgtgacgattgttggcggcggctttatcggactagagatggctgagaatttacaacaggctggctatcagatcacaatcattgaggctgccgaacacgtcttgggcactttggatgacgagtttgctcagctagtacacaaggaactatacgattacggtgtgcaggtgatactgcaagaacaagtgacggccattggtgcaacacaagtgcagctcgcctcgggacgcgccgtgaccagccagttagtgattgtggcaattggggttacaccagtaactgaattagcggttcaagcgggttgtgcgttaggcgtgaccggtggtatcaaggttgatcatcgttaccagacgtccgtggccgacatttatgcggtgggtgatgccattgaagtgactaatcggcttacacgtcaatctacgcggctagcattggcatttcccgcacaaatgcaggcccgacacatggtggatcatttatacgggcggacgccacagtatcagggtgtgatcggatcgcaggttcttcacatctttacgttaaacgtggcgtcaacgggcctgaacgctactgagtgtgagcaccagcaacttgattatcggttcgcaacggtggcaccacagaatcgggtcagcgtgatgccagtgacaacagccgtctttcttaagttgatattcagttatccgaccggtgagattttgggcgcgcaggccattggtcaatcggacgttgacaaaccgattgatattatcgctagtctaatcacgatgcacggtcgagtcagtgacctgacagatgttgaattatgttattcgccatgggtcagtaccgccaaaaatgtcgtcaacatggttggcttggtggcggaaaacgtcctgaatgatgaatttaagcaggttgcggtgacgcaggttcgacagctggtcttggcgggggcgtttatcatcgatgcccgtgaaccacaagagtacgctgatgggcacatcaagggcgctcataatattccactgagtcagtttcggcagcgcttagtggaaattccgaccaatcagccagtttatattcattgccagactggacagcgaagttacaatatggtccgcgcgttacttcagcgcggctatacgaatgtggtcaacattgctgggtcgtatgccgaactagttcagtatgaatattttaatgatcagacaacggggcgaacctcaattttgacacgaacatgatgattgataactaagatattaatttcaacaaaatttgataacgtagcagaggctattgggtaaaatagaaggttcagaagtgttagactgaaattatcataagaaagttggtggcaaaatatgcgaacgattgaagacgatgcagcgcttaagattctagcggatgtgattaagattccatcagttaacgaccatgagttgacggttgcaaaatatttgcaagccctgttggcgaagtatgatatttcagctaagatttaccccattaccggtgatcgtgcaaatctagttgcagagattggtcatgggcagcctgttttagcggtttccggtcatatggatgtggttgcggcaggtgacctggcggcgtgggacacagatcctttcaccttagtagaaaaatccggtcagttatttggtcggggcgtcacggatatgaaggctggtttagtcgcattagtcgctgcgatgatcaatattcagcagcaaggtggccctaaacatggcaccattcgcttgttggcgacaatgggcgaagaagttggtgaagctggctcagctgccttttatcaacaaggggcgatgcaagatgcagctggtttactgattgctgaaccttcaacggtttatggaacagcggctgagcagaaggggtcttatgacttaaaattgacgtctaagggtaaggcggtacacagttcgacacccgaacgcggctataatgctttagtcccgctgattaaattactcaatgaagccaatgactattttgaaacgattccggcaggcgaggtgggaccggtcagatttaacattgacgtgttaaacggtggggaccaagtaaattcgttacccgatttagcgactgcactcgttaatgtgcggacgattccggaatacgataatgaccaagtgacccaaaaattaacggacctgatcgcagcgtataatcagcaaggtgctgacattaagatgaccgctatcatgaatgagtcaccaattgcaaccacggctgataatcggttagtaaagttagtgcaggccattggcaagccctatgctggccgcgatgttgtcgttgtctcaagtccgggaattaccgatgcttctaatttggctaagcgtcaaccagccgattttccctttgcggtttatggaccgggtaatatgacccaacatcaggtcaatgaaagtttaccaaaacagatgttttatgactttattgcaatttatcaacagctgtttacacgttttttggccgagtaatcggtgttgattgatcgtaaaatcaaagacccgctagcagtcagtgactgtcagcgggtctttgaatggttagtaccaattttcaggtgcatgggtcggtgttgaaaaagcaacggcaatttgtcgcagggcttcgtaagtttcggcggtatttacccctaaaattgtcgccattcgttgttcactggtttcaaagaaacgttcgatcttggtggctaattggcgggccttgggtgttaggagtagtcgtttgtagcgaccatcgtcctttgctggcacgcgaatgagtaaatcagcggcttccattttggaaacgaggctggaacaggttgctttacgaatattgaactctaattctaagtcccgttggaagaggtcgtgatgctgttcattgttggcaataaagttgatcgtactgatttgcatgccagttagtcccagtgattttgcataatggtctgagtccctggctaatgcattgttcgctttcttaatcatgatccctaatgaatcttgcatgggaggactccttaatgatattatggttcgtattctaactaaagtgaattataagaactaattgttaaaaagtcaattaaaatagggcttaaaattttgaaatagtgtgctaaaatagttaattagttcgtattcgaactataggttaaggagctgattttaagtatggaaaaacgtgttgacctcaaattgattcttgcaatcgtggctgccggattactttcattttgcggagtgatcgtggagactgcgatgaatatcactttccctaagttgatgcgagaatttgcactcaatacggcgacggtccagtggatgaccacggcttacttgttagtagtcgcaattattgtgccaatttcggcgtttctgaaacgccgttttcgcactaaaacgctgtttgtgacagccaatttattgtttatactgggattggtcgttgacgcgaccgcgaccagttttcccgttttagtcactggacgaatcattcagggaatgggaactgggattgctttaccgttaatgtttaatattattattgattgggcaccagcacggcagaaagggaccttgatgggaattggcacgctgattaccgcaatcgccccagcactggggccgacttttgggggcttgatcgttagttggatggattggcattggattttcgtattgctaatcccggtactcgtgatttcacttgtgttagggctgtatgcgattcgacaagcccagccgacagttaaagttggatttgatgtggtcggttggctgatgatcgtcctcttattcgttggctttacaattggatttagcaagttagccacgattaccacgcaaccactgatttttgtggcttggctagtggtcggtctgattggtcttgtggggttcgttatccgcacacgtcgagcggcacaaccgctaatcaatctggcgatttttaccacaaaatcttatgatttgcacttaatggcgtactttttggttcaaatctgtgccctcgggttggccttcatattgcccaactacatccagttagtgaacggcaagagtgctttgttagctggcttatttgtactacctggcgcggcaatcggggctgtttttgccccactaggtggacgtattctagacagtctgggtgcagccaaaccagtcctaacgggttcaacaattttggttattgccatggcactgtttacggtgttggggatgcacctgtcaggcggttggattttagccatttacattttattaatgattggtattggcttaaccatgggtaatacgatgacgagtggcttacagcagttgtcagctgagcatcaagctgatggcaatgccgtgttcaataccatgcagcagtttgcaggggccattgggacttcagtcgtgtccgccgttatcacgttagttcaagtacagacgactggaacgagtgcgcatcggacagcgttaggatcaaccatggccttggggttgttgctgattttagtgctgattgaattggggaccatgatattggcaatgaagacgcgtcaagctggtcaacgataaaaatgttataaaaagattgacattgttttgagaaggtgtaatctttagttgttcaaaagttaatcggcgatgacgttcgccacataataattgataatcaatttgatgacgtctactgtttgtttttcagacagtaggcgtcttttctttttggttaagaaggagagattgatatggaaaaacaagttattgaaacggtaaaggctcgcgaaatttttgattcacgaggtaatccaacagttgaggctgacgttattttgtcagatgggacgctaggacgcgcggaagtaccatcgggagcttcgactggagaaaaagaggcagttgaattacgcgatggtggtgatcgtttagcaggtaaaggtgttcttaaggctgttaataatgttaatacggtcattaatcatgctttacatggtgctgacccgtttaaccaagcccatattgatcaaatcatgattgacctagatggtacgcccaacaaagcgcgtctgggtgcgaatgctattttgggtgtttcaatggcaacggcacgagcggcggcaaacgcattacagcagccgctttatcgttacttaggtggcactgatttagagctaccccaaacatttcataacgtgatcaatggtggggagcatgcagataatggcattgatattcaagaattcatgattacaccggtcgaacgaaccagttttcgggacggttttgaaaagatcgtgaatacttatcatactttgaaaaaagttatcgaagatgccgggtacacgactggtttaggtgatgagggtggctttgcgcctgatcttaaaaactcagaagaagccttgcaaatattacatgatgcgattattaaagctggttatacacctggtaaagaaattgcgattgcttttgacgcggcggcatcgtatttttataatcgaacgacccacaattatgactttgagggcaaaacgtacacgccggcagcccttggtgattattatctgcagttattagcgaagtttccagaaatcgtttcaattgaggacccatacggggaagaggactgggataactttgcaagctttacagctgctcatggtgaccagcttcaaattgtggctgatgatccggtctgcactaatccgcaattaattcggcaagcaattcagcgggggatggctaacaatattttaattaaattaaatcaaatcgggaccgttaccgaaactttggccgcgattcggctagctcgcaaaaatggttatgccacgatgatgtcacaccgatctggcgaaactggtgatactttcgtcgctgatttcacagtggccaccaatgcggctcaactaaaagctggtgcgccagcccgctctgaacgcattgaaaaatataatcaattattgcgaattgaggaagaattaggtactgatggtgctcggttggcacacttcccaaataacgtgatgtttgactaattatttgtgataaacctgattcgacagttaggttgccagtggtgcttgtcaaattcgagatgcagacatgattgaagatttaacggagcaacaagcagccgctaaactagcggcagatggatttaatgatgtcccagaaccaacgtttaacttttttaaggccgtagtcagtcgtctatgggaaccatcggcatggattttggagggagctttagttattgaagttgttttgggtaaagaaattcaggctggctttattgcgttaatgctggtctttgcagccgtcaatggtgcaattcaatcgcgacgtgcggccttggttttacaggagctggcgcatcaattgacgccaaccagttcggtacgtcgtgctggtcattggcagttgattgatgcgaaggctttagttgtgggtgatctgattagtttacaggtagggagtgtaatcccagctgatattcgtgtgttaacgaatccaattcatacggatgaaagctcaataacaggtgaatccgttgcagttagccatacgccgggtgaaacggcctttgcaggcacaatggtggtagccggggaaactttagcacgcgtactggcgactggaagtcatagtcgggctggaaaaacagtcagtttgattaatcaaaacaatgcgcctggtcatttacaacgattattgggtaaaattattggttacttggcattgttagacagtgctttagcactcatcattgttggaatagcgttaattcgccatgcagacatgattcagatgttaccgtttctagcgatgctgttcattgcgacgattccgattgccatgccgtcaagttttgcagttgcaaattcggtagaagcccgtgaacttagccagcagcggattctggtcagtgaattaacgggtattcaggaagctgccaatttgaatttattacttgttgacaaaacgggaacgataacgacaaatcagccgcaagtcgtgcagtttaaaaatttgtcggccagatcagatcagcaattgttgcggttagcagctagcgcgaccgattcgcgacatcctagcgtggtggatcaagcaattgtgaactttgctcatcgctatcagttgaaacggctgccacagcaggaatttaagccatttgatgcaagtgttggttatgccgaagcgccaacagttgtgcgggtacgtattggtgcacttagtcgtttgtacgagttaaccgcacagcaaccggctttagcaatcgaccaactggatttgacccggggccgttcagtggcggtcatgattaataatgttttacaaggtgtgttgattttgcaagatcaaccgcgcccagatagtgcggcggccttaaaaaggattcaacaccggggcgttaaaacgattatgctgacaggcgataatttaaaaacagcacaggctgtggctgatgcggttggattaaagggccaagtggtttcctaccagacctttaaaacgcactcgcgaccgttagcgcaagttgccgggattgccgaagttgttccagagaacaaattggcaattgtcaaagctatgcagcgcgcgggttacgtggtggggatgacgggcgacggtgttaatgatgcgccagcattaaagcagtcggaggttgggattgccgttgacaatgccactgatttagccagacgaagtgctaagttcgtcctgttaacgggtggtttggcaaatattctgacgattttagacagtggtcatcgcgtctaccagcggatgctgacttggacaattaccaaactcactcggacggtcgaactgaccgtgcttttaacaatcggctatttatggctagattacgtgccattgtcgctgaatgcgatggtattagtggctattctgaatgatttagtaacattggtccttggcactgatcgcacaatcattcgccatcgtcccgaacagtgggatatgccccgcttaagcaaaattgcggggttcctagcgactgggtggacagctgtgggtgttggtttgatagtctggctgcatggtttggggttgtctgctggtcagttgagcactagtctttacgtctatctcatatttagtgcaatgttaacaatcttgatgactcgtactagtggtccattttggcggggacggcctagtcgcgcagttgggttgaccatcggcttgaactgtctgttgaccatcggattagctagcagtggttggggagtgccggctattagtggctggctaactttaatagtgatcgtattagtgttaatgactggtatcggtttgacggtggccggcgacctctggcgacgattgactaaatgattgcaatgctgatattccgcaggggattaattaattgcgaaaagcgtgaatctcagctatcgttaaattggcattaaaaacgaacggaggtagcaaagttgcaagcatacgtcgtgaaccaaccaggtggaccagaagcgttacaattaacgacacttcctgaaccgaacgtcaaaccggggtggacccgggtaaaagttttaggttttggtatcaaccactcagaaatctttacgcgggaaggcaagtcaccgagcgtgcagttcccacgagtgctcggaatcgaagtagttggtgtggtcgatgagaccagtgcgccagcaacattcacgtctgggcaacgtgtggtttcaatcatgggtgagatgggtcgggcatatgatggtagttatgccgaatacgtattattaccgaacgagcaggtttatccgatcaaaacgaatctatcgattgcctcattggtggcaacccctgagacctactacacggcctatggcatttttaagtctttgcagcttaaagcgacggaccgggtgctgattcgagcagctactagtggggttggaattgccgatttaaatctgatcaaagcttataatccaaagatccatgtggccgggactactcggcggctagttaagcgccaacaattgattgatgctggctttgatgaggtcattgtcgctccggatagcgctcgtttaccagccgcaacggctcattttgataaaatcatcgacttgattggtccgctcagtgtcaaagattcattgtcgcatctcaacgaaggcggcattgtaaatatgacgggcgaattaggtgggctgtggaccgttcctgattttgacccgattagtgatattccgaatgggtgttatttagcgggcttttcctctggcgatgtttctcagacattgttgcaagatttatttgacttcatcgcagcatatcatgtgtcggtcgcccccgctcggatttttaactttaatcaggtaccggcggcccatgcttatttgcaagcggcagacagttttggaaaggtcattgtgttgttggaccaaaacgctgagtaatctggtggttggatactgctcagcctagtacttgcatgtggggcttagaccaccggattgaaatctgtaaaggaatctataataaagaaatcacgatcgtgtctgaccgtaaatcggctaatgctgactggtctgacgcgatttttttgcctaaatggtcgcttaagtgtatggtttgcttgaaaggtaaagcagttggaatcgtatcaaaaaatacaatcattagctggtaatgttcgcgaagtgtacttgtaatcccatgggaatctattagactgggtttaaggttgaccatcggttgatctggtaaaaattcgaagaggtggtagcagtgacgatgatttctagtccgtcgatggaggtcactaacgttggcgattacctcaaactaggggcctgtactgcggtgatggcccagccgattctcacagacgcattggcaagtgggccgtcgattgccacgcaaactgggattggtgttgtttataatctggtcaagtatacggcaccggcctttatttttggcattctctatacgacgacgcgtttgacgcttaatcagaccgcgttgacctataccgactatttgcgccagcaatggcatgcgctgtttattccaacgatttggtggaccatgatctacttaatcttgatgccacaattgcagcaaggtagccagtatcatgactggcggggatttttctggcagttcgttaatggtaatgcagcgcctcatctgtggtataacaccatgatgctacaatttatcatattaatgccgttattctgggcgcttggccgttggtgtcagtctcgacctcgacgcggctggatcgtatttggcggtacaacactggtcgccgttctttggttgtggttttatgaccaacaagttttccatggtcctcacagccgtgattggtatttactggaccggctttttatcagtttccagattttcgggttctatggcatgttagcttgggtgtttcgagatacctttcagcgcatgcttaacaagtggtggccgggattacttggtctatggttagttggcctgatctggactaattgggaactgttcagttacggcttcccggttaatttgcgcaacgccccgtattacaaaccatcaatgacggggtatgcgctagcagtcatcggcctgttggcggcgttgtgtgagattcaagcttgtcgtcaacgtccttttagcaaatttgtacatttctttgctggtatggcctataaggcatacttagcgaatgttttctggtctgaattgttgtggcgtggttttggtcgtactttgatggtcaaggctccctggctgagcattgcgctgtgttatggtttgacctggttattgtcctttacaacggcttttggtctgcatgcaggatggatgcgacttaaacgtgaatacgagcatgattaggggctaaccttgtaattagtcgtattcttcatgattaaagcgggacaattgtcgtgtcatactgggatgtaagttgaccagaccactttctgaatcggcttgaggtgtcgtgaaattgcgttactgtgttaatcataaaattattgatgctgtgcagatgttcgatgacaaaataagcacgttgtaaaaatcaccagagtgtggttttacaacgtgcttattttgatgtgggaattaggtcaacagggcttttgctgcgcgctttatgaagtagcgtttttgataagtgactacctgataatttttcaaatgaagcgcctggttgtttggttgttagttgaccacgattgtctctgtaatttgaccagcattggggtcggttagatagttaatactattggtcatgccaacttgcgcgggaccggcctttaccgtaatcgtcgtggcgacttcaccagcttttttttgatccatttgcttaaataaatcaacgtctgttttcggtaggtcgttagcagcgacgacggcactggttttcgtataggtcgtaacaatctgctgattgatacgaatgattttattagcgttgatgatgagatataacataccggtactatcaccactggcaacggcggtatgtgttaattgatagccagcgtgggctgcatcggttttgaaggccgcataggtcacgttttgattcagtgagcctaatgaatagtgactgaggtcctggatagcagatcgttcataactatcataacgatgctgatatagatagccatctttgatcagcaacttgcctgtatcgctagcgctagtcgtagtttcggcagcaatccaggtaccattcaaattcgctacgttgacgtgtttaggcgccgccttggcactagtatcagtgaaagcgcggccccgttcaatggtcgttgcctgttcagtatctgaatattgaatgttgacagcgtagaggtggtgccccttagcagcaaaggcggtgttgactggtaacggatcggtgtgattgccggattccaagtaaatcaagtcagtcagtttgttaatctggattgaggcaccgagctttttcaaaaccgcgttgatctgactaactgacatgtgatgcagccggtgtcggtaacttttcatgatatggcgttgctgatcatggtgccatttggcgtacgaaacttgacgatgtttgacgccggcggacaaaaattggccgttactagtggtccagcttgattgggcagtagttttgtcaaccacggaaatgtctaaattgctggcgacgccgtgttttgtttggctggaactaacggcttgatcaaaagtccatgttttggttggtgcttgaatcactttttgggtcgtcgctttgacggaccgatgatgcttcactggagcgaatgtttgggtcgtacaaccagcaagtgcaaggccaattgtcatcaccaaaatagctaatttgtgcattagggtactcctccaaatcaataggtatcgtgatcatcagtatagcatatgcgattatggtgagtgtcaattgtactggacctggtgtgcgcagggttcatgagtgttgggaggtttcacaactgactgcttattttctgttgagtcgtgcacgctaatctattgatttcaatctgcatcagtttaaacgaaaaatgtcgtggtgcttgatggctagggttatttggatggtgagtgtttcgaataacagctagtccgatttaagggttgacgatgatgaaaaagcgtgtatacttctaaaagtagttagccggctaattaactttagaaagaaggatttcaatgcctgacttttcgtttcgtgatcgaccagataaacagcgagtgcaattgacactgggcaaagcaagtagctcggcggatgctgagcaggtgttggcttttctggattttcagtggacatttcgaaccatgcaagccacctatgaacaattactcgatcaatatcaactttcagaatccaagtttattattttaatgttgctggaaaatgaaactgatcacacgctattgccgtcggagttagccacaaagctagggtctgctcgggcgactgtgagcaagttactggtcggcttgcaaaagcgaggctgggtggaaaagcagcatccacaagatgataagcggacagttgccattcatttgaccgccgccggtagtagtgttttgacgcaatttttaccggccaattttaaggcggttacaacaatttttgcgtcgtttaaggttcaagagcagcagcagtttaaaggcttattggataaaatcaagcaaggcacccaacaattaaaaagtgaggcaattaattatgaatgacaagaaaattgaattgttaacaacatatttaagcttatacatcgatcatcacaccgttttagccgatatgcaaaatgcgacgggcaagtacgtcgtcttagatgttcggaatgcaccggcccaagtgaagaaagatcaaatcaagggtgcaatcgcgatgcctgccaaggatctggcaaccagaatcagtgaactggatccggcgaagacctatgtcgtgtacgattggacggggggaacaaccctaggcaagacggcgttactcgtgctactatccgcaggctttgacgcgtatgaattagcaggagcgctggaaggctggaaagggatgcaactgccagttgaagtgcttgcggattagtgaaatatcgatttagacttaagtcatagttgtagtgctagacgcttaaagtagccagcggtgatgaaagtaatcaccgctggctactttgcgtttttgtgataaacactgggttgcgtcgtccacaatgagttgatttcgtatattgtgaaataagttcgttaattagttggccttacagtttatcattataatccgagttgatttgaaaacatgtccccattaaatgccttttctttcaagcctgtgttgaactttaacgggcgtaaccagtcaacatcaccaactatattttgccgataaaataatgaaaatgggttttactttgtgtaaaaatgaactacaatataaatggttaatgtaaacgcttacagaacttaagtttgataatgatgatattcaagtgcaggaacatagggaggtaatcttatgagtagtcgtgatacggcaaacgttttatggtttgatgaattacaccgcgaagatgtgaacctagtgggcggtaagtcgtcttcactgggtgaaatgacgtcatcgatggatgttccagtcccatatggctttgcaaccaccgcccgggcgtatcagtacttcatgacccagacgggattgaatgataaggtcaatgatttgttagccagcattcaggattatgaaaattctgatgaattgcatactgcgtgcgaacaaattcgtaacttgatcgtgaatgcgacaatgcccgcagatctggcggctgatattgaacaagcctatgcggatctcgctaagaaaatggggcaaactgatccgttcgtggcgattcgctcttcagcgactgcggaagacttaccaaacgcttcatttgccggccaacaagaatcttacttaaatattaaaggtgctgccgatgtcgttaatcgggttcaacaatgttactcgtcactgttcacggatcgcgcgacatattatcggcacaaacagcattttccacacgaaaaagtggccctctcagcggcgattcaaatgatggtcttttctaaggcttccgggatcatgttctccgtcaatgtagcggatggggatgcttccaagatcgtgatcgatgccatttatggtttgggtgaatatattgtgttgggcaaagttacgccggatcactttgttatcgataaacaatcaatgaaaatcgttgaaaagaatattatcaaacaacctgtccaattaatgcggttaccgggtggcgggactaaggaagagtccgtccccgatgaattacagggtcagccagtattaacagatgcgcaagtcattgaattggccggctacgctaaagaaatcgaacggcattacggttgttatatggacatggaatacgctttggacacgaataccaaccggctatggatcgttcaagcgcggccagaaacagtttggtcacagcgtaataagcacaaagatgcagctgacgatgaagatgttgtggatgaggcggatgccaaagttatcgtccgggggttaccagctagtccgggcttagccagtggggtcgtgcatgtcattgataatccgaaagacattgatcagtttaagcaaggcgaagtgttagtgacgttaatgacatcaccagattgggtaccggcaatgaagaaagctgcagcgatcgtgactaataacggtggcatgacttgtcacgctgcgatcgtttctcgtgagatgcagattccatgtattgtcggcactaaaagtaaggaagtcgcggcaaccgacgtcttgaagaccggcgatgtcgtaacggtcgatgctaagaacggggttgtttatcaaggtaaagtcgctagcatgttgaagccaaagagtggtgctacggcggttgctggtcaggtggttgcggccgagagctttgctccaactgctacgggcgtgatgatgaatttgggtgatcctgatttggctgacaaatattcaagtttaccagctgatggaatcggcttaatgcgcgaagagttcctatggacaacctttattcatgaacatccactatacttgatcgagcagggtcaccctgaaaaggtggtcaatatgctggcggatggtatcgcgaaggttgttcgggcaatggcaccacggccagtcgtcctacgcttctcagactttaagtcgagcgaatatcgtaatctaaagggtggcgacaaatacgagccgcatgaaccagctgatttactgggttggcggggtgcatctcggtactatgattccaagtatatcgaggcattcaagttggaactggctgcggtcaagaaagttcggaacgaatttgggttgaagaatttaaatgtcatgattccattcgtacgaaccgttgacgaagcacaaaaagtaacgaccattatgcgcgatgaaggcctagctcggagtgctgacttcaaagtctatatgatggctgaaatcccaaccaacattattttggccgaccaattcaatcaattcgttgatggctattcgatcggttcgaatgaccttgcaatgttgattctgggttgtgatcgtaataatgatacggtggctcacctctttgatgagcggaacttggccgttaaacgagcgattcggcacctgattaagacagcccataaagatggcaagacggtttcgatttgtggtcaagcaccatcagagtacccagagtttactaacttcctgattcaaagcggcatcgactatgtttcagtcaatccggatatggtcaaggagactaaacgaaatgtggcgcactttgaacaacgcattatgttggacaaagcgactggccggggcttacaggacccaattgattataaatggtaaactatgattcctgttaaaagttaaataatcactaaaggcgaaccaattcgtaactgaattggtccgcctttaagtttgtttagagccaaatactgattcagggttaattcggagcaagaggtcatctaaaaatgacgggcaggtggcatatgatttactttttaaactgtttcaagtaccgactagcaaataatttgtgaaacttaacgcccaaagtcgggttggcagcgtcaatatccgcatacatcgcggtggtaattttggttaacaagggtgccagttgatcgagctcgtcgtcagaaagcgtgttgacaaatggggggacctcctgggctgcggatgcaatctctttgcgaccagcagccgttaagttcacaaggttgacgcggcgatctttggtggacttggataaagtgaccagctgacgattgacaagtttatagacgaactcgctcgttgattgcggcgacatgccaaggcgacttgccaactgtttttgtgagaggtggtcctcatcggctagtgctagtagaatcttgccctgaccttcaacagttattcttggacgggcctgcttgacaatgtcatcataaattttgcttaattgttcgtactcggccaattttccggcgactagttccgccttaatattcgttgtcacgattgatcattccattcgttcttttcttaagtatacaacattctttggtatgcggtacgttaaggttagttgatttttagattgatggtcaataattagtcgttgacaatttagtcagggcacctgattgatttgtgggaggttttaacttggatgaagaaatgatgattcaaatgacacatgttcagaagcgatttggaacgaaagtcgccgttcaagacttgtcactgcaagtccaacggggtgaaatttttggcttattgggtcctaatggtgcgggtaaaacgacggtcatcaggatgatgacgaccctattgcgacaagatgctgggaaaatcttagtcaatggctttgattcattgtcgcaagcccgacgcgttcgccagcagtttggtttgaccggtcaaaccgctagtatcgatcaggacctgagtgcgcgggaaaacttgcagatttttgggcgcttgaatggtttaagccgtgcggcggcgaagcatcgagcgatggaattactgacggattttgatttgaagcattctgcggatcacgttttggccacattttctggcgggatgcggcgacgattagatttggcggttagcttgattggtaaaccggccattctttttctcgatgaaccgaccacgggcttggatccgcggacaagagcgcagatgtggcaagcgattcgtcaactagtggccgatggttcgactgtggtgctaacgactcagtacttagaagaagccgaccagttagccgaccacattgcgctcatagatcatggccagttagtcgccagtgggacgcccaccgctttgaaacaaacagtagggggtcaagagcttgaattggaagtcagtgcgacgacggccgtcacaccggctaaggatatcttacaagccatgctcggtcaagatgtccgtgttgcggaacggaccctaacagtgccgttggataccgctagcttgacgccggtcactgaaattctgatgcggttacaagctgctcaaatcacggtcagtaactttgcgatgcacgcgccatcgctcgatgatgtgttttttaaactgaccgtgggcacaaattagaggaggacaaagcgatggaaatcaaacaaccagcagagttaagtcatgttttgacaatgacgcatcggaacttattaaaaatgtggcataatccagataatgttagtgacgtggtgatacaaccaattatttttaccctattattcggttacttgtttgatggggccattgcgggcagtgtccaggcctatttaccaatgctagttaccggtattttgattcaaagtattttgaatgcagcatcgggatccggacagcaattacgtgaagacattaacgcgggggtgtttgaccgcttcaagacgctaccgatttcaccgatcgtaccgttagccggtcagttagtgggggatgttttccgattgcttatttctggcttgatggcactggtgacagcttttatgatgggctggcgacctattgttagtccgctagtattgatcggcgttttactgctggcagtatttgttggatggtcgctttcatgggtctttgctttagttggtttaatggtcaaaaatgcggccctgattggcagtctgtcaatgatcattattttagtgctgacctttttatctaacgcctttattccgactaagacgttaccacatttgttgcaaacaattgtccgattgaatccggtcagtctaacaattaccgcgatacgcacaattttgcggactggccattgggggcccgatgcatttggtgtactgttaagtggtttccttattattgtgatttttatgccgttaactgtgttggcatatcgccgatttggttaacggtacgctaaaaatagtgtgtgttgcggcttaatgaccggcagcgcatactatttttgaaatggggaattactgcccgttcgaaattgatggtgatgaaaagtgtcagataagtggagactgatacttgcgagggccaatgattggccgcaattgttgttcgtggtgccaacaagcgataatgagcaaaataataatcaatacttgcatagaagataaaacgaagtctgtcaatccataggctagaatgatgggcaaagtcatcataaagtaacgcaaattcggcgtacgatactggtgccaatatttggttaagtgccagccactgctgaggactaagtaaataaagccggcaccgcctaggataccaaaagaagctagtagcatgagcaaaatatcgtgggcgtgtgggacgtaggttcccgtcagttgcaaatagtgccgcgcaaagccaaaatacgtcacgccgaggtacggggcctgtttgaaaacggtgaagctgttgtgccaaatcgtcaagcgactttgaagtgcggtgatggtcgaagcacttctagggaaaacgtgccagacaattaaactgccagcaatcaagattgttgtaaccaaaatgcgatggtgacggcaaagctggtaagtcgtcatgatcagaatggcaatcatgatcatgagccctgtgcgcgatttggtttgataaacgcccacacaaagtaagccgaccaaaaaccagtttatgagcggccagcgcgtgaaggggtgaacacttccatgacttaactgtgtcaatagtaagccgagggcaatcaataataaacagcaggcatcatttggattataggcggacccgaacaagcgattctgattagcagcatagccccataataggtcacccagcatgaacttcagccacgttggtaatgtcaatacttggttaagccagtggaaagcaaaaccactaattgtaatatacaagccaaattggatgataaatttacgaagctcgtgccaagcaatcgactgcgtggactcacgacacaacaaccaaagattgcccaatacaaaaagcattaggacagacagaataacactacgataatcgtggtgattgagattgagcgtcgtgatgcccattaataggacgataaaccctagcaacgggtcgtgccgactgaattgtcgtggatgtttgagtaacgccagccattgccaccggcttaaataaatcagccatccgatacctaccggcggcagaatagctaataattttaggccagtcaaaaatggcgacgtcgttaaaagacgttttcgcatggttaatcaaactttctctcattagataatatgtcgcttgccagtcgacattagccatattatggcacgtctgcctgtcatccaaacttgcattaatagaattttagttagtttgaacaaagcttaggaattttcaggaaaatttaaccagctgaatgcgtattcacagtgaagcatggtaaaatatgattagtaacgtacggtgatacgggtgctatcctgaatcaccattgaaatgcgttggtttttaaggtcaaagatgattggccaacaaaggtctaatctagtgtgcgacctttgttcagactgctaacttccaggccattgggtatcgccatgatcttagttgaacctcgttgggtatttctgataaagagccgacccgtaattcaacgaccagcacgtttcgattttggtgcatactaaggatagcgagtgacgtgcgtggttagttaaactgaataattaaaacaattgaaccgggtggatttgaccacaaccactgaaagttagtcgtgtgggtaaatcttcccgaattaaaggggaactgtatgtggatgcaaaacaattatcaaaacgattagcaacggttggcgctttcgttcagccgggcgcccgcgtggccgatattgggtcagatcacgcttatttgccagctaatctcgcattaaatcatcaaattagttatggtgtagctggtgaagtcgtccgggggccctttgaaaatgcgcgtcatgagattcaaaagctggggttaacggattgcttagtggcccgtctagctgacggtcttgctgcgattgaaccagctgatcgtattgatacggtcacgattgccgggatggggggccctttgattcgccatattcttgaacaggggccgacccagctcgccggtgttcaacggttggtactcgagcctaatgttggtgaagcgaccgtgcgggaatggctggcggccaatcagtttcaaattgtagctgaacgaattctagctgaagatggccatacttatgagattctttgtgctgatcgggttgatcatcaggtgacgtatacgacggctgaacagatgtttggcccgtttctgctagctgagaagtcgccggtgtttatcgctaagtggcaacgtgagttacaacgagtaaatgcggcggttgcgcaaatgcaacgggctaaagtgataccagaggaacagttagcgctggctcacgctaaaatcaaattgattgaaggagtcttgacggatgcaagcaagtgaattaattgcgcgttttgaaaaatttgcgccactcaagttgaagtgggagcatgatcccaccggattacaaatcggcgatcctcatcaggatatccacaaggtgttagttaccctggatgtgcggccggaagttgtccaagaagccatcacgatcggtgctgacatgatttttgctcatcatcccgtcatgtttcgaccggccaacaatcttgattatcaggatcctcagaaagcaatgtatgcagaacttgcagctcaccacatcttggtgtacgcggcccatacgaatctggactgtgctgagggcggaatgaacgattggcttgcggcggccttagacttgcaaaatgtgcagggattggttcctgggtatcgtgcacaggctgttaagttgactttaacggtaccgaccaatcaagttgaaacggtacaggaatacttaacgaataccgtgggtgccacgctagatcgttacgctgtcaactcgggtgaacagttcagcgtcgacttactagccgatcagattccaactgcggtagcgggcattaatgacttagccgctgacacgtgggattaccaggtcgtgcaactgttgtctggcggtcatcagtattatatgggccgagtcggtgatttgccgacaccgttatcagcgcaggcatttgccgaacagtgtaaacaagtatttggtgtcagcggcctgcgactagtcagtgccgatccccgacaacggattacccgtgtggccgtcctgggcggcgatggtggtaagttctatccccaagcgttgcgagcaggtgcacaagcttacgtgaccggggatgtctattatcacaccggtcatgatatgctggcagccgggttgacggtcattgatccaggccaccatatcgagagtatttgtaagtcacaactcactaagctgtttgatcagtggcgtgtacaagctggctggccaatcgagattgtggcgtctcagctgaatactgatccgtttaccttcatctaagttaatcatgaactttaataaggaaaggaagttatcatatgtcaaaatatccaaacttaatttcagattttttaacctttgtcaaaattaatagtcgttcagatgaggaatcaacgacaattccttcgtcaccacgtgaaacggcctttttaaagcaattaatgagtaagctcactgatttaggcttgagcgatgttgaacaggatgcgcaaagtgcgtacgtttttgcgacgattcctgcgaatagtgacaaagctgttaaaactcttggctttatttcacatattgatacggctgactttaacgcggaaaatgtcaatccacaaattgttgtcaattatgacggtgaatcagttattaagctcggaaacggggactatgtgctggatccggcggtcttcccaaacttaaagaactatgctggtcacacgctgatcacaactgatggaaccacgctgcttggagctgatgataagtctggcgttgctgaaatcattagtgctgcggaatatttgttggcccatcctgagatcaaacatggcaagattcggttagcttttggtcccgatgaagaaattgggactggtgctgatcactttaatgtgcctgcctttggcgccgattatgcctacaccgtcgatggtggtccgcttggtgaactggagtatgaaacgttcaacgcggcccaagcgacggtgacgattacaggtgtcaacgttcatccaggggaagctaaggataagatggtcaacgccttgcagttagccgttgattttcaatcggcgttacccgcacatgatgtcccggaacacacggaaggccgtgaagggttcttcttcttgcttagtttagacgggaccgttgacagcgctaagatgacttacattattcgtgatcatgaccgcgataagttcgaagcacgtaaacggttatttatggcggttgcggatcggctgaatttggctgacggtgtggcccggatcaaggtcgacatgaaggaccagtattacaatatgcgcgaaatcattgaaaaagatatgcgggtcgttgaattggccaaacaagccatgctcaagctcggtatcacgccagccatttatccggttcgtggtgggacggatggctccaagatctcatttatgggcttgccgacaccaaacttgtttgctggtggtgagaacatgcacggtcggtttgaatacgtttcagaacaagtgatggcccaagccgtggacgttgtcttacaaatcgttcaggataattatgaccaggactaaatccttgaccttatttgaccttacgggttatactctaatagtcaataaaggtcaaacaaaaattggcagctatgacggctgcctttttgctaccgtttttgaggaggtacgtaaatatgaatccagaacaatttacagaaagtttacaacaagccttacaacaggcacaacaaatcgcacaaacacggcgccatcaagaaattggggtgccccatctatttaaatttttaacgcaaccaggcgaactggttcggcagatctttagtgaggccggcgctgatttagaccaattacaaacagagctcgaccgtgagctggatgacattgccgttgttagcggtggtaacgttcagtacggtggcagtatgagcagtagtctagctacgctgatgcaggctgccgatgctaagcgcaaagcgttaggtgatgattaccttgcgaccgacactttggctttagcgctgatggatcaaactggtgatcagttgaccaaatacttgaatcagcaaggcatcacggcaggacaagtcaagaatgccgttgatcgtattcgagggggtcaacgggtcacgtcacgtaatcaggaagatcagtatcaagctttggaaaagtacggcgtcgacttggttaaacaggcgcgccaggggaatcaagatccagtaattggccgggacgaagagattctggacgttattcggatcttgtcacgaaagacgaaaaacaatcctgtcttgattggtgaaccgggagttgggaaaacggccatcgtggaaggtctagcacaacgaattgttcgtggtgatgtgccggagaacttaaaagataagacgttgttctcgctagatatggggtctctgattgccggggcgaagtatcgtggtgaatttgaagaacgactcaaagccgtcctcaaggaaatcaagaagagcgatgggcagatcatcatgttcatcgatgaaatccataatatcgttggtgctggtaagacagaaggcagtatggacgccggtaacttgttgaaaccaatgttggcgcggggagaacttcatttgatcggggccacgacgttagatgaatatcgtcagtacatggaaaaggacaaggcactcgagcggcggttccaaaaagtattggttgctgaaccgagtgttgaagatacaatcagtattttacgtggcttaaaggaacgctttgaaatccatcatggtgttcggattcatgataacgccttagtggccgctgccaagttatctgatcgttatattacggatcgttacttgccagataaggccttagatttagtagatgaggcttctgctgaaatccgggtcgaaatgaactccaacccaacggaattagaccaagtcaaccgacaattaatgcgtttagaggtcgaggaagccgccttaaagaatgaaactgacgatgcctccgttaaacggctagcggatgtgcaaaaagaactcgccagcgcaaaagaaaaacagcgggctttatccgaacgctgggacagtgaaaagaagagcctccaagcgttaagcgacaaaaagtcggcgttagacaaagctaagcacgacttggaaaatgctgaaaataattatgatctggaacaagcagctaagttgcagcacgggacgattcccaagctggaacaagagttgaaggccatggaagccaatgatcatcatgaagattggttagttgaggaatccgtcacgccagatcagattgcaaacgtggtttcccggatgacaggaatcccagtagccaaactggttgccggtgagcgggagaaattattacacttggcggaccatttgcatgaacgagtggttggtcaggatgcggcggtcgatgccgtttcggatgccgtattacgttcgcgggccggtttgcaagatcctaatcgtcccctgggttcttttatgtttttaggcccaactggggttggtaagacggaattagcgaaagcattggctgagaatttgtttgacgccgatgatcatatggttcggatcgatatgagtgaatatatggagaaagagtccgtttcgcgattggtcggggcggcaccgggctacgttggttacgaagaaggcggtcagttgaccgaagctgtccggcgtaatccgtactcgatcgtgttattcgatgaaattgaaaaggcgcatccagatgtgtttaacatcttgttacaagtattggatgacggtcggttgacggatggtcaaggacggaccgtcgacttcaaaaataccatcttgattatgacgtcgaacttaggatcagagttgctactggcgggggttgatgaccagggtcacttgtcggccgacacccatcaacaggttatgcagctggttcaaagtcgattcaaaccggaatttttgaaccgaatcgatgacatcattatgttcacgccactacaattgggcgcaattgaggaaattgtggtgaaattgattgatcggttgtctgcccgtctccaagatcgtgagattacactgaaaatttctgacgaagcgaagaagtggatcgctaagcaggggtatgaaccggcatacggtgcccggccgctccggcgctttatcacgaatcacgtcgaaacaccgctggcaaaagagatcattgcggggcgcgtggcaccaaaatcgacagtcgccattaatttgatggacgatcacttagtcttcgaaaaccaatcgacccagccggcataagcgtaatcactgatttgaacgcgtgataatgcgtttcagtgacgataattgggccaataaaaactggaccgtgagcaccttgcgatgctcacggtccagctttttttaggcggattattattgtgacttggttgagcctatgattctggatggcttgatcgtgtaggtgtgaggcagctatctttggtttatgatgatggtagccgcgcttagcttcggacgagggggaccttgcgcccgtgcgtttaacctcatactgagaaaagagttgttaccgccgacgctgtcgtgttaagctactccaaaatcgaggagtaagcgaacatggacgacgatcgtaaaaggtttgaccagtatgcaaaaaatgaatcgaaaaattaatgtacaacgtggttctttatcagcggccgatttggcattttgggcagcagcacaacgcgcaaagcagaaatatgccaaaacgctgcaaatgctcaaagcaagtgatggatcgtaagcgtcattaatctgaatgttagggtcgggtatgtaccagcattctagttggctggcgcgtcaagcacacaacaaaaaaagacgagtaaccgcaatcgggatactcgtctttttttgttgtgctgagactaagcgaagcaaagcctctggttgtttttaattacttattatctgaacctttagcgggttgggaatgattagtaatataagtgatgctgttgaccacgattagcgcaaaaattgcggcaacgatgccaatttcaccaggattataggagagttgttcgagggcgccaccgatatagccgatgacttcaccgaagaggacactccaaaagataatcgtaagttgtctcatcattttccgacacctcccaatgaaaattattttaacacaccgacaggaaaaagcaattaggtaataacgggatattaaggctttaattaggctgatataattacgacgagacggcggtgaaaccctagtaaacataaccgtgcacgttatctgatgacttaaaactgccgcttagaacaactgtttggtataatgaatagtaacgaatatatctgaggacaagattggtcatcaactggcattgaatagactggtaaattctttgtttacccatcaattgggagcgggcttgacgtagctgatcggatgttacgttttcgatgcgagttgaaagctgatattttatgaaagggggcggcgatagtggcgcaatatgttccattgcaagtattgagtacttttagtttacttcacagcactagtacagttagtgagctagtccaaactgccaagcaacaggggtattccacgttggctttaacagacgttgatatcatgtacggtattgttgatttttataatgcctgtcgccaggcagaaattaccccgatattgggaataacattgaacttattaggacgtgaactaacggcgcaaacgtttagtctggtcgtgcttgcgaaagatcaagctggctatcaaaacttgatgcggttgtcgacgatgaagcagacggcgacggatgcaggattgtcgctaacagccgtattaccttatttgaaccatttaatggtcttaaccccggctaaagacagtgaactagctgcgctgttgttacaaaacaccgctgagcgagctgctgattggattaccacgctgaggcaggcggtcgactctgctagcctttacttagggatttctttggatcaggcccctgcattgcgaacaacaatgacggcctttgcgcaacagcatcaattgccggtagttgcgttagatccagtcgactatgtccaagcaaaggattactttgccgtttcagttttgcgagcaatcgatcggggccaacagatcgaacagcccgaatcgttacaaggtatcgaaggcagtcactacttacggccggccaacaccgtaacggctgactatgagcaactgggattgacgacggcggtggcggctacggccgaaattgcggcacagtgtcaagttgaattacaatttcaacagccacagttgccgcaatttccaacgcccgctggacaaccagcgaatgtttatttacggcagttatgcacggctggtctaacggagcgattggcggcaataacgccgtcggttgatcagcaggcttaccaggaccgtttggatcacgaactgaccgtgatcgatcagatgggctttgatgattactttttgatcgtgtgggatgtcatgaattttgcgcatgaggcccagattacaactggacctgggcgaggttctgcagcaggctcattagttgcttatgcactcaatattacggatgtcgatcccttaaaatatgacttgctatttgaacgtttcttgaacgctaaacgggcgaatatgccagatattgatttggatattccagataatcgccgtgaacaggtacttaattatgttcatgataagtatggtcatgaccgcgtcgcacaaatcattacgtttgggaccttggcagcaaagcaagcattgcgcgatgttggccgtgtgtttggcctctcaacttacgagatgagtgactggagtgccgcaatcccaaaccaattgcatattacacttgaccaggcctaccagggctcacaacggttacaaaacctcgttgctgattcatctaaaaataaattattatttgaaacagctcgccgtttggaagggttgccacgacattattcaacacacgcggccggggtggtattaagccaaaaaccattaattcagatcgtaccactacaagcaggtagtgaaactatgatgatgacccagtatactaaggacactgttgaagcggttggtttgttaaagatggatttcttaggattacggaatttgtctttgatggcaagtgcgctacattatgtgcagcgtcaaactggcaggccactggctattactaaaatcgatttgaacgatccagcgaccctgaaattatttcaggcgggcgacacgaccggagtcttccaatttgaatcggcgggaattcgaaacgtgttacggcgtctgcacccggataactttgaattggtcgccgcggtcaatgcactttaccggccggggcccatggaaaatatcgaccattttattgcccgcaaacaaggccaagaaccggtcagttatccggcggaacaacttgcgcccatcttaggaccaacgtacggtattctggtctatcaagaacaagtcatgcaagtcgccgcggtcatgggcggttttacactaggtgaagccgacttattgcggcgggcgatgagcaagaaaaaacgtgctgtgattgataaaatgcggcaacaatttatcgctggtgcacaacagaatggttattccgaagcagttgcgacacaggtttatcaatatattgaacaatttgcgaactatggtttcaaccgctcacacgcgattgcctacagtaagatggcttttgaacttgcttacttgaaagtccattattccggagcgttctttacctcattgatgaattctgtgttgggcaatggaacgaagctgaaacagtatctagcggaagctcgtcagcaccaagtggcgattattcccccggatattaatcggagcggtcaatactttgattggaatggtcaagccattgtgtttggactcagctcaatcaaagggttgcgccgtgactttattgcgagtgtgttagacgagcggcaggcgaacggaccgtttaaaagtcttcagcagttcatgcaacggattgacgcgaagtggctcaaagccgatttgatggatgcactgatctatgcgggggcttttgaccactttggtttgaaccgtgcagagctactgaccagtgtgcctgaattgatgtcaagtgccgagttagccggtggcagtatgagtttatttgaatcattagcccctaagatcaaaaaacagccggagctttcgttaggtgagcgattggccaaagaagcggagtatcttggtgtgtacgtttcagggcaccctgtggaaacgtatgattggctcgcgcaacaacgacatacgcaattagtcagcacgctcacgagtgaacaaccggcacaaatactggtctatattactaaggtccgaacgattcggaccaaacgtggtcaaccaatggcatttgcaacgggaagtgatttgtccggcgaaattgacttgacgatttttcccaacacctatcaacggattcaggcggaattgaaaccagaagcaatcgtgttaattactggtaaggtcgagcaacagcgggatttgcaagtgatcgtaaacacctggcagttggcggaacaattacccaaaccaaccggccaactctttttgcggttgcaacctgagcaagcaacggcgactgtgcaaaaggaaattttaaggatcttaagtcaatatcgaggtcctaatccagttctaatttactcggtagcagcacatcgaacggttgaactaaattcacagtattgggtcgcagaaaatccagatttggttggagcgcttacaaccttattaggtcgcgataatgtggtgatgaagaacgctatcccttgatacgaaggcgttttttaacgcatttaattttagaaaataacagacaatccacgtgaaaagtgttagaatcacttatggagttacgaactcaatttattgcctgaggtgaaaaaatgaaacgcattggtattttaaccagtggcggcgacgctcctggtatgaatgcggccgttcgtgcagttgctggtaaagcaatggctgaagggttggaagcatacggcatcaattacggctttgctggattagttgccggtgacattcacaaaatagaagcagccgacttagatggtgtgattcaacgcggcggaactttactatactccgcacgttatccagaatttgcccatgaagaaggtcaattaaaagggatcgaacaattgaagcggtttgggattgatgctttagttgttatcggtggcgacggttcttaccatggcgcattgcgcttaacggaacacggctacaacacgattggtcttccagggacgatcgataatgatattccttacacggacttcacaattggttttgacactgctgtcaacaccaacgtgcaagcccttgaccggatttatgatacggctcatagtcatgaccgtactttcgttgtggaagttatgggtcgtggcgctggtgacgtagccttatggtccggtgtttcaatcggcgcgactgctattgtggtccccgaagttgattgggacatggaagaaatcgccaacaagattaagcataaccgggccaatggtcatcggagcaacttgatcgtgttagccgaaggtgtgatgggtgcccaggagtttgttgagaagttatccgaatatggtgactttgatgctcgtgggaataccattgctcatatgcaacgtggtgggaatccaactgctaaagaccgtgtcatggccagcaagatgggtgcctacgctgtggaactcttgcttgccggcaagggtggcttagcggttgggattcaaaacaaccaattagtcaaccacaacatcttagatttatttgaatctaagcatgacgttgaagtgtcattagataagttgaatgaagaaatttcattcaagtaatcatggcatgttagttcttattttaatttgataaaaatgacgttaatgtctttttataaaaactttcaagggagagatttttcttatgaaaaaaaccaagattgtttcaacacttggtcctgccagcaccgatactgacactattgttaaattaatcgaagccggcgcaaatattttccgctttaacttttcacatggtgatcatgaagaacatttagatcgcttaaacaaagttcacgaagcagaaaagattacgggtaagaccgttggtatcatgcttgatactaagggtgctgaaattcggacgaccgttcaagctaacggaaaatctgaatacaagatcggtgacaaggttcgtatcaccatggatgattcattagatacgacccatgataagattgccgttacttacaagaacttctatgatgatgttcatgtaggtggccatgtcctctttgatgatggtttattagatatgaagatcgacgaaaaggacgaagctaaccgcgaattggttacaactgttcaaaacgccggcgttttaggctcacgtaagggtgttaacgctcctggcgtttcaatcaacttacctgggatcactgaaaaagactcaagtgatattcgctttggtttggatcatgaaatcaactacatcgctgcttcattcgttcgtaagccacaagatgtcttagacattcgtgaattacttgaagaaaagcacatggaacacgttcaaatcttccctaagatcgaatcacaagaaggtatcgacaacgccgatgaaattcttaaggtttgtgatggtttgatggttgctcgtggtgacatgggtgttgaaattcctgctgaaaatgtgccattggtacaaaagagtttaatcaagaagtgtaatgctttaggtatgcctgttattacggctactcaaatgttagactcaatgcaagaaaacccacgtcctactcgtgccgaagcttctgacgttgccaacgctgtctttgatggtactgacgcaacgatgctttctggtgaaagtgctaacggtctttaccctgttgaatctgttgccatgatggctaagattgacgaaaaggctgaaaacactttggctgaaaacggtacgttacaattaaaccgtttcgacaagactagtgttactgaaacaatcggtattgcgattgctcgggcagctaagaacttgaacattaagacgattgttgctgcgactgaatctggctacactgctaagatgatttcgaagtaccgtccaaatgctgatatcttagcaatcacttttgacgaacggacgcaacgtggcttaatggttaactggggtgttcaaccaatcgtggctgaaaaaccagaaaccactgatgacatgtttgatttagctgcttctaaggctgttgaacttggctttgccaaggaaggcgacttaatcttgatcactgccggtgtgccagttggcgaacgcggtacgactaacatcatgaagatccaattaattggttctaagttagctgatggtcaaggtgtcggtgatgaaacggttatcggtaaagccgtaatcgcaacgtctgctcaagaagctatcgacaaggccgttgaaggtggcgtcttagttactaagacgactgacaaagactacttaccagcaatcgaaaagtctagtgctttagttgttgaaaacggtggtttaacttcacacgctgctgttgttggtatctcaatgggaattcctgttatcgttggtgttaaggacgctactagtgttattgctgatggtcaattgatcacagttgattcacgtcgtggccttgtataccgcggtgcttcaaacgccctttaagatcaaatctaatttgatattgaaaagtcgtcgctttgcggcggctttttatattacataaagtgcttcactcccagttaaattagtatgaaacatggttaaaaggtgccaaatcgtcaacgtcaaatgatccagcttaagcccgctggaaaaagatctacttagcggaaatttacttagctagcggcgtcctataccgacttccaggcatttcggc

SEQ ID NO: 21 - DNA, 42162 bp, Lactobacillus plantarum
gcaattggcagaaatgcctggaggtcggtgtaggacgaattaactaagcaagtttacgctaacccggactgtttccagcgggcctaagctggctgcttttaaatttaaaaaacggcacgttttaatcatgactcatgacagtgtgacgcggatgaagtaattattttagaaatcccaatacccaacattaaattgatatgttggcggagaaatggagacgtgtgtacgtggcaaaagcaaaaactcagtttgtttgttctaactgtggttattcaacaccgcgatatttaggacggtgtccgaactgtggtgaatggaatacactaactgaagaacattttgatacaaaaccggaccgcaagtcgcgggtgagctttgcgggtaagtcggctaagccacaacgactcaaagaagtgtcgctgactaagacaccgcgtgtcaagactaagctgaaagagttcaaccgggtcttaggtggcggtgttgtgccaggttcactagttttgatcggtggtgatccaggtattggtaagtcaacgttactactgcaagtttcggggcaattggccgagacgggtggttccgtactatacgtgactggtgaagaaagtgcctcccaagtgaagatgcgggcggaccggctggctgttagcagtgaagacttttatctttatcctgagactgatatgtcgaatattcgttcaacgattgaatcgacgcatccagaatttgtggtcattgattcggtacaaacgatgcaagaacctgatatggactctgcgattggttcagtatcacaaatccgtgaaattacggctgaactactgcaaattgcgaagactaacggcattaccatttttattgtgggccatgtgactaagggtggtgccattgcggggcctaagatcttagaacatatggttgataccgttttgtactttgaaggtgatttacatcatacgtaccgcattttacgggcagtcaagaatcgattcgggtcaacgaatgaactgggaatatttgagatgcggacgggcggtttgtatgaagtggccaatccgtcagagatcttcttggaagaacgtctgaaggatgctacgggttccgccatcgttgtttcaatggaaggaacacgaccaatcttagtagaagttcaagcgctggtaacgccaacggtctttggtaatgcgaagcggaccgcaagtggcttggatcataatcgagtctccttgattatggcagtgttggaaaaacgggcgagtctaatgcttcagaaccaggacgcgtatttgaaagcggccggtggcgttaagttagatgaaccggcgattgacttagctattgcggtcagtgtggcttctagttatcgtgaccagcagactcgtccgagtgactgttttgttggtgaagtcggtttgactggtgagattcggcgggtcaaccggattgaatcacgagttggtgaggcggctaagctaggttttaaacgtatctttattcctaagaataatctgcaaggttgggatatcccaactggaatcgaagtaattggagttgccacgctaaaagaagcgctccaattagcattacaacaaccaaattattaaaaaggggctgatgccatgaagaagttaacggtgcgactagtatttattgtcgtcgggggtacgttaggactaacttacctgccgttcttgtggacgacaattttgtcgcaaccaaatgtgttattgaataacgtttttaccaactttttgttgggggcgctgattctatgggttttgtcattgttcttagccaatgccgctgtacgactggtggatcgagtcgaaaagaacttatccaagcaaaatccaatgacacttttatttggcagtatcggatttattattgggttattgatcgcggttctgatttcgcaattatttaatcgtagtccattattcctattgaacacggtcgtcccaattattttgatgttgttttttggttacattggtgcgcgagtcgggactacccggatcgacgagtggcggaaagttttcaacttccgccgtcgtgaaaaggaaacaagtccggagattactgatgctcagccagatcagaactatcatcattataagattctagataccaacatcttgattgacggccggatttacgacattgtcaagactggtttcttagaaggaacactgttagtaccgaacttcgtcttgtatgaattacagtacattgcggattcagctgatagtattaaacgtgtgcggggtcgtcgcgggctagatattttaaataagctacaaaatgaaaatattatcccggttgaaatgtacgagggcgattttgaggatattccagaagttgatagtaaactcattcaattggctaaaaaagtcaacggtgtgatcgtgacgaatgactacaacttgaataaggtgattgagttccaaaacgtacaagtcctcaatattaatcagttggctaagtcgttgaaaccacgggttattcctggtgaagagatgaatgtcatggtcgtcaaaaatggtagcgaacgccaacaaggggtcggttacttggacgatgggacgatggttgtcgtcgaagatgggaagttttacatcaatgaaaaggtggatgtcgttgtaacgagcgccttacaaacggatgctggtcgaatgatttttgcccgtttagcacacgctaatcgcggaatcccggatcatgcggatggaaataataagcacaacaataatcatagtaataatcgaaataataatcgcgataatcggcactaggaagcgattcaacggtagcaactcatttgatgggggctaccgtttttttgttcaatgatgactaatccaggacgtcgtaagggaggcgccgaatcgcaacaaaataggagggttaatgctcattatcaataaattgggatgttgttagtgtacgattagggcctgtttcgatatttttacaatgggttcagtctgaaaccttaatttttagcggtaaacatggtaaactggaaaagcaagtgaaagtcggaatattctggtcgatagaaaggttccggcgtaacatttaagatgaaaaaatacgaaagaggcgttaatcacattggcaaagagcaagattcgtgtgcgttacgcaccaagtccaactggccatttacacattggtaatgctcggactgcattgtttaactatttatttgcccggcataataagggaaagttcattcttcggattgaagacaccgatttaaagcggaatgttaaagacggtgaaaagagtcagatggacaatttgacgtggttagggattgattgggacgaaggtccggataagggtggcgactttggcccttaccgtcaatcagaacggaaatcaatctatgacccgttgattcaacaattaattgatgaaggtaaagcttacgaatcttacatgacggaagacgaattgtcggcacaacgtgaagctcaaaaagcgcgtaaggaaatgccacactacgtctacgaatttgctggcatgacggaagacgaaaaacaggcgaagatcgcggctgctaaggcggctggtatccaacccgttattcgcttccacgtcccagaaaatacgacctatgcttgggatgacatggttaaaggtaaagtttcgtttgaatccaagacggttggtggcgactttgtcatcaagaagcgtgacgggatgccaacgtacaactttgcggtggttgttgatgaccatatgatggaaattagccacgtcttccgtggtgatgaccacgttgccaacacgcctaagcaattgatgatttatgaagcctttggttggcaaccaccgaagtttggccacatgagcttaattatcaataccgaaaccggtaagaagttaagcaagcgtgacgaaaccgtattgcaatttatcgaacaataccgtgaattgggttacttaccagaagcaatgcttaacttcatcatcctactaggatggtcaccagttggcgaaagtgaattgttcagtaagcgcgaattcatcaaaatgtatgatgaaaagcggttgagcaagtcaccagcagcttttgatggcaagaagttggaatgggtgaacaaccagtacattaagaaggctgacgaaaatgaagtctttgcaatgtcaattcgccaattgatcaaggctggccggttaccacaacgcccagatatgagccagattgaatggtcacggacgttggtttcattatttaagaaccagatgagctatactggtcaaatcgttgatttagcagatctcttcttcaatggtccggctgatatcaatgatgaagctaaggccgaacttgataatgacacggcactccctgtcttgaaggaattccggcaacgaatcgaagatattgacgtcttcgaagcaaccgcaattcaaaagacgatcaagagcattcaaaaggatacgaagatcaagggccgggcattatacatgccgatccggatcgccgtttctcacgaaatgcacgggccagaattaccagaaacgattgaattattagggcgtgaaacgaccaaaaagcatctcgatgctatgattgcggaactcgccaagtaatgaatggattattaaaatattagttggttgtcgtaagtggcggtcgtcgtcagcaagacaacgcaattaatacatcgtgcggtcagcaagctagtccccgggtgagcgttatctcagtatcgcgaaagttacccagtggcgcgtgactgcatatgaaagtatcttttgtatggtggagtttcggttccaccgtgcgagggatgctttttatttgtgtttcaaacatggtaaactatcatcaaaagtaatgattcaattgaaaggagttgtcgccaatatgttaagtgtttttaatacgttaacgcgtcaaaaagaaccgttcaagcccatcacccccggagttgtgaaaatgtatgtctgtgggccgaccgtttataactatattcatatcggtaatgcgcgttctgcaattgcctttgatactatccgacggtattttgaatattgcggttaccacgttgactatgtctccaacttcacggatgtggatgataagctgatcaaacgtgccgctgaagatcacaccacggtaccagcagttgctgaccggtttattaaagcttttatggaagatacgactgcggtcaatattgaaccagcgacggttcacccgcgggcctctgagaatatcccagaaatcattgcatttgtacaagcattgattgaaaagggctatgcttacgaatcagctggcgacgtatattaccgcgcacggaagtttaaaaagtatggtcagttatctgaccagcgaatcgatgatttagaagtgggtgccagtcagcatactgccgatgaagaaaccgatcgtaaagaagatccaattgactttgcactctggaaagcagccaagcccggtgaaatttcatgggaatcgccatggggtgcgggtcggcccggctggcatattgaatgctcggtcatgtctactaagtacttgggcgatacgtttgatattcatggtggtggtcaggaccttgaattcccacatcatgaaaatgaaattgcccagagtgaagcgaagaccggcaagacgtttgccaattattggttacacaacggttttgtgacggttggcgatgacaacgaaaagatgagtaagtcattaggtaattttgtgacggttcacgatattattaaaacggttgatccgcaagtgctacggttcttcatggcgacgacccagtaccggcgaccgattcaatatacgcaggccaacttagacgaagcagctaataacttggataagttacgtaatgcttatcgtaatctcacgttccggttgcaagatgcgacgaacgggacggatactgcggtggcagaacagttacagacactcatcactaactttggaaccgcaatggatgacgatttcaatgttcaaaacggggtggctgctgtgtatgaattagctaagttagccaatgtctatgcagccaaggcaacggttcaaaaagagacgttgattgccttacagaaggcattagtgcagttgactggcgtcttcggcgtcacttttgaaacggctaatgcgacgctggctgatgacgcgattcaagcactgatcgatgaacgagaagctgctcgtaaagctaaggattttgctaaggccgaccagattcgtgatgatttgaaagctcaggggattattttagaagatacgcctcagggtgtgcggtttagaaaggaataatatgcaagttgattatcaacaattaaacgggattgcactcgcgtacctcggtgacgcggtgtatgaaccgtttattcgccaacatttgattgaaagtggttttactaaagccactaagttgcaccaccacgcaacccactatgtttcagccaaagcgcaagcggcactgatcgaacggatgcaggccgaagaagttttaacgccaactgaagtggacgtttttaagcgtggacggaatgccaagagtcatacgtcggccaaacataccgatgtcgtcacttaccggatctcaaccggttttgaagccgtttttgggtatttacaattgactcagcaggcggaccgaattgcagaactggcacagtggtgtattaaacaagttgatgaagggagggtttccagtgtcaaataatgaacaagaccaaacagcagctgactttgtaattgggcggcaccccgccatggcagcaatcaagagtgatcaacagatcaacaaagtctttattcaaagcggtctacaggccgatgtactgaatgacattgccaagattgcgaagaaacgtaatttgatcgtacagtacgtgccgaaacaaaagttagaccgtttaaccgacaacgccaaccatcagggggtagctgtgggggtggctgcttttgaatatgccaccattgatgatttatttgctgttgctaaggctaagaatgaagcgccatttttcttgatcttggataatatcgaagatccccataacttaggttcgattatgcggacggccgatgcagctggcgcccatggcatcattattccgaaacggcgcgccgtggggttaaccagtacggttgccaagacgtcaacgggggctatcgaacacgtgaaagttgcgcgggtgacgaacttggttcaaacggttaaacaattgcaagaagccggtctgtggatctttgggactgatatgaatgggacggactaccgacagtgggatgcttccggtgccgttggtttgattattggtaatgaaggtaagggaatttcaccattacttaagaagagtgtggacgaaatgttgaccattccaatgattggtcatgttcaaagtttgaatgccagtgtggcggccagccttctgatttatcaaggctacacgtcccggcatccactgggaaaataagatgaaacaacaattattgattgtcgatgcttacaatatgattggcaactggccagaactcaatcatttaaaacaaacggaccggttgccgcaagctcgtgacgagttaattagcatgttgactgagtataaaaaaattacgggccttaatattagcctggtttttgatgcgatgtacgttccgggtaattctaagagttatcgccaagctgatcttgagattatttggacgagtaaagaccagaccgctgacagttatatcgaaaagtacgcgggtgaaaagcaatcgcgagtacttcaagtgacggttgcgactagtgatcaggcagaacaatgggtaatctttttggaaggtgcattacgagtaccagccttggaattacgacaccgcgtcaagactgcgctgaaagatgtgcgtcatactgccgtgcgcacccaggatttaggtgccgttcgtaaatcaccctggaatgatgatcaattatcggccttggatcagtaccgccaacaactagaacgcaatcacgttaaacatcatcacaggtcgtaattaggtggttgccgcgagcgtgggctgtttctaaatcgtcataattaatatttaaattttgcaaaagataaccagtggcaatttaaggctcgaaagcagttctagtattaaaatatctagtaatcaaatgccccagttcagctgctgttcactagatgttaggatggcttgtcataacagttttagtgttatcggagtttgcgctggcgattgcattaatcggttggttagacagcgtagtggcttcgtgcaactccagcggacgcgcgtactcgtctccaacgggcttaagtaggtcgcacttgtctttggcgttagcaatattttgatattactaataattagtgcgatatagcactattaggttgatgaatgggacgatcatagtagttttgatagccgcgtataagaagatttctgtgagtgctgaggtggctgaattgaaacgttcgttcgcttgtgacggcacaattaacccggtatattagcattacagatgctcaggggtgcagtttctgaaactagtcagaagcgaggaatgtcacgtgaatgaacagcaattgatccacttagcagcagatggtgatgatgcaagcattaatgcattagcccagcagtatgtcccagttgtttggcggttgcgacggcaatactatgtccggaactttgacgaggatgattggcttcaagaaggtcgaattgcagtttatcgagcggctaaaaagtatcaacggctacggcaatgtagctttggcacttattaccgggtgctattgagtaatcagattattgatcatattcggcggacacaggctcgcaagcgtcgtccggaaggggatatcttatcgctggatgttaatgatgaggatatcttatgcaatattcagacgctaagggcctcgacccttgatgtggttcatgttcgtgagcaggtgcggatttttccagcaatctgttcggcatttgaaggattggtttttatggatctattggcagggcaatcgccagaacggattgcattgagtcggcaagtggaagttgatcaagtggtcaacgccacggatcgatgccgcaagaagatgcgtgactttttacaagacgctgcctgaaattgacattcgaaaagttccatgctaatgttatacctgatttattatggaggttttgtcgatggcacagaaaaaagttgcactggcatgtaccgtttgtggttcgcggaactacacgattgatgctaacccgaatcgaactgaccgcttagaagttaagaaattttgtaaatattgtggtaaacacacacttcatcgtgaaacgcggtagggggattagacatgcgcttatttaaattttttggtcaagttggacatgaaatgaaaaaagtgacctggccaacttggcgggaaaatcgtcgtgattcgtggacagttgtctcaacatcactgttcttcgtggcgtttttcgctttatttgattggattatccaattattattacaaatgttaacaagctggcattaatggctttttgaacaaatttttgttataataatggcattgaaagaaaacttcgtgcaaacgaggtttttttattttgccaaaagacattttaaaggagaataataatggtcgagtctgttgagaaaagatggtatgtcttacatacctacgctggttatgaaaataaggttagttctaacttggaatcccgtattcaatctatgggaatggaagacaatattttccgggtcgttgttcccgaagaagaagctcatgaagtcaagaatgggaaagacaaagttgaaatgaagaagatcttccctggttacgttttggttgaaatggtcatgacggaccaagcttggtatattgttcggaatacgccaggtgttactgggttcttaggatcacatgggcaaggtagtaaaccaacgccattgttgcctgaagaagcggaacaaatcttgcatcaactaggcatgagtgctcggcataccgaattggacgttgaagttggcgaacaagttaccatcatcgatggcgctttctctggcctttctggtgaaattactgaaattgacaacgaaaagatgaagctcaaggttaatatcaatatgttcggtcgggaaacaagtactgaattggacttcgatcaagttgaccagattcggtaattaatttaagtaagctggtggaccatcttggcagaagtaattttagtcatcatcggcgccttagtgctcggtattttggggcgtatcacctttaaattttggcaatacgggcgaccgcagcatttgcggcagtcggtgtcggctaattcagcagatgatagcgccgtgacgctatttattccagggtatgcgggcaaccggttctcttttggtggcatgctccaacgttttacggccgggggcatcgccaataagtcattagtcgtaatgattgatcgacataatcatccccatgtgactggtgagctagacgcttaccgcccaatggtacagttgatttttgccacgccacgcgttgctgtacggcaacaggcggcgggcgtcttggcagttgtgcagtatttgattgcgcatgagcacgttcagacgatcaatttagtcgctcattcgatgggtggtgtggtgctctttcaatacttgacgacagctgccaaactggtcaatttaccggaagtccgcaaggttgtcacaattggtgcgccgtttaatgatagtgaggtcgggcaaaatacgtatccgattgaaaaccacccgttgacggcgaccggaccaactaagactacgcccgtttataattattttttgcgaacgctccaacgattgccaaacacgatttcgtatttgaatattgcgggtaacattggcgatgcggcgcaaagtgatggtgctgtcgctctgaatagtgcgttgtcattgcgctttttactgcgaccaacgcgtgaccagtatcaagaatttgtggtacatggtaagaatgcccgccattcacgattacatgaaaactatgaagttgatcgccaaatcgtccagtttttatatccagaagctacaaaaaaggttgctggtgaaaaatagatatgctacaatgatgtttgtgcgtcacgtatgcacgtttacgtgggaggagcaaaaactcagctccatttaccacatcacggactaaggaggaatgtctcgtggctaaaaaagtagctaacgttgttaaattacaaattcctgcgggcaaagcaacacctgctccgccagttggcccagctttaggtcaagcaggtatcaatatcatgggtttcacaaaggatttcaatgctcgtactgctgatcaagcaggtatgatcatccctgttgtgattacggtgtacgaagatcgttcattcgacttcatcactaagaccccacctgctgccgttctattgaagaaagctgccggtgttgaaagtggttccggtgaacctaacacgaagaaggttgcaactgtaaccaaagatcaagttaagcaaatcgccgaaactaaaatgcaagatctaaacgcagctgacgttgaagcagctatgcgcatgatcgaaggtactgctcggagtatgggattcaccgtcgaaggctaattcagtactgttgagtatgtcggacacttcatcaaaatgaatgtgtcaagtgggaggaaatctccgtttgaaccacatttgcaaggaggaaaacacttagatggcaaagaaaagtaaacaataccaagacgccgctaagctcgttgatcgtgacaaagcttacgatgtaactgaagcggtagacttggttaaaaaaatggatttcgcaaagtttgatgcaactgttgaagttgccttcaaattaaacgttgatacaaagcaagccgaccaacaacttcgtggcgcggttgtccttcctaatggtaccggtaaagatcaaaccgttatcgtttttgctaagggtgacaaggctaaagaagctgaagaagccggtgctgactttgttggtgaaactgatttagttcagaagatccaagacggttggttagactttgatgtcgcaatcgctacccctgacatgatggcccaagttggtcgtttaggtcgggttcttggacctaaaggcttaatgcctaaccctaagactggtacggttacgatggacgttgctaaagccgttaacgattcaaaagctggtaaggtgacttaccggactgaccgtgacggtaacgttcacgttcctgttggcaaggtatcattcgatactgacaagttagttggtaacttcaagaccattgaagacaccatcgtgaaagctcgtccagcctcagtacgtgggactttcatccaaaacttagttgttacttcaacctttaccccagcggtacgtgttgatttagcatcattttaaggattaaattctgaaaacaattgaccccgtgggtgatctgtgatagattactagaggttaagtaatatctctacctaagactcaggcggcttaacggccttaatctacctgccgaggacattgttttttctctatgtcttggtggacatagggatttttttataaatccctgaaccaaaattctgggaggtgaatctgttgagtaaagaaacaattgctgttaaagcacaagaagtcgaagaagttgcagaacaattgaagagctcagtatcagccattgttgttgattaccgtggtttgactgttgaacaagtaactgatttacgtaagcaattacgtgaagccggtgttaagatgcgcgttatcaagaacaagatcatggtgcgtgccgctgataaggccggatttgaagacttaaaacctgtatttgctggtcctactgccgttgccttctctgaagaagacccagttgctcctgcaaagatcttggctaacttcgcgaagaccgctgatgcccttcaattaaagggtggcgtgatcgaaggtaaagttgctgatcttgaaactgttcaagaatacgctacgatgccatcacgtgaagaattattggctacgatcgccaacttgttacaagcacctgttcgtaacgttgcatacgctgttaaggcggttgctgaaaaaggcgacgaagacgcagcttaatttgctgtcagtgtgttaaaaaaactaaaatataagttcatataaaatggaggaacaaaaaatggcttttgataaagatgctattatcgactcattaaaagaagcttcaatctcagatttaaacgacttagttaaggctatcgaagaagaattcgatgtctcagcttcagcccctgttgctgttgccggtgctgctggtggcgacgctgccgctgctaaggattcatacgatgttgaattaactgaatccggtgaccaaaaggttaaggctattaaggccgttcgtgatatcactggtcttggcttgaaagatgctaagggtcttgttgataacgtaccttcaatcatcaaagaaggcgtttcagaagacgaagccaacgatatgaaagctaagcttgaagaagttggtggtgtcgttacccttaagtaattatttacttaacggaacgtcatcagaccacaccctactatggggtgtggtttttttttatctctagatgtggcgttggtgcgaatcacgtgcatgaccacgcatataacgattactgagaatttatacttaggctaagtgttagtgcaatttgatatcaaccaccgtatgattacggtgacttggcgttagaggcgtaaccgtattggattaagcaagtcaaaacaagcccaacagaacgtcgcatagtacgtctgttgggcttgttttaaaatttcacttgggttgaacttctggtcgacagggcactatcacttttgtggctgctgcgtgataggctgaatacgatgatcaatgatcgttagtgactgacctgactagtgccatcagtatagttcaaggtcataccgggctggatattgaaaatatagacattaaaactaacagtattgctaccaactgactgaccacgcatttgaacaccgcgggctaacaattcgttacctttgaaaatgggggtcacttggtagcggacgtagtttttcggactttctttcaaataggccgcaacttggttttcataggtcgtcatttcagggtcattcaaagaacgggttccggtcatgaggttcttgatattgttgttctgccccgttaattgatagccaatcagatgactgcggttgtaaagccaaccgctactgatgcgtttgttatgccaaccagttggtcgaacattcaaggcctcacgttcagctttgggcatcagtgactgatttaagagggcattagcagccgtcacccggttaagtgagtctaaattgccatattgttgccaggcaccctgactcgtactgagctccttagcggtaaatgcgggctgattctgattaatcgtgatcgtttgttgaccgttgtaagttttactagccaacgcattgttacttgggttatggtcagaattgaccttggttggtgctgttgtcgaagttgcgccagcttgcttgttcgtagccttgagcttgtcaatatgttgttgactactcgaaagttttttcgcagcctgctttaagctgctagcagaagcacgattggcagcttgaagtgccgtcagttgcttgtcattattagccgttactaagtgggtcttagtaacggtctttgtcttcacagttggctgagtggattcatcagatgtgccgagaatactaaagctgacgagcaatgcgataatggccggccaactatgccgccaccattgacgcccacggtagcgccgatgtaagcgccagaaccagtacagggttgcaaataataagatggtgccgatcaatgccatgaagtgatcctcctatcgaaatgacttacggaaaccagcggcccgcgccgcgtcttccgtactaaagtaaacggcatttttaccggccatccggtagttttgccccgtttcaacgtgataaattttggaattgcggttacctacgatacgtccagtttgggcggtatcggtatcgccagaaaaattattctgccgactcgtggttgcggtactagtttgagtttgttgactttgagaagctgcttgactgctggctttggccgcttgcttagattggctaaccgccgcgacggccgaagcggactgggcttctgactgggagcgtgattgtgcggtcgcttcactagcagctgatttggcggcagcctgtgacgctgattttgatgaggccattgcgtcgtcatgttttgcttttagttgttcggattgacgcttagcctgactagttgcaattgcgagttgggtcgtgtttgaactaagagctttggctgaggccgcgttagcccgactagcggcccttgcttttgcccaggcggctttattagcagcagtccgtttctcaacccgaaccgtcttggttttgacactggtatggttggcggcttgttgattaccagtggtacagccggttaagatgagtagactcgttagtgcaacgacgagtttttttgcatggtgcataagaaattcctccttgtttatgtatcactttaattatacataaacggtaaaggttggtaaagcgagtttggcaactaaaaatcaattaatattggtttatgctggtattaatttcgatgattaatcataattagtgctaactactaacacccattcggaacaatttagtaacaggtatttaaaatgttcatagcttaatacggcgacaaatcagacctgtgggggttattaacgacctataacggttgtataaacaggctaagattgcgataatagaacaaacacaccaatgggggaatttttttgaaggcaacgttacagaaaatcgggacggcactcaataaacgcatggggattatcaaagcattatttgtattctctgtcctgttatttgtgattacggaagtcggcaaaattgcgaaggaagtcagtggcgcgcagttggcgaatgcgcttgcttcgcaaagctggtggcatctgttaagcatggtcgtgattggtattatcgcagtgacaccaatgctgacgtatgacgtcatgattacaaagtttttacccaaccactattcacttggctatatcttaaaagctggatggatcaccaatacatttacgaatatcggtggttttgggggcgtgctgggcgcctcactgcgtgctaacttttataatcgcgaagccactaagaaacaaatcgtgtttgccatttccaagatcgctttgtttttagtttcgggattgtcattatattgtatgatttcactcgtgctagtctatggctttggcattgggaacatgtatggcagttactggatctggctcgtcggtggtgcactgtattttccagccatctttatttttacacgagtcaacgattcggaattcttcgatggccttacgctcggcaacgtcgttcggttattgagtgggtcgtttggtgaatggactggctgtgtgctgttcttcttattaattggaaactttatgggattacccattgattttgcagcggtcgtgccgttattcgtgattgcttcggttgtcggtgaagtgtcaatggtacccggtggtattgggtcattcgacgttttcatgatttttggcctcggtgcggtcggagtttctcgaccagacgcagtcgcatggctcttattttaccggttattctactatattatcccgtttgccatcgggttggtcttattcatccatgacaccggccatcgcttaaacgtgcgcttagcgggtattcctaagcaggcattacaacgtgttgctcagatggtactgacggtttttctctacttttctggttttttgatgttgttgatgtcaacggtccctaactttgcatataacaataaactcttcttacagttttatccgtacacctttttctttattaatcaggccagcagtattattatggccttcttactgattggggtggcgttgggaactgctggccgggtcaaaaaagctttttggccaacggtgattgtcctgctgattgcaattttgaatacgattcgctggctcgtcgtctatgatgcaatttcgatgaaatttgtgattttcttgattgtgattctagcgctagtggctttgtcgcggcatgcttattatcgtgatcggttggctttttcgtgggggcaaacgttgtgggttagctgcgtgtatgtggtgacctttatcttgtatacgattgtgggggtctataacgcaccccaaattcatcatcggcatgcggttcctgaagctctgttcttcccatcacaaaagctctggttatttggggtgattgggttagtcttagcggcaatgattttgattattatgtaccgctactttgcgagtggctataacgcccgattgcgtcaaaagatggatgcggctcgggtcaaacaagtgattgaaacttatggtggcaatgaaatctcacacttggcttatttgaatgataagttagcatattactatcaagtcgatggggtcgatcaactgattttcttataccaacagaaggccgataaactgattattatgggagagccattcggtaatcaagcggtattacaagctgccttggaacagttattggatgacgcagatagtgacggttgctcgctagtcttttacgaaattagtgagatgctgacgatgcgcctacacgaaatgggctttgactttatcaaaaccggtgaagaagggcacgttaaattggcagactttagtttggctggtaaacggctacggggtgaacgggccctaatgaataagtttacccgggatcactatgagtttgccatcttgcagccaccgttcagtgccgacgttatggctgaattacgagctgtttcggatagttggttagcaggtgagacggaaaaaggattctcgctcggattttttgatgagcagtatctcaatcaggcacccgtagcggtcgtttatgatcctgaccaccgaattgtcgcgtttgcgaatattatgccacagggaaatcatcagacgacttcaattgacttaatgcggtcaagccaatcggcgccatccggcattatggacacggtctttgtgcacctatttgaacaggcgcgtgacgatggctatgcctatttcaatatgggaatggccccgttatccggtgtaggggtttcacgctacagttttattcaagaaaaaattgctcatttaatttacgaatatggctaccagttatatggttttcagggattacggtcgtacaaagaaaagtatgtgaccgagtgggaaccgaagtacattgcgtaccgaaaacgtaattcactaatcttcaccattttacaattgctacaagtcgttaatacccgggtgcacaagtctgagcggcaccggccagtatggttgttgaaacgattgaaataactgaatagtatgtcataaagtaagtatcgttaatgacatagcaaaatgccccatcactgcgagaagcaatgatggggcattttatgatgactttagaattcagccgactaatatgatgagggctgaactaattgtggcagaagcactagagctgttttgcgtaggctagattatttagttcgtatacttaggcggtaacacatgtttgaaatcatggaaaccagcgaaaatttcatcaagatcatgcccattaatgaataggtcgaggttagcctcgggggcaaaccctaaatcggcggtcttttgtagcatggcgactagatcgtcgtagaagccgtcgatgttgtagagcgcaatcggcttttggtgaatatccatttgactccaagataacatttgtaagaattcttcaaaggtgccaaacccgccaggtaaaacgataaaggcgtcagcgaggtgaagcatcttttccttgcgttcggtcatcgtgcgcgtttcgataaaagtcgtgacgtccttaaatgcaagttctcttgcgaccagaaaatgcgggataatcccgataacgcggccaccagcatccatagttgctttggcgactttccccattaaaccatggtcgccaccgccatagacgagttggtaatcattagcggccaagtattgaccgagtgccaccgttttgtcactaaatgcgggatctaaaccagaattagacccacaaaaaacacagatattatgaattgccattctaaactacccccaagataaaattttctagcaaaaatgcggcccggataggcgccgcatttttgtgaactaacgtgttgattaatcgtctggattaccaatatcgtagtcggtgtcttgcattgcttcaacttgacccaagcggtaaccattcccaacttgtgagaagaagtcatgattagaagtccccgttgaaatcccgttcatgacgaccgggttaacgtcttccgcagtatctgggaagagggcatcttggccgagattcatcaaggctttgttggcgttataacgactaaaagtcaagacttcatcagaccaaccaatttgatcgtaaactaaatgaatgtagttttcttcattctcatagagtttgtataagaaatcgaacatccagtctttaaattctgcctgctgcttttcagaacggtctttgaagcctaattggaacttataaccaatgtaagtgccatggacactttcgtcccgcaaaatcaatttaatgatttcggcaacgtttggcaattgattgtgccccaagtagtacagtggcgtatagaaaccagaatagaacaggaaagtttccaaaaagacgttcgcaactttttgcttcaatggatcttcgtcgatgttatcgtaaagcttgtagatccattgggcttttgcttgcaagaattcttcactgtcactccagtcaaaaatttcattaatttcgtccggcgtattcaatgtttcaaaaattgttgaataactctttgcatgaacagattccatgaattggatgttattcaatacggccgtttcatgtgaggttaagacgttgcggcgaagtgcttgcagaccgtcttgtgattgtaacgtatccagcagcgtcaaaccgccgaaaacgtgtcccacgacccaccggtgatcatcatctaattcacgccagtctgccatgtcgttggaaactggaatccgggtgtctaaccaaaattgttcggttaacttttcccaagtacttttatcaattgcatctgaaactcgatcccagttaattgccttatagttgccattactgagcagtttttggtagtaagccaagtctgttgccatttgttatcctcctagagatctaagatactaaattacgcagctttcacattcgttaacaccgacttcgccatcgtcgtccgtaaaggtccgaatataataaatcgatttgatccctttgcggtaggcgtagttccgtaaaatgtttaagtcccgcgtggtcatcttatcagtgcgaccatctttccattcgtataagccagctggaatagttgaccgcatgaagagggtcaagctcattccttggtcaacgtgttgttgagcagccgcatagacatcgataactttacgcatatcagtatcgtatgctgacttataatagttaattgtatcattagataggtaaggagcgggataataaatcttaccaattttcttttcttgtcgttcttcgacccggttgatgattgggtgtaggctggcagtcgtatcgttgatgtacgagattgacccatttggggcgacagccatccggttttgatgatagaggccatcacgcataacggcttctttgagggcttcccaatcagctttggttggaatgaagataccgtcaaacagtgcagcggtcttgtcatattttggttgccaatcttgggtggtgtacttgtcaaagtaagaaccatcggcatacttggatttttcaaagttaacgaaggtttcgtgacgttcacgcgcaatttcgttagaagcttttaaggtccagtagtttaagagtaagaagtagatattggtaaagtcaacggcttctttactgccgtattccatctgattcttcgcgaaaaaggcatggagccccatggcacctaatccaatggtatgggcttgacggttccctttttggatggaaggaacgacgtcgacgttagagtggtcagtaacaaaagttaacgcgcgcaccatggcttcaacagaatgtccaaagtctggagaggtcattaagttaacaatgttagtcgaaccaaggttacaactaatatcagttcccaacttctcatactgttgttggtcatcaattaatgatggggtttgcacttgcatcacttctgagcacaagttactcatcacgattttaccgtcgataggattttcgcggttcgcggtatcaatgttgacgacgtatgggtagccagattcttgttgtaacttgctgatttcattttcaaggtcacgcgccttgatcttagttttacggatgttcgggttcttaaccatattgtcgtattctttggtgatatcgacatatgagaacggtaccccgtattcgcgttcaacgccgtaaggactgaagagatacatatcagcgtcagccttgatcaactcgtaaaacttgtcgggtacggtgacaccgagtgaaagcgtcttgagccgaatcttttcgtcggcgttttccttcttagcagaaagaaaggcaataatatctggatgaaagacactaaggtaaacgaccccggcaccttgacgttgacctaattggttagagtaggagaaactgtcttctaataatttcatgacgggtacgaccccactagcagcgccatcgatatgcttgattggatcaccggcaccccgtaagttgctgaggttaataccgaccccgccaccgatccgagaaagttgtaacgcggagttaatcgtccggccgattgagttcatatcatcggtcgattgaatcaagaagcaagaaatcaattcaccacgccgggcccgaccagcattgagaaaactgggagtggctggttgataacgttggtgaacgatttcgtcggccaggtccatcgccaagtcttcattaccatcagcaaagtagagggcgttcattgccacacggtcaataaagttttccaagtaatagtcgccatcatccgtctttaaggcgtattgggcataaaatttgtaagccgccataaacgtcttgaagtggaagtcttgcgaccgcaagtaatcgtaaagtttttcgataaagctaaaatcatacttatcaatggcaggggtttccaaatagtcgtgttcacgtaggtagtcaaagcgcgccttaagactatcaaatttcatcgtgttcggttcaacattttgttcaaggaaagcggcaagtgcctcctgatccttgttgagcggaatctgattgttaacgggaatattgatctcattatttaagtcgtaatacgtgacgtcttttaaatcttttaaggtcataaggaatcctctttctatcagtataattgtggctggcaaaatcgacgacccacaatcagtaggttgatgattgtgggtcgtttatcatattttaaagggtaaaccagctatgtaaccacgcaaaaaagcgtgaacaaactaaacagctaattgttttaaagcatcaggacggaagccggcaatgctgtcttcgccattgatttcaacgaccggaacagcatggaaaccttgattcttcaggtaatcgacgtattcaggattcgtattgatgttcttctcttcaaaggcaatattgtgcgccgtgaggaacttcttagtcatcttgcattgcatgcagttgtttttagtaaatacagtaacttttttcatttttcatcatcctaactcgtttttctgataaatttagtatacaacatgtggtgaaaaaaacaatcaaaaaacacaacatctagggtgtggtaaaaatcacaagccctagatgttgtgttagtgtcagcttttaaccgactaaaaagttttttaaattatttgtggttcactcgctgaatcagttatcatagatatagaccagaaatttagaggaaaataaatatgaccaactattattatacacacaatccggatattgtgcatgatgaaaagcaatggaattttgaaatttttaatcactcgtttaaatttacgacggacaacggtgtcttctccaagcgtaccgtggattacggctcacgaacactacttgcagcgtttgatccaactgatttgccagcgggcccaatgctagatttgggaaccggatatggtcccattgggatggcgctcgcgtatcaatcacccgaacgaacggttgatatggtcgatgtgaacgagttagcgctaagcttagcgcgtaaaaatgttgctttgaaccaaattacgaataccaatatttttacgtctgatgtctatcaacaagtgaccgcgactaattacgcggcgattgtcaccaacccaccggtgcgcgcaggtaaggcagtggtggatgcgatgttaacgggggccgtttcacggctagtcgttggtggaacactcaccgtcgttttacagaaaaagcagggcgcaccatctgcgaagaaattgatgcaaacgacctttggtaattgtcaggtgattaagaaggacaaagggtattacatcctacaaagtgtaaaggagggatagtcgtgacggaacccacagcggaagactggatgcaagaagcattacatgaagcgcggatggcctacttaattggcgaagtgccgattggggccgtgatcgttcaccagggtgaaattattggccgtggtcacaatttacgggagcatggtcaggatgcaacgatgcacgcggaaattattgcgattcaggaagcttgcgaatatttgcatagttggcgattagccgattgtcagctatatgtcaccttggaaccatgtttgatgtgtagtggggctattattaatgcacggctacctgaactctactttggtgcccgtgatcccaaggctggcgccgttcgtagtttgtatcaggtgatggatgatacccggttaaatcatcaagtaacggttcatgaacgcatcttggcacgtccggccggcgagatgttggaaaacttcttccgtgggattcgtaaacggaaaaaggcggctaaaaaagcacgacgtgaagctgctgaaaaaaattaggccgatggctggtaattgtggcgcaaatcatgtattatagtatttgccgcaaggccaaaaggcaagggtggatttacgaatcgtgtcaggtccggaaggaagcagcactaagtttgcttcatcttgtgccttttgtttttatgaaatgtaacagctcttagccattcggttgagagctttttatttaaattaaatattgagtgctagttttgaacgtgctgataggttggtttatttttatttacctattattatagtagtaatacgttatttgggtgatgcttttcaggctgatagttaaagccactgcttgttgaaggaataaccaaacgcctaacaaaggtggttaaaggcctgggcatcgactcgttggcaagtgcgcttagatgcttaatttgcataaccgacactgatcgttagtggaagcagcacaaccaggaagctaactgttcaggacgtttaaacaatggcttataataagtaatgataaccaaagtatgactgatgtaagaaaggaagaatcgcatgtatcgggcactatatcgggtttggcgtccccaacgctttgatgagattgtcgggcaacagatgattacccagacactaaaaaatgccattatgacccaccagacgagtcatgcgtatctgtttaccggtccccggggaactgggaaaacgtcggcagcaaagatttttgccaaggcaattaactgtcaccatcttgttgatggggaaccttgcaatgaatgtgagacttgtacggcgattaccaaggggcaactaaatgatgtcatcgaaattgatgcggcttctaataatggcgtggaagagattcgtgatattcgggacaaagcgaagtatgctccaacgcaagcggattataaagtctacattattgatgaagttcatatgttatcgactggcgcgtttaatgcgttgctcaaaacgctagaagaacccccggctaacgttatatttatcttagcgacaacggagccccataagattccattaacgattatttcacggacgcaacggtttgattttcggcggattacagctaaggatagctacgatcggatggtgtacatcctcaatgagaaggatgtgacctatgatgaaaaagcgctacgcgtcattgcagcggctgctgaaggtggaatgcgggatgctttaagtattctggatcaagtaatttcgtttggagataacacggttacgttggatgatgcgttaatggtgacgggaagtgtgaccaagcagttgctggctaactatgtcagtgaggtcaccgaccatgatacgaagccggcactagagacgatgcgacaaatcttacaagaaggtaaagatgcgaaccgtttcattgaagatttgatcagttatacgcgtgacgtgttactctatcaacaggcccctgaaatggtcgatagtgtggcgatgggcgaggatgatcaacaatttgaagcatttgccaagcaaatcgatgctgaagtcctgtatcaaatggtcaagacgttgaacgatattcaacaacaaatgcggttcacgacgcaccccgacgtttatttagaagtgttgacggtcaagttagctcagttggatggtcaagcggccgttcaaccggtagctgcggcaacggtcaatcctgaagatcccactgtgcataaactggcacaacaagttgaacagttgcaaagcgaggtcaaaacgttacgttctcaaggtggtagtgtcactaaacccgcaccggctaagccgcggtcgagtaatggcccggttgttaagaaggttaatgtcagtcagatttatcctattctgggagcggcaacgaagaatgatctcattaaggtgcgcgatgtttggactgatttgatgaacattttgagtgtgactcagcgggccctaatgcacgtggcccaaccagttgcggccagttcagaaggtgttgtggttgcgtttgactatgcgtttgtttatcaaaaagcgattgatgaccagaccttgatcgatgcactcggaaatggtttggatcggctgatgggacaggcacccaagattgtctgtgtgcctaaagaacagtggccacaaattcgtaaggattatttggccactcatcagccaggaggtgcaacatcagagcaacaagcaccggccaaagaaccggtcgttgaagaagctaagaatatgttcggtgatttagttgaagtacagccggactaaagacgaaaggaactgataattatgatgcgtggaatgggtaatatgcaaagtatgatgaaacaaatgaagaagatgcaggcgcaaatgacagccgaacaagcggctttaaatgaacaaaccttcacgggtgcggcgccagacgacatggtcaaagtcacttttactggtgataagaagatgaaggatattacgattaaccctgatgctgttgatcctgatgatgtggatatgttacaggacttagtcgttgctgcggtgaacgacgcgttgactgaggtcgatgaacagacacaaagtacgatgggaaaatatactaagggattacagtaaaaacgaggtaagtacatgcagtatccagaaccaattgctaagttgattgatagttatatgaagttgcccggcattggtggcaagactgcgacacggctggcgttttatacaattgatatgaacggtgatgacgtcaccgagttcgctaagtcgctgattgcggccaaacgggacctgcatttttgtagtatttgcggtaatatcaccgaagatgatccgtgtgtgatttgtaaggataagtcgcgtgatcaaagcaccgttctggttgttgaagaggccaaggatgtcatggcaatggaaaagattaaggaatacaacgggctgtatcacgtcttacatggggtattgtcacccattgatggcaaaggtccggaagatatcaacattgccagtttattgaaacggctacagcaaaatgaagccatcaaggaagtcattattgccaccaatgccacgcctgaaggtgaagcaacagcgatgtacatctcgcggttagttaagccggcggggatcaaagtgacccgattggcgcacggcttgtcggttggtagtgatattcaatatgcggatgaaatgaccttattcaaagcagttgaaggtcgccaagaaatgtaattggaggtgccaccatgtttaaacgtaaacagaagatcaagcatcccaaggaagtttttgatgaacagttattgtcgaccctgaatgccgctaagttggactgggaccgtgcgaagcagaaccaagaagcggtctatgataataatacgagtgaactagttacgcagaccgccttagcgcgtgctaagtatttatatctgtatcgtgaagcacgtttacgtcaagttcatgggcagacgattcagcgctcggtcattgataaatagactgttagtgatttaagagataacttgtttcaaaataaagacgcacgtcgttgatttttgtaaatctacggcgtgcgtttttgatttagaaccctagcattattttaccagttaatctgtcatgcattgtgattaagacatgctaggtgcggcaattggaatagaagatgtgtatctactaatgaataacaaactaaaatcggtatttatcaatcgtgggtagtactacctaataactttttagcaattcaccgaataaatcatcaaaaccacaattggtagtagccgacccacgtaaaaatcgtgaaaaagtaccctcactagtggtaaccgtattagacaggtactcaaaaatcaagtacaattgctacatataagaaaatagatgggattgggaatgttgacaggaaaattagttacttttgaagggccagacggtgccggcaaaacgtcagctttaaacgcgattgtggccaaattacagccacaattaggggatcgcttagttgtgacgcgtgaaccgggcgggaatcaaatctcagaagcaattcgaaaaatcattttagaccgtcataatacggcgatggacgaccgtacggaagcgttactctatgcggcagcacggcgacaacatatcgtccaaaccattcaaccagcattgcagaacgaccaacttgtcttgtgtgatcgctacatcgatagctcggtcgcttatcagggggccggtcgtggtattggggaacaagcggtttatgatatgaatcagttcgcgaccgcggggttaaccgcagatttaacgttgtattttgacgtagatgctgccgttggattaaaccgcattcaacaacatcgccaaaatgaaattaatcgcttggacgtggaagccttaagttttcatcaccgggtgcaagcagcgtatttgagattactggctgatcatcctgaccgtatcaagcgcgtcgatgcaagtcagccattggaccaagttgtgacgcaggccttagagattatggcgttacagttaccgacttatgtggcatccaagggaggggaagaccaatgaaattaattattgcaatcgttcaagataaggacagtaaccggttgagcagccagttcattgaagccaatgttcgggccacgaagctctcaacgacggggggcttcctacgttcaggtaataccacttttatgatcggtattgatgatgaccgtgtggatgaagttttagccatgattaaagaaacgagtcatgcgcgggaacagtttatgacaccaccagtcaatctagacgtgacgatggatggcgcagctgcctatccagttgaagttcaagtcggtggcgccacggtctttgttctaccaattgaacaatttcaccaattttaatgaaggatgattattaatggcaacaaccgagtcatttgcgcaaacgttagcggcgaaacagccccgcttattagcggcatttaaacacatcatcgcccagaaccatctggcccacgcgtacttattcgcggggatggaaggcgctggacaaccagaactggcccattggattgcgcaacggttgttctgcctgcatattaatgatggtgaaccagatggcacttgtgaggagtgcgtccggattgctaatgggtcgcaccctgatattgtgacagtggctcccgagggtcagcgaattcacgttgatcaggttcgttacttaaaagctgaattctctaagagtgcggtcgaaggtaaccggaaactgttcatcattaatgatgcggagaagatgacagcgagtgctgccaatagcttattgaagtttattgaggagccaagtggtaacgtcacggccttgttattaacgactaataagcaactgatgctaccaacgattatttcacgaacccaggtgatcgaattcccaccattaaatgcgcaggcgttacagcagacgtttgaacaggccgggattgcgccaaaccaagcgcagatgttacggggcctgacaaatagcgtgacccaggcgcaggcgttgctagcggatgattggttaccacaagctgcgcaagcattgtggcggtggtttgaccaggctgttaagggtgatccacggagttttgtggctgtgcaggtcaatttagttggtttggctaaggacgctgatcatcagctggttatgttggatttaattgcggccttgttccaagatctattgcaattacattttgaggtggcaacgacagcgttaacctttggtcagtaccaaaaagaattggccgggttaacggctgaagtcagcgatgagcagttgattgcggcgacagaactagctttaacggccaagcgccagctagctagcaatattagttttcaaaatgtcttagaaggcttaacgttaaagttatggccgatttttcaaacaaacgcttaaataaaggaaaacgagggtgagcgcgtggataagcgtgatttatacgatagtttcggtgagatggaacaacagatgcaacaaatgctagacaaaatggctaagttacgcgccgatatgacaacggtgttagagaaaaacgcggaattggtcattgaaaatgaacatttacgtgaacacatggtcgaaattgaaaatgaattgccgaaaaaagcggctagcacgaccacgctctcaaagtcacggcaaaacttggaaaaactctatgatgagggcttccacgtctgcaaccagttttacggcaaacggcgtgacgatgacgaatcctgcgttttttgtttggaagtcatttatggtgaacgtgaacgcgcatagtcgaaaaagtctgggagtagtcccagactttttgtgcttttcaccacgagtcactcataggaacaagtcacggtcgagaggattgttaggaggacgttttggaaacacaacaaagttttgcagatcatgcgggtatcgggaccttgtacttagtaccgacgccaattggcaacttacaggatatgacttatcgggcagtggcgacgcttaaaacggttgacctaattgccgcagaagatacccggaatacccaaaagttattgaatcattttgaaattacaacgaaacaaattagctttcatgaacataacacccaagaacggattccccagttaattgaaaaattacagacgggcgttaacttagcacaagttagcgatgcggggatgccgtcaatcagtgatcccggcaaagaacttgtggcagcctgcattgccgcgaatattccagtcgtgccactaccaggtgccaatgccggcctgactgcgctgattgcttctggcctagtgccacagccattttatttctacggctttttaccgcgtaagaagaatgaacaaaaagctgatttggctaaattggctcggcgacatgaaacagtggtcttgtacgaatcgccattccgtgttgccaagaccttgaccctcctagcgaccgtctgtgaagggacgcggccaattgtggcgtgccgggaattgactaagcgttacgaggaattcgcgcgtggaaccttggctgaaatggtgacgtgggcgcaggatcatcagttaaagggcgaatttgtccttttgatcggtggtaatccggataaggatgaaccagaaacaacggatgaattggcacagttgccagtcaaagcccaagtcgaagcgttgattgcagccggagataagcccaacgtggccattaagacgattgcgaagcgacgaaatattccccggcaaagcgtttataatcaatttcatgaactaaataccaacgatgaggagtcttgatgaatggcaactttaggcgcaaatgcgagtctttacagtgaacaacaccggattacgtattatgaatgtgaccgcactggtcgcgcaaccttaacgacattaattgatattgccgtactggcatcagaggatcaaagcgacgcccttggtttaacgacggaaatggtgcaaagccatggtgtcggttgggtcgtcacgcaatatgccatcgatattacacggatgccccgccaagacgaagtcgttacgattgccgttcggggtagtgcttataatccatattttgcttaccgtgaattttggattcgagatgcagatggtcaacagctggcctatattacgagtatctgggtcatgatgagtcaaacgacccggcgaatcgtaaaaattttaccagaactggtcgcgccgtatcagtcggaagtcgtcaagcgcattccgcgcttgccacgaccgattagttttgaagcgaccgatacaacgattacgaagccgtaccatgtccgcttctttgacattgatcccaaccggcatgttaataatgcacactattttgattggctcgtagatacgctacccgcgacgttcttgcttcaacatgatttagttcacgttgatgttcgctatgaaaatgaagtcaagtacgggcaaacggtgactgctcatgcgaacatcttaccgagcgaagtggccgatcaggtcacgacgagtcatttgatcgaagttgatgatgagaagtgttgtgaggtcacgattcaatggcggactttaccagagccgattcagtaatttgctgggttggtatttacactagtgtgttaatgatgtgatcgtgagcgacttggtcgattagaacgcacgtttttattagagtcgctggcgattcagtatgctatgattaatacatccatacaggggaggttcattatgtcaattttagttttagggggagctggctacattggttctcacatggtcgatcggttagtagaacacggtacggacgtcgtggtcgttgataatttggtcacgggacaccgtgctgctgttaattcggcggccaagttttatcagggtgatttgcgggatgcggattttttgaatcacgtttttgatactgaggacattgaagctgtcgtgcattttgccgccttttcaatcgtaccagaatcaatgagtaagccactgaagtactttgataacaatactggtgggatgatcacgttacttgaaacgatgcaggcccatgatgtgaagcaaatcgtcttctcatcaacggccgctacttatgggacacctaagcagattccaattaaagaaactgatccacagttaccaatcaacccgtatggcgctagcaagttaatgatggaacaaattatgcactgggcggacgttgcctatggtattaagtttgtcgcgttacgttactttaacgttgcgggtgccaagccagatggcagtattggcgaagatcatggccctgaaacacatctggttccaatcattttacaagttgcgcaaggaaaacgcgatgaacttaaaatcttcggcgatgactataatacgccggatgggacgaatgtgcgtgactatgtgcatgttgtcgacttagctgatgcacatatcttggctttgaagtacttggctgcaggaaatgacagtaatgcctttaacctgggttcttcaactggtttctctaacaaacaaatgttagcggctgctcgtgaagttaccgggcaaccaattccagctaagctagcaccacggcggcctggtgatccagactcattggttgcggcgagtgataaggcgcgtgacgtgctaggttggcaaccaaattatgacaatgttaacgatattattgaaacagcgtgggcttggacgcagaagcatcccaatggctacgatgatcgtgactagtatcggttagctgataattgaaagcggctttgaaatctcgtcaatagatttcaaagccgcttttgtggtcgtcaaaaaaggtgcatgtcaggattgagtccttggcacgcaccttttagattgatcaatgcagttagcggtgaagttgttgataatcaccgataattgttaagagtcgttgaatatcagttgtatcaacatcaccgatggtaccaattctgaagctagggatatttgaaaccttcccaggataaatgacgaagccgcgttgcttgatgaactgatagaagtcagcaaaatcaaagtcgacgttcgggtatttgaatgacgtaatgatgggcccttgaatggctggatcaatcactaattcaaaacctagcgcttgtaagccgtcgctaaggagttgttgactagcacggtaacgttggtagcgtggtgtcacgccgccttctgcttgcaattcaatgagtgcttgcgcaaaggcatgtaccacgtgggttggcgaagtgaagcgccattttcctggttgcttggtcatggcttgccattggtcgtagagatctagacaaagtgaacgagcgttgtcagcagtgtgggccaaggtcgcttgttttgcaatgatgaacgcaaaaccgggcacgccttgcacacacttgttggcactactaatcaagtagtcacaatccaattcatcaatgctaatcgggacgccacctaaactggacatggcatcgatgatcgttacgatcccgtgttcatgcatgataggcattaaggcttcgattgggttgagaatcccagttgtcgtttcgctatgaacggttgcgaagtgggtaatctccggatggtcagctaaggttgcttcaatccgaaccggatcgacggcttcatcttcgttgaacacaacgtcgatatgtggaatatcgtaatattctgcgatttgactgattcgatgcccatatgcgccgttaatggcaatcattaaagttgcatcggtccgtggtactgctgtgccaatggtggcctcaacaccaaaactgccgcttccttgtagtaggacggtcgtatagttttctggattggcttgggccatagctaagatttgttgccgaatggtttcggtgacgtgccgatagtcactatcccaagtacaataatcaatttgcattgcgtccttaacactggcagtcgtactgagtggaccgggtgttaggagtaaataaggttgtttcataaaaatcgggctccttgtctgctaatgatcagtggcaaccggttgattgatttgatcaagcaatgccggtaattcagccatcgattgtaaaatgtaatcggcaccagcgcgttgataagcggcagtgacgtgggctcgtcgttcagcttgttcggcggggctaagggcgttgaaggctaactcagaaagtcccatgatgttgctaccatcaataatccctacagagactgcgtcggcgttgttgccttctaagatatcattaacggaatccccaattttcatgacggttgttggatcggtgattgtgagctgttcagctgctaacgcaagcattgccggcgctggtcgaccaacaccaccagtttgttctgaagtgatgttgacggcgggacgatagccttgcttagctgcaatcggtaagaccagagctaacatttcagcgtcatagccggtggtcgtgccatagctgatattgtgagcggtcaaatagtcaattacatctgacatgccgggctttaattgtccgaattcagtcagggagctaagcaagattgccttgaagttgctaaagatttgattgcagtcgtcttcagtcggtaagacttggaaacgcgcctgccagtcgttttgaacggccggtaaatccatgattttatggatatgggtgtacttatctagtcccatatcttggcgaatctcagcttcagagatttgaataccaacgttggcaaaggctttttggaaagccacgatgggcgcccggctgccatagtcaatggtcgtgccggcccagtcaaaaattactgctttaattgtcattgatgaaaactcctttgaatttacttagttgttctttaagtagtggccacgtaaccgcatagaaaccagttcgagcacgattgcgacacccaagagtaggtagacaatcaaaccaacttcatggaaatcgaagtagaaactgccagccatgaagaggtagtaaccgatatcgtcagcaccggctgcagcaccaacggcgaccgcattggcaaagttaatttcaaaccggatgaacgtccagctaagaagtgctggaatgattgacgggagaatggcctgaaaaacaatcggccaaaaacccacgccactcgcctttaacgcttcaatcgtatcttgtgaggtttcttcaatactttcagaataagccttaaccaagtacgctacactgtggaaggtcaagccgaccacggctgcactagcacctaatcccatgactacggagtaaattaacacccataaaatcgttggaatggcacgaataaaggccatgactgctttaatactagtagctaaccaactgggtgctaagttacgggcagcaccgacggcaatgaagaaggcgattagcgctcctaacaaagtcgtcaacattgctaatgaaacactagtcattagggcccgtaagagttgccccagtgtgtcttgaccaacgctagggtgtaagaacatagcattcaggttgagacctaagctatgcaaagcgtcaatgatgttcaggttggcattattgagtgtgactaatgaatagacactgataagcgttaggccaatcataacggctcgcaggattttgcggggccgagtcaccaacgaaatcgaccgggttggtggtgctgacggttgaagtacttgtgttttgggttgactgttttcaatcatgcaattgccctccgaattcgattagatgtcaattctaaaacaatgactaaaatcgcaattaacaaaacaattagaccagcagcgtcatagcggaacgccttaaaatagtagtcaaagagaaaaccaacacccgtacccgtcaagagtccgaccaaggttgcgtcccgtaagttgttttcaatcatgtagagaatccaactagtcaaggtactagcggcttcgggtaacaccccacagaagacacattggaaatagttggcgccaacggcttgcagtgcttgaagcttttcggcatcgaggtcctcaatagtttcagtaaaggcccgtgttagatagcctagcgtcataaagaacagtgccaagaagcccgtaaagtcactctgtttaaaagaaaacagaagaatcatcgcccaagcgaccaccggaatattacgtaagagtgaagcaccaaaacgaataatccagcggaggacaggcgttggggtggtcgtcttagcaccgagaatcgcaaagatcagggcgaagagactagcgaccatggttgatgaaattgccacgagcaaggtccgccacagctgataaagaatcggtcccagataagaaatcgaacgacttgtcggaataaagttggtaaacaaccacattaagcccgctggaatcttactgattgaagcccacgcctgaaaattaacgagggccatggataagacgtagatgccaattaaaatgagcaaaacaactgataatcgcaaccgacgttgccgaaaaaagcgttgcggtgtcattggattagttttcattggcagccaccgccgttgattggtcaggttggcgataaatgtgttgtaagaccgcgtcgtcaacttcattagtggcgccttcgaaagcgatggcgccgctgttaatgccgacgatatggtcggtgtacgccattgcgatatcgacctgatgtagattaatgaggataatcagttgtttttcctttgccaatcgccgtagaatgtccatgacaatggtcgttgatttgggatctagggaagcaatcggttcatcacataaaatcatcttaggatgttgcattaatgcccgtgcgatcccgacccgttgttgttggccaccacttaattgatcgcaacgttggtaggcgtattcttttaaccctacttcgtcgagtagttgtagcgcctcttgtttttcggcgctactgtaaaggccgagcatgccagcaactgttgatttagcgcctaatcggccatgcagaacattttcaagggccgttaacggactgatcagattgtagttttggaaaatcatgccgatatgatgacgaactttgcgtaattcagctttgttcgcttgacgaatgtcagtgtcatcgagcaaaatttgaccactatcatcgcggatcaactgattgatactccgtaaaatagttgttttaccagcaccagacgggccgatgatggcagttacttcgcccggtttagctgtgaagttgactgctttgagcgaatgcttattggaaccatatgttttatctagctgaataaccttgagcattggcaaatcctttcattgtgaactaatggtacgtggtttagtaacctactaacttatgcgttggcgcgtaccacttgtcggtaacattaactaatttggacttttctgatttcttagggaacatcattggtgtcttcgcatttggttcagagaagatctttttgttttgggcaaaggacttcgacgtgaactcagtggcgatcttcttttgatcatccttgctgagggccttggtattgtatacccatgggccttgttgaacaggcatcatggcaatgttaacgaccgacttgccggctaaacttgtaaatggcgcttcggcgttatccttaacagtgaaagttgagccgaccttgtcccatgatcccttggtaacgtttaagtatggcattaaatcagcatcatcaaaggcagcgacatccgcatcccccttgattaagttgaccgcggaaccctgatgagagccaccatagagcactttactaaagaatgatccgctttgagttaatttatcttggtcagcggttttgatgttgaattcacgtgagatttcagccgttggtactaagaagcctgaagttgaactgttggaaacataagacatcttcttgcctttgacgttcttaatactgtacttaccgttttcttcatactttttggcatctttttgttgtaccattaagtaggagttataagtagcgtctttcaaggtacctttagcatcagattgtgcggcaaaaggtacaacatctttgctcttgtggtgtgcttggatataaccgttagcccccatgtatgcgacttgagctttgccggatgcaattgcttgaatcgcaacgttatagtcggtcgtggtttgtaatttaaccgtcttacccgttgccttttcaactgcttgcttaatggccgtacgggaaccagcaaaactcttggctgattcgttaggatagaagaccaccgtgatggttttgctgctatccgtactgctaccaccagatttagcactggttccgctagcgcaacctgcgagtcctaaacctaaaaccgaaatgaatgaaagacctaataatgacttactaacttttgacatagtttccaattacctccaagtaattttagttacttgtgtagcataacaaggtattgtaaatgtgcggacaaggattagtgaagtatatgtataagttatgtaaataatatttacattcggttttcaattcagtgattggtaagtatgagtggaaactggtcaggatagttgttgattgtttctggattgaattggttggttactaccgtaaagctttcaaagtaagtaaattatgataagatatgtgaagtaattcaaaatgaggagttttttaaaattatgaagttgttggcgattgatacttcgaatcggccattgagtgtcgcggtattagaagatacccagatcttggccacaacgaccactaatgttggccgtaaccacagtagtacattattaccgattattgaacaagccatggctcaagctaaattggcaccagctgatttagaccggatcgtcgttgctgccggaccagggtcgtatacggggttgcgaattggcgtgacgactgctaaaacacttgcctttacattagataaagccttagttggtgtatcgagtttggccgtgttagctggcaacattgtgacggaaggccaattagtggcgccgttatttgatgcgcgtcgtgacaacatctttgccgggttatatcggattaagaaccagcgtccagttgccgttatcgctgatcaacatatcagtgtgaccgagtggggccaacgattagctagttatgatgaaccaattacctttgtcggcgcggatgtcgatcaatatgcggatgctttgcagcaatcgttagccaagcagttcgttcgtgcagccccacaacttgacttgccccaagccgtagtactaggtttgatgggtcgaacgctgacacccgtgagtgaaattcataactttgtgccgaactatttgcgtttaacgcaagctgaacgtgattggcaagccaagcacccagaaaaggaacatgcgccctatgttgagaaaatttaaggagtactttcaaaaaatgaccaccggtggcaatcaacgtcgccaacgtgtattggccattcaaaatcacatcgttaaagtgggcgaagtcaattactatgtttcacgcgcactgattaccgatgtgcccgagatgctagccattgaacgggccgtatatgcgggacagacaccgtgggatgaaaatgcgtttaagacggaacttcgccgacagagcggtcgtttctatattgtgatgcgtcatgaagatcgcctcgtcgctttttgtggttgtgtctttgatgatcgccgccaagatgcacatatcaccaatattgctgtacatcctgatgttcaaggccaaggactaggccattttatgatgcaagtcatgatgaagcgggcgcgtaagttgcattaccaaacggtgacccttgaggttcgttacagtaatacgattgcgcaacaactttaccgcgatttagggtttgaaaagactggtatcaagaaacggtactattttggcgaccatgaagatgctattgatatgacttatcgtattccggtagctacggatgactgaacgacagcttgtcgccagtacgcagcttgacgcgggtcgggccgtccaagtttgttaccagttagcgacattagcatatcccggtggcgcaccttggcggcaagcgacgtttgcggcggacatggcgttaccaacggtacactatgatttattacggtggcaggatgaactgatcgggtttgtcagccgctcgacagtgcttgatgagaccgaaattacgaatattgcaattgatccggcctatcagcgtcaagggcatgcgcggtggttattaacagcctgcttagcacaattatcggcagggtccgtattcctagaagtccgggctagtaatctcgctgcccagcgcttgtatcagcaatgcggctttgaccagattgccacgcgtaaggaatattatcatgatcccgaagaagatgcgtggatcatgcgtaaaatgattaattaaaaggatgggaaccgtggaaaaacaaaacttgattttagcgtttgagtccagttgtgacgagactagtgtggcagtgatcaaagatggccatgagattttatccaacgtgattgcaacgcagattaatagtcacaaacggtttggtggcgtggttcctgaagttgccagccgtcatcatattgaacaaattacaatttgtattgaagccgcacttcaagaggcacacgtgacgtatgctgaccttgatgctgttgccgtgacgtatggccccggtctagtgggggcactgttagtcggtgttaatgcagctaagacagtggcatacgcgcaccaattaccgctgattccagttaaccatatggccgggcacatttatgccgctcggtttgttaagccattcgaatttccgctaatggcactattagtttctggcggtcatactgaattggtctacatgcaagcagatgggcagtttgagattattggtgagacacgtgacgatgcggctggagaagcttatgataaaatcggtcgggtattgggtgttccatatccggcaggtaaagtcattgacgagatggcacatgcaggtcacgacactttcaaatttccgcgagcaatgattgatgaagataattacgattttagttttagtgggctgaagagtgcgttcatcaatacggtccatcacgcagatcaaattggcgcgactctggataagaacgatttagcggctagctttcaggccagcgtggttgatgttctgatgagtaaaacgttacgagtcctcaaacaatatccagttaagcaattagtcttagccggtggcgttgcagctaatcaggggctacgtgaacggttacaacaagatttaccaaccgcttttcctgacaccgaactaatcttagcgcctctaaagttatgcggtgataatggtgccatgattggtgctgcgggctatgttcaatatcagcatcaccaattcggcgacgcggcgctgaatgccgatccaagcttagaatttgattggatgccaggtatgttgaagtaatgaagcagttataaacgggtgtgaaaagtcagtccttttcacacccgttttagtatcttttcattaattatgattgaaaggtgccggttaggtggattcctgttcgtcagcaatgcgcgtccgattccgacctccggggc

SEQ ID NO: 22 - DNA, 41158 bp, Lactobacillus plantarum
gaggtgagcgcatgactgaaacacaggtgctagtaattaacgctgacagaccggacattgatcaaccgttagcaatcgggaccgaaccggaaatgtttaagctcgcgcaacataactataaatctggtgaatggccgttcccggttagactggttaagcctgggactaaggtacgcagtgatgcggcctacctagccagtatgaaacatgatccgaagcagggagaacgtgaagatattaaagccattcggcaagcacataagcatggcaaacatacgcttagagaactagctgatagtacggcaatggaattaaatcgggtaaaggatttagtccacaaatacagcctgccactgactaacgattactggcgtgctgagaagtatagtgatcgcctatcaaacactggcacgattatgcgagaagattgatgctccagagttttcgattaggcaggccagtatgtctaacgggatcgttaatggctactacattagccgggtgccgaaagcatgaacaaagtcgtgattaagggcgaactacctagcttaaatgagtacatcagggctgaacgggccaacagatacgccgcagctaacctaaagaagcggtacacggccttatgtagtgtatatgcgcgggctagtcgaaattctggagtcgaattcagctggccttgcaagcttaaatttacgtggtacacgaagaacaaccggaaagatgcggataatatcgcgtttgctaaaaagtttgtgctggacggctttatgaaggctgggcttttaggcaacgacaatcgaaagcacatcacaggattccaggacgaatttgccgttgataaacgaaatcctagagtagaaatagatgaaatcacggaggacgaagatgcctaaacacactaagaagcggtcaacgattaaacggaagcaccggcgaatgaaggaacacgccgaagcaaacaaagctaaagcacaggatagtaagcaattggccaaggaatatgagccatacaggattgataagcgggcgttcggggaggatttaaaatgagcactaaaaacaagattgggcttggcatgataatcttacttattttagtcacgatcattggtaacttcttagacggattttggcatggagttacttttatcagtgttgtggcatggattgtgatagcgctggaactatcgagttctaggagatgattggagatggcgacgatgattaagtttagagcgtgggacaaaaagacaaaagaatattttcgtatttctgagttgtggaactctgggacaaatccggagtgctttaattttgatgggtggacggataactttgggaataaaggaagactaaaagatattgtaattgagcagtttaccggcctgaaagacgtgaacggcaaggatatctatgaaggtgatattgtttcttttgggagtatgtggtgtgttggcgatgaatatgaccccagagaagaagaacacatcggcctcgtagaatatcgtcccgactatgcgagttatgtggttaattgcaacgggaaaatatatccgttagaggaattaactagttttgatggatattcagtacaaggtaacgtgcacgagaacccggagctgctggaggaaaggtaactgttaaatcatgaaatggacagacaacgaaaaacatcaaattgcacaactcgttactatgggactatcagattcagagattgccgaacgtatgggcaagacacgtgcagcagttaaacactaccgtcaacgccatgttactgatattaaaattgaagattccaaagaagttacaaccgaagccaatggcgtacaaacagccacgatcctcatgcgcttaaaacatgagcctgacaaatcaccacgcacaatgcttgcgctaactggctatgatcctgataaattcgatttaatcagttctcaatacaaagtatatgaacaacactcaaccgaagatggcacagttcctcaatacagtatcacggttaaagtccgccctaaggacgacataagcgtttcagaactaaccagtgtaattaacaatggggttaagcaaaagtacttaaagcgaacaccagctgtgttaaaacgcatgctggtggttccactttacgatttacattttgggatcaacagttatgataatatgaagccgtttttagaaaaaattcaagcgattatttattcgcactcgctacaaaaaatcgttatcgaacttggcggtgacctattacattctgattacctaagaactacaaaaaccgtcaagggcactcaactagatcatgttgatagtcgccaggcatgggaagacgctgcaaattttgtcaaaaacatcattgaaccggctatcaaaaattcggatgtcgccgaattacgagccattggtggcaaccacgacttcgatatgcagtgggcgttcgttgagatgatccgagcacgatacccacagttgtcagtatttaatccgggatcgtaccggcaagtgttcacatatggtcatgtgtcgatcatgatggctcacggtgacacagccaaagcgaaactgtcacaactgttcgccaacgaatatccggctgaatggtcaagtagcgtatggcgtgagacacattggggacattttcacacggaaacagtcaaagatgatggtgggacaattcagcgccaatttggaacgcctaagcctgctgatgggtatgagatcaaaaacggctacacaatgaatcagcacgttttggaagttctggaatatgacgtaaatggtttatctgcagaatacacattgaagggaaattaggcaatgaaacgaacgacgattagaaaagttgaagatattctacgtgactatcccaagattgacaagtatatcgagaaacgtgaacaggaattacgttatccaactgtccctcgtgatgacaatgttggaggtggcaaggcacaatacaagtatccggaaacgacactcaacacgattatcacgattgatgacgatcgacgcattaatgctttgaaacatcaacgggaagtgattgacgattgtctagatgatgtgggacatgatactgaagtaatcgtaaatgaactatattttaagaaacatcagcaatacacgattgatggactaattacaaaccacttaatcaacgttagtcatactaaggcgtttaaattaagaaatgagtttattatggaatgcgctaagggattgggattatatgaaatcgcgtattaattgcgtattttcgacccctataatcgtgctaaattggtagtatgccaaatgtgattgacgtgcatgaagtaatcctcaaaattacagactggtaatcgctgtgggctaattggtaagccacaatggtatgcaggttcgagtcctaccggcgatattgttatgcagcatggtcactcatgagggctaaaactgtgtaacatgtgcttgtggcggaataggtagacgcgcacaattcatccatgtgagagagtatatgtatgtggaatgcttaagaccattggcagcgtatattgggtggctccatgtagggtgcaaatccctaccaagcacattgaaagtaccgcggctttatgaatgcccttcataaaaccacgccctttcaaattgccaacaattgaatctccaaactagctctcgcttattggcgggagtttttgtatagttatggtagtttggaggtaggaacatggaaaaatcaaaagaattactctcaatgcttgaaaatcccgagtattttttgaatgcgcagagacaaacgctagagtctcgaatcgaggcaaaaaaattgactaaaagtgaaacaaaaaaagtgagaattgaaagcgcaaaatctgttggtaggaaagcctcaatggatctattgaaccaaagctggggggatatgattgttgatatcattggtgcacatgaagagattgagggaaagcttaatgagtctaaagaagctcttttacttggggagtatttaaataaatcagataaccaggaatatgcgctaaaacggcttattaatgtaattaccgatccgtatggcagcatcttatttaataaactgcttttaatattaaaagattatccggctgatggggacatgatggatatcttaagagatacattattaaacttgtccgatgtaaataactttaaaagtgtttttacaaagtacaaatttctaatctcactaattgataggataacccctcaggctatggtaattttacaggactacttgaaatggccaccttttagtatgtctatgataatcaataacgatcacgttgaaggggatatgagtaaggaatttacggatgcatattcacactctaaaggcattgatgatcctaatattgtatcgagaattcagtattcagtacaagaattacaaaaaaatgaatttgtttttggaagccagataagtaccggtcaagttattatgcaaccaagtgaggttgggatggacttgatcggattcataaatcatggttaaagaattttacaaacggcatgtataaaattaattataaggtaaggtgtggtggtatggcaaagctgattaacacaaaatatggctacgtcacgccacaggaagcggagatggatgcccacatagataaatggatgaagcgtcgtgctaaacacaaacggaggaagcaacatgccaaggacaagaagatgccgctatcctaactgccatgcgatggtcactttccctgaccactattgtcagcagcactatgagcatgaagctgagtacttggctagtcggcaacgttgggcacgtagcaatgacaaacactacacacacaagtacaacacggttacacgttatcgtaatgaagataagcgtcagcaatacaacttctatcggacaaggcaatggtcacatctaaggcaacaagtcctagagcgtgaccattacttatgtgcttactgtaaagcgcaaggcattatcacacctgctaaaacggttgatcacattgtgccgattgagtttgacgaagcattgaaagctaacgttgataacttagctgtaatctgcagtaagtgtcaccgactcaagacagactgggaacaagtaacttatggcactggtcaaggcaacgagctgcaaagcgtaacgccgatcaatgatgtatcgtcaatcgttgtgttaatgaataaggagtgaagatattgaaaccatgttattttaaatcaagtgcaatcattgatactgaaacagttgtcaaagctattaaacaatcagatttaaagtcagatgctaggacaacagacatgaataacaggtatgataagattcctgattacaaagtaattgaatcagtaatgcaacaggaactaaccgataagcaaattgcacatgttaagagtgaaattgaaacagctgttgtacagaataagcgtagggcttacatcaaccttgacggctttaatcatagtcaaaagataaagttggtacaggtgctaagcaacaaggactatcaaattgacgaaaattcaaactggcgctggtcattactcgtcaacttattggcgcctatcgttcgatttaagcaactttaaatttatgagtgtaattgttcgtgacgataattaaaacaaaccccgccccctcatgggcacctccctgagcacacacattggaaaaaaagtgtgacgggaacaatttttgaaaatttttaggtagggggggtcaaccaataatgaaaggaggcatagaaaatgaaaaaagcagataaagacgtcaacgatggtcaattatcacgtacaccgccagcttacttaggccggcaagctaaggtcgtttggcgtcgattagtgccctttttagaagacaataccccggttaagcgcattgatagcgggcttgtagagcaatatgcttcccaatatgagatttatcgcaacgcgtataaacatatccaggaaaacggtgaagtccaagcaatctataaaacattacaagatcagaccggtaaaaaaattggtcgagacttcgtgggctacaagcgtaatcccatgacacaaatttacgattcagcggttaaaaatctgactaaactaggcgctgaactaggcttgtcgccaaaatcgcgcagtgatttgttaaagctgaatttagatgatcacaaagacgatcgaagtattaatgatcgtatgaaagaatttctaggagactgataatgaagattgatttaacgcaaacacatgatgttattggagcttatcaatcattagactgctcagcgattcgccaacaatacactgatttgggcacaaagtatgcctttaatgtccttgatgagaaggtgattactggctatttgatcaagctagcggcttttcgccatatccgagacttgcaacgtcaaggcagcgttgaatttccctttacttattcggttaagaaagtagaccaagtgcttaaatttgcttccatctgtccaaacgttgatacaggcgaaccaaccaagcttatgccgtggcaagaattcattatggctatgctggttggctggcgtaatgatgatggtggcaagcgtttctcacgagcaattgtttcggttgcacgtggccaaggtaaaacttatctgatggcgattatcactacctatagttttttgattgagtcattgggactatctaaccaagattacttagtatcttctattaattataaacaaactagtaaaattctaggctacattaagtcaatgcttgctaagattgcaacgattgaaccatttaaaacactaattcaagatagtggcttagatactcggacgttgtcttcgcaagcggatcaagtcacaatgagcaagactaataacaagctacgagcaatcagtcacgaagccggtcagtacgatagttttcatttcacaacggctatatttgatgaaattggtgaaattaaaacacgacaaaagatttctaaaattgtgtcagggcaagttaaggtgcgtaataagcaatttattcaaatctcaacggcatatcctgatcccactgttccgtttcacgatgatgagcgtatgattcagcaagccatggaacaagattatttgcgcgatgctgatacatatttggggcttatttggtcgcaggacaatcttgatgaaacttataagcccgatatgtggattaaaagtaatcccttattagatttaccgagccaacgagaagtgttactgaacggcttgacagacaagcgtgattctgacgccttgtcgggcacactcaacgatttccaaaacaagaaccttaacttgtggctagaacagtcgaccgacagctttttgaaactgcctgacgttgagcgagctattataccatcatttagttttgatgaccggcaagtatacattggctttgactactcgatgtttagtgataacacggcgctggcgtttgtatttccttatcgtgatcataatgacaaaccaagatggtttatttatcagcacagctttattccctggcagaaagctggttcgattgaagctaaagaaaagcaagacggtattaattatcgggacttagctaaaaagggattttgcacaattagtagccatccacaaggactaatcaatgacgagcaggtctaccaatggttacttaactttgttgagcgacatagactggaagttgttttctttggttatgacgcatggggactaacaccaacaattaagcaattggacttaaactctggttggccattgcaagctattcggcagcggactagtgaattgaaggatccaactaagtttttgcagacgatgtttgttgaagggtcagttgaccgcttagatgatcgaattatggaaaaggcattactaaatgctgagatttatgaagacaaaattggtattcaagtcgataaagctaaggccacattgaagattgatgtggtagatgcgttaattgatgccctattccaagccatgtatcactttgaagactttgcagacgtaaacaaccctgataaacaggtcgaacgtatgaacgaaaagcaagttcttgaatggtttaataacccggaatcaggattgctaggagatgatattaatgatttttaaacaattttttgcgactatctggcgttactttgatgtactgtgctttattctaggcatgattgctggggtatatgcagcctttttatttgggcaggcacagggcgttctagcaatcgcggtagctttatttttagttggctggctttcagaagtcgtaacagctggccaaaaaggaggtgattaacaatgcctttttttgaaccaccaacggcaataaacaattcagttagtattcaaagcgtgccagtagaagacgataatatcgttaattttttgtcaccaactggcaataatgagtatgttagtgctaaagacgctttggaaaattcagatatttattcagcagttaaccaaatatctggagacttagccacgatacaattaatggccaatatgccacgagcgcaagggattctaaacaatcctagcacgacagctaatggccacacgttttggcagtctatgtattcacaactattattgggtggcgaatgtttcgcgtaccgttggcgtaatcccaatggcttagacctgcgctgggaatatttgcgacctagccaagtgcaaacctacttattagatgatggcagtggtttaacctatacggttacctttgacgagcctaatttgggcgttcttcaatatgtaccacagtctgacatgattcatattcgctgggctagtaccgatggcggtatgacgggtaacagtccattaaaagcattatcgagtgagttacaagtcaagagttcgtctaacagtttaacgttggctgcattagcacgttcaattagcgctcctggcgtcctatctattcagcacggtgggctgctaagtgagaagatgaaagccagccgctcacgtaacttcatgaaacaggtgaacaagtcaaacggtggcccggtagttattgatcaacttgaagattacaagccactagaaatgaaagcggatgttactaagctgttaagccaaacagattggacgagtaaacaaatcgctaaagtcttcggcattcctgatagctatttgaatggccaaggtgaccagcaaagtaatattgaccaaattaaaggcatgtacaccaacgcccttaatcgctatttacaggcgattttatctgagctggataataagcttaatgctaagataacggccaatatacggactgctgtagacccattgggagactcatttgcagccaccctatcagggctagctaaagatggcacgattgccaataatcaagcaacttggttattacagcagactggttattttccggatgaaatgcctgatgctaagaatccaacgacacaacaagttgtaattcaatcaggaaaaggaggtgataatgatgacaaagaaagtgatgattaaaggcgatattgttgatgatcaaacagccggtttctatcagttctttggaatgccagcagtatcaccttcgggcgttgctgacattttaaatgatgacgatgatgacggtgatgatgaagcacttgaagttgacattgcttccaatggtggtgatgtttttgcggctagtgagatttacactatgctaaagaattatgctggcaatgtaacagttaatattcaaggcttagccgctagtgcggcaagcgtggttgctatggctggcgatcatatcaacatttcaccaactgctcagattatgatccataaggcttggtcacaaccagctggtaatgctgacgatctggagcatgaagccagtattttaaatggcattgatcaatcgattgccagcgcttatgaagctaaaactggcatggatcaagctgacttgctacaactaatggcaaatgaaacatggttaaccgctagtgatgccgtcgataaaggttttgctgacgaaattatgtttgctaatgatcaacaattgcaaccggtgaacgctatttcacacattccacctaaatctgcagttaataaactgatgaatctcatttacaaggcggataaggataaagctaagccgtctaaagaagaaaatactactaatagtcaatctgctgaattacgaaacagcaaattggctattttatttggtaaaaatcaaaaggaggccaactaatggctaatattaacacgatgaatgatgcttggattgcccaagggcaaaaggtatcagacttgaacgacaagttaaacgcagctgtccttgatgacagctttgataaagagcaatttaaagcaatgaagcaagaccgcgacaacgcggttgcccggcgtgacgctttacatgaacaattggaagaagaacgcaaggcacaagaaattgccaacatggatgataaggacaagaccccacttgatgatgatgaaaaagacatcaaagccaagttcgttgagaatttcaaaggcatgattaagggcgacccgaaagttatgaacttggtaacttctgctactgacggcggtggtaatgcgattggtttgactatccctcaagatattcaaacagccattaacacattggttcgccagttcgactcattacaacagtatgttaatcgggaaactgttacaactcaaactgggtcacgagtttacgaaaagtggaccgatcttactccgttggccaatttagatgatgaaacggctactattggtgataatgatgatcccaagttatcgcttgtcaaatacacaatccatcggtatgctggcattaccactgccactaattcgttattaaaggatacggcggataacattttggcttggttatctcaatggattgctaagaaggttgttgttactcgcaatgctcaaatcattgcggcgatgaacaaagcacctaaaaagcctactttggccaagtttgatgacattattacgatgattaacactgctgttgaccctgccatcaagtccacgtcgttcttaatgacaaatacgtctggtttcaacgaactttccgaagttaaggatgctatgggtcgctatttattgcaaccagatccaacccaacctgatcagtatttaatccgtggcaagcggattgtagaggtagctgacaagtggttgcctgacgttacagctacggcaggaaaggctcatccactttactatggtgatttgtcgcaagcggtaactttgtttgaccgagaaagcacttccttattgactactaatattggcggtggtgcctttgaaaaagaccaaaccaagattcgcgtgattgatcgctttgatgtggaagccactgatacggaagcctttgttgcgggttcattcagtaaaattgctgatcaaccggccaactttgctgcttcaactcccggcaagtaattagccaactatgtcgccgacaaatacacaatacagtgacaatctgggcggctaagtaaggatgtgatttaagtggcagccgatttaaaaacattaaaatcatctttgcgaattgacgggaatgatgatgacgagttgctaaaaggatacttgtctgcagccactagctacattgaacaggccgtcggggatgaaaatggcgttccagggttctatgaaatggaaagcgtgaatgacttgtttgaaacggctgtttacgccttagctggttcatactggtattaccggacgtcaatcacttcaaacgctgttaatccagttgacttagttgttgattcaattattggccaattgcgaggcctgtataatcaaaagcaggatgaggtggacgacaatggcgattaataagttaactccagttgactttaaccaacgtatacagattggcactgttaaaactgttcaaaaccctattaatgggactagtaagcagacatttgttggccagtttagtttatactgcgcaccctatacacgatcaattgcatattcgtatcaacttacagctgaacaattagagcaagtagtggtcattattagacataatcctaaagtttatgaaggcattaaatgccaatataaaggtaaactttacgatgtcatcaatgacagcatagatgattctagtaattatctgtcttgcgattatttgacactcaaacaggttactaagggggcttagctatggcaaacgatgatatggccgaccaactagaaagctggcttaaagacgtccacaagctagtccccaacgaagctgaacaagagaagataaccaaagccggtgctaagaagttagctgataacttaaccgaagtcacgaaaaagaaacactattcaagtcataaagacgagaagtacggacacatggctgacaatataagctataactctaacgatatagacggcgaacatgacggtagttcaattgtgggctggactaacaaattccatgatatgaacgccagaagattaaacgatggtactaagtacattaaggctgaccacttcgttgaccagaacctagacgactcacaagatgatgtctttaacgccatgctagatgaatataagaagggggacgatgactagtgttattaccagtatcacaggtagccagcctagttaacaccctaaatttaacgtggctcgataaagtctaccttaacagcatacctaaagaagatttagacaacactgatttaacagtcatgctattacaagagactgattcaagtccggcctatcttgcaaacagcacgtttaaaggattagcaatgggtgttgagattcaaatcttttataaggttaacctagcagatgactttaacccattggaagctgaaatagctttaatgaaaaatcttaaagcgtccggctggttaattgtatctagtcagcaccacacaactgacccggataccaaccaagtaaccaaaacaatttatgtagctaaaaatgaaatgatttaaaggagagatatttaaatgtcaaaacacaacattgtcaaagcaacttttgctttacttgacagtaaaggtgacttaattaaagaccctgataaaggtctatctactgatggaatttatgttgctgaccatcaaggcgaagggttcagtcaaatcaacgtatccacccttgaagcggctggaactcccggctggggtaatggacaagtcaaacgaacagcctatggtaagtctatgcccacgctggctttaaccgccttagatttagacttcaagattaatcagatgctaaaggggttcacacaaagcgccaatacaggtgcatgggtacgtcaactacctaagcctcatgtggcaatgattgccgaatcacaatcattagatggggatatttcaatctacgaatgcttcaataatgttgaatttgttgaagaagggtctaacaactcaactgataccaacaatgaagcggcttactcaacagccttacatggtaccgtcttaacgccattgaagcctaccatcttcttagctgccaacaaggtacaacaaccttatatggtcgctaagtcgactgataaaggctttgacttaaccaagctatacgctgaagtatttggtggctatgtgttaagcccatcgagtgtagtgcctggtgtaggacttggtaaatagcaacaattaaaaagcttcccttaactgggtggctttttaatacatacaaatttaaataaaggggtacaaacaattatgaaaatcaatgctaaaaactattttaaaatcaacaagatggccaatgtaacaccaactaacaatatcattcgattagctaccaaggttcaaattagcatgctggagtcacaggacactgaaaaagagatcactgaactagacgcaatgaaaaatggcctggaattgcaggacgatatggccgattttgtgcaacgtgtaatgggctacactgatcagcagatggaaacgattaataacactatctcaattgaacggtttggcgaaggtgtcggctacttaattatgcgcttaaatggcatctcagacgctgacattaagctgtctgaacagaagcaacgtaaagccatcgaagacgctaagtcgtcaaaataaaccggcacaaacgcaacagcgagcttaaaaaggaagtcctaaagttgaaaaaccaacaggaagacttcaacctactagctcaacaattattaactgaggggttatcaccgaaagaatttgatgatagctccttctttaatatgatggctagtttaaacgctcgtaaaaaggaagaccgtgctgaactggttgacccgctagaggccattaaccaaacgtatggcttataagcgcttgtgccaaaaaggaggttaaaaaagaatggctaaaaaagtagtcggccgtgagatgaccagtagggttggcctagattcagcagaagctgttaaatcactcaagcagttaactgctgaggttaaagccaatactagtggctggaaggctcaggaagtcgcactaaactcggcagggaaataccaagaagccgcagcagctagggtagacgggttagctaagtcaatggagatgcaaaagtctaaaattgatgagttgaagaagcgtcaatctggtctaaataaagacactgaagatggtgcgcttaagtatactaaactgactgatgaaattaacaaggctaatcggtcatatgacagtatgggtggtcaactagaccgagctaaaaataggctacaatattacaattcaggcttggcagacctacaaaaaggctataaacagagtacggctttaagtaagtcttatgttgaacgcctagaagctgaaggcaaacaagaagatgctaataaggcccgtttaagtggtttaaaacaggcctattctaacattcaggcccaatacaagacccaatccgatgagctagaaaaaattaaaaaagctagtggtgacacttcagacgcttacaagctacagcagactcgtgttaatcagactgcaacagccatggctaaggctaagactagccaaaatgagctagttaaggcgatggaaaaagaaccacatggctttatgtcaggtgtacggtctaagttagattccgttgatgacaaggctaagaagacctctcatttatttggtaccatattaggtgcccatctagttgctaatggggttaccaacgctttatcgagtataacggcatcttttggcgaacttactagtgctgtaacagaatatgataacaagcaacgtacaatgacggccacatggactactttaactggttcaaacggaaaaggtaaacaaatggtcgacattggtaatgggttagcctcagcttttaatcaaaatatcaatgtggttgatgaacttaaccagtcattttaccatgtgtttgataatgcaccacggactaaagaattaactaagtccatcttaacgctgggtgatacgcttaacctaagtgatgagaatgttactagattaggcaccaacttcactcatatgctatcaagtggcaagatgcaacttggcgacttcaacatgattaacgaccaattaccaatgtacgctgaaaaaatgttggagtttgaaaagaagcaacagcataacagtaagttaaccatgtcaacgctgcgtgaccagatgagtgccggtaagattagcgctaaagacgccgaagaagttatgaactcacttggtggtaagtatgccaaggcttcagaaaacttgatgaagaccatacccggtatggaacgatcaatcaggactcaaatgccggcgttattagatgccgtttacaagccgattgcaaatatgaagtctccgttaatgggccagtttaccaagtggattggcgataagaatactaaagctgagtttaaagatgttggcaatgcactagccttgcagattaatgacataactaaagcgtttgctggtaaaaaatttaatgttggtgatagcctcaataagatgttgtctaatctagcaaaaggcattgataaagtcggtgctaacatcattgctcacaaaaaagagatcaagtcattctttggctcaatgaagaccgcttccaagacatcttttaacgtatttgtacagtcacttaaggacatcgagcctatactgaagattgttggtggatttgctgagaaacaccctaaagtatttgctggtttggcttctagtgcctttgttgcaagtaagggtatatctgcattaaaactagccttcagtggtttagacttggcaaagggcttaggtggcaagctcagccggattgtgttaaagccaaaggttgatggagctaaaggtgaacgagaactaaccaaatttgcaagctttgtcaagcgttcagggactggaatgggtcactggttaaagatggctgctagtgtaaccactgctaaagctaagagtggaattagtgctttatggacacacactaaatcagtcggtggcaagatcggcaaaggtctaaaatggactgctaagattgcttataaaggtgcatctaaagcttttagtgtcttagctggcggtatcaagttggttggtaagtcgtttttatcattgggcaggctattattaactaacccaatcggcctagttttaactgccgtggttgcgttaggcgtggcattctacgaggcttacaagcatattaagccgttccgtgaatgggttaacaagacatttaaatcagtggttaactttggcaagggtatcgctaaatggggttcaaatgtcggcaagtcggtaggcaaagcgctaggcaaagttggtaacaccatgggtaaatgggctaaaaccactaccggtttctttaaaaaacacaagaccgagatattaactactttgattaacccatttgcaggcttagctacatggttcttaaaggacactaaaactggtaagaatattcaaaagtggtctaaaggttttagcaaagacattcaaaaaatgggctttaagaaagcgatggacaaacaggtcaatgacgcttctaaggcgtttagcaagactaagttcggcaagtggtttaagaccgtttcagatagtttcaacacttggaagtctagctttaagaagagctggaacagccactggtcagacatgggtaaatcgctcaggaataactggaacggttccgttaagaacactaggaacttctttagcaccgttggcaataagtggaatggttttaagaacagctttagaaagggctggaacagtcattggaatgatatgactaggaacttgcatggtgcatggaacagttcttataagcataccagagacttcttttctagcatgggtaagaagtgggacggttggaagtctagctttagaaagagttggaacagtcactggaatgatatgcgttccaacttaaatcactattggaacaggtcatataagcatactagagacttctttagtagtatgggaaccaagtgggctggctggaaaaagagctggtcacatagttggaataaccactgggacaccatgcgggctaacttgcacagctattggaacaaagaccttagccatactaaagtgttcggacactcaatgggtgactggctatcagcctttaagaagacatttaatggcggctggtctggcttagtaaccggcgttgagaatatcttcaaaggcctttggaaggatttaaagaactttgctaaagatggcatgaacgatgttatcgaccttatcaatggtggtatcaatgcggttgatagtgtcatccatacgtttggtggtaaaaagaaaaccattggtgatttaagtcatgttaactttgccactggtactggtgtgcttagtgggtcacgtaatccgattaccaagcctactatggcaatgttaaatgatggtaatgacagtccgcaaactggcaacaaagaaatggtcatgctacctaatggcgattcaggcattgtgcaaggacgtaacactaagatgatgctacccgctggatcagaagtgctgagcgctagtgagacagccatgctaatggcaatgcaaggtgttaccaagtacgcgaaagggactggattctttggtgacattttaaacagtgtcactagtggtatttcgggtgtgactagctgggttggtaaaaaggtaggaagtttagagaaattctttaataccgctactaacatcattgctcacccaattaagtcgcttgaaaacctgtttagttggtcttctaagggcgtatcaggtgtcatgagtaacattggtcatggactattcaatggtgttgaaaaacaagctaagacatggtggtcaaccctatggggtggcgttagtgacagcctagacagtggtgcttctagttctagcctagttaatgcgatggagaagtacggtgctacaaacaagtacgtttggggtgctgaaggccctagtgcgtttgactgttccggcctggttgagtatgccctaaagaaacttggaattagcttcccacggactagtagtgagcagtacagggcgtctaagagtgtcagcaatcctaaaccgggtgacttggtattctttggcccaggtggtagcgaccacgttggggtatacaccggcaatggcgagttctatagtgctgaaaatgagcattctggtatgggtatcagtaaggtgcatggcggtggctatggtacgtttgctggttacggacgagttcccggtttatctgatagcactagctcggataaggcatctaagtctagtggactactcggcaccattaagaagcaagtaggtagtggcttctggaagttcatcagcaagttagccgatgagtttggtgatggtggtagtagtaaccccggcggctcaggtgttcaacgttggaagccagatgttatcaaagccttgaagaagaacggctttgaagccagtgctagtcaagtatcagcatggatgaaagtcattgcacgtgaatcaaacggtgacccatcagtggttaacaattgggacgctaacgctagaatgggcattccatctaaagggctggttcaaactatccagccgacatttgatgcttacaagtttcccggccataacaatccacttaatggttatgatgacttgctagctggtatccactatatgaaggctaaatatgggtcaggtcctagtgcgtttgctcgtgttagtggtcctgaaggctacgaaaacggtggcatcatcaacactaatcagttgattgaggtcgctgaacataataaacctgaaatggtgctaccattgaccaacaagagtcgggctaaccagttaattgcacaggctagtcaagtggtaaatggcaatactagcacgcagattgcgtctaatagcagtgaaagtagtgagaagcttgataaagtcatctcactattggcggctttattagctggtcaaggaaacgtacaagccgttatttctaacgattccatagttaatgcaaacaagaattacactaagaagatttcacaatactcacaaatgatggggtactaatatcccagtcaatcaaagggttgtccttaattgggcgacctttttacataattaaacttaaaaggaggttaaatcgtgaccttacaacgagacgattttgaatacgctaacttgaatagccgggacgatttacaggttgagatgggtaacgtggtattacctagtgcaccggccatggctgaacaggtgactgatataccagccatgtatggtaaccaatttaatggcacagactttaccagccggtcgattagcattccggtgtcaatctactgtgctgataatcaagacgcctttaatcaggtgatgcacaatttaagtggtctgctattaagcgatgaccccagtgataataacaaggagtatccattaatctttggctttgaacctaaggtgacatattggggacatattaccgcaattagtgacccagccccgattaacccgggtatgtatgacatgacactaaccattacctttgtgcagtctgatccccgggcgaccttgccacaggttgagaagcctttaaataatggcttaaatacgattactgttgatggcactgcacgaacagagccggttattcaggtcatccctaaacgagatttaaagtatattggctttagtttaaatggtggtcagtttggcttagggcctgagtcacctggagaccaagccactgcggttcaaccttatactaaagttgttgatgacccgctaggaactatggcaatgtggacaaatgatgccaatgcacttagcaatatgaaaactggtgaagcttacacgtatcaaggccacagcgagattaagactgaaactaatgtaatgcgaccaactgtaaatagcaatgggtatgactttggaccgatgcctacaactatggaagaccgctggtatgggccagcttatcggtatactggcatgacacaatcacttacggactggcgagtacgaacgggtattcatcaatttaggtacaatggtactcataatagtcgtgcaatgggacgtgttgaagtcttgctactagaccctaacggtaacactattggacgctttggtatgcgtgacatggcctatggtgctaaaccaatggctaggcttcaaatatgtgagcctggatcaacattagaatatggtgacagatatactgacttgtattatggttcagggccatcaggttcttttacgaataagcctgaccagaaaattcaaatcaaaactggcacgacaaccaaaactgtcactaaatatggtcgttccagaagaggaaaagtaactaaacaaaccattaaaaaaaccgttgatacctatacaaccgtggtcaataaggaggaggactccgcactggcaggtgcttggttagtgttggatattactaaacgaggacaagtattcacatggagtatcacccagtattcgactaaaacaggccgaccattcctagaccctcatattcacatgttagtacatggaacctatgttgatactcaaaataagtatcagacagccttaggtggaattgggtctgtctttctaaagcacccaattacagaagatattcataaagttgcctatcggaacccctttatgtcaatgactgaccttcaaatatggaaagtcaataaagttgatgccacaaagccaacttatattgctggtgccggtgaagaaattgtaatggattgtgaggcagatacagttactgtaaatggcaagctagtttcaccagtttggtcaaccgactttcctaagttgaaaccgggcgttaatggcttgtcgatgattggtgacctagatgacgctcaaatgaccctaaaatatctacctaggctactataacaacactttaaaggcttcccattaagggtggcctttttacataaataaaacaaggaggctaacagatggctttaaataaccagtatttaatcctagattctaatttaaagcggattggtaccctgactgttgatggtgccactaagttctctaacgacagcgtcaagattcaactagccgactcagacacgaccagcactagctatgacgatgatgccaatattggaactcaagataattttaacggcacgattaatctaaatgcccagtctaagaagttcgaccatcaaggctcattagacgtgcttcaaggccaaccggattcagataaagtagtggctggtaacaacctagcttattatgacgagccatcaggtcattggtatgtcatgcacatatacagcgtggaagaaagcaatacagccgctactaagcatgtcacaacggctaactttactaatctatgcttatacacactagcgcatcattacccagtggcaattacggctagtgctagttcgattcagacggcttttaatcagtgttttaatgccactggctggacgctagactatcagactactaatgtgatgactccatcgattaccattgatggtaaaacaaaagctagtacattagtacagacactcatccaagcttataacgttgagattgacccttatgttgagattaatagccaaggcaacatcacgaaaaaggtgtgtgtcattactgaccaacttaatgctgatgtggtctacaacgaggcggtatttggtaagaatatgactagcttaaagcgaacaacggtgtcaaacccaatcactaagcttatcccttatggtgctaacggcaacacaattgggctagtcaatgatggtaagtcttacattgttgatgatgaagccaatcgagcatataacccggactggcaagctggtttgtactatgagggggttgttacagctaactcaattgaagacccggctggaattaaggcctgggccgaagaaatgttgcaattgtataatcacccgcggacgtattatgaggttaatgtaacgtctaattttaacccgccattaggggccagtattcgttttaaagatgagttaatcaagccggcattaaatgccagtggccgagtcattcaacggacaattagtttcgctaacccttatggcaacacagtcggctttggtgaatatgtcacggtaccagttgcaacaccagcctggatgcaaggttatcaaagtgctattaatagcgccattgaaaaggcaaaggaggacgctagctcggttaaaccagtggctttaactcctgacggcaataatttcactgatactacccagactaagcggttaatcttacaggcttgggaaggtaacactaatatttcagcctatattgataacaaggggtttatttggcaccgttataatactgacggcacccttgatactagtttcaatcaaactggctatttagtacaagcagcatacaattccgttggcacactgcacgggactattgagaccagttacattcaagatgaaccagagattaagttacaaactagtgctattcgtaatttgggtagttttagcccagacgacagcacactaggaataactgaggcggcacaatatatgtgtcctttgagcaacggtcagtatataactagtcgggcaattaatcaaagtacaactggagataccatgtttgtcttacatgacactaattttaagccgattagtaagatgatcatttcacatggcgggcatggttcaagcttctcgattgaagaagtagatggggctgtttacatttggtctataactaagcctaatttaaacgttaacgaatatgcagttagtcgtataccctaccttgctaatgtaaccctaggaaatgatgatgatagaatcacacgtttttgcactgtcgatcgttatataagagtcagtgttgatttcaaacacgggtacgtactatgtggctacgtgaatggcaagcatgatgtgctacgactcgatgacgttaaacaaggtaattatgatgtgctatatagttttgatgttgccaactatgggtttgactggaaccgacaaacctaccaatcacaaggcattgactttccatatgtttactttcactcgggtggttacaacatgaaagatcctcgcatggtgtacgccgttaatgttgttcatggtgggcaagagttcgcctctaactacttactggatatgaatttagggttaaccgatgacgttatcgagcctgaaacatgcaacattatttatgaccagaataaccagccggagctattggctactttcaattgtaaatatcaaggtaattatttagaacgcgtctttgtaataccaattaaagaacgtttgccaatgattaagaaaggaggtgaattaaatggctgaatctaacgcaacacaggtcattctaacagatgatggtattaagattatcaaggctcaaaatacggctgagaatgccactagtgggatcaccaatttaaatgaccccaacttaatgagtgtcattgaaaagcaggcacaggcctcacagtatgctggattaactagtcagtataatgtgattttaaagcgagctaaagatgccagcatcagtacgactgctttaaccacggcctatgataaactgaacacctttatggcggccatcttaacggataccactaaggccagtgattttgaccgggacacttataagagtctcacagacgcttacaattctgctctaagcactgtacagaacgccttaagcaacagttataacactgatattagcaacatgaagtctagtgtatcggtagctagtcaagctgcttctagtgctgtcatagtagcatcacaagcaactgcaacgggaaatggtgctagtcaggctgcatcacaagcccttggggcagctaacgaagctaaaagcgccggtgagaatgctaagagtgctgctgctgaggcacaaaccgctggagaagacgctaaaaagcaggttaaggatacccaaaataaaatagtatattatgcttcaatctcagatgaaaaagacattgctatacccggcaaatatattatagttaacaccgacacctatattaaagacggtacaattaaaactgcacatataggtgacgctgcaataactaaggctaagattgataaactagctgttggtgaggcacaaattgaagatgctgctatcactcgtgctaaggttggcaaaatggctgttggtactgctgagattgaagatgcatctatcacagatgctaaagtaggcgacattagtgctaaccatttaaaagttggtacgattgactttaataagattactggtaaaaatattaacgcatcaaacatcactactggaacaatgagcactgaccggctagatgttaataagctatcagcattaagtgccaatttaggcgatgttactgctggttcacttaaaggtgtcgacattgtggctaacacgtttagcacgcctaatggctcattcacaaccgatgcaagtggcacgataaaggctaagaacatgacgcttattggtggcacgttaacctcaccaacaatcaatactagcacgattaatggttcaactatcaatgggacaacgttcaatgccggcgacagtattagtaattctaataatacgagtaatttctatccattcaccattgaacctactggtaaagcttccacgacactttttaattcagtggacgctctaagaacagagatgagtggtggcggactaagaaccatgtatcgcgccataaactcttccggaagtcaatatgaagcttatgatggcaattttagtggcgatatgatttctttgaactctggctttactaatggcaaggatatgtcattctcacaatccgtttctggaagccaattaactggtcaagttctgatcagtccgttgaatgggctgacgctacacggagatactcaacaaatcacctttaatggtacttctgctgatgttacaccgaagggcatcattattacgccctacggcaatatcaaccctaatggcacacaaaatatttggtatgtcggcaataatatgaatatgaagacagccagctttggcattgacggttcgggtgctaataatattcagttcaatcgttctttagatattggcaacttcaacataaatacctatcacacgattaccagttccgacaacggcccgatccatttcaatcgtgctaatggcaaacccgtcgacatctacgctagtaccgttcactatgatagtctagttaaatcgtccctattaagtgttaagcgtgacgtgcaaaaggctgatacatcctattgggcgcagctagttaactcaattgacttggcaacataccaatacaaaaccgacgataataccagtcatttgcgattatctagcattgttgacgacgttaatgtaacaaagcagtggcaattgccagacgtgtttatcagccgtgatgaagacggtaagctgtgtggggtagatgacagtgtacttttaaacgccaccctagccacggtacaggaacagcaaaagcagattgatcaattaaacgggcacaatatggaactagaggctagattaaacaaattggaggccaaattaaatggatagcattttaatcacgaattataagccggattacacgaataacattatgacaatcagtattcagattaacacgctgggtattagctcacaggtaagtattaccatggacgaatttaacactgccattgctggaggtgctgggggcactgatagggttaaattgaaggtgttgaatacgctgattgacagtctgaccgctttaaaaccagttaccacaactatgacaacgaccaatactaaggaggcttaaattatgaatgttgatgcacaggctttaattaacaagctaacaagtaactatgcccaagcgattgcccttaaagaccagcaattagcgatggcacaagttcaaattgaccagcttaatgccaagttggctgaaaaggaggcgcataaagatggcaaaaacgcttagttttactgatatgtccccacggacggttaaaattggtgatacgactaccagtttcacgttaatttgtggcaatgataatggggccactgatttaactaatgccacttcaattactgttaaattgggcaatgctagtggctaccttaaatcggccacagttgacccagctagtctaacggacccaacggctggtaaaattaccgttgcttttaatgctgacttgatgactagtttgccagctggtagctatgccattgaagtgtgggtggttgatagtaccgggacgtcaatctaccctagtgatgggtcaaccggttttactattaccaataacattcaaagtgccaatggtagcacgattacgaccattacttttgatgactttgtgaaagcaatgaataaagccgcaagcacaattgctaaaggtgacaaaggtgatacaggaagcgttgataatgctggcttgaccacagcaccagcttttgttgagcttaaagcgcaggttgataatagtgccgtgggtatcaacctattaacaggtaccagcaatcaggtggttcaagccaacaattggaatatgcaagttgctgacatcaaatatgataaaagtcttggcaaggctctatgtgcgtctgttatgattaacaacgctgactacgcaagtaatttattacgagggtcagcaagcattaggatggacacttttgacaaaagtggaaaaaccttagcaacagtttggggtgtaagtgttaactataatgccaatggtctaagtcagtgttccataaacattgatgataataccgcagaggtcaaagcgcatatcttgacgaataacatgaatgataacgcattttattcctgcttaaaaattgagcgaggcaccaaagctacaccatggtgccctaatccaacagaaattttgacacaatcagattacgcaaaaataaaagcggctattgtagcgctagggggggctttgtcatgagttttgatttaagcgaatttttaacagaaggtttaattaacagtgttaacaatgggttaattccatcagatttagtaactgtatatgctggcaattatctagtgaaatcactaattacccaaactcaggttactcaagtatcagaggcaattacagcctacaaagctgcacaagcagaagctactgctaaggattcaaaagaagctcaagaagttgctacgcgagccgattcatccttagctgcacagacagaagctaccatagaccatagcagcgcacactaagaggtagacaattgaataataacaaattaaaggcactcatcttaatggcgagcgccatttttatggtctttttgatggccaatgttaccagtcaggcttcaactagccgtgaccaaggggttgattggtctaagtttcaaggcaatagtggtgtatttggctacaacactgataagtttgtattctcacaggcgggtggcttctatggtgggactaatatccctcagaccacatatgctagccaagttaagtcagctcaacaggctggtaaacgggtgcacacctatttgtgggacggggttgggggcaatatgaccaatgccaaggcgatgatggcctattacttgccacgagttaagacgcccaagggtagtattgtagcgctagactatgaggacggggcaagtaatagcgtgacagccaacactaatgccgttctagcccagatggccctcattaaagcggctggctataccccggtattatactccggcaaagcctatctaaatgctcatgttaatgtgagcgccattgtacgtgcctatggtagctgtctgtggttagctgaatatccggattatctggttagaactatccctgattataactggttcccaagtatggacggcgtggctatcttccaattcacgagcatgtataaatcaggcggattagacggcaatgttgatttaactggcattaccaagtcaggctatacgactgctagcaaggctaaagcacaggccaatgttaagaaggctcaaaaggctaagaaggccacctttaaggtcattaaatacaaccagcgaggggtgttctatcctaatcaggcactagctgttcgctacacggatagtgacaaagttagtcaagtggctacctattacaagagtgagagtgtaacttataacgcggttattattgaacacgattatgtatgggcacgttacacccgttcaaatggcctatacggattcattaagctaggcgtcaccaatgggccagcctacgggaagcgagttactggtcagccggttagtcatacgtactacacagtcaagtctggcgacagctggtgggcgatcgcacaacgcaacggcctgagcatgactacactagctagccagaatggcaagtcaatttacaccactatctatcctgaccagcgattggtggtgagataatggcacaatatgatgacacaactaagttattaatggatattcaaaaggatgtggccgccaccaaaacgaaagttgagaacatcgaagaaaagctgaatcaagttgacgatattggcgacaaagcggacaaggccctagccaagtcaatcgaagccagccatcaaattgaccgcgtgacacagattcaaaattggctaatcggtgtcttggttagtggcgtgctcgtcacgttagttatttacatcgcagaaaagttcctttaggaggtaaaacatgattaaaaaaattagcttcaagaatgtcgatggtagtttgaatggtaagttgattgctgggattatttcgttattaattgtgttaatccaacaagtctttgccatgtttggcattaaatttactggtgactggacgagtattgtggccgttgttaacacggttctaactatccttggtatgctgggcgttattactgacgttcaaacagtgacaacaccaacagttaaaagtgacgaggaaagtcaggttgaaacgaccgctaatgcggttgctgacgaagcgcaaacaccaacgtccacagtcgctgtagtgaatagttctgcatcatctgacactgaaatggcgtcagaatccgcctcacaagcagcaaaatagtgctataacttgatatagagtttaattaattgtggagcttgatcactctgcaacttttcccctgcgtttcggcgtgggggattttttatgtattacccgcctaggaattttggtgcacatttggtgcacgccgtgaaacaaaacgttgctatgtcagtacctaaccaccgtatactactccgggtggggtcagttgaatattagaaagcaccgtttcagggcagcgttttagtgacgttaccttggaacggtgctttgggtttaagtagccacaaatgatatgaaatcgaaatgaatactgtattagtctaaacgcccgctaccagtccaaatgactagtagcgggcgttgcgattaacgaatgacgatgacgttgcaaggggcgtgatccacgacgtagctggtcgttgaaccaacggctacgcgatggggcgagttggtaccagtggcgccgagcacgatcaagtcaatttcgggatgttgcttggcatagtcctcaatggtgtgttttggaatcccgtagctgatttcagtttttaaattcggtgcggacgtggtggcgacgaattgttgtcgctgccgcatggcatcctttgcgtgagcggcttccgcgtctagtaattcagatagaaccgggtcgagtgcgggggtgtggtaggcgctgtcatccaccacgtagagcgcagtcaggtttgcttggtgccgctgggcaatgttgaccgcttcggtaaaagcggcttgtgcagcatcggaactgtcaacgggtactaaaatatttgtgtaacggcttggcattataaccacctccagttatctttacgataattataatggattagtgtcgggcaataaaattaaacgcacctagtgggcaaggtcgatgaactagcgtatattatagacagtaaatttcttttgggggttaggtatgttaaagcatgtacagaacagcctattgacctttgaacgggtcgttgagcggcaacgttattggcgcgccttacgtgatacgttaacgctgctttttccaatcgcattagttggggcgtacgttagttttatgaaccaggcaatctttcagcgcaatggttttttgaatcatatttattatctcagtcactggctgccgggttttaaatatttggcagcttacacgacgatgcttaatctgagtatcaacggcattcttgccgtgattgcggctttttcagccgctaattttgtcgcgcggagtgctcagcgtgataatttgttagcgggattgacggcggcaattagttttatcatgcttaatatcaattataatttttttagtacccagggtcagcctgctggcagtcggtttttagaagataatttgggaactcagggcatcttcctcgcactattggtgggcctgttgactggttggttgttcagtcatttgacacggtatccacacatccaccaggagatcgagacccagacgcacttgctagcgcgggcacacgcgaactggttaccgatagtcgctgctctgctggtgttcagtgccatcgggtatggtattagttttgtcagtaaagggggattaaacggcctgttttacgcggtcttcaccttaccattcagtaatccgggggcgtcgctactagcgataattggcgtggcatcactcagcaatttatactggttaattgggattatcggtccggttgactttagtggtaacagtactacgagtacggttcaaaatttggaatatgcgttgcaacacggttcggcgtggggcgcgccaaatccagtaacgctccatacgttatttgatgcgtttgcgaacgtaggtggtcccggaatgacgttagcgttattgattgcaattttgtggcgttcacgtaaccgtaattatcgaacagtggccaagaccagtgccttgccagtactgtttaatatcaaccaaccgttgctcgtcggcttaccgattgcttatagtccgattttagcgattccgtttctgttagcgccactggctagcatggtcatcacgtggtgcgcgttgaagcttcaatggataccgccggtcgtttatccggttggtagaacgatgccaggcttcttgaccggttggctgggaactggtggcgactggcgggccttcatcgttagtctgatcaatatagcggtggccacagcaatctacttgccatttgtcttactggcaaaccaggttgaggaggaggcgaaggcggatgcttaaacgatattggtggcggtggcttcttggaatcggtttgttagtcgggatctgttggccggcctacacgtggactcaagtgaatatcaagacgctgaaaaacactggtcggacgcggatggcaccagttattatggtccccggatcgagtgcgtcacagaaccggtttgatagtttgattaccgagttggggaaggaaacgccgaaaaaacacagtgtattgaagctgacagttcagacggatgggacaattaagtatagtggttcgattgctgctaatgataatgagccgttcatcgtgattggcttcgcgaataatcgtgatggtaaagctaatattgataagcaagctgtctggttgaatacggcattcaaggcgttggtcaaaacgtatcactttaatcacttttatgcgctaggtcattccaatggtggcctcatttggaccctctttttagagcgctatctaaaggaaagtccgaaggttcatattgaccggttaatgacgattgcctcgccgtacaatatggaatcgacaagtacgaccgccaagacgagcatgttcaaggaactttaccgttatcggactggtttgccggaatcgttaaccgtttactcgattgcggggacggaaaactataccagtgatgggacggtgccgtataacagcgttaactacggtaagtacatctttcaagatcaggtcaagcattttacggagattactgtaacgggggcgaatacggcgcactccgatctaccacagaataagcaaatcgtcagcctgattcgacagtatttattggctgaaacgatgcctgacaaggttcgtcaaaaaaacgcacaacgggtacaaaattagttacgttgtgtggcagtgctactgctgttaagacaacactggtgaacgatctggttaagaaagttatacatgcagtgaatagaacaacaaaaacgattagcgtctcgtaaccgggacgctaatcgttttttagttagatttgcaataaattaatgatgatgcctagcgttgtgtgagcgggctgaccgtttcgagtagtggtgcttcgacggcttcgcccggtgcttgactcgcattgtgacacgggttccccgaactcgcaaggcttgtgcattggttgccggcagggtcagtaaaccgccacagacggccaggatgacgagcactggtaatcctcggtggatcgacatgatagaacgcccccttaactaaagtccttatttagtgtataagtaattcgagtcagcgtcaacctaaggtccgttactgactttacaaaacgttaacggcatattaacggattattcacaaaaagccgtcaaatttgattgtattttgccaagttttcctttatggtgggagtaatatataaaagggagtttggctaaatgaatattgaaatcttaaactcagcaatccaagacttacatttccaaattgtttatgatcgttctgaagacgatgacaatcctggtcagggtcaattcagctatacgaccgccaatccagatgttaagaagacgtttggcgatgacgttgtgcaggcccaattacaagtgacctataaagaagaaatgttcgacttatccgcgaccgtttttgcgattgtacgcctaagtggtgagatggtgggaattattgaacgtcaatctgacaacaaatcaattgaagacgacgaacaagaaatgttgaacaatttgaatggtgccatcattccagcgttgtctgccaaagtccgggcctatgcagcattattgtcaactgaagctagcaactttgccatcatgccagctgactttgatgatagccagcccaatgatgctgaataagcgtaatccaagagcttgtcaaactggcaagctttttttgatgacttaaggaatgagttctagcgttgtgtaaccgttaacaaaggtgctataataatgatggtcagagttgactaggcaactgcggttgcaatgacgaggtcagaaggtctgattggtgacttcagcaattattactttgatccaggcttatcggaatggttcaaagcgggggtgaccgcaagtcggtcagcacacataggggcagtgaatattgacacatagtttgagccaagctggtaagtatcgtggtggccaagttacgctgtaatttggccgctatttttatcttattttcagccgaacactgcgacaaaaaatgaaaactgtcgtgatgaaatcactgtaaattgtcacatgaaagcgtatactgacggtgagaggggtgagtgttatgtttaaaccaatggcatctgtttttacgaaccatcaaattgcgggtcattatcgggccattgagcgggcgcaaaagtgcgtggttccatttcattttgagattcagggacaggagtatccaaagccaaaaccagaacgtaactggttacggcgcttatcggggacgtcgagcgagaagtacgcaatggtcgaactgaccccgacaaaggtcgttttgtggtcaccagaaggacgcaatctgggtgaaatgccactgagtgcggtgcggcgaattcagatcggtgcgattcggtgtcacgtaacggaaggactcgacccacgccacgcatttcgggcgacgatctttgtgctgactgatagcggtaattattattttgctaattctgatatggaagttttaccggcgatttgtaagttcgcccatgaacatcaagtgccggtagaagacccactgcggttgattccgcttttaaaggtcggttggcgggtcgcggccgtgacgttacatgagacctatgcgcaactggttgcgcacacgggttacccggctgataaggtttaacttaattttatgattaataataatgaaaaacggactgtcgataacgacaatccgttttttactgcggttaaatgtagttggcttaaactaagccttgcgctaacatggcgtcagcaacttttgtgaagccagcaatgttagcaccactcaggtaatcaccgctaacgtggtattcgtcggcagcggcaacggagtgtgcaaagatatcttgcatgatttgcttgaggcgattatcgacttcttcaaaagtccagctcaaacgcatactattttggctcatttcaagggcggaaacggcaacgccaccagcattggcagctttggccggaccatatagcaagctggaagcttggtatgccgcaatggcttctggactgctaggcatgttagccccttcggcaacgaccttggcaccattggcaatcaagttcttggcttgatcaccgctgatttcgttttgggtggcgcaaggtaacgcgatatcataagctacttgggcgtcccagacggaaccttcgtaatagctggcactggctacacggtcggcatagtctttgatgcgaccacgttcaacttccttgatctgcttcacgatcttgaagtcgataccgttttcgtcaataacgtaaccgtttgagtcggagcaggtaatcaccttgccaccgagtgcttcaaccttttgaatcgcgtagatggcgacattaccagcaccagaaatggcaacgcgttgaccagggaaggaaagttggttggccttgagcatttcgttggtatagtaggcgagaccataaccggtagcttcagtccgggctaacgaaccgccatagttcaaacctttaccggtgagtacgccgcggtcagcgccccggagtcgcttgtattggccgtataaaaagccaatttcgcggccaccaacaccgatatcaccagcaggaacgtcggtatcgagaccaatgtacttgctcagttcggtcatgaaactctgacagaagcgcataatttcgttgtctgatttgcccttagggtcgaaatcagagccccctttaccaccgccgattggcaggccggtcagggcatttttgaagatctgttcaaagcccaagaatttgacgatactcagattaacggatgggtgtaaccgtaagccgcccttgtatggaccgattgctgagttaaattgtactcggaacccacggttgactcgtgcatgactagcatcgtcgagccaaggaacccggaattgaataatccgttctggttcggtcaaacgttccaaaatattggcttcgatatattctggatgttgttcgaggactggcgtgatcgttttgaagacgtcgttgatggcctctaaaaattcggtttggttcggatcacggtgttcaatgacttggtaaacgtgttggacataatcagttgcttgactcaatatgatcatccttccttgaataagttaactataatcttcattttaatggtcacgttcggaaattgcacgagttaaattaactaaattttgatgaatttttagtgattgtggtaaaaccgtgctgttgatagcgcttgcgatttggttcggcggactaacaataattcgcattttaatgcaaagtcagaagtgagggcgtatgcttgtgacaattaaatagtagtcaagtcagatttgacgggcgactcatcaggaacaggggggatcatgatgaacaaacggcgttggttattaagtttattgccaatcttactggggttgattggcgtgggtgtgtggggatcacagcaattaggtcaaggagcacagcaagtgacaccaaagacaattaaagtacagcaggcagcgtcaaaaatcaaatccgcgacgaaaaagcaaacgacgactaagcctaaagtgaagcccggccagcttactgaggcccaggcaatcaagcaaatcgatcagttgatcaaaagtcatcatattatggggacactattactgaccacgaacggtccggcgggggtccgggtccggacgtatggttatgcggatgatgccaatcaagtccgcaatactgcgacggaggcttacccattagcatcattacaaaaagctgtgactggcgtgatggttcaaaaactgatcaatcagggtaagttgagtctgacgacgaagctgagtcacttttatccggaaattccgtacgccaaccagattacgatgcgtgaactattagaccatcgttccggtattcggatgactgagatcacaccaaagacgattttgccaacggagacggcgcggctgaactttacactgcaacatttacggtcgacgaataatcatgcttatgcctattccaacgcgaactttaccttattagcaggggtcattcgcaaagtgacgcataaatcctatcaggcggctttgactaatgacatcattcggccattgggattaaaacatacctatgaatataacgatattccgggtaatgtgatcaacccgacttcgtatcgcttggctaatgggtttggtcagagtggcatcatttctaagccgttacaatctagtgaattaggctgtggtagtctatatatgagtgtgggggattattataaatttatgtatgggcttcagagcggccagctagttggcgaagccggtttaaagtcacttgcggataattttcaaattaaatattcggcaggcgtttattaccaggcaggccagttgattcgagtgggtggcaatgacaataattttcatagctactatatggggtcacgaaatgccaaagtcgccttagtcttatttgaaaatcagggtgtttttggtggtgacaaccaggtagcgtataagattcgtgatattttattgaagacggtacctttttagaaacggtacgggctaaacatcatcttaattgcaggagaacgtgtgcctgcaatcaaggtggtgtttttgcttacccgtccgtttggctgaatccttgaaaataactaaacttttactcgaaatgatggcgccacgacgtaactaacgctatgatgagattagaaactaaatgatgcaggtgaaagttaatgacaaaaccaattaaggtaatgacgattttcggcacgcggccagaagcaattaagatggcgcccatcgtgttgcagttgcagcaacagccacaatttgaaccggtaacggtggtgacggctcaacaccgcgagatgttagaccaggtgctcacgatttttcacattacgccggactatgatttgaatatcatgaaacctaatcagacgttagctggtatcaccagccgggtactgacgaagctagatgcaattatggatacagtcaagcctgatatcgtgctggtgcatggcgatacaaccacgacgtttgcagctagtgtgagtgctttctatcatcaaatcccagtcggacacgtggaagcagggttgcggacatggcagaagtactcgccatatcctgaagagatgaatcggcagctgaccgacgtgctggccgacatgtactttgcaccgaccgaattaagtcggcagaatctattgaaggaaaaccatccggatacggccatcacggtaacgggcaatacggccatcgatgccctaaaacagacggtttcgatggactatcaacacgctgcgcttgatttgattcagcctgggcaccggatgatcttactcacgatgcatcggcgtgagaatcagggcgccccgatggaagcggtctttgtcgccatcaaacgagtggttgctcagcatcccgatgtcgaagtggtctacccagtacacttgagtccggcagtgcagacagtcgctaaacgtatcctcggccataccgatcgcattcacctcattgacccgctcgacgtgcttgatttccacaacatggcggcgcgcagttacttcattatgacggattcgggtggggtgcaggaagaagccccgtcactgaataaaccggtgctcgtattgcgtgatactactgaacgaccggaaggggtcaccgcggggacgttacgattagtcggcactgatggtcagcaggttgcggcagcgatgaccagcctgttagatgattccgcagtgtaccaacggatggcagacgctaaaaatccttatggcgatggtcatgctgcggaatacatcttacaagcgattatgaaaaaaattggtacacattaaaattatttacatttttgtataaacagtgtaatattaagcactgacatagtgataaaaattttcacttctcctgtaaagatgtgaaattagtgaagtagccggagatggatgccgcgggggtatcaataccggttatttttttgcgttaaaatctagatggcccggtactactgagtgtctaggcagctacttgattttgtcaaagtggctgacggctgggatataagcggattttactcatcagtggtcaggtattgccatcaattgatctgattggaccgattagtctattcgctgaaagcactaatcctagtataaaaggtgtttcccgcggcattccattgtataattgtaaatactataagtgagcgttgaggataaatgaatgaatttaaaagcccgttaccctaaaattgcgaaaagcctggaaattattattcggcggtatggacaagccaatgtcagcaataatgcgattgtgctggcctactacgcgttaatgtcgattgccccgattatcttgattgccggaaacctcattgcccggttcgatttgaagtctggacagattttagcgtacgctcaggaagtcattcctagtaacgtctaccagacgtttaagccgattttagtttcattcctgtctagtggcagcagtagtagtttgtcaattgggattttggtgacagtctggtcggcgtctaaaattattgctgcgattcgtaggagtctaaatgaggcgtacggggtcacggatgcccagaatgccatcttgacacgggttattgccttcttcttaacgctgggactattactcttaatcgtagggctggcgattttctttacgttgagtcagttgattctagatgtgatcttgaatttaacaaatctcacgcgtgcaatcattccgaattggattaatcagttgttggaaaacaaaaacttgattacctttgttgggatgttcgtcgtcgccatgttgttgtattactttgtaccgaatgctaaggtgaaattgcgctacatttggacgggggcgttagtcacgacgattggctggatcgtgatttcacaagggttccgggtgtacattgaattatttgctaaacggattacgacttaccaaacgattgggagtttaattgtactgatgttctggttgaacttttccgggattctcttgatgtttggtggcgtcgtcaatgcgtcggtgcaggaatggtttgagcataagattgagccaaagtctccacggatgattcgtcgcattcggcgacaattcttcaaacgcaaaaaaacgactaaaaaagaataatcagaaccttttaattgaatccgaacgtttaatcctgtaaaatcaaaactttttgcgatttacatattaaacgattcggattttgtgtataatggtgttcgtgtgaaaaaagtgccggtgctttctgaaagtaagtggcgtctatttcaaaataaacaggcgtaacaacgccacaggaggagaaagatagtgattcatcagcttttggcagagttcatgggaaccgccttgatgattatttttggtgtcggtgtacattgtagtgaggttttaaaggggaccaagtatcgtggttccggccatatcttcgcaattacaacatggggttttgggattacaattgccctcttcattttcggcaatgtctgcattaacccggccatggtattagcccaatgtattttagggaatctttcatggtcattgttcatcccgtattcagttgcagaagttttgggtggggtcgttggtgccgtgatcgtctggatcatgtacgcggaccattttgccgcttctgctgatgagatttccccaattacgattcggaacttattctcaaccgcacccgctgtgcggaacttaccacggaacttcttcgtcgaattcttcgatacatttatttttatttctgggattttagctatttctgaagtgaagacgccgggaatcgtgccgattggtgttgggctcttagtctgggccattgggatggggctaggtggcccaaccggattcgccatgaaccttgcacgggacatgggcccacggatcgcccacgccattttaccaattaagaacaaggctgacagcgactggcaatacgggatcattgttcctgggattgcacctttcgttggggctgcttgtgcagcgttgtttatgcatggattctttgggattgggtagataatatagtaagtttgtattcctgaaaatcaattaaagagcaattgaaagtgtaatatttctttcgattgttcttttatattgtctgaagaataaagcaaaagttatatttatggtagattgtaa

SEQ ID NO: 23 - DNA, 40240 bp, Lactobacillus plantarum
ggcagaaatgcctggaggtcgatataggacgaaccaatctaagcatatttacgctaacttgaacttttcccagcgggtctaagctggctgcttttgaacttaagaatcggcacgttttaatcatgattgtttaataacgatgagtaataaaaaaacaatcgcaccaattctagtagaatcggtgcgattgtcttaacttacttatttattgagctgcacactgttcacaaagtggcattaaatctttcaaatcctcgacggatgagccattttctaagaagcaattgaccatatctagccaatattcatcatcggcgctaaaatgcgcgttgacatccttgcaaggtaataacccggcattggtataggcgacgattttatcagcagcgaccccgctatgggctgctaattgttccagagtcattttctctcaccatttgtcctttcaaaaaatcaatgtgattatgttacgcccccagcttttgaaatgcaagcaacaatttcgtaacgtcacgattaaaagtcaatgataattttcttcattattttcaccgaaagtagtaaactaattcttaacccgcctttgcctcattcgtcaccttactattggcggatatcaagcgtgctttttcatcataacacgcactcaaacttaacctacatagttatcctgtttcatgaaccacactaattgtcagataatcccatttagtgttggttaacgcatacttattgaatcggaggtcgtacatttatggattctagtttaacctttcgcgcgggcatcaaggatgtcattcccaccgtctttggatacattggcgttggcctagcaatgggcattgtcgccaacacgagtcacctatcagtttgggccgttctgctcatgtcactaatcgtctatgctggttccgcacaatttattatcgtcagtatgctcctagcaggtagtccgatttcggcaatcgtcttatccacttttttgattaattcacgcatgattttaatgagcatgtcaatcgctcaatatttcaaaaaagagtcgttattgcaaaatatcggactgggatcgttactaactgatgagaccttcgcgctcagcatgaacaagctcaatcagaccaatcaacaattaaaaacgagttggttacacgctgctaacattgtggcttacttagtttgggcagccgcgacagtggtggggtgccttttaggtaacttgattactgaccctaaccagttcggcttggattttgccgttgttggtatgttcattggtttactttacttgcagatcatcacggatcgcagtaaatcattgccgacccagttgtgggtcgtactatttgtggccctcgccatgtattttctcatgcgttgggttccgggcaacttggctttgatctttgcgacgctactcggttgcggttttggaatggtggtggaccacaaatgagtacttacatttttgtgaccatcttactctgcggcctcgtgacttggctatcacgcattgtcccgtttgccatcattaaaaatctgtcagtcccccaatggctaatcagctttttatcatttgtgccagttgccattatgaccgctatttttgtggaaagtctgctcacctaccatgcgggacactggccagaatttaatctcccaaatatttatgcctcaattcctgccattcttgcaggagtgctcaccaaaagtttactagccgtcgttatcacaggcatcgttgccatggccgtattacgcctagttggctgggcttagagcgcaaggtcacatctaatttaatattcctacttaaacgtcccgcaaatttgtgcatgagtttgcgggatttttctgtgactttttcagccataaggccggcaatcagcatctaaatgtgtcatgtcaataacggtcaattcgaactacctaaatagtcagtagaaatccgctctgccaataaaccggcatccaactaattggacgtttcacgcaatatgaaatttttatcaatgaaagcgttccatctgcgcgctccgctttatcttatgaattaaagcaagtataatagtcaaagtgtacgtcgcggattgtcaagcataattatgacagacattggtaagaaaccgttataattgttcagagtgctttacatccgtgaatgaaacgggtaaattaacaacgaaccatctgtacacatatagtagataagaactgtctaaactttaaagattgagagatgaacagacatgtgcggttttgctggttgcttaactgatcggactaaagcggataacgcagcttacgatcagaccatccacgaaatgactaaaatgattgtccatcggggacccgatgatgacggttattttgctgatgacaacattaccatgggttttcggcgcttaagtatcattgacttagccggtggtcaccaaccactatcttatgataatgaacgttactggatgacatttaacggggaaatttataactacgttgaattacgtgaacaactcaaacaagaaggctatgaattcaaaacaagctccgattctgaagtaattcttgcgatgtacgccaagtaccacgctgacgcaacgaagtacttacggggaatgtttgctttcgtcatctgggataaacaagaaaaaacgttatttgccgcgcgcgatcagttcgggatcaagccgttctattacgctatcagtggtgatgacttctattatgcttccgaaagcaaggccatttacaagattttaaaggataaaaccttcgataaaaatgccttacaagattacatgacgttccaatttgttcctgaaccagaaacactcacaaaagaaatcaaaatgctcgcccctggttgctccttgacgaaaaagttggggtctgcgccacggatcgatcggtattatcaccgtgaattccatccggtccaacgttctgaagacgagtatgccaaaaaaatcaaagatgccttaattgactccgttaagattcacatgcgttccgatgtaccagttggttctttcctttcaggcgggatcgactcatcaatcatcgtcgcgattgcaaaaaacttcaacccaaaccttgaaacgatctccgttggtttcgaacgtgaagggtatagtgaacttgacgttgctcaagagaccgctgaaaagcttggtgttaagaattacagcatgacgattacgcctgaagccttcatgaaggccttcccgcactttgtgtggagcatggatgatccgttggctgacccggccgctgtgccgcagtatttcttagccaaagaagcggtcaaacacgttaaggtttgtttgacaggtgaaggcgctgacgaactcttcggtggctacaccatctatcatgaaccagaatcattgaaaccgttccgctacacgaaaccgattaatggtgccttgaagcgtatcgcactcatgatgccagagggaatgcgtggtcggtcattcttactacgagggaccaccccattagaaaatcgctatgttgggaacgcctttatctttggtgaacaagaaaaacaagccttcttcaagaattacaatcagaaccatccgttccagtccatcacgcaaccgctctatgatgaatccgtcgactatgatccaatcagtcggatgcaattcatcgatatgcacacgtggttaaacggtgacttgttgcataacgccgaccggacaacgatggcgcacagtttggaactgcggaccccgtttgttgaccgtgaagtgtataacttagcagccgaaattccagctgatcttcgaattagtcacggcacaacaaagtacattcttcgtaaagcggtcgaagacatcgtgccagcgcacgtccttcaccgtaaaaagcttggtttcccagtaccaattcggttctggctcaaagatgaaatgtacgactgggctaagcagatcattaacgattcgcaaactgaccaatacttcaataaggactacttcttgaaactcttagatgaccacaaggccggcgttcgggataattctcggaaactctggacggtcctcaccttcatgatgtggcaccgactctatgtcgaatctgaccacttgatggatagccccgaagctaacgccgttgcggaaaaagtcgaggagttttagatcaatggaaattattgttcaaaagttcggcggcacgtcagtcaaggacgaagccgcccgtattcaagctttaaagcacgttcaatacgccgtcgatcagggcgataaagtcattgccgttgtctcagcaattggccggaaaggtgccccttacgccaccgactcattactcggattagttggggccgagcactcccgcttaaccaatcgagaactcgacatgttggtctcagttggggaaaccatctcgaccgctgtctttaccgagttagcgcgtaagcaaggcctaaacgtcacggccatgactggtcatgatgctggcatcgtgactaacgacgattttcaaaatgcgaagattctccgcgttgatccgaaaccaatcacggacgcctttattgacgccgacgtggtagtcgtaactggttttcaaggtgctactgagagcggccacattactacgattggccgtggtggttccgatacatcagcagccatcctcggcgccgctttaaaagcaaaacgtgttgatatttttactgatgtcaacggcatgatgactgccgatccacgactcgtcacccacgcccgcttcattaaggccatcagctacgaagaacttgctaacatggcccatgaaggtgctaaggtcattcatccgcgtgctgttgaaattgcagaacaagctcacgtgccgatgcggattcggtcaacttatcaggaacccgacgaattagggactttagtcactgaccggaccacgacccaaatcgaacattatcgtactgtgacagggattgcacaccaaactgatttgacgcaatttactgttcctaccgatacgttaagttcaagtgccattttccaattgatggcacagcacggtttgagtgttgactttattaacattacaccacaccaagttgtcttcaacctggttgatggtgacgcggacgttgccaagcagctactgactgacgcgcacgtccattgtcagtcaattgcgaactgtgctaaagtttccgttgtcggtgctggtatcactgggacacccggcgtcactgctcggatcgtctcggcattagctgcacaacatatcgatattttacaatcgaccgatagttatacgaccatctgggtgctcgttaaggaagccgatttaaaagcggccatgaacgccttacatgatgagttcttaggaatcgaataaccatccctgcaagtccggcttaattgccgggcttttttgttgacctagattggcctggagatggcacgttcaaccagcagcacaccatgtaccgagcgattacaagcataatttcaattctcatttggggtgacaattatccggtttgcatgtattctagaaacagtaactttattgaaaaggacgctaatattatgcaagcaagtcaattaattaatagtttaaaattcaagcaggttcagcccgccttgaccacggactttgatgtcaccatgctgacgcaggatacccgcgaagttcagcccggcgccatgtttattgccgtcgttggttatcacgtcgacggtcacgacctcgttgatcaggccatcggaaaaggggccaagatcatcgtggcgtcaaaacctttagacgtcaacgtaccggtcatctacgttgaaaacaccgaacgcgctatggcaattcttgccgacgttttctacggtgcgcctagtcaaaagatgcggatgattggggtgacgggtaccaatggtaagaccactgtcacccacctgatcgaacaaatctatcgtgatcagcagcaagccaccggcctgattgggaccatgtatcgcaaaatcaaggatgaaaaactgccaactgccaacaccacccccgacgccatcacaacgcaacggactctagcggccatgcgggatgccggtgttgaaactgtcgccatggaagtttcttcaattgccctcgtactcggacgggtctgggggattgattacgacatcgccgttttcacgaacttgacgcaagaccatttggatttccacaaaacaatggctaagtacacggaagccaaggccatgctctttgcacaactgggcaataagtacagcgccgacggaactaataaggtcgctgttctgaacaccgatgatcccgttggccgtgaatttgaacagtacacggcagcgcacgtactaacatttggactcaaaccagatgccatgatcaacgcacaaaatgttgaaatcaagagccacgggactgaatttgacctctccgtcttcggccacgtaacccacgtgacgatgcaactgattggccagttcaacgtgtacaacatgctggcggccttcgccgcagcttacgctagtggcatccccgaagaccaaatcattaagtcactggagaaggttaccggcgttaagggccgcttccaatccgttccttcccacacgggtgtcagtgtcatcgttgactactcacacactccggacggcttattgaatgccctagaaacgattcaagatttcgcgactaaggatatttattgcgtcgtcggctgtggtggtgatcgcgacaagacgaaacggccaaagatggctaaaattgctgtcgaacacagtactaagccaatctttacttctgacaatcctcggacggaagacccaaccatgattctaaatgacatggttgccggcgtgccaaacgccgacgtgcccgtctacgaagaccgccacgttgccatcgccaaggccattgaagcagcacaacccggcgacgttgttttaatcgctggtaaaggccacgaagattatcaaatcatcggccggactaagcatcactttgatgacagtgaagaagccgctaaaacactagctctgaaaccaaccattgattaatggtcaaaacagaactgaccgacaaggctattttcaattctatttctgttaacaattggtgacatccgcgacacgcgtctttaaccattaacacccccagcaacagctaatttgattggccgttgctgggggtgttttttgcttgtttggctttctcccaaccagcgctacaaaacaggcatcagtcgtgtttgtacaaaagatgcacccacctttcgattattaaccagccaaactatcgcctatctttgataattcacctaatttggaaatataattatgttgataaaaggggttaattatcattgttagtttaagtttaattcgtttggggggatttataatgtcaatttttcaaacttggaaacgccgaattgcatacggttccactgacatggccggtaatattatttggcaaatggtcagcacttacttactgttctattacacaacggtcgcgggcatctcagctgcttttgcaggaatgctgttcttcgtcgtgcgcttcattgatgcgtttgatgcattgatttatggttatttgattgatcatacacacacgaagtatggacaatcgcgcccctactttgtgtggtttggcattccgttagggttgctggccatgtcgctattcatgattccatcatttggcggcaataccacaatgcgactcgtctacatttcaatcacttacactttctttagcctgatttattctggtgccaacacgcccattacttcgattttaccaagcttgactgatgatagcgttgagcggaccaagttagcgagtgctcggatggtcatgacaaccatcgggaccagtgcagtggctgccatcactttgccaatggttaaattactcggcaaaggcaatcagtcgaaaggtttcaccctctgggctattatcttaggcctcgttatcatgggactcttcatctttgcttttctcaatctcaaggaaactaacggtgcacaaaatccagacggtaccactgagtcagccgaatcactctcaatctggcaaagcttgaagggtgcggctagcaacaaaccatggctattattagcctgctcattcattctgctacaaaccttctggatgctacggggaaattcagcgatcttctttatcaaatacgtctacggtcggcctgaattagcgccaattttcctggggattggctttgtttccgtcatcgggaacctgtccgtaccattcctatcacaacgctttaagaaccgtaacgttttgcagttttcactcgtactgggcgttatcggccaactactgctgccaatcgctgaaaagatgcgtagtgtgagcctactaattgctggctccgtcattttcttgattgcgatggggatcacgttcacgattgtcttcgcgatgctatcagataccgttgactactcaacgaaagtactgggcctaaatgaaaccggatttttatctgccgtaccaatgattggcgccaaattaggaatgggaattggcggttttctagccggtcaatttctcgcatggggacaattcaatgccaaggcagctgtacagtccggacgaaccattacatttattaatctcgcttttatttggatgccgattattttattagccgcgatgattttcatgatgcaattctatcggttagacgaaaaagaattacaagccaacaaggccgacgcagcggctaaagttgaacctaaggaggatgttgaatatgatgccaacaattaattcgattcaaacaaccgtcaacggcgtcgtcaaaatcgttaaaccatttaacaacgacatcgccggtgaacaatttgacccgcacgtccttcaaacactaacggccttcaaacaaccacccatccttgaaaatgatctagcagcgctccgcagtggtagtttaacccccgccatcgcggaccctgttggtgatgcggttacagttcaaagtcgaaatattacggctctgaatcgcacggtcagcgttgaatggctgacaccacaaaatgtcattaatcacacagtactggtctacttccacggtggtgccttttacggcggtgttcccggcaataatacggtccttttaaagctggtcgcagctaaaagtcactgcgagattcttaatgtcgattacagcttagcgccagaagcaccagcacccgctggtattttagacgggctcgcgattttccaatatttggaacaacgtgacgctgaaacaatgattaccgttgctggcgattcggctggcgctaacgtcatcatggctgcaacaaatctgaatcaacaactcggtagcaatcgtatcaatcaacaactgctgttgtacccagttaccgccccaaatgctgaccacgccggtccactctgggatttggccgcctttccgattattgactcacagcgtgccattctcaccaactatcacgacctctttcggcaacttgacagcatcatgacggattattatgttccagagaactttgattcacattctccactcatctcaccgctacaccaggaaaacttcacaatgacaccaccaaccacgatcatggtcggcgagtttgatccattccgaccacaagcttgggcttatgcacaacgcctggccgctgccgatactgcgaccacgtttattcagtatcagggcttgaaccacgctttcgcaccattagtggatcagtattggcaaagccaagatgtggcccaagtgatggcggccgcgttaatttagcgactagggcatatcaaaaatcaccagtatcacgttgcagaaatcacatgtaaaaaacaagcggactgataaaaaccgccccgcattttactatccgaaatgcgggcggtttcgcgttaagctaacatttaagtctgagacttgtgctatactcttggcatggggggattaacgtgaacaaaaatgataaagccaagcgtttgatgcaacaaatcgacgttgcctataatgatcctgaagttaaacaagacgcacaagttcgtgctgacttacttcgctatgctatggaacttgacaagaacggtaactatttattaattgccactaaagttaacggcatggcaatgcgcgtcatgcgtgatcacatgcaccaaccactccaagcaattaacacactctacacccaaaccgcccgcacctccgaatattattggggcgtggcggcagctagtatttttagtgggctgtggtaaagcactatcacgtgcgagcgctcactataaatcatattaacaacagttttgaaccggaacacagacaaataacttgaatcaaccgttaatttcaaagggccgctcctgacaaaccatgccagaagcgtccctttactaactacttaaaattttatcgatcagagtcaagttaacagctaaagtaaggcgttgtacttggctcagccatttacttcaagtacccggtttcattccaagtcgtcagttcaaaatgcagattatccgtcgtcgataacactgtcaggctatcattatccacgataccgtggcccactgtcttcataacttgcccatcgaccacaaaaggtgctcgtaattctgctacggggacacccattaacgccttgacagtcatcgtcgtcaccagaccgtgcgatacgattaatagtggttgcgtgctagctaccccaacttgatcaatcaaacgatgtagtgtcgaagtcgttcgggtgacaaaatccgcataactttcgccaccgccagctagttccggtcggtattcggcaggtttagtaaaaataacttgggcgtaggactgcggctgtacttccgcttcctgtttgccgtcccaatcaccaaaatcaaactcacgcaagccatcgtcgatttgaatcggcggttgccactgattggcagccacaatgtatttcgccgtatccagcgctcgttgctgcggactgctatatactgctgaaaattgagtggtgcttaagtaatcaccagcggcctttgccccatcgattccgctagcaaccagcggggaatctgctcgtccaccttgaaatcggtgttctaagttatattgtgttcgaccgtgacgaatgaaataaatctgcatggcacgttcaccttcctaatccgttcaatagtttaattctaactgtgtcatgctcaatagaaaagtcttcagtgccataatgacgtaaaaaaataccgtggtctaagaaacacaccacgatatttcagttattatgataaaggcttaaccaagtgctggtacggatgtgtgccaatcatgagctgaccatccgggacaaaaccatgccggtggtataacttagctgcccggggattgccatcatcaacgtttaaactcagtttcgtggcccccagttgaccaacgagtcctggtaatgcttctagtaaggcactaccaactccgtggccctgagcttgcggatcaactgccaacatgcttaaataccactcattcggccgggtctcaccacctaattccagtggtgcctcaaaccccgcatgatgacctgaagtcgtccgcaacaaatcgtttacagcgacttcattcttcgctaagtgcccaaacgcgacaccgacgattttgtgagccatgaccgccacaaaagtctgcgctaacccatctaaattggccggtcgctgatacaactcagtcaacattgccaataggtcggcctcgctaacattttttaagactggcatttccatatcacggtaaatcatcgcaatcaatggtgcaatttgagcactatcttgcggttatgccgttcgaatttccatcatcacaacgctcccaactgttttctcaaccgtagcaaatcccgcggtcatcgtcaatcgttgtgcttaatttgttgccgatgttgaatcgtcatcacccacgtcgtgacgggaactaccaggataacgccaattaacgagaataataccattaatacttccgcaacaaatattttattattgataacactcccgaaggaataatgtaagcccgcaaaccagataaatagcgccaagaagccaccaaaaaagccgaaaaacaaggtattaaaagtcgtcccgataatctgcttaccaatactgataccatcgatatagagtcgcttagttggcaactgcggatgctgcgccagaatttcactcagaccagccgcaatcgcaatagcagcttccgcaatggcccctagtgtacttaaaattgcttcagttactgctacgccaataaaggagaccccaatggctaacgacataccttccagatcttcactatcttctaaactaaagccctgcgccatgatccaattttcaacgggaaaaataatcagcactaacatgaccataacaatcaatgctgcaatataagctggcttggccgccacttcgttgtcctccccaaagaaaatcgtgaaggccaagatgattgtcccaatgaccaacgacacccccattgctggaaagccccatgaaatcaaaacaacggctaaaaacaacaatccaaagttaaataacaaactcaaaaaggccgtcgctccagtcttaccaccaattaatgtcatcaagcctagtaagatcaatcctaaaacggtaatcgtgttcatgccatcaccgccttaggcatcaatcgactggctaaccaactggctactggaatcgctaaaacgataccgataccagaaatcaaactttggaccatccccaacgacatattcattgtaaaagtgtaaccccagctattgccgttacggaaatagagcaaagtcatcgcgaaagtatccgccatgaaaatcaaaaatagcacgttgatcaagggccccataatagaccggccaatttgaatacccgacttaaatacttgtcgtggtgcaatgtccgggcgctccgttttcagttgaaacaatgaagcaacaatatctgttgattcatccatgactgctccgagtgaaccgaggactgtttcgactaaaaataacggtcggggaacttgcgtcacgtactgcatcgattcataagtcacaccacgctcatgggtcaccgcaaagacgatcagactaataatgacagccagtcccgtgccaaccacagtcgcgcccaatgttactaacatttgacgactaaaaccgagaactagcaacagtgtgagcacggcgaagattacggccaatacgccaaagagcaggtaaatgtgaccaccattagtagctaaatcgatctgaatggcggcataaaatagtacagcattgagtgcgacactcaaaaaggccatcagaccgctgaaacgcataattaacaagagcagtgctagggctaaccacgcgacaaacgccaatgcggtatctcgttttaacccctgaatcgtcactgcactactatgatcactaggaatccgtaagaaaacttgattacggacgtgatacggctgatccattgcgcccgagcgcgtatacgtattcttgatctggtaagttcgaccacgatgtgccttattgagcacccggaccgttaccaactgtgtcactgtcgcatccttattctcaaattcatccgtcgtcgtgcttcgactcttagtctgcacgtgggtcacttgtgcaactgtctgctgataaagtcccgcattaactcgggtcaatccaaccccgattagtcctaaaataatcaccagcagtgttaaccacaacccccaccgttgcttgattcgctgtttcacattttcaccttttttcacttcaatggtcaccagtttaccacccattttccaatacaaacttcgattctggcaatctttaacagaatctaaggttctacggtaatctaggccgttacttgaacgcgtaaagctttcagccaagcaatttcttcctcatcgtggaggcgctgagcaatttttattcccttttcaatcaatgccagggcctgttcaggttgctgatggacccgccattcataaacggcagttaacttataatgagccaaaggttggtaacgacgtaataactgttgaacaccatcatcttgataccaggctatgatctgggggtcacgatgattggtgaccaagttccagtacaatgtcgcatctaaatacttcgccaaatcagctggcggcaacgtattgaaacttggctccaagcgactcaaccccgctaacagttcgggggtgtccagcccatgttgaagtccccattccagaatcaaccaggcttgccggacgactaaataattccgattgccaccatcgcgcggcataacaatcatactcgcatcaaggtcacggacactaccggtctgaaccttaacggccgcagcacacgcagtgacatacgcggcggtcatcgccgccgttgattcgcgtgcctgccgaaattcctggcccgccgtgggataaccgtgcaagttcattggtaataattgggcggctttcaacgtattgacccagatccaaataatgaacgcaaacaaccataaatcgaaactaaacttaaattgattcagagttattaaactgagcatgaccgtcagtaagttgaacaggccaccgccaaaacaataaatggcgtgattgaaccgtttggcatccgccgggggtgctgccacgatatgtggatgacgcgtcagcggtcgttctaatttccaatgaccacgaacccgacttaattgaagtcgaaaaccggtaatccggacaattcgagcaccaattaatcgaaatccgacccactgaccgagccaatgaattaacgtcgcacctagttcgctggcgactagtgccaatcctagccaaccgactgttgcaataaattgtccaaaaacttgcatgctattcctcctcgtaccttgattgacagcctttatttaacaaaattaattttgaaatcaataatacgtttttgggcatgacccatgattagtttttgacaaagttagattcaaaaaccggcagcttggatgcgccaaaaccgaaaccaatcacagcatgctgccaaataaaaattcatctaatttaacatgttttaattatggttcatacgcctggcaaccagtaccaagtgtcctcattttctaattcgacgataccatattaattatacgcgtggacactgaaataatcgctggtacttcgtaattgttcttattatagcaaaacaagctgacctccggcgattaagacgccaagcccagcttgctaatcaattgaattttaatgtcgttgttgctgaatgcacatgccgtatcccttaacgacgccggtgtttaacaacagtgaagaaatgtaaaatcattgctaaaagaacataaaagacgacgacaaagacgccgtagtaggcccaaaaattgttcagcggaatcaattgttgaatccccgcttcgattcccatggttagtagtgccatcaccgcaatcatgaagaataattgaatataccgtttcaccgtactgtcatccctttcctttttatgtgcagcccgcgcgccgacccgttcacattctgcttgcttagcagctgtgatggtttgcataccccacgttttagttacgacaatctcccgtaatttgatgagaccacccatcgtcaaaaatttatcaagtgttttaaacgttgcgtcagtcacgccggtcaaataattttcaataccacccgcgtaacaatccgtgatcgtcacataatgcttgttcttaaagcgatcaggtactgcttcacccacggaattaaaccgtgcgatccgcccccgaaaacagtcacagaagtttttcattacccccgataagctccccaaataggttggtgcagctaatacccagacatccgccgccattaattttgcttccagcgcgtctaagtcagcattcggttgactatcgtgatctggtcgcaactcataatcgttgaggttgactagttccgtgtcagcgctggccgcggccccctttaagacggcttgcagtagctgggcagtcacgccatcagcgcgatgcgaacctaatattcctaagactttcacattttccactcccatcattcattcaaaagctatttttattttaacgcatttcaacataaaaatatggttatcaaacgaacagcaattgttaaacccgctaatagtacttacttttaacaaaaaggtttgacaatcgattaacgacttgctttaattatacataagtacgaacgttccaataacaattagtctaactgacaacttgtagacttaaagttttcttggctgcaactatttcaccagaacttgaacatcgagctgtcataccaacacttaacaactaattcagcgtactgccgatggggggagttagtccttaagtgtaaattgaatttgaaaggacgcagtcaccatggctaattttcaacaatccgaaacggcacttattgaaagtgccacactaattaatatcttcgccgaaaaaattcggcgtcagattatcattgctctggggaacagtgataatggtctcaacgttactgatattaccgccttggtcaatatttcacgccccgccgtttcacatcatctacgcttaatgcgtgaagctggggtcattgatatgcgcagtaacggagtcgagcatatttattttctcacgttaaccgcaccattacagcaattacaggcaacttttgcgacgctaacggctgataacgcgccacttagtcagtcgtaagcactagcgcctcattcaatagtcaccgcaaccttcaggataacgcaggcctgcaacttacccgctaaacgttagcttgattttagacggttgccaaccaaaaatcggcactgccagaatgttcaacgcattctagcagtgccgatttttattaaccattcatccggattatcactggtcctaaactgaacttagtcgtgattcagggcttgcagatcagctggcaatgccgcctcaaagtgtaaagtctgttccgaaaaggggtcaaagaactgtaaactagcggcgtgtaaggcttgccgttgaatccacgccaagttaccgccatacagcgcatcacctaataaggggtgcccaagcgtcgttagatggacccgaatttgatgcgtccgtccagtcacaagttccaaccgtaaccgactcacgttatgctgcaattggtccgcctccacttgatacgtcgtaatggcgcgttggcccgccgtggtgaccactcgccgaggactgtcagccacccggccaatcgggcgatcaattgtgccactagccggcgtaatggtcccttcaatccaagcttgatacgtcttcactaattgcgccgcaattcggggctctgtcaacatcccctgcgccacccgatgtttagcaactaacacaaggccactcgtatcccggtccaaccgcgtgatcaggtgcggtcgttgattactggcatgactggctatcaaataacccttgattcgattgaccaacgtatcggtccgattactaggccccggcacgctggttaacccggctggtttattaagaacgagccaattagcatcttcatactcaatttgaattggttgttcgctgacggctaccgctgtatccggtgcctcgtctggtagttgaattcccgcaatatcgccatcatgaatggtaataacgcccgtttgaacttgattattgacaagaaacgcgccggtgccatgcttgattgccttgattgttcgcatactgatggcatgcgtcgtcaggaatcgtttcattgccattggttgcccctggtgttgccaagtaaattccatacgtgttactccatttcatctcgtagtttaccaatcagccatctaatcggtttcctcatcggtgctagttgctgattccgcatgagctgccgctcgaatcgtcgccataaaggtttcaccatacttttcaagtttgctggccccgacccctttgaccgttaagaaagctgcgtcgtcttctggcatcaggtcacacatcgaatgaagcgtccggtcagaaaaaatcacaaatggtggtacgccctgttcttccgccaattggcgccgaagtgtccgcaactgttcgaagagtgcactgttctctggcaccgtctgctgcaccttttgggccgtctttcggtgtaccgtggtcgttcctttaagcacggccactccactcgctgagactgtcagcgttggatactgaccacccaccgactgcaaataaccgctcgcagtcaaaaaatcgatcagttccacgacactcttctgtcgctgcccggacatcaacccgtacgtcgacaacgtattgaggttcgattcgcggacccgttgattattagcgcccgtcaatacctgggccacgacccctttaccgaaccgggaatgaagcctaacgacgcacgataagacttgttgagctgccgtggtgatatcctgtgattcccgctgatcagtacaattactacaccgaccacacggcgcggatttttcaccaaagtatttcaagataaactgttgtaaacagccctgggtattcgcataccgtgtcatcacctgtagcttctgatacgccaggtgtcggtgctccgtatccatctccgactcatcaataaagaagtgctgaagttgaatatcaaccggtcgaaaaatcaaaatcgcttcactaggtaacccatcccggccagcccgaccggcttcctgataataagcttccaaagttccggggacctgcgcgtgaatcacaaaacgcacgttactcttatcaatgcccattccaaacgcgttggttgccaccatgacgtcaacacggtcgtacaagaaatcctcttggttttgccgccgaaccgcatcatctagcccagcgtggtacggcgtggccttaatatcatgcttttgcaacaaactcgtcagacgcatcacttctttacgggtgctggcgtaaataatcccggcttcaccatgattaactttcaaataatctaaaatgtaacggtccgtgtcttggcccttgaccaccgtcaaatccaagttatcgcgggcaaaaccagtattcacttcatgttgtggatcgatcgctaagcggccgcaaatatccgcagcaacttgctcagttgccgtcgcagttaaagctagaacttgcggatgggtcggcaattgttcaatcgccgtgctgagcgctaaataactgggacgaaaatcgtgcccccactgtgaaatacagtgggcctcatcaattgctaacagttggatgggcaaccggcccagcgcttgaataaaataatccgaatctaaccgctcgggtgccacataaagtaaggtataatcccccgcccgtagttcttgaagccgttcgttaatctcttggaaatccagtgaactgttaataaaagtcgccgcgatgccattatcatttaacgcgtctacctgatctttcattaaagaaattaatggtgagacaacgacggtcagcccctgaaaaagtaacgctgggatttggtaacataatgacttaccacccccagtcggcataatcgctagggtgttttcaccggccaacacttgttcaatcactgctttttgccccggtcggaattcatcatatccgaacgtggtctttaatacttgctgtgccgccgctaagtcaatcatcacacgtaaactccctctttgaattaatactctcattctaccgagaataccggcccatgacaagaacgcgccccggtaatcactaggtacgttaagtcgcacttgcgccacgaaaactatcaaaataccgaaaagtgcccgtccctattgattttataggaacggacactttaaagagaccgatatcgattaaacgaccatgtcagattggccatcaaagggcactcgcccacacagtttatatgtacaatgctgacttagccttgcttgggtcggccacggtgatccaccaaaccttccatgccgtgttgtcgatattttcgtacccatgtatagacttgtggatacgaaacattaaaatgcttagcggcttctcgataatcgttgcaatggtccagcgtatactttacgatcgcaattcgttcttccagcgttgcgcgtcgtcctcgatccatgactcggcctcctctcattcactactattcatcataccaagagttctcaattttttgtagctttttccccgtgacttgcctgattcgttgcgatttttaataaattatttcgaatcagtccagcgcacctagcgctcatcttaaaataaatttgttaacgcagttattttgcttgcatttaagaacatatgttcgtatactcgtgttgaggtgattagcatgcagtcagaaaatctaaccgttaagtatttaaataaaagcaagatattaaagttggacccctttatgttgtacttacaagtcacgccattaaaggcgaccgagcctacgcccatcaactgcatcatcgtcaagcatgcattgactttattttaccaactccaacctgacgcacaactagcactctacggtcactataacaccaggcaccaattcgtgattaccaaattcatggttcgatctgcagtgcaaacactagccagctaatgtacaaagccgctaaaatataagtacttagatcagaggagctgttgtcgatgatgccaacgaacctaaccttacttgagcgtaagatctcaaataacttgaattgtctatactttgtcaaccatcccgtttaccgtattcaaaaggaccatcaattagcactcgcttcagaatacagccttgccggcaacgtgaccgaaattatctgtgatgaacagcagcgctatcatattttattcgtggcgcgtaaagaaattgtcttaactgaaaagaaggtcgctaaagtaaccaataaccagctcgggcaggataccgttcaatttctggcgacgctgggataccagtttccccctgcgcagccggccggtgaactaagccaacccacgatcctaccttcaccaacggaattgagtgaatgtccgaccgcttacgtaatcatcgactgcgagttcggcactcgctttcgtcgtaatggctccgctaaagccgtcagttggcacgtcatcgaatcacccgaattacgggctagtatcttccagctcagtgccatcggtttttcccatcatacgcagacagcgccttttttcaatcgttacttcgatgatcctaactttttacctgacaaaaagttggccggtttatcagcaactggcttaacgaccgtcgcttacgaggcgcaaggcgaccccttgacgattctaaaagcattcatccagcaagttatccagccacaactccccctcgttttttgggatcagacacaggacatgaaacacattcgattattactaactcagtattatcagcaattgacccccaccgaacagcagctagtcagtcgcccggtcacgatttttgatgcccaagcctatacgaataccttgatcaatcgtggcaaccataaggtcggtagccatgatctgccattaaatggcttagccgcactttttaatatcagcaatccacaccagcataacgccatttgggatgttcagacaactgaattagtcatggttaagcttgctgaactaactcaccaaacgccggtaatcactacaccgcctgcaccgatcgcactaccagctacggtgccagcggtggttccgtcaatccagacgcctagccccacaccacaacatgccagccacgcgcaagttcaccagttacgggcacgtggcaagacttaccgtgaaattgcggcggtcaccggttttagtattagcgggattaattatattctcaaaaaagcccgttctatcccgacccgctcagaaagcgtataatgatattaatagcttaaaaggagtgttttaatatcatggaaaaacgtattaaaggttcatgtaccacgattctcgtcggtaaaaaagcctcaatcgatggctcgaccattatttcacgaaacgatgatggtcacgaagccctagaccccgaacgattagttgtggtcaatcccgcagatcaaccccggcactatcagtccgtcattagtaaggtcgaagtcgacttacctgacaatcccttacggtatacttcaattcccaactcaatcttgaccaatgggacctggccagcagcagggatcaacagtgagaacatcgccatgtccgcaaccgaaaccatcaccacgaactcgcgtatcttgggaatcgatcccttcgttgccggcggaattggtgaagaagacctttgcaccctagtattaccatacattcacagcgccaaggaaggcgttactcgtctaggtgccctgcttgaacaatacgggacttacgaaccaaacggtatcgctttttctgatcaagacgaaatctggtggttagaaaccattggtggtcaccactgggctgctaaacgtattcctgacgatgcttacgtggttgctccgaaccgcatgaatattgacgatttcgattttaacgctgatgataccttagcttcagctgaccttgaacaattaattgaagattaccacttgaatcctgactttgaccgtgtcaacttgcggcacatctttgggagtgcttcaatcaaagatacggtttacaacaacccccgggcttggttcggtcagaaatacttcacgccggacgttgtgcaagatccaatggaacaagacttaccattcatctgccatgctaaccgtaagatttctatcgaagacgtcaagtttgttttgagttctcactttgaaaacacgaaatacgatgtttacgggagtggctctgaagctgacaaaacccttttccggccaatcgggatcaaccgtaaccacgatgtgcacatcttacagattcgcaacaacgtccccgctgctgttgccggtattcactggttagcctttggtgccaatacctttaacacggtcgtaccattctatgcaaatgtcaatgacacgccagctagctacaaagatgcggacggcacctttaatctcaaccacatgtactggttaagctgtacaaccgcccttttgggtgacaccgactacgacttttacgtggatatgcggaatagttacgaactcgaagccatgagtgcttaccgtaaaatcgagaatgataccgacgctgacttggctaaccaccaagacgtcacggcctatcttgaaacggctaaccaacaattggccgataccgcgatgaagttacaaactaaattactcggcgatatggtcattgccggttctgaaaaaatgaaattacgttataatttgaacgattaattaagcccggtagcttgcggttttagctaagatttttatggtgaattcatgagactaaactaatttatttttaatttagtggtttacaaataccagaatcgtgctaatataaatatcacaagataaaaaacggaggaaagaggagtacgattagtcaacctgccagtgaatcgggagtgagtggaaacccgaccagaacttgactaatccgaaaaacactttcttagttgctaactgaaataacctcgttaaagtaggattagccgttaaccggtacgttaccatcggtggtgtatgtttgtacactattttaaagctggtttactgtaaggtaaacaacttgggtggtaccgcgaaagagtctttcgtcccttgataattcaagggatggaaggctcttttcttttatcctgtaactaaaatctgaacttattttaaaggagaccacgcatatgcatttaattattccaaaggattacgatcctaaattatccgttaaagaaacccaacaggccattcgttacattcgtgaaacgttccaagatgaatttgggaagcaactaaacttatctcggctttcagcaccgatgttcgttgaaaagaaaactggtctgaacgataacttaaacggtgtcgaaaaacctgtctccttcactatgcaagacatgggtgatgaacaaatcgaaatcgttcactcacttgctaagtggaaacgggtcgctttaaagcgctacggttttgatatgcatgaaggtctctacacgaacatgaacgctattcgtaaggatgaagatttggacaattaccactccgcctacgttgatcaatgggattgggaaaaagtgatcagtaaggaagaacgaaccgttgaaactttgaaagccacggtacgtcaaatctttaaagtgatcaagcacatggaacacgaagtttggtacaagttcccacaagccgttcaccacttaccagacgaaattcacttcttaaccacacaagagctcgaagacatgtaccctgacatgacgccgcgcgaacgcgaaaacgccatttgcaagaaactcggctgtgtcttcttaatgcaaattggctggaagcttgattccggcgaacgtcacgatggccgcgcccccgactatgatgactggaaattgaacggcgatatcctcttctggtatgaaccattagaccaagctatcgaaatctcaagtatgggaatccgggtcgatgctgaatcaatgaagaaacaacttaaagacgtggacgccgaagaccggcttagcttgccataccaccaaatgatcttgaacgcggacgtcccttacacgatcggtggcgggattggtcaatcacggctctgcatgttattacttggcaaagcccatgtcggtgaagtacaagctgccttgtggccacaagccatgatcgaccaatgtgccgaacataacattcatttactttaatctgatttaaaatccaacaagaaggagtgatcaatatcatggaaaccattagtattatcaacgccgctgaccatgtcaatgaacaagttaaaattggggtgtggctcagtaataagcgttctagcggcaaaattgcctttcttcaattacgcgatggcactgcaacttttcaaggggtagctctcaaaaacgagctcggtgaaacggcttttgcacaactgaccgacctcgcgcaagaaactagcctctgggtcaccggcacgattcatgcagatacccgttccccctttggctacgagcttgccatctcacaatttgaagtggttgggactagtcacgactacccgatcacgcccaaggaccatggtattgatttcctgttggatcatcgccatctttggctacggtcatcgcgtcccaacgcaattatgcggattcgcaacgaggtcattcgagccgtttatgagttcttcaatgaccgcggttttattaagattgacgcgccgattttgaccggttccgctcctgaagggacgactgaattattcaaaactgattactttggtcaggacgcctatttatcacaatccggccagttatacggtgaagctggcgcaatggcgttcggcaaaatcttcacgtttggaccaacttttcgggccgaaaaatccaagactcgtcgccacttaacagaattctggcaacttgaacctgaaatggcctggatgcatcaagatgaaagtctggaagtccaagaacaattggtggcctacctcgttcaagccgtgattgaccattgcccccacgaactggccgttttggaccgcgatgttgcgacgttgcaaaagtacaccaagctcccatttccgcgagtttcgtacgacgatgctattacactactccaagcgaacggctttgacgtcgactggggtgtcgactttggctcaccggaagagacatttttggcagaacactttgaccaaccagtctttgtcttaaactatcccaaagcaatcaaggccttttacatgcaggcacacccgacgcgcgatgatgtcgtcattgcagctgacctgttagcacctgaaggttacggcgaaatcatcggcggttccgaacgctcaacagattatgactacttgaaggaacggttactagccagcggtcaagacttgcaggattacgagtggtatctcgatttacgcaaatatggttcggtgccacactccggtttcggtatgggtctggaacgttttctggcttggatcactttgcaagatcacgttcgcgaaaccattccgtttccacgtatgttgcaccgtatttacccgtaaagtcgctccaacctagtgctagtagcattggttaatcaaaattaatcgtgcatcctttaaattccccacgcattttcgaatgtgtggggaattttttctcttatttgttgacaagcaacaatattcaagataaaatgttgcttgtcaacaaaattaaggagctgtttaaaatgacaaaattattaatgattaatgctcatccacacacgaccgtccccagtgcctcactgaccgttgcagcgagttttaaaactgcgtatcagcaaacccatccgcacgatgagattacgacacgcgatctttatcaggacggcgttcccgctttgaacgacacaaccttcgaagcttggcgtaaacaaaaacacggtgaagaactaacgtcagtggaagctgaactacttagccgtcacgccgcctggctagctgaatttctagcagccgacaagatcgtcttcgttaatccaatgtacaatcactttcttccagccgaactcaaacaatacttagacttaaccgcagtcgcccgtaaaacttttaagtacacggtcaacggcccggtcggcttattacccgacaaacacgtcttacacattcaggctgcgggtggctactatcaccaacctgatcaacacaaccaggttgaagcaggcgacccctacctccgtggcatgatgcaacggtatgggattcaggattaccgaaccatcttcattgaaggattggaccaatttccagaacagcgagaacaggccatcactgccgcacaggtagcagcagaaaaactcgccggtgaattttaaaaccggtataataatagtaataaaagctaatgattaattgataattgcgcgctaaccaacacgagaaccaatcgccgtgacgcacaactatctaagggggatcaatcgatgtcaatatccacggaacagacaattctaacgcagctcaaaacgattcgaaccaagcgtgcttccactactggtgaacagaaatggttacagcagcatatcaccgaagccaatctacgccgcctgttgccggatatttccatcgttggcctacatttattatctgaactagaggccggtccacaaacgggcatcgacttagccactaacctcggcgtcactcgaggtggtgtgacccgggcagccaaacgactcgtaacgcagggcttaattggctcattccagcaacccgatgatcacaaaaagatcttctaccgcttaacgccgagtggtcgtaagctggcccgctatcatgataagatgcatgcaacccgcaatcatcaagcaatcacgctcctccatgaacactactcaccagcagaacttgcggtgattcaacgcttcttggctgatttgacggattatgaagcttaataaaaccaaaaacaccgctacgactaatgcgcgttcgttagtcacagcggtgtttttgaatttctaatgattagtgattttgtaaccgatacttgcgaattgccataatcaatgacaacgtgttgagtaccaatgataaactgctgaggatcaaactcgtttttgtaatacgcatgagcggcctccattgattgaatttgttaattctagtttaccggtattacgcactaaaagatactaaaagcactaggtgattcgtgggttgtgccgatcagtggttaatcatttgacacggtctgttcggcctgggatagcgcgtccttgactgcggccttgatggcacggctcgatacagaagcgccggaaactgcatccacatcataagtgttagcagccaccatttttgccggcaattcggcaactgcctgaccaccaacttcaccagtctcatgttgttcaactacttcaacatgagttaattgttggtcaacatacgtgatacgaaccacaatttgcccaccaatgccatcatctgagcgccctaagtattggtgttcaccaactgtgatgtccggtgatgcttcagctagcaaatcattggcaccagtctgatgcaccgaagcactagtattcgcatccggcttagccactgctttttcatcgactaattgtgtcgtttcttccttaggtttagctgcattttcaccagcgatttttccaaaaatcaggcattcagctaaattaccgccaccttgatactgatttgcacaaataccgcccaactcacctgcaccatacaagtgcggaataggttgctgatttgcatctaaaatttctgcccggtcattacgacgtggtcccccttgggtattaagtacgttgtttgttaacttaagcgcataatatggtccatcatcaaatgcccgcatcgtatcaacctgccgattaaacgcgtagtcagtaccagactcgacaaaataattgaaatcatgaacggtcttggtaagtaccgtaccatcaacttccataactcgtgctaagtcgtttagagtagtggccttcacaactaaatcggtgagattattaatcggcgtatattgacttgctaacatctgttgatactgagtctcatcaaaaaccaggtatggatggacatttgtccgcggtactcgccacattccatgatcataaatgtgaccatgccggttggcttcactctcatcaaaataccgactaccgtcatcagccaccgtaataacgctaccatggttcactcccggccagcctaaaatcaagcgaccacgttcaccttgtggtgcggcaatcgaaagaccatgtaaaaatccgagtgattcataattttgcatgtgccaaaagtccgcgccaacttcttgggccaacttaataccagcacccttattaaacagcgtgcctaatggtgccaagtgctcagcaccaaggtagtcctggatggcttgttgattattttcaaaaccaccacatgctaggactacgccattggtagctcgaacattaactaaacgatgctgacgttcgatttggacaccgataattgtattcgtagtgggatcttgaatcagatgttatgccggagcactaagccagacatcaatctgttgctgccgatctaacactttttgtcgaagaattttccacaaagctgcatcaaaaatgccatgatggacagttgtaaagtcataggattggactccatcaaattcaggaaactcatgaactgcactgtctaatgaaattggagaatcagcagctgtaaaatcatttttgacactcaccggttcaacattgagatacttttgaacatagtcgcgcatattcgccatgcccgctatgaaagtatcaaccatactatcgtctaattgcatgggtgccgttaagttttgataatattttttaccctcatcgaaactatctaccgttcctaagagttgggcagaataacgggtattgcctccttcatgcccattcggcgctgcatcagtgagcaacaccttcgcatgtgcatccgccgcaaaccgcgctgctgtcgccccggcaccaccaaagccaataactaccgtatcatattgataatcccatttaacctgattcattttttggggcatgctgaccaccctttcaaaatccatttaacgtattctaaagcacaattgaaattgatatttaaatcacaaacagaatcatttttttactacatctgtattatataaccgctttcatttttatagaaataacaatctgattatctgttattacaaatgagtaatgggttatacttgattttaataagattaagcattaaaggtggcgatttcatggaaaataaattgttagtatttttagaagctattcaacagcacaatagtatgacgaaagctgcacaaagtttattcatcagtcagccgtacattagccgcacaattaaaagtgcggaaactcattttgggacccccttaatcgaccgcggccatcatccacttgaattaacttatgctggagaaagattactgacttatttgcaaagtgacgctcgtctccatcagcgaatgaacactgagcttaaagaaatcagtcaaaataagtatcaaagtatgacgattgggattacaccaccgatggctaatgcttggtttagtcaaacactacctgctttttatcaacgttttccgaacattcgcactaaaatactagaaatcacaacatcaaaagcagaaacgttgctagctagtcatcagctagacttttttattggcaaaacaattcatcaaactaacgtcaaaaccatccctttgcagacaatttctttgtctttagtcattccaaaaacagccggaatatatcagtccaatcaattttggcgaccgttcacccccaccattcttacaggaatgaccggtgagcctgtcatccgtgcagtcggtgaagctcgctttcaagaactggttgaccattactttgccgataaaggcattcaaacgattccactcattgaagtcgataactctcgctttgcactaagcttgacacttcaaggacttggtagcattgttctagccactgcaatgttggcaagactagtcactgaaccagccaagtaccctatcaatgctttcaaattaccaacaagcgagctcagccttgattttagtattgcctacttaccaagtcacgtgctagctaaaccgattgcttatctagtcgaacaagcttgtcaaacctttaaccctgcgattgatttttaacataaaacgcaaactgtcagcatctattaagctagatgattgacagtttgcgttttactttcaaaataaatcaccggtagtaaatcatgttcaaccccaccagctgttgcattagttgctcattttctggtgatagtttgatttgttgctgccgcagacatttggagatgtctaagttcattctgtcgaatactcccagtactgaaccagttcgttgttccaatagttcctgataataagttgccagcagctgtcgtaacggttgctcattcgtggtatttagattagcaactaaatcactaattatgcccacagcaacacgtgcccgatcctgccccccgctgtaccatttcaccgtcatatctgttcgactccttttacgcaataacaactgccaccatggtcgctgaacaggtcttctgctcaaacctaataactcatccgttgagacagcaaatagtttgctcagtgctaccaataactctaaatctggataactttttcctaattcccacttggaaatagtttgccgtgagacgtgtaaccgctccgccaccgtctgctgggaccattcatgctgttgtcgttgctcttttattttactgccaatcacaattttcatcctacccgctcctctattacaatactagactattgagtgcaccaattcattgcaacacacttaagcgctaccgcaacggttggttgcaaccgctcaagatcaagtctcggtatgaaaatgctgatacaacgactttcctgaaactaacaattccacaacttgttgaggatcatcaaccgtcacaccttgtcgttgcaaataactgacaaattgcggtaaatagtcgctggccttcaacgcacattccagctgataagtttgggcattagtctttaaaatcaattgaaaataatccggattgaaatcaaatggtgaaagtcgtttgcgacaccgataactgatggtaactcgctgcagatctgtatagtggattagttggcaccgtggacaattgaacacaatttggcgaaacttcgtcaatgtcgatgcagcatacgtatgcaattcaatggtagcaggctgaatcacccagtaactattgattcccactggaacgaccacaatcaatccaacaatataaagtgataaaaagagccaccacggctgataaccaaaaccagtaaataatagacaaacaaatagccaaaataatccgagacccagaagtcgcccaaagcttagtcgccgaccaacaatatatggctttggaaagaaagcactaccacgcactaattcatccaaggatagattatacagatccgacagtgccagtaaattatcgattgacggaatcgcctttccgcgttcccacttagacaccgcctgagtcgtaacaaataacttggacgctaattgtgcctgtgtcaatccatactgacagcgacgcgttttcaataatgctgcgagtaacattggctcgccccccctttatgatttcagcttaatcctcaaccacgatcaaaccaatcaactcatggttgtttagtcacaatcatgtatggtagtcataatttgttgaacttccgtggttaaatcttgttgctcgccaattaagacttcgttagcaacgcccaacgtatcatgtggaagccaccaccgacgcatgtcttccacaccaaaatcacgatgacgcttttgatgacgcgccaaggtcgtggcaaagctcacttcaaaataataagtaaggacgcgtggaaacgattgactaagccgcgccaatatttttccataccgatcacgtgctaagatgccttccacaatgactacaggcacacgtcccagcccataacacgcaatttgttcaatcagaccaattgaaatatttcccgggtaatcatgactcatcagcatgtcgcgacgaacgacatcttgggacactagcaacgtatgatggcccacgcgtcgttgcaacgcctgcgctagcgtcgtcttgccactcccagaatttccccgaataatcaccaaagttgtttccatccacatgtcctccactcattcctgtatcttaatcataccgcacagctaacaaaaaaacgttagccaaattggctaacgttcgctgatactatttggctttactggcgttacgtcgggcatcatgtaaaatcttcaatgcgcgtttccgcgattttaagttggtcccccgtagacgcctgcgcgcacttgctaaatcttgtttttccatcatgggtgcctcctgataaatagtaattattactatttaaattataatcaatcttatgcttacgtcaactattatgcagccagctgacattgacagatacaattagctcccaataattaaattatcatttattagactaacggcaatgacaatgttacccttaaattgtcaacgacattatataagtattttgaaggagtggggatctttgaaaccaaacaatgttaataatcagaataaacgtcaccaatcgcgatgggtaatcacgagcgcaaccgccatgatactgacaacgttaacgattgccagtcaggcggcggctgccgacaatacagtcacgaccacaaccaacgaaccgaccaacagtcagttgaatacgaatactcaagttaacgctactcaggtcaatttgaaagcggatacttctacatcagtatccacgataaaatccgaccagtcagcagtcgcagccacgtcacccaccacatcaaccggaagtccctctgagcactcgtcgtcagtgaacaccaacccacaacaacaatcagcaaatccagcatcacaatctcaagcaactaccacgtcagaatcaacaccgaccacagatattaagcacccaactcaaaccgcaccagctcaaacaacctccgcatcaactactgaaccaactaccgaatcaaacactgaatcagcgactgatagtcaagctaaagcaacgacaaccgataatcaagcttccaagcaaccaagccagcaagccgcacccgcgccgtccaactccactaccaccgaggtgaatactcagtcagcgactagctcagcgtcaaccgatgataaaattgttaccaatgtaaaccaggaaaagctggttttgaaatctaaccaaccagtcgtccgtgccattagccgcaccgcgtcagaaaatattaacgattggatgccgaacacattattgcaacaagaggtactcagtcaactgcgcaaacagaacccagatcgtacctggaactcagctgcagacatcactaaggcagatatgctactactgaccacctactatggcaaggacacttatatcgacggcaagacttcctactcattagaaggactgcaatatgccactaaccttacgacagtctggctcaacaacaacttgaacgcaccgtctggcagttactatagtgatgtcactgatatttcaccattagccaacttacaaaaactccaagtggtcaatattcagcaaaaccggatcacggacatttcaccgctcgcaaacttaaagaatttaacggaggtcgatgccgcctataaccacatttcagatttttcgccacttaaaggatttaaaaatctgaaaggcacattcagtaaccaatttatcaccttaccacccgcctatattagtgcagataataatattgcgacgctggcgattgattgctatttgccagatggctctaaagttcaactgaagcccaataatggcgtcggtgaaactgttttctacaaaaacggtcagctttacgttcgctggtactttaacggtgcgggcggtggtaattacgacagcaacggtcatatctactacacgaatatgaagccccagcaacccggactaacaggtccgacctttaacggtaccacggttattcccatggacgattattatttcatgactgccacttctgacggtaacaactttgtcgtcgtccgcccgtatgtcttagctgccactgctgcgcccatcacggtcaaatacgtcgacgcgcttaccggtgaatccttagtcaccgctgacctcaccttaaacggaatcgtcggtcagccttacacgactcagcgcattgatgacgagctaccaaattatgactttacgaacattgtcggcaatgccagtggtgtcttcacggcggatgcccagaccgtcacttattactactcgtaaggacgccggcgacattacgattcacatggtcgatactaatggcaacttagtctacgaaccgcaaattctacctggaaaacacaatctcggtaacgcctacaatttagatgcgccaacctttgaccattttaaattacagcaaactatcggcaatgcggctggcgttttcacgactgatccgcaaagcatcacgtttgtctatgtccgcttagacgccggtaacattacggtgaaatatcaagacaagcagggacaccaattaaagcccgataagacagtttccggctcccaatcactcggccaaacttatacgactgaaccactaggcattgaaaattacaccctgatgacaacgccggcaaacgccacgggcactttcacagaccaggaacagacggtcatttacgtctatgtgcgccgcgatgctggccagatcgttgttaagtatcaagatagtgctggtaacccactagcacctgacaagtttttagacggcaaagagcagttaggagcagcctatcaaacggcagccatttcaattcctaacttttacctagtcgccacacccgcgaacgccaccgggaccttttcaaccgacacgcaaactgttatttaccagtatgcgcgctcgaatgctgaccatatcacggtgaagtatcaagacgctaacggcacgactttagctcccgacgacatcctaaccggtaacggtcagctaggtcgcccctaccagacaaacgccaagacgattgaaaactaccgcttaattcaaacgccagcgaacgctactgggcaattcagcgaccaagcgcaaactgtcatctacgtctacactcgcgaggatgcgggcgatatcacggttcagtatttagacgaaaacggccagcagttaaccgccgatagcgtattaagcggtcaaggtcaattaggacagccctatgaaacatcaccgctgaacattaacggctatacggtaaaatcgacacagggtaacacgactggaaactatactttgcagccacaacgcgtcgtttacatttacgagcggacagctggacagccggtcactgccaagtatcaggaccaagatggtaagtctatccatcctgacgttgttcacagcggttatttgggtgacaactactcgaccgaacaacttgttatcgacggctacacctttaaaactgttcaaggcgaggtcaatgggacatttgggactactgcgaagactgtgacctacgtctacgaacggacggctgggctacccgtcactgtcaagtatctggatgagcatggtaagtctatccatcctgacgttgttctcagtggttatttgggtgacggctactcgactgaacagctggttatcgatggttacaccttcaaggctgtgcagggtgacgtcagtgggacgttcggaactaccgcgaagactttgacctacgtttacactgaaaacacccccacgattccagatacccaaggaaccgttacggtacattacgtgactaaggatggcattaaactgaacgaaccaaccgtgctgagcggcaagacgggaaccacttatcaaaccgtgcccctgacattcactgatcatgaactcgttggtcagccggaaaatgccatgggtctcttcactgctgataacgtggacgtcacgtacgtctaccaagcaactgacacgactggtaccgacgatattattgatcccgaacaaccggaacaaccgactaagcctgttgagccaaccacacccgagacgcctaacgaaccaggaacgaccgtaacgcagccagacggtattaaaccgactcaaccagcggtagctgtaaaaccagcagcgaccgtgaaaccaacgcttaaacccacggccgaccaggtaagtttggtcaaaataacgagtcccgtcactgaacattcagcccagttaccacaaaccgacgaacagactggcaaattagcggtcatcctaggactgttattatccgtcgtcacactcggtttctatggtaaaaatcggcaatcataacgtcatcaggtctaacgaaaacgacacttcgaaaaatgaagtgtcgttttttctggtcaaaggtgcctataatgaaattaataattataattccgatgaaggaagtcctaatcgatgaaagtctatctcattcgtcactccgaaccaacttatcaacaggtcactacagctggattaactggtttcggccgtgaactcggcggcttaaccgaccgtggtattatgctggcacaacaatgcgcccagcagccgttatttgcacaagttcaattaattctgtcgtcaccctacacgcgtgccttacaaacggcactggaaattgtgcgttttaatgatattccactaaaggtcgaacttggattacacgagtggctacccgataacacgggtattcggactgataccgatgaacaagcggccacggcctacaagctctatcgacaacacgccggcaaacgcaccactgctagtccccgcccctacgaatcggcggctgaaatgaaggcccgagttttggcaactttgaataagtatgccgcatcttacgattgtatcgcctgcgtcacgcacggcgaggtcatgcgacagtttggcgatcagaaagacgtggattattgtggtgtgcgtgttattgcggttgattaggtagttagggaaacattacttcatttgctatggttaaccagattatgagctagtcaacttggcatttttgcttggcttgcgaattggtatttttcaaaactgcttctacggttgttattcaaataatgcagaagcacccacaaatcagcataattatttttaatcttgataattatactagtattaaaccaaatgtggcataattattgatttatactctccgggtgcctgaagccaactttcaaactgtacttaagatgattattttatctcatttcactcacgctaaatgccccatatctaatcataaccattagtttaaatgcaatgaattagctagaaaattctttactattttaatgactaactttgggacttgctcattggcagcgataaggttgtcggttttatcaaaaatacgagctatcatactttgatttcttttgctgggatattttaatactacttgtttcaaatcagagttgtgcaaatgaactatagattttccctgtgcccttttaattagctctttgttttgctgaccattagaaatacaaagtgccagaaaagaactatcaataatgtttattttgggcttaattatattaaggtctcctcccaagacagccccagagatacatacatgcgacgctctggcaatgtcttcggctgtctcaccggaagcaggtacaataacatcattacattcgctaaaaacagaaccaggacgtactttcacaaaagtatcttttatagtagtaatattcacctgataatttgtatataaccgaccatataagacaataggtgtaccttgatctataatatctttcttcgaatagccggctcccttcgaaaagtcagctaataatttcaacttacgctgctcccaagtaccagttcctaatatatgaccgataagcctgaaaacttgggagcagcgtaagctaaaagagataactagtgtaattaaggatggtacacatggtacacatattgagcactatggagcttacctgttaagcgcaaaaaatatcctatcaaataggattgtctacagtaaaaatgatcgacaaattagtattaacgattttaataaaatatacaaagggtattcattaaatgatggggattttcttttgactattgttggaactatagggcgcacagccatttatagacagtccaaagataaaatcgcttttcaacgttcagtagccataatacgtggaaaagaagaaattatagataattattttttgatgtttagctttcaattgcctaccataaaaaaaatattgcaaagagtaacatctatttcggcgcaaccaggtatatacctgagagatctttcaaatatagaagtatggtatccagttatctctgaacaacagaaaatcattgctttattaaagaacatatgtaaccttatcgctgccaatgagtataatctgaaaaacgccctcaacattcgaggacgtttgaatctgcacttattaacgtaaatcctattgtctatattaggcttgctaaatgtttcatgaccttgtcgttatcctggttttctaattcttgaataatgtgtaaataagtttgctgtgtagtcgtcatattagaatgacctaaccgtcgagctactgaggcgatactaacaccagcatacaataataatgaagcatgtgtatgtcgcaaaccatggactgaaatcacaggaatagatgcgtgcttacataaacgctccaaataatgattaaccgtatcattataaacttttgcttgaacaaaaattggttgatcttcgggcagctttttagtcaactgggaaaattgaatcacagtctgccaatccagcggtactttacggactgatgagttatttttggtaggtgcgaagtcacttttggcagatttataatcccaagttttactaattgaaagtgtttggtgagcaaaatcgaaatcagcaggagtaacacctaaggcttctgcaaaacgaattccagtcttagcaatcagcaagatgaagtagtcccaattgacttcgttgttcaggtttaattcatttaacaatgcctgcaactcatactgatgtagatactttgttttatgctgacgatgcttaattcccttgataattgctttccgtgtcgggtcgcgatcgataaacccttcttccaacgcatcaataagtgaaccttttaaatgacgatgaaagtccattgtcgtttgccgttcatgggtttccgcataatcattgagcaattgctgatatgtcagccttgataaatcagccatctttagatccggcgctaacgttaccaattgccgatgtgacatttcatatttgcgataagtcactggacggaccgcatctaatttatagagctgcatccactgaaaaaaatactgatgaaacttaacatgctgtgccataagaaacctccaaaaaatgagttaacaaccacttgtgcggccgctaactcatttatacatgaataattattcatttggctaaaattgacacttacaaataaattaatactatcgctattcagcagggatagcccgtaaaaaatccataaatttggtagattgtaaaatta

SEQ ID NO: 24 - DNA, 39713 bp, Lactobacillus plantarum
gttttcagacagtccctagtttttggtgctataaaaggatttaagactatttatgtatggtggatattaatttaattaatggttattagattagaaaacggttagtgctattgttgattaagattaaggctagtataatagttattatgtttaattaagaaacaaaacttgttacttttaaacgaaatacaaactggttaagaagtttggaggaatctctattggataaggaacaaaagctggatcggtcgttctttggccaaccccgtggcttacggacgttgttcttcactgaaatgtgggaacgattcagttactacgggatgcgtgcgctactgatctattacatgtactacagtgtcgctaaaggtggtcttggatttgaccaagtcaccgcagcatccattatgtcaatctattcggcattagtttacgtttctagtgtcctcggtggctttctaagtgaccgtgtctggggtagccgtaagaccgtctttattggtggggtcttcatcatgttaggccacatcgttttatcaacgccatttggagttggtgcactatttgtttcaatcgcacttattgtcattgggactgggttattaaagccaaacgtctctgacatggttggtcaattgtatacagtggaagatacacgtcgggatgctggttttagtattttcgtcttcgggattaacttaggttcattggttgcaccagccttagttggtcggatcggcttaaatgttaacttccacttaggcttctccttagctgcgattgggatgttctttggtctattgcaatactactttgatggtaagaagaatttaagttctgctagcctctatccaactgatccattagaacccggtgatttgaaaaaaatcatgcggtggacaatcttaggaatcgttgggattgggttgattctactattaatgcaattaatgaatgctcttacgttagcaaatgttattagtttaattagtacgcttgttatcttgacaccaatcgtttactttattttgatgttaacgtctgacaagactaatgcaacagaacgttcacgtgttcgggcttatatcccattgtttattgccgctgctttattctgggcaattgaagaacagggttcgtccgtacttgcgttatttgcagctaatcgggttaatttggatcttggttttacccatctagctgcttctgatttccaaatgctaaacccattgttcatcatgatttatacaacaccattcgtgtggttgtggactaagtggggtaaaaaacaacctagttcaccaactaaatttgcgattgggttgctattcgctggggcttcttacctagtgatggctgtacctggagcgctctttggaactgcagggaaggttagtccatggtggttagttgccagttgggcagtcgttgaaattgctgaaatgttgatttcaccaattggtttatcagttaccaccaagcttgcaccaaaggcttttgcttctcagatgatgagtatgtggttcctaactgattcggttggtagtgcgcttaatgcacagattgtccgtttctactcgacgcaaaccgaagtgccatattttgcgattaccgggattgttagtgtcgttttagggattatcctctttatgatggtgccaatgattaaacggtcgatgcaaggcattcgctaaattgaatatttactcgaagatatgttatcttagtggtagcatatcttttttgttttggaggggttgaccatcgtacgaattgctttcagtagtgataatcattttgatgttaatcgagtggatgcgactgcgatgatgcgatctcaggcgacctatcttttacagaatggtgttcagatttatttgattgctggcgatctttttaatgactttcagcgtagtcagcagtttgtcgtcgatttacaggccctattaggcgcacagacgtgtgtttactggattgcgggtaatcatgacatggtccatggcatttcgtttgacgagcttgaaacagggcattttgatggctacctgcataaccggtatatcgatatttctggtacagattggcgcgtgattggacataatgggtggtatgactatcagtatgctgcccaggtccctgatacgactgcggccgacttcttacactggaagaatgcgttttggatcgaccgggctattaaacagccgatgagcgatcaggagcggactgatttaatgctcaaccaagtaaaagcgcagcttaacttggctgctgtggatcacaagcaagttatttttatgacgcactttgttccccggatcgattatttgcgtttttctgatgataatcggttttggaatatggctaacgcgttaatgggaacgccccggttaggacaactgttggagcagtttaacgtggcgcacgttttatttggtcatttgcacgtccatccgcaaccgcgggtgtttggtcagaccacctattatgaccaagcagtgggctatggactcaagcgtatcaatgaatggcaagccaataattttatggcggagtggtatcaagatacgcaaattctggatttgaaataaaaactgaaaaaactttgaaaaaagtcttgattttttattcaaaattatgtattctaatatagttgaatgatttacggaggggtagcgaagtctggctaaacgcggcggactgtaaatccgctccttcgggttcggtggttcgaatccactcccctccatttcattattgggctatagccaagtggtaaggcaacgggttttgatcccgtgatgcgctggttcgaacccagctagcccaattgttacgcctttcgtcgttaatcaggtcttaagatcttgatgtaacgacttttttattggcttaaatttatcttaatatcggcgggtagtgccacttcgtgaagaatgcgtaacggattcttcacgaagtggatttttttgtctcggtctgtttatttgccatcatcaataataatgtgatatgttttagtattctatttggggcacgatccagatgggataggaggtctggtcaatgaatttatttattccgtaagtacacggaagaggttaatggctggcattgttaattttaaaaatacgtactagttaactcgtcatgacggccatcacaattattatgagtcgttcttataaaagcacaccaatttttaaagcacatatgggttatggaaagaagcgcgctaaccgtgctgttcgaaatcgtatgaatcgtggtgaatttgatgttttgccggctaattcgcatgcctggtataaacgatgttatgagcagtatgatgttgtcgattattgctccagagagacttattcgcaagttcaacttgagctggagacgatgcgattagagattactcgtaacggtgggattattcgaagaatcccacaacatctggttgttacgtatacttttgatccggtgatatctgatattgtgcacatgcagcgaacggaagaactaattcctgcgcaagatgtccaaatgtttgtaggtacttttgaacagtggtgtcgggagcgtcgcaactgctgggccaaggcttattatcgaaaataagtcgtattggaacttgatctatgagatttggttgaagaggctacgtagccttagttgtcccactaccagccccaactagttgactgaataaatcaaattttccacagaactgttatcaaatgtagtaacagcagactgttcagcgtcgcaatgacgcttggacagctttttgcatggcccatatctggatgcaaaggcatttacctgccagagatgacgtggttattaagtatatgactagtagtcagttattcagaattataagatgtttattcaatcgaacctcgaaaattgagtttgttagcgttaagcttaatttagggaatcataccatcatgaataacgtaagcgaccatgatgatgaccaaggaggatttgaaatggcggtaactaaaattgatttaaaaaccacgatgacttaccgggagcatgcaattactagtaaatcatttgctcgaaaattagggattgaactgccgtttgcgatgtacgcaatggcggcgggtgaaagtattagtgctgaacaatccacgctgacccgcttatttgaggttgttgatggtactttgaccgtccgtttggcgacggagaccgaccaagaagtgcatgcgggcgagatgttagtggtgccagctcatacggtccatacgttggtcgctgagcagccgtgccagtttattcaattagaaacgaaataggccttaatagcgagatgcggaggaattcaaatgagtttaattaacaaaattgatcatgctaaggtcctcaatttaactgaacaaattccactggatgatgatcaagttaatagccggacactggttcaacgggatgatttaagtatgacgctattttcagtcgcaaccgaccaagagattggcggccattctgcccagggcgatgcgatggtcaatattttaagtggagaagcggaaattacgattgaaggcaccatttatcatttaactgcgggacaatcgatcgtgattcctaaggatgcccggcacgcgttatatgccgttcaaggatttcagatgttattggtggtcgttaaacccgactaatgcacgtggttatcgatgagacggagggagtaatatgccgctgtatacgtttattggtgatattcatagtgccgcggatgatctggcagttttattagccgatcctgaagttaccgcgacgcgcttgattttcttgggcgattatattgatggtacggcggcacgctattttggtcatgccaccgagtcagctccgttggcgccgctaaaagtactgacgatggttagaaaacgggtacgggaatacggcgatgtggctttacttggcaatcatgatgaattttggctacggacagctcatggtgatgacaatgccaccgcaacttgggtgttgaacggtggtcaccggacctggcgcaaattagggatttactcctccaatcccaatcatgttcggcgggcattaaatggtgcgctattaaagccggatactgatttcttagcacatttgccgctgatgtggcaacatggtcggttactggctatgcacgcgggtgttaactggcaatacccattaacacaacaaacaacgactgacctactgtggattcgggatgactattatgatgacttcacgactggcagtcaccgttggcatcggaacttattcaataaagtcatcattactggtcatacgcaggtgcagaccttgactggttcacacactggttatttaaagatgcaggcagatgcgcaagacgttccacgatatctaattgatgcaggcagtcgttcaggcctgtttgatggtggaatttgtgcgttaacgctgacggtcgatggtgaatttgtcagggcgaaacgcgtgatcaagggtcaccgctacgatggtcagcaaatcgtcactccggccatgttggtggatcaggcgcactaagtatcactaaacatctcagagatagaacgtaaaaggagcaggctcacatgatattgagactgctccttttatgatgtcacgctagttactggttttcgcactatttcaagttgattggtttgcaagttctcactgaatcgttactcagcgtaactgaattataggtgtaaatagaaccagccaccaaggcctaaaatgaacaggccaagtccattgagggccgtaaacacgatcaaaaaatggtggagtggttgttcatcattgaagggcaacaattgttttaaggcaagcagatttgctagtgaggccaccaatgaccccagaccgccgatattgacgcctaaaaatagcgctgataaatggggcgtgaaattcgctagtaagatggcggctggaacattgctgatgacttggctagtaattagtccagtaatatagacactgggggctgtctgagttaattggttgagccaatgcgttattgcgggattatgactgatggcgctaacgaagatgaagaagcagataaaggttaagagtagtgcgtaatcaacgtactgaaagacgcgtcggttaatcatgaggcctacgacaatcgttccgataataactagtgaaatgggcaccaaattaaaaatgccaagcataatgaaactgagcaggccgcccgcaagcccgatttgactgcgagaaatgggcgtagatttggttggtgttacagttagcggcaaccgaggtaaccgccggcttaaggcaactaataaagctagactagcaagcattaacggagtcgacaatttaaaaaacgtgaatagattaacgtgatagaacgtgaccaaaaataaattttggggattgccaatgggcgtaaacgcgctaccaagattggctgccatgataattaaagtcgttgggtaggcaatggccaggtgctgccgccgggcgagtgtgagaaagattggaattaacgttaggatcgcaacgtcgttagttaaaatcattgagccaccaaaggccagtaagatgaataattgacacatttgacgggtatcgtgtgatttaactaagagccagtcccttaaagtatcaagcaaatgcatcgcgcgaagtaattgaacactgatcatgagtgcaaataaggtgccaatcgtagcccaattaattgccgtcagttggggtgtcccgatgaacaaacttaaaccagcacaaattaatgcaataataaagattttatcgtgaagtgtgcgacgaacgactgtcaccatggtaaacgtccccctcaatagtcagttaattagttctaacttaaacaaactcgtcgctaaatgtaaactgatagacatttttcagataaggatgtagccacccgaacggtaacccaaataaaaaatcgcttcaaagttatgtgtttaactttgaagcgattagtgcttggttttgattgccagttagcttgcttaatgtgtatctagtttatcttgctgagtgttttgaccgaagaaccacaagtaggcaccatataacgcgttagcgagcatcactagttgcaatgctaacattgaggcggctgcaggactgaagccttttaattggttgaaccagataataacgttaatcacgtcgagtgtgatccacgcaacccattgggaacgataaccgttgaccatgaggacactaccgacaatcccaagtggtaacagggtcgcgtccaggtagatttggttaccgttaagttgtttactaaagtgtaagacaatggcgtagacgagtacggctaacgcgaaccaggcacaaccggctaatttgctcaatttacgaccagtcagttcgctggcatcgggttgcgctgccattttacgatgccagacggtgatgccgacaaattgcatgataaggtaaaatgattgcgacgcaatgtcaccaatcagccgattggtgatggccgtagtaagccaagccgcacaggcaataatgccccaactatagttcgtcagtcgcccttgatcaaccagaattaagttaatcacgaccgtaatcccggtcaataggccaatccagccatgtaggctgtaatcgcgacccagaataaaaccaatgatggtcacgattagcatcgtgctcatcatcaacttagtggtgcggcgaagcgtctttaattcattaagtccccgttgccagctgaagacggcgcgcatggccgtgggcagactagtgatgtcttgctggcattgttgcagcagggttgataaggtgagtcggaaatggttgttctggttcatagtgaaacactccttagttgtttttagacagccgtgttcggaagcaacgctgtgtttgattgctgtttacattagcttgttcaagcagacctgtcaacgagcttcgcacatattgaaggccgattattaatagattaatcaattggtttcagtattgataagcaatcaccttaatagagtggctcgtgatatttatttgttgatagtgaaagttgagctgaaagaagtgattaattacccacagtttcacaaatattggtatagtagaagagtaagcgggaatgtctgtttaatcctgcctagccgttaatcggttagtggttaatgatataaattataagtcagaggagcgttttacggatgaaaatcggatttattggtgccggtaacatgggccgcgcgattattgatgggtggttaaaacaacaagcggtcgtcccagcagatatttatattcacagtgcccatgttgcgagttatcaaccttatgcgcaaaaaaatgggctacaggcctgtgacactaatttggccgtggcacaagctgctgacgttatcgttttggcagttaagccgaacattgcgttggccgcattaaaagaagttcaagcagctttaacgggcaagtgggttattacaatggtatcaggattgagtttggccgattatgccacggttgtccctgatctccccgttctgagaatcatgccgaatgtgaacgtggcgattggtgccgggatgacggcgttggttggtaatgatgccttaacaccagagcaatatgcggctggacaacaattattcgatgcgattggtgccacgagtgccatcgctgagaaagattttccaactttttcagccttagcaggtagttcgccggcctacatctatttctttattgacgcgatggcccgcgcaggcgtcaagcacggtttgagcaaggatgcagcgactaagattgcggcgcaggccacgctgggcagtgcgcagaatgttttagcttctgataaaattccgtttgacctgatcgatcaagtttcttcacctggtggcacgacggttgctggattactggccatggaagaggccggctttatgaccgcagtggtgaagggaattgatgcaacgattgcgaaggaacttggcgaatcttaaattacttggtgctggtggttgcaagtttggtctataccgattataattaaaccagataaatccaaggaggaattgttcatgagcaaagtgttaaaacatgccatcatttatactggtctagaaaagatcgatgacggctacattcgtttcggtaaggaaattgaagcggttggtccaatggatgactacgtggcccaacccgatgatgatatcgaatttgtgagtggcaaaacgattgtaccgggcttcattgatgttcatagccatggtggttatagttttgattcaatggacgggaatccagctgaaattaacgaaatggttaatgatatggttgcccgcgaaggtattacgtcatacttctgtacgaccatgacgcaatccaacgaaaacttagaccattcgatggccggtattaacaaggccgccgatgaaaatccggttatccaaggggttcatttggaaggcccattcatttcggcgacgtttaagggtgcccaacctgaaaagtacattaagaatcctaacgttgacttattagacaactggaacaagttgtcgggtggtcgggttaagttgattacttacgcgccggaagatcctggttcgcgtgaatttgaaaagtactgcttggaaaatggcattgtgccttcagtgggccacagtaacgcgactcgtgaacaattattagcaagtaaagcaactcacgtgacgcatttatacaacgcgcaacgtgaattcaagcaccgtgaaccaggtgttactggtcatgccatgcttgaaaacaacatgtactgtgaattgatctgtgatgggttccatatcgtgcctgacatgatcaagctcgcttacgaacaaaagggcgttgaccggatcgaattggtgactgattcaatgcgtgccaagggtgaacccgacggtatcagtgaattaggtggtcaaaaagtgattgttaaggatggtcaagcacgtcttgaagaaggtaacttggctggttctgtcctgacattcattaatgccttcaagaacattcagaagttcaccggttgcggcattgctgaagcggttaagatggcttctgtcaaccaagcacgtgaatttgggttgactaagaaaggaacattggaagccggtaaagatgctgatatcaacatcttagatggcaatcaagatttagtcgcaacatatagctacggtaaaaaagcagctaaataaattagaagtaagggatgagtaccatgagttcgccaatttatattcaaatccacaaccaaattaagcaggcgattgaagcaggtcggtgggccgttggtgaccggattccgtctgaacgggagctggctacacagttcgatgttagtcggatgacccttcgacaagcaatccagacattggttgacgaaggaatattagagcggcgagtcggtgccggcacgtttgtcgcgaatcagaaggtccaagaaaaaatgtccggtgtcaccagttttactgatctaatgctggcccagggtaaggtcccatcaagtaagacgatttcatatcacgtgacgagcccgtcgctatctgagagcgaaaagttggcgttaggcgccaacgaacaagttctacggatggaacgaattcgctatggtgatgatgtgccaatttgttttgaggtcgcaacagttccagaacgactcgtcaagcagttcaccaaggacgaaattacgagttcgttgtatcggacgttggaagagaaggcaagtttagtgcctggtaaggctcaacagactgtttcggcgatgtctgcttctgagcgtatcgcagaatacttgtcagtccggcgtggcgatgcgttgctacggttacggcagatttcgtatctgcaaaccggcgaaccgtttgaatacgtgcggacccagtacgttggtaaccggtttgagttttatcttgaaaaataaccagtcggtcgggtgctgggcacctgattagagtgatgataccaaaaatagctcacctaggatgttattctaggtgagctatttttgaattcatgactgaagactgggtacacgcacaaaagcaattgtcatcgtaacgcagtggcttataactggtaatgattgccagttaattggcttgctggcgcgctatttttttaactaaccgcaagtagcggggtaacacgagcatccgcttgaaacgacttggttcttgaatcagacggtagagccattcaacgtggtgtttttgccaaaataacggcgcccgcttaaccgcgcctgcaattacgtcgaagctacccccgacacccatccagagcgcatcgaggcgttgacggtgttcggcaatgaaaaattcctgcttaggaaaaccagtggctacgaagaccatatcgggttgcgcggccacgatttggtcgacaacggtttgttcgtcgtcataatagccatcacgggcacccgcgacaacgatgccgggataagctcgttgaacgatcgtggtcacttgctttaacacggccggcttggcacctaacaaaaagatccgttggtgctgttggctaccccattctagtagtgttaaaagggtgtcatagccggtgatccgttcggggagtggtgtgccaagaatctgggccccctgaatgacgccaatgccgtctggcgtgatatagtccgcttgcgttaacacctgttggtaatcggggtgttcacgagcgtacattaagatctcggggttagcggtcaccacaaagcgattgcgatgcgcgagaatatcggtttgaagttgctgaacaaaaccagcgttagttgtcttgataaacggcacgtttaagatgttaaccgtgtcaaaagggactgacataagcgacctcactttctaatcataattaaagtataggtaaatcaacgaattctgcaactttttggatgcttaagcgcattcttttataaaaaatgctaaaataagcttaacttactgtaaacacggttattacctacgaaatggagaattatactcatgacgcaaatctatccggatgatagttttaccttgcatacggatgcttatcaaattaatatgatccaaacctactgggaacaaggtattcacaacaaacatgcggtgtttgaagtgttctttcgtaagatgccgttccaaaatgggtacgcggtatttgcgggtctggaacgagttgttaattatatcaatcatttacattttacggcaactgacatcgcatatttacgtgaactgggtggctactcagacggttttctagattatttagcgaatttcaaatttgatgcgacgattcgtgcggttcgtgaaggagacttggtctttaataatgaaccgttgttacaagtcgaaggaccactggccacttgtcagttaattgaaacggcactactcaatattatcaattatcaaacgctgattgcgactaaagcggcgcgcattaagtcggttgtcggtgaagatggcttgctagaattcggtactcggcgggcgcaagagtttgatgcggccatctggggaacccgggcggcttatattggtggctttgacgcgacgagtaacgtgcgggctggcaaaatttttggtattccgattagcgggacccatgcgcatgcgctcgtgcagacttatcgaaacgattatcaagctttcaaggcctatgcggagacccatcatgactgtgtctttctagtggatacgtatgatacgttacgtagcggggtgccgagtgcgattcgagtggctaaggaaatgggtgataaaatcaatttccaaggggttcgtatcgatagtggcgatatggcttacttatcaaaacgcgtgcgtgaacagctagacgaagctggttttccggatgccaagatttatgcgtcaaatgatttggacgaaaaaacgatccaaaacttgaagatgcaaggtgctaaaattagtgtctggggtgttgggacgaagctaatcacggcctttgaccaacccgcgttaggggccgtgtacaagatggtttcgatcgagaatgatcatcatcagatggttgatacgatcaaactttcaaataacgcggaaaaggtctcaacgcctggtcaaaaacaagtttggcggattacgaagcgtgcggatggcaagtcagaaggtgactatgtgacgttgtacgatgaagatccgcgcaacgaagaatcaatttacatgttccatccaagctatacgtatattaataagacggtcagcgattttgatgcgcgaccactattggttcccatctatgaccgcggtcaacaagtttatactttaccaacgttagatgaaatcaaggagtattcatttgaaagtctagatgcactctgggacgaatacaagcgggatttaaaccctcaggattacccggtcgacttgtcacaaaaactttatgatcataaaatgaatattattaacacggtcagagaccacgttaaccataaagatgaggaggaagcttactaatgcggccattacaagctgagattattaaagcgttacacgttgcaccaacgattgatccagaagttgagattcgtcgaagtattgattttttgaaggcttatttaactaaaaatacctttttgaagacctatgtgcttggcatctctggcggtcaagattccacgttagctggaaaattgacggagatggccattaccgaaatgcggcaggaaacgggtgatgatcgctatcaattcatcgcagtccggttaccatatggcaatcaagcggatgaagcggatgcgatggcagcgattgattttatgcaagccgacgtgacggatcgggtggatattcaaccggctacggatgccatggtaactgcattgaaagctaaccaattgacgattcatgatttcaacaagggcaatattaaagcgcgccaacgcatgatcgtgcaatatgggattgctggtgaaatgcacggcgctgtcgtgggaaccgaccatgcagccgaagctgttactggtttttataccaagtacggtgacggtggtgcggatattgtgccactatggcgattgaacaagcgtcaaggtaaacaaatgctggccgctttagatgcgcccaagcatttgtatgacaaagtcccgaccgctgacttggaagaagatcggccagcattacctgatgaagtcgcgttaggtgttcgttacgacgacatcgacgattacttggaaggccggacggtcagcgatgctgcggccgaaaagattgaggcgtggtacttaaagactgcccacaaacggcacgcggccatcactgtgtttgatgatttttggaaataagctagttagctgataatcgattaggattacggctaacctaattaaaaaggcgacttgaagattattcagcttcaggtcgcctttttgcatagtcacataattttatggtgactaccgtaatattggtgggattggtggaaaagcggtagaatggtttaaaatatgtaaacgcttaatgtgagaatatccaagtgctgtggcgaatgcagaggtagtcaaagcgattattttgctagacagctcccatggaatctggtattcttacgatacaatcataagggagtaactagcagaaatattctgcggcaatatcgtcagcaagaagccaatccggtattgtcttaaatagtgagacttatgtatgttcacacaattttgcgtgcatacatgagtctcattttttatctggagatcagttagggagtggggctcggatgccagaaaaggagcttacgatgagtacaaaaccaaagtatcaacaagcgttatccgccgtttatgaggaactaggcactgatgaatacggcttacagcaaagtgctgcgtcgcaacggttagaacaatatgggccgaatgcgttgaatcagcaaaaaacgacttccttgttgcaaaaatttattgcgcagttcaaggatttcatgattatcgtcctgttagtggccgccttgattgccgcctttactggggaagccgtcgatgccgttatcatcttattggtggtggtattaaatgcgattttcggtgtcttccaggaatcgaaagcggaagaggccatcaacgcgttgaaggaaatgtcagcgccggacgcgactgttttacgggatggtcagctgcaaacggtcaagagtgacgcgttggttcctggggatgttgtgtcgctagaagccggggatatcgttcccgcggatttacgattaattgagagtgcgtcattgaaggttgaagaatcggcgctgacgggtgaatctgtcccagttgagaagcaggcggagatgattgccgatggggaattaccaatcggggaccggttaaacatggcgtacatgaatagtaacgtgacgtatggtcgggccactgggattgtggtggcgactgggatgcagactgaagtaggtcgaattgccggcatgattgaagcggccgatgagacgaccacaccactgcaagcgaacttgacacagttagggaagtcgctgacgattttaatcttagttattgccgcagtggtatttggtatcggaatgttgcgcggtcaagagagtttgatcaacatgttattgacggcgatttcgttagccgtagccgcaattccagaagggttgccggcaatcgttacgatcacgttagcgttaggaacccagcggatggccaaacggcatgcgttagtacgaaaattacccgcagttgaaacgttgggaagtaccgatattattgcctctgataagaccggaacgttgacgcaaaacaaaatgaccgttgaaaagttggtcgtcaaccaggaactggtggacgcgcgcgctactgaattgccgcttgatagccatttagcgcaagtgatgattttaagtaatgatacaaagatcatgccggatgggttagcaggtgacccaacggaaacagcgttgattcaatataatttggatcagggttatccagtcgatcagttgttgacggaccgtccccgagtgacagaagtcccctttgattcggaacgtaaattgatgtcgacggtgcaccccttagaagatggtcgcttcttagtagccgtcaagggggctcctgatgaattacttaaacgggtcactcagattgaaagtaacggtgacgttcagccgttaaccaagacaagccgtgaccagattctaactgttaatcatgaattggcaacgcaagccttacgggtcttagcatttgcttataaagtgatcaccacggttccaacgactgttaatacggagacgttagaaaatgacctggtctttgccgggatggtcggcatgattgatccagaacggccagaagttgaacaagccgttgcagaagctaaatcagctggaattcggccgttgatgatcacgggtgaccaccgtgataccgccgaagcaattgccgtccgtcttggtatcattaacgctggcgaagatgacgctgtgattactggtgccgagttagatgcaatgagtgatgcggaattcggcaaaaaggtcggcgattactcggtgtatgcccgggtggcgcctgaacacaaagttcgaatcgtgaacgcatggcaaaaacgaggcaaagttgttgctatgactggtgatggggtcaacgatgcgcccgccttgaaggctgctgatatcggtattggtatgggaatcactgggacggaagtttccaagggggctagtgacatggtcttggctgatgataacttcgccacgatcgtggttgctgtcgaggaaggccgaaaagtgttcgccaatattcaaaaggcgattcagtaccttttgtcagcaaacttaggggaagtcttaaccttgttcgtgatgacgatgttgggctggcaaatcttggcaccagtgcatatcttatggatcaacctagtgaccgacaccttgccagcaattgccttaggcgttgaaccaactgaaaagaacattatgcagcataaaccgcgcgggagaaattctaatttcttctcaggtggggtcttcagcagtattatttatcaagggctactggaaggtggcattacgttgctcgtgtactggttagctttgacgtatccggttcacgcaacggcctcattagctcatgctgatgcgttaacgatggctttcgcgacccttggcttgattcagttgttccacgcgtttaattctaaatccattcatgaatcgttgtttacggtcggcttgttccgaaacaagttctttaattgggcgattctaattgcatttgtgatgctggcgatgacaatcgtcgttcccggtctgaatgggttattccacgtgagtcacttggatgcttaccaatggggaatcgtggccttagcttccttatcgatggtcgtgattgttgaaattgttaagttcttccaacgtcgacacatgcggcgcgcataacccatccattaggggtaaaataaggctaactaatttaaagaaaagagtttgtacatgaaaaaagcaacgattcaaacgtatatgccagtactgtctaaagttatcgaaagtactgaaaaaatgggggaagaattaaacccatcttttgaaaaactacgtcaggccattgataatgacgcagttgccaaaatggttccagctgaattcaatgatattcagatggaatttagcgatggtactgaacagtatcaacaaaatttggcacagttgaaaaaagttgcggtacccgcacggttaatggggcggcaccgtaatttgttagcagcatacgaagcctacacgaatgcgtgtgcggccatgacggctagcatgaacatcgacaatcaaacgattgatgtggctgcttttaatcaggctgaaacggatcaagagactgaaatgggccgcgtttcaaataacgtgcaacggatcatgaatacagtcatgtaggagcgctaatctgggtgattggatttagcacactaataaaacgctcggtaacgtttatgcgttgccgagcgttttattgttggttgcggggcagccaactgtgcggccgcgccgtgctcgtttagcctaatgggctggttttttccagctcacaaccaatgtgtgaacagtatcggtaatggcttcgattggtagtgacagtcaacgacaattttcagatggtcattcggcgcggaaacttgggtaaaacgcgtataatataatgtaatgagattaaaagattgggtgaaataatggataatcagattttaacgttagttaatcaaacgctgacgaagtttaaaccgcaacagatcaaagcggttctcggactcatggacgaaggcaacaccgttccgtttatcgcacggtatcgaaaggaacgtaccggtaacttagatgaagttgaaattcgcgaaattaaagataactatgatcggcttgcgagtctagagagtcgtaaggcagatgtgatgaagttgatcgctgaacaagatcacttgacgccggctttaaagcaagccattgaaaaagctgacaagttgcaagatgtcgaagatttgtacttaccgtacaaacagaagcgacgtacgaaggcaacgattgcgaaagatgctggactggagccgttagcagcttggttattacgttttccggcaagtggtattcaggaacacgcggcgcagtttgtgaacgaagcgcaggacatcacagacgcgaataccgcgttagctggagctcacgaaatcttggctgaggcctttggtgataatgccggtttacgaaactgggtccggaattatacgcgtgaccggggcttactagtcgcaaaagtgaaacccaagggtaaagcagccgatgaacaaggtgtttaccaacagtattatgattttaatagtcccatcaagcagatggtaccgtaccgggtactggctatcaaccgtggggaagccgaaaaagtattgaaagtcagcattgatgttgatcgtgctggaattgaccggtattgtcattttcgctttattggtcagcaccacggcccagcgattgaactagtagaagctgcttatcaggatgcctacaaacgctttattggcccagccatcgaacgtgaacttcgcaatgaattgagtgcggctgccaatgaacaggccatcaaagtctttggcgataatttgtaccacttattaatgcaggcaccattaaaaggtcgcgtggtattagggttcgaccctgcttaccggacggggtgtaaattagccgtgatggacgcgaatggtaagttcttagataagctcgtgatttatccacacaaaccagctccaactgccaaacgggaagctgctgcgggtgagtttaaaacctttttggagaagtatcatgttgaaatgattgcgattggtaacgggacggcttcccgcgaatccgaggagtttgtggcacaggtattgaagactatgacccgaccggtttattatgtcatcgtgaacgaagccggggcttccgtgtactctgctagtgctaaggcgcgcgccgaatttcctgagctacacgttgaacaacgtagtgcgattagtatcggccggcgactacaagacccactggcagaattgatcaaaatcgatccgaagtcagtgggagtggggcaataccaacacgatgtgccccagaaggaattgacaacgcagctagatacggtgattgagaccgcggttaaccaagttggggtcaatttgaataccgctagttcggagctattgacgcatatttcggggctatccagcacgattgcccaaaatgtgattacttatcgggatgaaaatggcgaattcacgagccgaccacaattgaaaaaagtgccgcggttgggaccgaaagcttatgaacaagcggtcggcttcctgcgaatcattgacggcaagaatgtttttgataacacggatattcatccagaaagttatcccgcagccaaagcgttattggcagcggctggattgaagacgacggacgttgggacgactaaagcccaacagttgaatcaattagatttagcgcaacttgcgaccagcaccggtgtcggtgaactgaccttaaaggatattattagtagtttgcaaaagcccgggcgtgatgttcgtgatacgatgcccgcaccgttactccggcaagacgttttaaagatgagtgatctaaaaccagggatgcagttgcaaggaaccgtacgcaacgtggtcgactttggggcgtttgtggatattggtgtcaagcaagatggcctcgtacatgtctccaaactaacggataagttcttgaaagatccgcgtcaggcggtggcagttggcgacatcgtaacggtgtgggtcgaagcagttgatgaacagcggcagcgcatcgctttgacgatgattgcaccggctgaagcataatgactgatttagagttacagcagctcgttgcgaccatttccatgcgtgattttcaccgtccgttccagcaccgcgcttattttaatgctcggttacgaacgacgggtggtcgttatcagttggcctcgcatgatattgatatcaatccgaagatgctgactgattttgatgaggccaccttgattggcgtcatcaagcatgaattgtgccattatcatttacatttgactaagcggggatatcggcatcgtgatgcagactttaaacgattactcgcgcaagtgggtggctcgcgctatgcaccagcgccgaagcaggcgacggcccggccgtatcggtatatttatgaatgccaacggtgtggccagcggtattaccgcaagcgccgcatggacactcgccgctatacgtgtggtcgttgtcaggggccaattaaattagtctgaaaaggtttgctaaagtggtacgcttccgatagaattagcttaactattgatatggagggattaagatggaaacgattaaaattggtgtggtcggactaggcacagtcgggaccggcgttgtaaaaatgcttcaagcgcatcaggaaaagatttcagaaattaccggtcgtaagttggaactagcctgcgtagttgtccacaacttgaaaaagcacgaacaagttgatttgggggacgttcagatgaccgaccaaatcgcgaccctgcttgatgatccgtccattcaaattatggtcgaagtgatgggttcaattcatccggcgaaggaatatattacgcaagccttgcaagctggcaaacacgtggtgacggccaataaggacttgattgcgcaatatggccgggagttggttcagattgctcgtgaaaatcatcgcgacttattctatgaagctagtgttgctggtgggattccaattttacggacgattgataatagtttcgccgctgaccggattcaacgggtcatgggaatcgtcaacgggaccactaattacatcatgacgcagatgctgactaagcattggtcgtatgatcaagccttgagctcagcacaagacttggggtttgccgaaagtgatcccactaatgatgtcgaaggccttgatgcggcgttcaagatgattattttaacgcagtttgcctttgggatgagtctttccctcgaccacgttcaagttcagggaattacgaaaatcagcccagaggatattgcggaagctcaccagcttgggtatacaattaaattactcgggattgcggaagaaattgacgatcgcattgcggtctcagtcgggcctgtgcttgtttctgatcagcatccacttgccacggtacaaaatgaaaataatgctgtaatggtaacgggaacggctgtggggaacacgatgttttacggtcctggcgctggagaactcccgaccgccaacagtgtgctgagtgatattacaacggttgcgaaaaatattgcgttgaatacgactggtaacacgtttaactcttatcgccaggagacagtcttagcaacgcctgaagatgttgtgtatcctcactttattgccttgaagatgcgtgatgtgccggggatgatgatgaaattgacggcgattatgacccgcgcagaagtttcatttagtcgaatcattcaaaatcaattaggtgacggcaacgctcgtgttgtgatcattacccatgccatgaatgatcaacagttagcagatatcactcgtgaaatcggtgaacaagagaatatgcaactattagcgagttataaagttttaaagaatgcgtaggtgaggacatgttaacgatttcggttccggcgacttccgctaatcttggtcccggttttgattcaatcggtctggcgctggacatgcaactaacgctacaagtgttgcaacctagtgatcattggcagattgaccatccctttggggcggatgtgccgacggatgaacgcaacttaattattaaaacggcgttgcatttggtaccagatttacaaccacagcatttacagatggcttcaaaaatcccgttagcgcgcggattgggtagtagctcgacggccatcgtagccggcttagtgctggcaaatgaattgaccggcgcaacgcactcttctgctgagctactggaagttgccactcaactggagggtcatccagataacgttgcaccagccctattaggaggcttggttgtggcgacgaacactgatgaacgcgtccgtgcggtgaagttacagttaccgatgctttttgcaagtgtctacgtgcctaacgaaccgctattgacgaccgccagtcgccaagccttgccaactgaattggcgtaccaccaagccgttactggtagtagtgtggcgaatacgttagtggctgctctagcaactcaaaattgggacgtggcgttaccgctgctagaacaggaccagttccatgaacagtatcgggctaagttagtgccggcactacaaacggttagagaccatgcccacgctctgggattaacggggacttatttgagtggtgctgggccgacagtgattactttgggtgattacgggcaactcgctacgttgcaggcgcaattgagccgagatgcaacactcaccggccaattattcctattgccaatggatgcaactggtgtaaaagtacaaaaatcttaaaataagcttgtcagactcgcaaaattttgttatgatattttttgtgagttgtgatgcggccatggcggaattggcagacgcgcaagattaaggatcttgtcggggttaacccggtggaagttcgaatcttcttggccgcactaacgaatataagaatcgatttcgataggttaagccttgaaggatcgattctttttttgttgcggtaaattggactggtcacgttatttcaggcttgcttttttgccaactacttcaactatgttcaccaaatttgccgtaccttattgtttaatctcatgattaccagcattataatgaaaacggttaatctactgattacgatattaagagaaggcgaggaccaggcattgattagaatgagtagatggtggtggcgtatcttggtgggcggagtgcttgttagtgcccgcacaagcggccgtaacgacttatccgattacagggattcaggtggtgcagacgcgggtctatcagacgaatagtcagaacggtgtcggttaccatttaaccgtcgtgcgtcatcagcgtgcccaattgcgtgttaatttacatttaaagtatcaccagcatacacagtggacgcgtactgagcaagctggtatttatcgcaacgggcattaccagcgcttctactacgtgcataatggtcatcagcagagcggctggatagctgctaatcagctaaaacccgccagtacggcgtcggttcaactgcgggtaccactgattgaccagctaccggagttgccaacggggtgtgagatgacagcgactaccatgatgctgcagtatgccggtgttaatattaataaggaacagtttgccagccacgtgccgcgcagttcgaatcctaacactggttttgttggtgatcctgcttcggcttacggtattggtctctacatctacccccaaggcttgttaccaacgatccgccactatctgccgtccgctgtagatctcagcggggtgggcctgcaacgacttaaagcacagctcactaaacgtcatccggtagtcgcttgggttcagggactcgatggttttgcgagtcatacagtgacgctcactggatatacaacggcaactattaggtacaatgatccttggcgtggtcaatccggacagatggataaccaagcatttgagacgatgtggcaattaaatggtcgtcgggcactgagctattaagaaattgataccatagttaacattagttactgtttcataattttatattaaaaatacgctatttgacacacaaaataatcgtttttaatactgtatcacactagtgtatcaacttctagcctgaaataagggcttttagctttagtgtattttggcacggaatttgcatatatataagtgagtgcgaaaaagattgcgcttacagtatcaaaaacataaatagttacaggcaatttagatattatttattcgttttatatgactgtaacgaaaaaataggaggtacaaagatggtaagcattatcattgctagtcacggcgaattcgctaaaggcatctatcaatctggatcaatgattttcggcgaacaagaaaacgttcaagccgttacgttgatgcctagcgaaggccctgacgacatcaaggctaagttagaaaaagccattgcttcattcgacgatcaagagcaagtcttattcttagtcgacctttggggcggtacaccattcaatcaagttaacggcttgtttgaagcacacaaggacaaatgggcaatcgttgccggtttgaacttgccaatgttaattgaagcgtatgcttcacgactttcaatggattcggcacacgaaattgccacgcatatcattgaaactgctaaggatggggtaaaggttcgtcctgaagcattagcacctaaggaagaaaaggctgctgccgctgcaacgaccaacaataacgctggccggccagggaagttggaatatgggttagcacggattgactcgcgactcttgcatggacaagttgctactgcttggagtaagacagttaacccaactcggatcattgttgcgtctgataacgttgctaaagacgagctgcggactaacatgatcaagcaagcagcgccatctggtgtcaaagcgcacgttattccaattgctcaaatgattaagattgctaaagacgacaagcactttggtggtcaaaaggcgttggtcttattcgaaacaccacaagatgcattacgtgcaatcgagggtggtgtgccaattaagacattgaacattggttcgatggctcattcggctggtaaagttcaaccaaacaaggttttggcatttgatcaagatgatatcgacacttaccgtaaacttgaaaaagacggcatcgaatttgatgttcggaaggttccaagtgatggtaaagaaaatatggataacattttgaacaaagctgaaaatatgttgaaggaacaaaagtagttccaagaatatcagaaaagatggaggattaaatcatgaatttgaacgtaattcaagtgattttagtcgtacttgtatcatttttagctggtatggaaggtattttggatgaattccacttccatcaaccagttgttgcatgtaccctaatcggattagtaaccggacaattagtcccatgtattatcttaggtgggagtttacaaatgattgccttaggttgggccaacattggtgccgccgttgcacctgatgctgcgttagcatcaattgcatctgcaattattttagttttaggtggtcaaggccgtgccggagttacttcagctattgcgattgccgttcctttagccgttgctgggttactcttaacgatcatcgctcgtacgttagcaactgggattgtccacatcatggaccgggccgctgaagaaggtagttttagtaaaattgacttctggcaatgggttgcgatctgcatgcaaggacttcgtattgcgattccagccgctttgattttggccgttggtgctacgccagtgaaggcaatgttaaacgctatgcctagctggttaactgatggtttatcaatcggtggtggtatggttgttgccgttggttatgcaatggttatcaacatgatggcttctcgtgaagtttggccattcttcgctttaggttttgttttagctgcaatcagtgaaattactttgattggtttaggtgcaattggtatttccttagccttaatgtacttggcactttcaaagcaaggtaactctggcaatggtggtggctccaacacgggtgatccggttggcgacattatcgacaagtattagagaaggaggcaaactgagatgtctgaaactacaaatattactaaaaaagttacattaagtaaaagtgatcgtctgcatgtttggtggcgttcaacgttcctccaaggttcatggaactacgaacgtatgcaaaacggtggttgggcttattctttaattccagcaatcaagaaattatatacaactaaagaagaccgtgctgctgctttgaagcggcatctagaattcttcaacactcatccatacgtggcttcaccagttattggtgttaccttagcgcttgaagaagaacgtgccaatggggcacctattgatgacgttacgattcaaggggttaaagttggtatgatgggacctttagccggtgttggggacccagtgttctggtacacggttaagcctatcgttggtgccttagctgcatcattggctatttctggtagcattgttggaccaatcttatacttcgttgtttggaatgcaattcggatgggcttcatgtggtatacccaagaattcggttacaaagccggttctaagattactgatgacttatctggtggtattttgcaagatattacccgtggtgcttccatgttagggatgtttatcttagcggcgttaattgaacggtgggttaaggtggacttcagtccagttaaagtttcgaccattaagcaacaagctggttcgtacattgactgggataaactgcccaagggtgcttctggtgttaaggaagccttaacacagcaagctgctggtcgttcacttgacaaatacaaggtaaccaccttacaagataacttggatcaattgattcctggtttgatggcgttgctgttaaccttcctctgcatgtggttattaaagaagaaagtttcaccaatcattattattcttggcctcttcgtattgggggttctgttgcacgttattggttggatgtaatacttgcttatgtcatatttaaaggatggactcgtgggagctcatcctttttatttacaagcgtactttgcataactgacaaactcgccgtataatcggtatgaggatggatacgaggagggattaatatggtgcaatcaatcaatactaaggttgatttagttacgaacggcaattcacatatggggttgaccgattacggtaaaatcatggtcggtgataacggctttgaattttatgatgatcgcaatgttcgtaactttattcaaatcccttggactgaagtgaaatatgtggtcgtatccgtaatgtttggtggccgttggattccgcggttctcttttcaaacgaaacggaacggtatgattactttctcagctaaggaccctaagaaggtgctacgagccgttcggcaatatattgagcctgatcgaattgtaaaatcactgacatttttccaagtccttgggagaatattcaagggtaaaggtaaaaaagataagtatttgaaataatgaccaatgctgtcgagggttctttgccgacggattggtgattatttaatagttagtttaagaagcttaagtatcaacgggtggggttaacgcgggttgatacttaagcttttttaacgcatcaaaagcagtatccgagcacgttaaggtgcgtcataaatggaatttcaataccatgaaacagaaatagttgtactgacaagtcttaaaaagtaactgattcgggaactatggtagaatatagtgtgttatagtgtatcaaaacggatcagctatttgatagtggtgaaaaggagtggcgaagttgaccagaaaatccaagatttgtgaatacgtccgtcaacatagcgatcgacacggactgacgacggaaatggtagcgaccgctttaatgatagcgcgttcaaacgtcagcaaggaattaaatgcactggtacgagaaggccagctgcacaagctgacagggcggcctgtgcactatgttccggtgaatacgacagccacaacggccacaacaactagtggcgtagcgaatggggcgacgacagagcgaataccgacagcgcccgtcgcgacgtctgtgcctaaaccggttgtaaatgatatatttgccagcatgattggttcgcatgagagccttgctaatcaagtggaacaggcgaaagcggccattctttacccaccgcggggattgaatacattaatcattggcccgactggttctggtaaaacttactttgcaaacgccatgtatcgttttgcggaaacccaacaagtcttaacgaacccgcaaggcctgattacattcaattgtgccgattatgcgcataatccggaattattgatgtcgcatttgtttggttatgttaaggggtcttttacaggtgctaatgaagataaggacggtttgatccaagaagcggatgggggcatgttgttcctagatgaagtgcaccgtctaccaccagaaggtcaggaaatgattttttatttcatggatcacgggacttattcacgactcggtgagacggcgaagagtcaccatgccaatgtccgcttagtctgtgcaacgaccgaggacccagaaagtaccctactgcagacctttgttcggcgaattccgattacgattcagctaccagcgttcaatcatcgctcagccaaggaacgtttagaattactgaaggcattattgtcattggaagctaatcgaatcaataaacagattcggttaacggaggacgtggtgcaggccttacttggctcagtcacatttgggaacgtcggtcagttgaagtcgaacattcagctggtgtgtgcccagggttttgtcaatagcatcgaaaatgacagtgaaatcacaatcacgatggatgatttgccacagaatatccgtagcggtctcatgacagtagcctctaaccgtcacgaactgggggccatctctgagttgttggacccggttctcatcgtgaagccaaatgatggtccaacaccgcttcgtaataagaacgataattatgaattaccatataatttatatgagattattggtgataaagcagcgttactccgacgagaaggccttgataaagaacacatcaatcgtttcatcacgaccgatatcaatgtgcatttgaaatcattttataaacaaaatcagttagaagtttcaccagaaaacaagttagccgagatcgttgatcaggacgttattgattttaccaagacggcacagatgacggttcaagatatgctgggttataacttcaaggataactttatttacgctgtgagcttgcatgtcagttcctttatcaaacgcatccaggcaggcaagcccatgcgtcaaatgagttcggatatgttagcgatggtgcgtgaatatccggctgaaatcaaagcagcggaggcgctcaagcaaggattagaggaacggtatcatttaccgattcccaagtccgaagtttattatctggccattttgctcatctcgttaaaatcgatgcagcttaacggcaaagttggcgtgttggtggcagcgcacgggatgagtaccgcgtcttccatggcacaggtcgtcggacaattgttagatgattatgatgttcaggctttcgacatgcctctcgatatggacccgagtgtcgcctatgatcatgtcaagcgacgagtagaaaagcttgattctgggaaaggaattttgttactagtcgatatggggtcgttaacgaccttcggggaacgaattcagcaggagacaggaattgcgacgcgaacgattgacatggtgaccacgccggttgttttggaagccgttcggaaggctagcctggtcgatagtgatctggattctatgtatcaggagctcgttggtttcaaaggttattcgcgaatttcacggaacctaccaacggatagtcagcgcgcaacagtcaagcccgccttagcgacggataagacggcacaacgggcgattattgcaatttgtgcgaccggcgttgggacggctgaacgtatcaagtcaattttagacagtttattagctcaaaactttatcgaaggtattacggtattcccaatctcagtggtcgaaatgaagacacggatacaacaaatcagtcaaaattatcaaatcattgcggcaactgggattacaaaacccgaattagacgtcccttttatttcattggaagaattgctacaaggtggtggcgaaaagtttattgaccagttagcgacgggtatcgattcgccacagaccatggcggaagaaagtcagcagttgacaccggaactctgcgaacggtacttaggcgattacttcacgtttttaaatcctaagaagttaacgggaattttatgggagtatagcgaagtgattgcgacgcacttggatggtgtaatgacgaatgcttttcgcattgatttgattatgcacttagcgggtgcgctagaacgaacggccatcaaagatgaaatttcggcacccaccgaagagatgccagacattatggcatcgaagtggtacccacttgtgcaacaggccaatcagcaattgacagatcaactacagttaaccttctcagatgctgaaaattattatattgtgcaattattggagactcatcaggcaaaggtcgcgatgagttgatacactaacttggcatgctttttgcatgtatcttattgagtagatttaaccgactgaggagggaaagtagatgttagcatttgtcgttgtcagtcatgggagttttgcgcagggcgttgtcgattcatcctacatgatctttggcaagcaagataaggtccaaacggttacctttcaactagacgaagaacctaatgaattagctgataaattagctgctgcggttgcccggtttgacgcggatgatcaagttttattcttggttgacctatggggcggttcgccatttaacgccgctagtcggatcgttgccgaacatacagagcgcatgggtctgattaccggtctgaatctgccaatgctgattgaggcttacactgttcgtaataagccaattgatgaggtgattgcccaccttgaagagactggaaagattgggattaagcatctcaagttgttacaggacgatggggaagatgagccgctatgacgatggatattcgtttagcacgcattgatagtcggctactccacgggcaagttgccacggtgtggaccaagacggtcagtcctaaccgtattttggtcgtctcagacgaagttgcccaggatgcacttcgcaagattctaattgtgcaagccgcgccccctggtgtgaaagctaatgtgattacagttgacaaaatgatcgagatttatcaagactcgctatttgatgaagtaaagccactaatcctaactgatacgccccagaacatggcgcgcttagtagcggggggacttgattttagcaaaacgggcattgatattggtagtctagctttttcagcgggcatggtgatggtcaccaatgctattgcaatcggtcaagccgaagcacgggcattatatgcgttacaagcagcgggattaaaggtgtttgcgcagaaagtcccgacggataaacgggttgatgtgatgccgctattagctaaaaatggctttatggcgccagataagtattaacaaagttatgatggacagtggtgtgtcggttatgggcaccactgttctttcattttggctaggtttctaaggatttaccaaaaatacagccgtaaactttgacggataggcttttattgataaaattaaactaatcgaaacggaaagtagcgggggtttaaaaatgccaacttatacaaaattaaccgccatgggacaatatgttccgggacgcgttgttgataatgacgaattagcagccattatggacactagcgacgaatggattcaggcgcatactgggattaaaacccgacactacgcgatgaatgatgaaaacacctcggatttagccacccaggtcgcccagcagttactacaaaaaagtggtttagctgccagtgccattgatttgatcctagttacgacaattacgcccgatgccttaacacctgcgacggcttgtttagtgcaagctaatattggcgctgataatgcgtttgcgttcgacctgagtgcagcgtgtgctgggttcacgtttggcctagcaacggctgacaagtttattcgcagtgggcaataccaaaatgtgatggtgatcagtgcggaagttaattccaagatgatggactttcaagaccggacggcagccgtcttctttggggacggtgctggtggcgcgttattacaagctactgacaatccagatgaaaacagcttgatcgctgagaaattagaatcgcaaggaaacgctacggtcattcactctggacgagtacggccgattactgaagttgccgcaacgaactacccgcaaacggatgcgttttaccaagttggacgggatgtttttcaatttgccacgacggttgttccagaacagatgcgtgggttaattgcgagtgcgcaactgacacccagtgatttacaatacgtgatctgtcatcaagctaatttacggatcattgaaaaaattgcggctaacttggcgttaccaatgacgaagtttccacataatgttgatcattatggtaatacgtcctcagctggggtggcaatggccttagccaatgtttttgataccttaactgggccagtgctgttaacagcatttggtggcgggctagcatatggctcagtcttgatcaagaagtaggggtgtgcagatggaattaaaagatttagatcgattagttgagaaatacgcgcgacagggttatcagcaaattcgtgttaaagccggcgacttggagattgaagtgacaaaaccagcgttagcttcagaaacggtaactcccgtagccgctacgcctgccagcacagttgcggagactgaagatgaagtcgttacactgccgagtccgatggtcggggtggtccacttggcaccagatttaaaggttggtcagtcactgacagctggtcaagaactaggccagattgagagtatgaaattattcaatccattagttagtccgaccgatgggacgttaacagcagtactagttgctgacgacgccactgttgagtacgaacaaccgttatttacaatgcgaaaggatcggtagctatgtttcgcaagctgttaatcgcgaatcgcggtgaaattgccgtacggattatcaaagcctgtcaacaattgaatattcagacggtcgccgtttgctcaactgctgatcggcatgcgggttacacacaattagcggatgaagtggtctgtatcggacctgcagctgccagtggatcgtatttaaatgccgaagcgattctaatggctgcaattaatacgcacgccgatgcgattcacccgggatatggttttttagctgaaaatgcggattttgccgccatgtgtgcggaatgtggcattgcctggattggcccgcagactgagcaaattaagttgatgggtgataaggcccgtgctaaggattttgcacggcaacaagccgttccggtactagcaggtcaatcattacagggcttagcatggccggatattaaacacgcggccgccaagatcggttttccactagttttgaaagccagttatggtggcggtggcaagggtattcgagtgcttaccaacgttcatgaactccatcaacaattgcgggctgcgcgtcaagaagctgctgcgtcctttttgaatgatgcgatgtatttagagcaatttctgacaactgctcgccacattgaagttcaagtcctcggcacggggacgaaattattcattcttggtgatcgtgactgtagcctccaattgcacaagcaaaaggttctcgaagaaagtccggcaagtattttgactgagacacaacgccggaccttatacgatttgtcccggcagttattagcgggtacacattatcaaagtttgggcacaattgaatacttatttgcggatggtcagttctatttcatggaaatgaatacgcgtttacaggttgaacacggggtgacagaattaaccaccggaattgatattgtggctgaacaaatcaaacaggcggctggcgtcccggttgattttccagaacatgttggcttgcagcccaagtgtacggcgatcgaagctcggttgaccgcgaccttaccggttaagcagacgcggattgaaacgctgagctggccagccgatgtacgagtggatacggattatcatcagggcgatcggctagtaaccatgtatgatggtttgattgccaagttgatggtcaccggtgcgaaccgtcagcaaaccgtgcgcaacttacaacgggccttagcgcaagtaacattgacgggacccacgacgaacttaacttttctacagcaaacggtggcccggcccgcctacattcatgatcagtacacgattcacagtctagcacgttgggaggcgtcgaaatgagtcattatccagcttctgggacctggcaagcctgccctaagtgcggtcggcacgtccaccaacgccaatggggcacttatcagcaatgtccttattgtcactattggcaacgattgacgacggcgcaacgattagaacaactcgtcgatgaaggggcgtttcagccgttgacgatgactgagcggcctgtcaatcagctgggattcccggactatacgaacaaactgcggcgggctcaacgccagaccgggttaaacgaggctgttgtctgtggaacggccctgattgagcaacaaccctgtatcttagcagtgatggatagtcattttatgatggggacgttaaacacggcggtcacacgtcgcttattgcacgctagtgaacaggcgcgggcccaacggctaccactgatcattgtgaccgcctcaggtggtgctcggatgcaagaaggtgtttatgccttggtcggaatgaatttgattctggcagaattagcacggttagcagcaacgccgttacccttgatcacagtgctgacagatcccactatggggggcgtatcggcgagttttgcgtttaagggtgacctgattatcgcagaagcgggtgctaagattggctttgccggagcccgggtcattcaacaaactttgcctgtcaagctgccggcggattttcaaacggcggatcagctgtttaaaaatggcatggtggatgcagttgttgaacgacctcaattgcggtcaacgctaggacaagcattagcgaattatgggattgggaggtcagcccatggataaacgattacagcgattacagcgattacgggcggctgatcggatcagtgcgccgactatcattcaagcgttattgccgacaatgacgcaacaacggggagaccgtttattaggtcaggatgcggctttgacggcgggctttgggcgcactgctactggtcgccaattagctgttctgggcgttgaccggggtgttgatattgcgagccggcgtcgaaaaaacgggggggcattaactgttccaggctatcgcacggcgttaagagtcgtaacccatgcggctaaatttgggtggccggtcgttagcttaatcaatatgccaggtgctgatgcgagtccccaatcggaacgctatggtcagagtcaggccattgcggacttgattgcggtgactggtcagctgaccgtaccgaacgttgttgtatttctcggtgagggccatagcggtggggcgttagcctttgccaacgccaaccgcattatcatgctagatgatgcacttttcaacgttgcttctcccgaggcagttacagcgattttacatgggcaacaaactagcagtgacgccatcgatttattaccaatgacagctagcgctttgcagtcgcgcggcttagttgacctggttattgaccatcaggatcagacattagttgctgcgatcaaccaggcgattgagacccaacttaccgcactagaagcattgccgacaccggatctaattgaacagcgcgaaacaaagtttcaacactttttacaatcttggccggtcaattaaaaataatcatcaaaaaatgggtttctcagaatttttattctgaagaaacccattttttaatagttgcttagtactgattagttgtggtttgatcttgagtcgtggtctggtcctgcgtcgttgtatcttgtgtcgtactagtgccataagtagtggtatcactagacgttgtggtacttgatgaacttgaactggaacttgagctacccgttgtaattgaagctgtctcagagaagactgactctgttaaattactgtttgagagtcccagcgctttacggatgcgcttcgaattcttgtaacgttctgacgaagaggcaacttgataagagagcccatcgatcgtcgcgtcagtaccttgaacggtatatgatttggcatggtgagacgcattcttgtacttcgtatcgagtgcgaccatgtcattccaagttaagtcggtgcgcatgttcttagcgagttctttcgtaatcttttcaatattggcaattgacccaagtgagttagactgactaaccatggccataataacctgccgttgccgtttttgacgaccataatcaccctgaggatcgtcataacgcatccgtgagtaatcaagtgccgctgcaccattaagtttgatcttaacgcccttcttaacgttggcattaccgtatttgaaagtcagcttaggtgtcacggtcacgccgcccatcgcgttgatgatctgttttaaaccacccatgttcagtaagacgtagaagtcaattggaacatccagtaacttctccactgacttgacggcaccacttgcgcccccaatggtgtaggctgcgttaattttttgtgattgcccattgatcatcacttgcgtatcccgtggaatactagtgagcgtcatactttcttttttaggattgattgtcgcaacaatcatggtatcagtccgggccgagaagtccttgccgcgacctagtgcaccagtatcagttcccaacagtagaatcgagaatggcttgcccttcttaataacggcatcaacattccgaagcttggtcgagccggtcgactggtaggtcgtattcatcgtatccttagcggcattccaggtcttatagccccaccagccacccgtaacgatcaacaggacaacgacgattagtaaagtaattaaccaaggacgttttttgtgtggtttcaaatgtgggttacgctgttgctgttcacgatagcggcgttggcgtggtcccatttcattatcattgttattttctgacatattcgttcctcatcactttagatttttccctcaatagtcattttatgacgtttagcaaatcattggtccttaaagttagtaatttaaaaagattttaataatcaaaaaattactggcatcagtagtaacacaattatagaacactataagtaatattgtgaccggcgtcaaacgtttccatctataaattacggtacaagccatcataaaacagtggtatacttgaataattctcattgaattattattttacatagcttgatagcgatattcaatgatgagcaatttgttaagaggggaagactgagcgtgcaaattttacagacattcgtgcagagtattcaaggtgtcatgacgatcatcgtgatgattgcagttggttacttgttggcacgctggggctggtttaatgaaagtgcgactaagctgattgcccgattggtcactcaaattgcgctaccagcctacatgattgcaacgatcacaaagcagtttacagcgcataaattattatcaacgttgccaggattacgttttccagttcttaatatggctattttgtttggtatttcgttcggggtgatgcgagccttaaatattaaaaagagtcatcgcggcttatttgcctccatgtttttgaactccaatacggtgtttattgggctaccggttaatcaagccttgtttgggaatagcgcattaccatatgtgttagtttattacatggccaataccaccattttctggacgctgggcgtttacttgattcaacgtgacggtactggcaccgctaagtttgacttgaagcagacactgaccaagatcttctcaccgccattactaggatttatgattggtgtcttgcttgttctaggaaacattcacgttccaaaattcttgatggatgatttctcatatatcggcggtctaacgattccgctgtccatgatctttattgggatttcaatggccaacgccgggttaagcagcatgcgcttcgaccgggatagcttgggaattttacttgggcgttttatccttgcgccggtactgatgacgctgatgcttattccgatgtcgattccattggagatgaagcaagtcttcattctgcagtccgcgatgcctgtcatgacgaacgcgccagttgtctccaaactgtacggggcggatgccgattatgccgcggtcatggtgacagaaacgacactattgagcctaatcgttattccgattttgatggtgatcgttcaagccaactttattcgttaattattgtgtgatttaaaattaaaagtacccgaatgcgtgccactagtgacaggcgttgcgggtgcttttttgctggttgttaatgatgaaaactcaatttagttcggtcaacaaggtttgaccaattagatactttctgctcagggctgtcccaacacgtctcgctggtagtttttgatgacaagctgatgagtgcgtgctggatgatggttgaggcggcaagatgccattgaatggttccagcctgatgaaaattattttcaaaagcaattaaaaattgaaaaaataacgcctgattccgcgttaaacggcgttttcccgcggataaaagcgaggtaatatactgagctgatttgaaaatcacgtgaaaatggtgctatactgagaaccgttgcgtattaaattttgattaagaaggaagcgaacgtttcgtgaagaaagcatatctttacattgcaatttcgaccttaatgtttagttcgatggaaattgcgctaaagatggccggcagtgcctttaatccaatccaattgaatctaattcgattttttattggggcaattgtgttactgccatttgcattgcgggcattaaagcaaaccggacgaaagttagtgagtgctgactggcggctatttgctttaaccgggctagtgtgtgtcattgtcagtatgtcgctttaccaactcgcgattacggtcgatcaagcttcgactgtggccgtattgtttagaacgtgtttggatactt

SEQ ID NO: 25 - DNA, 38679 bp, Lactobacillus plantarum
caattggccgaaatgcctggaggtcggtgttaggacgcgctaacaaaacatgtttacactcactcgacttttttccagcggtctaagctggccgactttgacttgacgcgtttggaacgttttaacaataattcatgctgacatgaaaagattgcgtgtatgggcccttttatcgcggcggtagctgtggtaaattggaaacatcagcctaagttgacgtgataataatgagatagagggggtcacagcgtgatttatggtaccggcattgatttaactgagcttagtcggattgaagcgattctagcgaagggactgagattgcctgaaaagatcttaacaccggctgagttggcggtgttttcacgttacccggttaaacgccagatcgagtttatggcagggcgtttttcagctaaggaagcatatagtaaggcatatggcacgggaattggtgcggcagttggatttcaagatatcgaaattttagacaacgcccagggtaaaccggaagttacgcgccacccgtttgatggtccagcgtggatttcaatttcacacacggatacgttagtaatgacacaagttatattggaaagaggcaatttgtgatggttgtaattggggagcaccgccacacacaagtcacagtcgacttgcaggcaattaagacaaatattagtaatgaaatggcgcaaaaggatgagttgaccgagttatgggcagtcgttaaagcgaatggttatggacatggaattatccaagttgctcaggctgccaaagaagccggggcgaccggcttttgtgttgcaatcctggatgaggcattagcgttgcgggccgctggctttgcggaacccatcctagtacttggaattacggaaccggaatacgccccgctggtagctgaaaaggatatttcactagctgttggaacgcaagattggctgactacggccgcagcaattttagcggctaatcaagtgacgacaccacttcacgttcatcttgcattagatacgggtatgggacgaatcgggtttcagacgcccgaaaaattggcaacggcggttacgactttgcgtcaaccgcagtcaccatttgactttgaagggatttttacgcattttgcaacggctgaccaggcagatgatacgtattttgcccatcaattaaataattggaaacacttgattgcagtggtggatgagctaccacgctatgtccacgtgtccaattcggccaccagtctctggcatcaagcttgcaatggcaacatggtgcgctttggggttgcactctatggtctaaatccttctggtcgcgaactcagcgcaccataccccttgcaacctgcgttgtcgctaacggcacgcttgacgtttgttaaacgcttcgctcggggcaaatcggtcagctatggtgccacgtatacggccgcacaggatgaatggattggcacggtgccgattgggtatgcggacggctatgaacgccgattacaaggcttccatgtacttgttgatggtgagttttgcggaatcgtcggacgggtctgcatggaccagctgatggttcgtctgccacatgaagtaccggttggagctaaggtaactttggttggcacggacggtgctcgtaccatttcgttgcaagatattgctgactattgtgggacaattcattatgagattgcttgtgggttagcaccacgagtgccgagagtttatatagattaagctttatcagacgataggtttgcgccgactgtctcgtacaggctatggttacatggttggttattgagattaagccaataaaatgagtgctggagaaattctggcgctcattttttagagtctcctattttattgatgagggctgttaagtttatttcagtgattcgattgatttatcggcatctaattataagttcgtttatttttaaacattgatgaaatcatcactgggcagtcttaattaatcggtctgaagtattagttttaacggtgcttagcgattagttctttggattaaattggtaaacggttgctaaaagtgaatggttcatgctattatgagtagcaagatggttatattgggatactatcagatacattgggtatcgaataaagggagatgaggcgatggccgcagctgacattaagcgtggtgacatcttttatgcagatttatcaccagtcgtaggctccgaacaaggaggcatgcgtccagtactaatcgtgcaaaataatgtcggtaaccattacagtcccacagtgattgtcgcggcaatcactgctaaggttcaaaaagcgaagatgccaacacatgttaacatcaacgctgcccatacggggattgaaaaaaattcggttgtgttgttggagcagatacgaacgattgataagcaacggcttaaagatcgcgtcactcatttggatgatcagacgatgcgccgagttgataatgcgttacagattagtattgggttagctgatcgaacacgacgtcggccacaacgcacgtttcaatcatagtcaatcgatggggattaattatttacataattgaactatttcggtgcgatgaccgagtatggataatcagcgggtttcaattcagttaatgactggattgaaacccgcttttagtttctaaattggctaccggtaaatgttacagggcctgttggagcatttagtgatgagctaacattattgtgcattatgattgtctttctgacgacgattaggtaagctagttgaacccattataacgaggggcgattggctgtaaatcgtgaatatcggtgaaaggatgggggcataatgagtaaacaggctcagttcaataagcatcgggtggcaggattgttagtcgcgatgggcgttgtatatggtgatattggaaccagtccgttatacgtgatgaaggccatcattaccggtcaaggtgggatgcaggccgttgatgagaagtttatgttgggggccgtctcgctagttttttggacaatgacgttgctcacgaccgttaagtacgttctgattgcgttaaacgcggataatcatggcgaaggcggtatcttttcactattcgcattggtgcgtcatcatgcgcgctggttagtcattccggccatgattggtggggctgcattactggcggatggggcgctaactcccgcagtgacagttacgactgccatcgaaggcttacgcgatgtaccagcatatgttcaactgtttggtgccggccaaaatacgattatactgattacacttggaattatcaccctattatttatgctgcaacgttttggaacgaacacgattggcaagttatttggccccatcatgttgggctggttcacgtttttgggagtcagtggcttcgttaatctggtgcaggattggacaatcctgcgtgcactgaatccctattatgcgtggttactcttgatcagcccggcgaacaaagtgggaatcttgattctagggagcgtctttctggcaacgaccggtgctgaggccctatacagtgacctggggcacgtcggcaaaacgaatattcggttgagctggccgtatgtcaaagcttgcctactactcagctatttcggtcaggccgcatggattttaggtcccggccaagcgattcagggccatgtgaatcccttttttgcaatgttacctgctaacctgacgatggcggcagtgatttttgcgacgctcgcggccattatcgcgtcacagtcgctgatcagtgggtcgtttacgttagttagtgaagcgattcgactgaaactattcccccgattactgactacttaccccggtaaagcagtgggccaaatgtatttaccggtcgttaactgggggctgtggggcgtgacgagtatgctggtgattttctttcaaactagtgaaagaatggaagctgcatacgggttagccatcacactgacaatgctgatgacgaccactttgatctacgcgtttttacggcaaaagcgcttaccattaatcggtgcgggactactgaccggtttcttcgcgaccatcgaagtgattttcctgattgccagcgcagccaagttctggcacggcggctacgtagcggtcggacttgctttactaattttcctagtgatggccgtgtggtatcgtggcgaacaaattgtccgacaacataaccacccgcttagtttacgacaatatcaggaccagcttgctaagttacgcgacgatcagacggtggacaagttccagacgaacgtcgtcttcctaacaagccgaatggatggcgaccaagtggagcgaaaggtattatattcgattttagacaagtggccgaaacgtgccgacgtctactggtttgttaatgtgacaatcacggatgaaccgtataccgcggagtatactgtcgacacgttagcaacggactatttggtaactgttaagttatacctgggctttcgtgtccgccaagatattaaccgctatttacggacgattgtccgcgacttaatggctacgggacgtttagcggcgcaaaagcagacatattcagtcacttctggccgcgatgtcggtgacttccgcttcgttatcatcgaggagaagttagaaaatggtagtcggttatcccgcttggatcgattagtgatcgagacgaaattaatgattaaaaaatacgcgacaacgcctgccaaatggttcggcctagaattctccgaggtgactcttgaaaccgttccaattctattcaacgagatcccggcgttaccgatcactgaaagacagtaatgccatgcagatttctgggggtcagaatcagccagcttagatttgcttgaaaaagttcagcgtagtgtaaacacgctctacgacatctaattgtaaggcgcttcacgtcggctacgttccagcaattggcaactagccccgaaatccggaataggacgaacaagtgctgaaaaatagaaaactaactgtcggcttgcttaacaactcatctaattttaatttttgcttgagcaactgataactcaaaactaatttcaatagctgatactggacgcaaaacgttgatttgacaacgataaaagaacgactgaattcaaatcaaaaattagaaacattaaattttgtgttgacaagtgtgaacttagaactataatctaattatattctaattattcaaatgcggtgatgagataagtaaatcaatcgtgggtttttcagggagccgggtcaggtgcaagccggtattcccgcatggttgaaaatggtcttggagcattcagtgccgaatgattaagcgctgacggtggtccccgataaacggacaaaggtatctcaattcagtgagattgacgtacctgctgaggactattttgcgaaaaatagtcgaattaaaggtggtaacacgagtcatcgtccttctgtcataacgatagtggggcgattttttattatatatttttggggaggcttcgcgtatgcgaaaaaaggaaattatttttgggttattaagttttattgcactgggaacagtattagctggctgcggcagtagcagtgctagtagtaaggatacatctaaaacctataagtatggtgaagtaacgataccagctaaggacggttctatttgtaatgcgccaaattatatcgcgtatgagaaggggttctttaagaaaaatggtatcaaggccaaactagtagcgaacccgcgggatatcagtgacctagaagcgggttttgcgagtggcaaatatgacgcgcaaaatggtgattttcaatacttacctgcgattcaaaacggggcgcaaatcaaagctgttggtggaatccaccaaggctgtatcaagttgctggttccgaaaaactcaagcattaagagtgttaaggacttaaaaggcaagacgattgggattccggctcagggttcaacaccacaatacgtgacgtccattgcacttcaacatgcgggtattgatccgaagacgggagtaacgtggaaggtttacagcactgatctattggcaaaggcggctgaaaaggggcaggtcgatgcaattgggacggtcgatccgtatgcttaccaagcacaaaaggaatctgggtttaagaccattattgataataataacaatagtggcaatgctaagatggctgcaatgggaatgaaatcaaagggtgcttgctgttacttgtacgtttcgagcaagttagtcaaagagaatccagcgaaggctaaggccattgtccgttcatacaaacaagccgctgcttggatcaataaccatcctgaagagacagcaaagattgaattaaataaggggtatgtctccaagacgaagtttatcaatgtgaagaatgtgacccagatcttgaaagatgaacattttgaactaaatcttaagacaggtaaagaagatttaagttattatatcaagcaattgaagcaagcaggatatttgaagaagaatacgaataacaagcaattgttgaagcaagcttattggtatccagatttatctaagaactaagttcaaggaggtagaatagtatgcaaataacagcagtccaattgagtcgaaaaaaagttgtgcaggcagctaagacaactggccgttattggaagccctggcacttgacctggaacattgttagtttagtcgtattagcaattgcgtattttgaaaaccaattggttgtatcacaggaaaccgttaataatcagacgtatcattggtttttaggtgggtactttgcttatttattgattgttacgctgattggcgcagttacaaatggtcgaattcgccggtataatggacattttgcccagttgaacgtttcgttagttggcttgctgatcgtgcaggatcttctgaccgaaaagtttgtcgttctagaacagcctttcttcgtgagctttgcacaaatcttggaccagatgcgcgaaaatgccggcttgctctgggcttcgacgttgtcatcattagcgctttggttgattagttttgtgattgggaccattcttggaatcttacttggtttgggcatgggacgctatcgtgagtttaactactgggcattcccctacttgaaggtcatcgggattatccctgcggctgcatggatgccgctgacgatggtcatctttccgactagttacatggccgaagtcttcttgattgccttctcggtttggtttccagtggccttcatgacgattggtggcgttcaagggattagcaaggaatacttcgaatcagcaaagaccttaggatttagtgagtggcagattatccgcaaaatcgtccttcccggagcgttgccaagtatctttactggcgtttatacggcaatgggattgtcgtttacaatgctggtaatttccgagatgattggtgctaaggtcggactgggctggtttatcaactgggcaaagggtaccgggaattatacacaagtctatgcggcaattgtgattatggcgattctgttttcagtgttatttgcggtgtttaccaaagttcaagattactgcctacgttggcgcgatggtgctcactagaaaggagcttataagatgggattacttgcagttcaacatgttaatcagcggcttcaagacaatgatggtcatcagatcgacgtgctagatgatattgatttcaccgtcaatccgggtgagttcgtagcaatcattgggccgtctggttgtggtaagaccacgttactacgcctgatttctggattagaccatcccgctagcggtcagctaacgatcgataatcagcagattaagcgaccagataattctcgcggttatgttttccaacatggcagcctttttccatggtcaacaatcaaggagaatattagtgtcggcctgaaagtgacgcgtggtcggcattatgaccaccaattggtcgaccattatattgaattgatggggctaaaaggctttgaaaatgcttatccgcatcaggtttctggtgggatggcccaacgagctgccctcgcgcggtcaattatcatgaacccgcagctcctacttttggatgagccgatgggggctcttgatgcgtttacacgtgcggatattcagaatgtcatcgaacaggtttggcagcagacacagacgacgatgattttagttactcatgatatcgatgaggcagtctacttgagtgaccgaattattgtgatgacgcctcgtcctgggagaatcaaagaaattgtgacaaatccattaccacatccacggtcacgtttgagtgtcgattttgctgaatttcggcatcggattcaagataaattaaactttggcgctcatgatggacaggttactgggtgatggctaaaaaatgcttatcaagatgattggcgagataccagtcttgataagcatttttgctgtgaaaaaacaggatcgcatggtggtgagcttgatatggccatccaggggacttcgttagttggactaagtacgaagaagcaggcttattcgcttaccatcgttgtcgtactggccaatagggtcttaagcgtatcaatcgccgtaatcaatggttgtccatgattcaatgcagcgatagccacgggattatcaggttggtcattaagcgtgaaacccactgctttagtctttgcaggccaatcagtcgtgttagcgattgttgtgacggtgaggtggttagccgcgaacagttcctggaccgcgggttgcgccacagtggcaatatcggtgatgagaccatccacggtttgccaagtctctaagtgataactatcagccatggcggcatgccaagcggtcgtgaaagtcgggccgataccaagagtctcaccagttgatttcatctcaggacttaaaacgactggtgattgtggcaatttattgaaagagaagactggggcctttatagcaatttgttgtggagcgggtgtcaagagtccggggactaggccaagggttgctaaactttgaccgagaattagccgggttgccaattgtgccagtggcaagtgagtaaccttgctcatgtaaggaactgttcgacttgcccgcggattaacgtcgattacgtagacatcatcggtgacgacgaactgaatgttcatcataccgacacagtggaggtgttgtgctaatttggtggcaatggtgacgatcttatcttgaacagcagggctgaggtgctgtggtggatagactgtaatggaatcgccagaatgaacgccagcaccttcaatatgttccatgattcctggaatgaagcacgacgttccgtcggagagaacgtcaacttcacactcggttcccgccaagtattggtccattaagataggcgcaccatggccagctgccaccgctgatttaataactggcgtgagctcatgatcgttatgaacgattgccatggcccggccgccgagtacaaagcttggccgtacgagtaaggggtaaccgattgcgtgagctgcttgatgggcaccggataactcagttacggtcgttccagcggcttgggcaatctttagtagacttaaacagtccgcaaaagattgccggtcttcggtcaaatcggtagcggacacactggttcctaggacggtgactcctaatttagtgagctgatgggcaaggttgatcgcagtttggcccccaaattgaacgatgacgcccgcgggttgctccaacgcaatgattggcatcaaacgttcgattgttagtggctcgaaataaagcttatccgagatagaaaagtcggtggagaccgtctcgggattgttattgacgacgattgcatggtagccagcttgttgaatggccttgacacagtgaacggtggtgtagtcgaattcgatgccttgtccgattcgaatggggcctgatccgagtactaaaatactgtgtcctagtgggtgactctcgttagtttgtccaaaagcagtgctgtaaaaatatggtgtaacactggcaaattcaccagcacacgtatcgaccattttataaacgaatggtaaatcagcagtcatggcagcgatggtcgctaccgaagtttgggcataatgcgccatggtcgccagactcacaccgtactttttcgccgataagaggtgttgggacgtcggcacttgcttgatattccggatgagttgggcgatgtgctgtaacttactcaagaaaaatggcgtgatttgcgttagcgtcgctaattttgctaacggccaacccgcttgcagcgccgccaatagatagaagagccgctgatctgtcgggtgggtcaattggtcgatatattcagtcgtggtgacgtggtggtcaggggtcaaggacgcttgggtcttgggatcgatttcaagcgaagcaatagccttgagcgtggcttcctccaaggttgacccaatcgccatgacctcccccgtggctttcatctgtgttcccaagtgagcgtcggccgttggaaacttgtcaaacgcaaaccgggggattttggcaaccacatagtctaaagctggttcaaaggccgcgtagattgtctgcgtgactggattcttgatctcagataaatttagaccaattgcgatatcggctgcaattttggcaattggatatcccgtcgctttagaagctagcgccgatgaacgactgacccgcgggttcacttcgatgacgtagtactgacgactattcgggtcttgagcgagttgaacgttgcacccacctctaatgtcgagggcttccacaatcgtcaaagccgccgttcgtagctgctgatattcagtgtcagtcaaagtctgaacgggggcatacacgatagaatcgccagtgtgaataccgaccggatcgaagttttccatggaacagacgatgatcttggtaccctgattatcacgcatgacttcgaattcaatttctttgaagccggcgatactttgttcaatcaagcactcggtgacgggggacatggtcaacccccgctgtaacgtttgggtcaattcggcggcattattggcaatgccgccacctgaacccccgagtgtaaaggctggacgaacaatgaccggataaccgattttttcagcaaacgacaatgcactggtcacgtggtgaacagtggtacttgctggaatcggttgatggagccgcttcataagtgttttaaatgctgcccggtcttcagcttgattgatggtggctagggaagttcctagcagttggatcttcaactcattaagaacgccagcctgatctaacgccatcgctaggttcaatccggtttgtccaccaagtgtcgggagcaaagcatcagggtgggtggcccgcagaattttagtgacactggtcaaagtcagaggttctaagtagacttcgtcggcggtggccgtgtcagtcatgatggttgctgggtttgaattgatcaaaatgacatgatagccggccgctttaaggcttagacaagcctgagtaccggcatagtcgaactcagcggcttgaccgattttgattggaccagaaccgatgacagcaatcgaatgaatggcattgtttttaggcattaacaaccgcctccttttgaattgttagtaagaaatcatcgaaaaattgcccagcttcctggggccccgggtgtgcttcgggatggaattgcaccgacattacggcctggtgcggtaggcgcaagccttcaatgctgccgtcatttaattcagtgtgcgtgacgatcagcggggtgcccttgatcgatgccggatcgacggcgtaatcatgattttgcgaagtcatgataatacgaccgtcagcgcaggcttgtaccggatggtttagcccgtggtgaccaaaggaaagctggtaagtctgagcaccataggcgagcgcaatcaactgatgaccaaggcaaatgccagccagcggataacgttgtgcgagttggcgaatggtcgctaagtaagtgtgatagtcggtcggatcaccgggaccgttggataacaaaattccgtcagggtgatacgcggccacggccttgagactagctgtaggtggaaggacaacaacgtccgcgccccgggcttgcaattcagcggtgatagctgctttttcaccaaagttgagaatcgcgacgcgtggacggatggtggtcgtcgctactgggaggggggtagccgttagtacttggggtgcgaatgtggcgagttgcacttcaaaatcagtgatgggatgattgctcaagattgccatctgggctcccgtttggcgaatgtgaatcgttaggtcacgagtatcgacgccttcaatgccggctacatggtggattgtcagaaaacttgccagtgattggcgactagtatagtgatcattaaaagtggccagctcgtgaacgatgatggcttgtgcgccaatcgttggtgcctgggccacggtcggatcgataccataattaccaattaatgggtaagtgaaggcaatcatttgatttaggtaggatggatcagtcaatgtttcctgataacccgtcattcccgtattgaagacgatgcgccccgcagcctctagctggcaatccccaattgccgttccaatccactgtgtgccgtctgctaaagttaagtatttgttcatcccaatcgcaccctttctgataatttggttaaaatttcattttggttaatgggataagtaaacatcattttattgtggatgtcaattaaaaatgcatattaaatgcataaatcgctgaataaagctaaaaatatgcaattaatagaataaaaatgaatattttttcaataaagcttgcaatttaaaagcgatgagaatatagtgtgaatcatactttctgcatgaacatgcagctaatacactatttttgaatatttgaggtgattatatgcaagtcgcgctagttggcgttacggggtacagtggcatggtgttgtaccggctcttgaaacaacatcccgagatcgatcgcatccaattatacgggcacgtgggagcaactacggtggcattaaagacggtggcagccatgtaccagaaagaaacggcggttattcgaccattcgatgcgacggcaatcatgcgcgataacgcgattgtgttctttgcgacatcagcgggtatcacgcgacaattggcattaccattcatcgctgctcattttccagtcatcgatttatctggtgacttccgcttgcatgatccagagcaatatcagcggtggtaccaacgtgatccagcatcggcgaccgctttggcgcaggcgagctacggcttagctgatatgccggcgccgttgtccacctacattgcgaatcccggctgctatgcgactgctacgttattaggactagcgccacttgctcagcagcagttggtcgaaccgacttcgattgttgtggatgctaagtccggcttatctggtgctggcaaacgagcgacagctgcgagtcattacgtcgctgtgaatgataatttgagtttatacaagttgaatcaacatcaacatatccctgaaatgatgcaacagttacagcagtggtggtccgcgatttctgcgattgaatttactaccactttgattccagtaacgcgtgggattatgacgacgatttatgccaaagcgaagtcagcattgacaacgacgcaggtccgggcagcttttaccgcgacctatcatgagcagccgttcgtgcaagtgctaccaacggggatgccgacgctcaaggacgttgttgggtctaataactgtgcgttaggcgttgattataatccggtcacgaacaccatcgtggttgtgagcgtcattgacaatttgatgaaaggtgctgcggggcaggccgttcagaattttaatcgctattttgatttcgcggttacggccggattaccgacgttacctgtatttccctgataaggtgcaataagagaggaagttatgcagatgcaagttttaacgaatacgaagtttgaaacggttgcctttcagtggccggcaggtttttacagtgatggcattcatattggtcttcgtcgtcataaaaaagattttggttggctattttcaaaagtgcctgccagtgcggctggaacttatacgacgaatcagtttcaggcagcaccaactaagttaactaaacagatgatcgaccagggccaccaattacagggactgttgctgaatagtgcaatcgccaattcttgtactggcgagcaggggtggcagaatgcgctgcaagaacaagcctggttagcgaataaactaaacgtggcgccgaacttgattggcgttgcttcaactgggctgattggtgctcagttacccatggataaaatcaaaaacggcttgccgcaattgacaccaacgaagagtgacgcggtgacctacgccgtgttaacgacagaccagcatccaaaaaccgtctgtgtgcagtgtgaactcagcggccagttagttaccttgaccggttttgccaaaggttctggaatgattcatcccaagatggcaaccatgcttggttttgtcaccactgatgcccaaatagacgggccagttttacaggacatgctaagtactaacgttgatcagacattcaatcaaattactgttgacggtgacacgtctactaatgacatggtggtcacgttggcgaatggtctggcagataatccgagtttgcaagcgggtaccaccgactatgatatttttaatcaggcgttgcaccatgtcttaggccaacttgccaagcaaattgctgctgacggtgagggtgcgaccaagttagtcgaatgtaatgtggtccacgccgctacaacgtttgacggtcagcaaatcgccaaagcaattgttggctctaacctcgttaaggcggccattttcggtgaagacccgaattgggggcgaatcattagcacgattggcgccactgatgcagacatcgatgtggcgacggtcgatattgaaatgaacggcgttttacttgttcaacaaagtctggccgttgactttgatatggcagcggtgcaggcgaccttacgtgataaccagattatgatcgatgttgatttacatcacggtacagcaagtggtcaggcttggggttgtgacttgacttacaattacgtcaaaattaacgcgagctatcatacttaaacggaggtggtgaaaatgacaaaattaattgtaattaagattgggggccaggcgattagccaattgagcaccactttctttgaccaaatcgcacagtggtaccaacagcattatcagattctgatcgtacacggtggggggccaatgatcaatcgactgacgactcagcttgctttgcccgtgcataaggtgaacgggttgcgggtgacggatgcggcgaccttagtgctcaccaagttggccctgctaggagatgcgcaaccagccttacttgcaaaattaacgcaacatcacctacctgtgttggggctcaatgcggcggataatcagttactaactggtgaattgattgattatcgacagctagggtatgtcggccggctcaccgctgtcaatcaagtgcaattaatgcaattgttggctcatcatatcggtattttggcccctttagccttaaccgagacgggacaatggctcaatgtcaatgcggatatggcagcgaccgtgctagcccaacaactacatgctgaaaaattggttttgctaaccgatgtcccgggaattatacatcacggtaatgtgatgacatcactatcgccacaacaagctcagcaattgattcgaacagctgtgatcaccgcgggaatgcaacccaaagttcaagctgcaattgccgcgattcagacgggagtcaagcaggctattattacgaatgcaatcgatcaaccaggaaccgcaattattcaggaggtggccgtatgaccatgcaacacgtgtttccaacctatcaacgttttccatttgccattatggatggtcagggcgttcatctgactgataatcatggcaagacgtatttagattttacggcgggaatcggggtctgcaactttgggtatcaccaaccacaaattcaggcggccgtcacccagcagttgacgcatatctggcatacgtcgaatttatacgaaaatgaattacaagatgccgttgccggcctgttagcgaatggtgaagagcgactcgtatactttgcaaattccggaaccgaagccaatgaagctgcattaaaactcgcacggaagtacacgggtaaaaccggcatcttagcttttcagcattcatttcacggtcgaacctatggcgctatgtcgatgacgggcaatcctcatattcaggctggctatgcgccattagtgcctggcatcacgtttgcaacctataatgacgacgcggctttggacaaaatcacaccagagttggcggccgttattttagaagtcgttcaaggtgaaggcggcgtctttgcgggacaaacagcttggttacaagcggttaatgcgaaatgccaagcaacgggtgttttgttgattattgatgaggtgcagacgggaatcggtcggactggttaccggatggcctatgaaggttacggcctggaccctgatatctacacggttgccaagggcttagcgaatggcttgccagtgggggcaatggttggtcggcggcaattagccactgcctttggtccgggcagccatggctcgacgttcgccggtaatgctgttgctatggcggcagcaaaacgtgtcttgacccaattaacaccggcgctgttaacgacggttcgagcccatgccgaacttgtctggcaagccctagcgactcaagtcgaaccgataccggtagtgaaacaaatcacggggaagggcctaatgattggaatccacttagatgaacaaatcccggttaatcaagtcattacccggctacaagtagaaggtttattgacgttatcagctggcgataatacgttacgtttgttacccccaattgtgatgcaatcggccgatttattagctgggattgccttgattgcaaaggtactgacaactttgacaacggaggtcacgacgaatgaataatcaatttgaaggtcggtcattcttgaaggaaatcgactatacaccaacagaattagcttacttaattgacttcgctagtcacttgaaggcccttaaagcacaccatatcccacacccttatttacaaggaaaaaatattgcgttgctgtttgaaaaaacgtcgacacggacacgttctgcgtttactgtggcggctaatgatctgggcgcgaatccagagtttttgggtaaggacgacatccaattcgggacgaaggagtcagttgttgatacggcgaaagtactggggtccatgtatgatggtattgaatttcggggctttaaacaaagcacggtcgaagacttagcgacctatagtggtgtgccagtctggaacgggttgaccgatgagtggcacccgacgcagattttagcggatttcttaacattaaaggaacattttggtcatttaaaagggttgacgttagcgtacgttggtgatggtcgcaataatatggctaacagtttacttgtggcgggagcgatgctcggcatcaatatcgctatcggggccccggtagcgttacagccagccccagcagtggtcgcgttagcccaacagtatgcgcaggcagctgggagcacggtcgtgattacggctgatccgcaacaagccgttactcaggctgatgcgctttatacggatgtctgggtctcaatgggcgagcaggtcgactatggtgagcggatcaagcaactattgccgtttcaaattaatactgcgttgctcgcagctactggcaagtcatcgacgattgtcatgcattgcttaccagcactacacgatctaaagacgcagctgggagccaaattaggcgaacagtacggaatgacggcgtttgaaattacggatgatgtcttccagagtaagcaggcggtcgtctttgaagaggccggcaaccggatgccagcaattaaggcggtaatggcggctacattaggtaacttatttattcctaccagcattttcaattagcaagcttgcgggaactactagagcgtgctacgattatattcgctttgtttcaatcaatacgtggttcgtaaccatcccacgttaaaaaaactaggaggaattaagcgaatgacacaatcaaaaattcgaccatggattatcaacgccctagtcgctgcaatgtatgttgtactatgcctaggccccgcagcttttagcttagcatcgggcgcaattcaattccgcgtttctgaagggttgaaccacttagccgtgttcaatcgcaagtatatttggggaattgttgctggcgttattttgtttgacgcttttggtcccggtgcgagtctcctcaacgttctctttggtggcggccaatcattattagccctgctggtattgacgtggttggcccctaagttgaagacggtttggcaacggatgttactgaatatcgcgctattcaccgtttcgatgtttatgatcgcactgatgattaccatgatgagtagtggtgtcgctttctggccgacgtatctaacaactgctttatcagagttgattatcatgagtatcactgcgccaattatgtacagcttggatcgggtcttgcactttagtgaccggattcagtagggtgtaactgaatttaatattaagaacgaccggcgtagtatgtgaagatgatttttcgcatattacgccggtctcttatttattcatttaatgaaatgtggttaatttgatttttggttgattattttgaaatggtcaacgtgttttggattgttaactgctcggcagcaatgatcgtcctaattcgaactgttttcagcagtcttaagctggtcgcttttgaactgaaaattcatctcataaaaaaagccccaaggtaacctcggggcaactgtgattattcagcttgtaaatcttccacttcgatgactttaaattgtttgcgattcaagttgtcgataattcgtttgagcttttcactgtcgacattttctggcaaggtaaagagcgtccgataaccgagtgtcccgttttggacgtctaaggtcaggcagccggcgattgaagtatatttcgtgataatcttagccatggctgcaagatcaccacgttcaccaacggagacaactgttaaaacatagctaccaacattaacgttccaagattgtgagagcatgtcgagcagacgcgtatgagtgagaatgccatagaaatagccgtgttcatcgagcaccgcaatgtatggcaaatctttgatggagaagaagatgttgtagaaggcggagtcgacttgaatcgttttcgtggcatttttaagcagggtcgtcacgggaagcgacatgtcgccgccccgtgacttgtgccgatagatgtgcatcttatagatgttgccgcggaagatatgaccggtttcatctaagattggaatacagcggaagccggaatcctccaaggcttttaaggcgtcctctaaggtcgcgtccgccgtaatggtgacgaggcgttctttaggctttacgagtgtttttaatagcatagcagttggtcccccagatttattagtttgttttaataaataataccataaaacgaccgcttacacgtatcattatgacatcaaacgacggctaaaagggatgaaaaagccggcctgataacattcagaccggcttggttaaattagatttaaattagaaaacaatgactggtgttccgactggcacggcagcaaaaacttttttcatgacagaaggtggggtgttcacacaaccatgcgagccgtgcttcttgtaccaagtaccaccatattgagtttgccatgaagaatcgtgaattccttcgccagtgtcatcgaacggcatccaataagaaactggttgggaataacttgagccatcgtcattatcacctttaagggtcgcgttcttttccttattccagatgtaccaaacacccgttgttgtagcgtgtttaccgggctttccagtaacgatgtccgttgaaactttgagcttcccatcaacgtagacgtacatatgctgattttctttatcaacttcgacgtaggtgttgccgatgtcggtgcccttgttgttatatccggaaccactggtgattggtgagcgggtaaagtccttgcctttcaaaatttcagtagcaagggctttggcctctgcttcggtcttaatggtccagccataaaacccaccgctgacggatacggtcccacgcgccgtactcttgaactgacgcgtcgtatgataggtatgatacttatcattcaattgcttcatgtaagtcagaacagcgttttggtctaaactcactttgccttgcttatcgactttaatccaactgagaattaggtcgtgaggaatcgtgaatttatgaccgttgatattataggtggccttttcggtagcgtatttcgctgattttactttggccgtctttaaactagcactcgtgctggtaacggccggagtgacgtaggcgtctttaagggtgatatgactgtcaccattactaattgctttggtgacgaccgtcttaagtttagcttgatctaattcggttccttgaacttctttcttaatctcaacttggttatgttgataaactaacttggcgttttcagtttttgttcgtttggtttgattggcagtcgtggtgattttttgtagtagggttttcaaatcagtgtgattgatggttagttgtccaaccgctgagctatcatcagcctgagccgattgcaatagtgcaaggggccaacgccagtagttttgtttggtcactaatttggttaaatcttttttagtattgattgtaataccggctgatttgctggtaaatgagtactttgtttggccgttttcaataattcgataagtgcgatgttctaaagcgcgattaactttcggtgctgcttgagcggcggttttaccactgacgtcaacaccagcgaccgacgtattactgaggaacgtttgttgatgttgccagattaagctcgtggcaacatatccgatgacgaggagaccgaggatactgcccccaatcataagtccacgtttatgtttcataattaagttggtcctccatatattcgtaatattctcaccttataacagaagtgagatgagtgcaaacttcaaggccggtaatcgtgataagaaagttttaaaaatagcctttagtgcgtgttgcgctttaatgaatcgctaaggtaccctcaagcaaacaaaaaaacgcccgtctgctatagacgagcgttcatcatacatttaatcgtatgaaatgattatttattttctaattcagctaaaccgtcgttaagcacttttttcaaagttgcggcggaatcttgcatcttcttgagttcgtcagctgaaagtggtgattcgatgatttgtttcaaaccagttccaccaatcacagccggagtcccgatataaatgtcgtttaagccgtattggccgtccatgtaggcacctactggtaaaacggcattttcatcacgtaaaatggctttggaaatccgcattaaagcagtcccgataccgtagaacgtggcacccttcaagttgatgatgtcgtaagctttgttacgaacaccgtcttctaacttggctaaatcttcgtcagaaacgccttgttccttagcgacatcgcgaactggacgtgtcccgatggttgcagttgagtaagcagcaaattcagaatcaccgtgttcacccatgatgtaagcatcaacggaacgaggatcaacattgaattgtttgcctaacgcaacgcgtaaacgtgaagagtctaaggaagtccctgaaccaatgacacgatcctttgggaaacctgagaatttccaagtagcgtaagttaagatgtcaacagggttagcagcaactaagaagatgccgtcaaagccggagtcaacaactggtttgacaatggatgataggatatttaaattcttgttaactaagtctaaacgtgattcaccaggcttttggggcgcaccggctgtaataacaactaagtcagcgtccttacaatctgaatattcgcctgagtaaatcttcttgggagcggtgaatgcttgggcgtcttcaagatcaagggcgtcaccctttgtccgatctttaacaacatcgacaattacaaattcttcagcaattccttgttgtgccatggcaaaagcgtaactagaaccaacagcgccgtcgccgactaacacaactttttgatgatttggcatgcttgacaaaataagtcatcctctcgtagtgaaaatttagtttttacggttaaagtataccatgtttgtgcaaaataagtgttagattgagcatgcttttaatacaattattaacaatgtccgcaaaaccctttggcgggcgtcaataagccctttgtggtatacttatcgcacttaataaacgctaacttttgaacacttgactggcgggcgcgtcggtcacggtgtgagtagtggtgccaatacgacttaggtggtatcgttactcagagttgccgaatcgggtcgattaccggttcggcctgttttggtatgcaaagtaataggagaagataaaattatgaaaatgatcgttgggttaggcaacattgggcggcaatatgcccagacacgtcataatgttggttttatgattgtggacgaattagctagcaaactaaacgttacgtttcaaacgagtaaatttgaagcacaggtggcaacggcttttcaagacggtgagaagattttactggtgaaacccgccacttatatgaatgattctggacgagcggtgggaccgttgatgagctattacaatgttgatcctgctgatttgctcgttatacatgatgatttagatttaccactaggaaaagtacgcctcaaacaaaagggatcggcgggtggtcataatggcatcaagagcattattagtcatgttggtgatcagcacttcaagcgcgttaaagttggtattgaccatcctcagaagatgagtgttgttgattacgtgttggggaaatttacgccagccgaagtggcgaagtttgacgatgctaagattacggcgctagcggcggtcgaagcttggttagcaaatgatgattttgcggcagttatgaatcaatataactagcccgggaggaaacgacagaatggatattgaaacgattgttgagcaaacgcccgactttcaaacaattttagcaggtatcaacccgcgtagtcggcaactaatcaccggattgaacggttcggcacgaacggtttatttaagcgcgctatttcaccaattaacgcattcattactgatcgtgaccgataacggttttcacgcgagtcagctagtggatgatttaacgagtctcttagatgaagaccaagtttttttattcccagctgaagaaatgattgcgacggaggttgcgacaagttcaccagagtcacgagcgcaacgagtccaggctttaaacgccttattgcgtgacagtccggcagtggtcgtgacctcggttgcaggtgcccggcggttcttgccgcccgtcgcacaatttcaagcagccacgttaccggtagccgttggtcaagatattgatttggaagacttgcagcgacaactacacgacatgggttacgttaaggaaaagttagtcgcacgcccaggagattttgcggtacggggctcaatcgtggatatttacccgttagatgcggactaccctttacgactggacttctttgatactgaagttgatacactgaagtattttgacccggaaacgcaacgttcggtggaaaacttggatgagtatacgattttaccagctaccgactttatcctaacatcagctatgctgcaggccggggcacagcgtcttaaaacggcgattgcggctgaaaataagaaactcaagccagccgaacgccagactttggccgataatttagcacaacctttagctgacatggaaaaaggaattatcggaaacgatttattattatatggcgattatttatacgaccggaaaacgagtatttttgactatgtggccgctgacgggctcgttatcttcgaagaatattcgcgtttgcttgatagtgagcagcagttattaacgcaagaagctgactgggttacggaccaattggcacatcaccgggtgctggcaactgcgagttacggcaatgatattcgggatttgctccgggatgaccaacatgcacaactcttgatttcgctgtttcaaaagggcatcggcaacgtcaaactagcgcaagtaactaacgtgcgcacacgcccgatgcaggaattttttgggcagctcccagcgttgaagaccgaactggatcggtggcataagcttaaacagacggtggtcttgatggtatcagaggctgagcgtctgacaaaggtcagtgatacgcttgatgattttgaaatcgaagcggtcatgactaaggccactaatttacaaccgggtgcggttcaaatcgtgcaaggtagcttgcaaaatggatttgagtttccggatggtaaattagtcatcgtaaccgagcaagaaatgttcaagaaggtggctaagaagcgtccacgtcgtcagaccttggctaatgccgaacggttgaagagttatacggatctcaaacccggcgattacgtcgtgcacgtcaatcacgggatcggaaagtacgttggtatggagacgctggaagttgatggtgtccatcaagactacattacgattgcgtatcaaaataatgcgaagatctttattcccgtgacccagttaaacctagttcaaaagtacgtttcgtcagaatcaaagacgccacgcatcaataagttgggtggtaccgaatggacgaaagcgaagcgcaaagtcgcggcgaaaattgaagatatcgcggatgaactagtcgacctgtatgccaagcgagaggcggagaaaggttacgcctttccaccggacgatagttatcaagatgatttcgataacgattttccgtacccagagacgccggatcaaattcgtagtattaatgaaatcaagcatgatatggaacgaccgaaaccgatggaccgcctattggtcggcgatgttggttatgggaagacggaagtcgcgttgcgggccgcgtttaaggcgattgaggccggcaaacaagtggcctttctagtgccaacgaccattttagctcagcaacattatgaaacgatgctgaatcggtttgaaggctatccgattaacgttggcatgctgtcacgattcagaacaactaaggaaatgaaagagacggtccaacagttaaagagtggtgaaattgacatcgtggttggtacgcaccgcttactatctaaggacgtcgcgtttgctgatctgggcctgctcattattgatgaggaacaacggtttggggtcaagcacaaggaacgactgaaggccttgaaggctagtgtggatgtcttgacgttaacggcaacgccgattccgcgaacattacacatgtcgatgctcggtgtacgggacttatcagtgattgagacgccgccaacgaaccgttatccgatccaaacgtacgtcatggaacagaattttggcgtcattaaagagggaattgaacgagaaatgcaacgtaatgggcaggtcttttatttgcataaccgggttcatgatattgataaagtcgttgcacagatcaaagacttggttcccgacgcggcggtggcccatattgatggtcagatgcctgagtcacaactcgaagggattctctacgatttcattcggggtgagtacgatgtgttagtgacaacgacgatcattgagaccggggttgatattccaaacgtcaacaccttatttgtggaaaatgctgaccggatgggactgtcacagctataccagttgcgtggccggattggtcggagtagtcgggtcgcctatgcttactttacttatcagcaaaataaagttttgacagaagttggtgagaaacggttacaggccatcaaggactttacggaacttggatctggctttaaaatcgcgatgcgcgacttgtcgattcggggtgctggtaacttgttaggtaagcaacagcacggctttattgactcagttggttatgacctctatacccagatgttgtcagaagcagtggcgaagaagcgtggtcaggcggctaaagttaagaccgatgccacggtcgaacttggaatcgaagcctacttgccgaccagctatattgaagatgaacggcaaaagatcgaaatttataaacggattcgccagctggagaataatgatcagtacatggaagttcaggatgatttaatggatcgatttggtgattatccggtagaagtcgctggactattagcagtaggtaagctgaagttactggcggatgacgcgctgattgagaagattcagcgtgacgatagtgagctacacctaacgttatccaaacaagggacggctaagctagatactaaagatatttttaaggccttggcaaaaacaaaattaaaagcgacagttggaattgatgatgataaaatgaaggttaaattagtcattcagccaaagatgcaacaggatgagtggctggcgcaattaacacagtttgtcgaacaactgagtttgatcttagccgaagacgatgtcgctagtacgtcttagctcggtagttgttgttatgaagcatggttgcacggggtgggttaagcgctatcgagtggaaccaatggcaaatagcaggaattatcgtctgatggggcgttgtcctggctagtcagggcgcggctcaaatgaattagtatgagacaccgagttgctcggtagaagggatttgttatgccaaaggatcacttgaacaccgtgttcaaaggtgcgttaattttatcgatatcatcattagtcgctaagattttaagcgcggtataccggattcccttacagaacatggttggtaatacgggattttacgtttatcagcagatttatccgctgtacggcattggcatgacctttgcattaaatggatttccaaattttatttctaagttagtggcagaacagccagacgaaacgagtaagtcgctgattgcacggcgggcgtttcatatcttatccggattatcgttggtcgtctttttcggcttgcagcttggtgcaacgtggattgcggcccacatgggtgacgttaatctagcaccaatcattagtgccgtggcttggatgtttgtctttatgccatggttagcaacaggccgtggttactatcaaggaaaatttttgatgggaccgaccgcagtgtcccaactgatcgaacaggtcgtacgggtcgcaattatcatcatggctgcatatttcagtgtccgtctcggttgggataattatcggatgggaacgtgggcaatgagttcagcgccactagctgcaatctgttcatcactgatttttactgcttttggtctacgctatttattggcgcccgcacccgcacccgcacccgcaccgacccacccattacctagttatcgcaaattaaccaaaagatttgtaattgaaggtgggacgctgtgtcttgtcgccgctgtcgttatcttactgcaattagtggattcatttacggttatgcggggcttggtacatcaaggtcagttaccagaagtagccaaggcactaaaaggggtctacgatcgtggtcaacctttggttcagttagggttggtggtggcgacggccttttcagcaacgttattgcctgctttgacggatgcgttagccaagcgtcaaccgattgaattcaagcgccagacacaggcgatggttcacgttagtttagcattatcaatggcagcgacggtcggtctagttgcgttgatgccacaaatcaatcgcttgttatttggttcattagaaggaacaacggcattgcgaatctatattattagtattttatttgcagcgttgattacgacgtatacaagtgtgttacagagtttgaacgaatatacggccatgatcattggcatcattgctggattagcgacaaaagtgctggctaattacatcttcgtggtccactatggcatcaacggtgccagtgcggtgaccgtattgagcttggccgtgatgtttgcggtcatgtggttaggttcgccggaagacttgcagcaggtgctattagagagtggttatttgataaaattgctcgcattaagtgccgtaatgggtatcgtggttgtgcttagttgtcatcaaatcaccgccttagtaggtccgatactagcgaatacgcgtggaatggctggaattataacggtgattggggtgctaatcggtgtgctggtgtttgttgccggggccgtctatgcccgattattcacgattcgcgagtggttagtgttgccatatggaaagcggctaattaaggccgttgcaaaaggaaaggaacatcattcatgagtatgcgtttagataagtttttaaaggtttcacgaatcatcaagcggcgctctgttgctaaagaaatcgccgataaggggcggattcaaattaacggtaaggtagcgaagtcttctagtaatgttagcgttgatgatgaactaattattagttttggaaataagacattaacagtcaaagtgacgcagttattggaaacaactaagaaaaatgatgccgagctgatgtatgacatcatcagcgaagactacaaaacggattatcgccaaccatttagtgattaggtcggtgtatccgttcatcgaaatggtcgtaaacgttgacttaatcagcatgatgtcgtttacaccggccgatgaagttgttataatttaggcaacccaatttgaaaggactggaccaacatgacgaacgggtcacgtaacaaaatcaagcagttagataatgattatattcgtcaagttgccaccgacgagcatgggcaagcccagcgtgttgcacaagtacggcggcgacggtttattttgattgttgcggtgttcggagcattgatactattctttggttttcagttgattaatacgcggtccaatctgcaccaggtaaaccgtcaagttgcgaccagtcaagttaaattaaaaaaggtgcagcaaaaaaataatcaacttgagagtcagatcaaacagttgaataataaggattacttacaaaagttattacgttcaaagtatgattatacgaagagtggcgaaacggtctacagcttaccaaatgataatgctgccgatgtaactgccaactaatcggggttgtggtctgctttatatgagtagaccactttttattaattgcttaaatgtataactcaacgtttcacaaagtatgctatactaaaaccattatttcataggaggaacaactttttttatggcaattgaagtaggtacaaaagtcactggtaaggtatctgggattactaattttggtgcatttgtaaacttgggtaataatcaaacggggctagtacacatcagtgaggtttccgatggctttgtaaaggacattcatgatgtcttgagcgtgggcgacgatgttacagtcaaagtgttatccgttggtgatgacggtaagattggcttgtcaatccgtaaagcggttgacaagcctcaaggtgaacatgaacatcatggcaaccatcagggtggcaaccggccaaacaatcatcaaggtaacaaccatggtcatggtgaacgtcaaagcaatggcaatcatcacgatcggtcaaataatttccatagtcgtgggggaaatggcggcggtcgttaccaatcacgacaacatgaacctaagaagcaggactttgattcattgatgtctggtttcttaaaagatagcgaggatcggctagcaaccttaaaacgtaatactgaaggtaagcgtggtggccgtggtggtcgtcgtagctaaacttagtgacttgccattaatctagttaaattttgaagcacggtgcggctatttagagtcacgaccgtgctttttttattgaaaattgccgattgttcaaggtcagtcagcgagacacgttggaaacagtgtgagttaccgtaaacttgcttggctagttcatcttatgctatccagtcggaataatgttcaaataggtgacaaacgaccagccaactaatcggcaagttttaacaataaataaatccaatgtatttataatgaagttagatgggaggttaagatgacaccaattcaaaagttcaatcggcaattagctgcagccaaactgttatcaccacagcaaacagtggtggtagcggtgtcgactggggtcgattcaatggtattgttgcatttgttgcaacgattgccagcagcggaacggccacgggtagtggtggctcatgttaatcatcatttacgcgaacaaagtcaaatggaagcggactacttgcgacaatattgccagcagcaaaacttgaagctagtcatggccgattggctacccgcggcacatcccaagagtggtattgaagcagctgggcgtcagttccggtaccatgtttttgctaaggtgatgcgggaaaatcgtgcaacggcagttttgactgcgcaccacgccaatgatcaagtcgaaacgtatctgatgaagcttgcgcgtggtggcaacatctcacaattgacaggaatcgcaactagtcggccctttgcaacgggccgattaattcggccgttgttgacgtggtcgaaagatcagctacgaaactatgctgccgagcagcatgtcgtttattttgaagacgttactaatcaagatgtggccttgacccgtaatcggattcggcaccgtgtcgtgccagaacttatgacggttaatccccagttattaaagcatgtggccgattaccagcaacagttgacaacgctgttgacggctaaaaagcaaatggtcacggtactactgtcgcaggtcgtaacggccacaggggcgttggttgttgatcagtggggcgcactcccgagccagtggcagttagccgtttttgcgacgtggctcgagcagcagacgcaacaactattcaccgagtcgaagttacaaccgctggtctcgtggggacaacggacgcggcctgccacgagtagattaacggtaaacgcggcctgggagttgtaccgtaacgctggtatcattgaagctttgccaataaaaaaaaggggtaaaaagttaatgccccgtgaaaaaattatggtagacttaaaccaatggcagaaaattactgcaacccaaacggtgggaatctttacgcgggtgccaaatgttgtcagtcagccattttggttaacagaagccgattggccgctagtgtggcggccgtggcaagctggtgatcgaatcgttctcaagggcggtggtcatcagctggtacgtcgactgctgattgatcgaaaagttccggctgaacggcgtgaacaggtgcaagtgttagtgaatgctcaagggaacgttctgtgggtggtcggtcataagtttagctatcgtacgactggtacccagacagtatttttagccttaaaacacgagagttgaaaggagtacatctgaaacgatgaacaacgacattgaacgagtactttatagtcgcgaggatatccatcaggttgcacaaaaattaggaaaagaactcacaactgcatatgctggtaagaacccattaattatttgcgtactcaagggtgccgttttatttaccacggacattattcgtgaaatggatatttacgcggatcttgattttattaatttatcaagttacggtaatgaaacgatctctagtggtgaggttcaactaacgaaggacttagatgctgatgtgacggggcgtgatgtgttagtcattgaagacatcattgataccgggcggacgttgaagttcttgatcgatttgttgaagcggcgcgatgtgaactcagttaaggtctgcacgttattggataaaccagctggtcgactcgttgatattaaggcagattatattggttttgaagtaccgaatgagtttgtggtcggttacggtcttgactatgcagaacgctatcggaacttgccgtacgttgggattttaaaacctgcgatttacgagcataaataattggtcaatgatagtcaaatgtgctattatttagactatcgaagtactgtatataaaagtttcgatgaaggaggcacatatgaacaatcgacgcaatggactctttcgtaatagcttattttacattttgatgtttctgagcttgatgggaattatctactttttctttggcggtaattccggctcacaaacgcaaaatattcgttatagcgaatttgtcaaacaattagataagaataacgttaaaaacgttagtatccagcctagtggcggcgtctacaaggtaactggttcataccggaaagcacggacgacttcttctgcaaacgcccttggtatcaagagcgcatctacaaagacgacgtcattttcaacaacgatgttggaaaacaactccacggttgaccaagtttctaagttggcggctaagcatgacgtcaaggttacggctaaggccgaagaatctagcggcatctgggtcacgttattaatgtacatcgcgccagtcatcctgatgttattcctcttctatatgatgatgggacaagcaggacaaggcggcgggaacaaccgggttatgaactttggtaagaccaaagcaaaaccagctgatagtaagcaaaataaggttcgtttctcagatgttgccggtgaagaagaagaaaagcaagaattggtcgaagttgtcgaattcttgaaagatccgcggaagttcgtgtccttaggtgcacggatcccatctggggtactcctcgaggggcctcctggtactggtaaaacgttgcttgctaaagcggttgccggtgaagctggtgtcccattcttctcaatctctggttctgacttcgtcgaaatgttcgtcggggttggtgctagccgggttcgggacttattcgaacaagctaagaagaacgccccatctatcatctttattgatgaaattgatgcggttggtcggcaacgtggcaatggtatgggcggcggtcatgatgaacgtgaacaaaccctgaaccaattgttagttgaaatggatggttttacaggtaatgaaggtgtcatcgtcatggcggcgacaaaccgttctgatgtacttgatcctgccttacttcgtccaggtcgtttcgaccggaagatcttagttggtcgtccagacgttaagggtcgggaagccatcttaaaagtccatgctaagaataagccattagcagctgacgttgatttgaaggaaattgccaagcaaacacctggattcgtgggtgccgatttggaaaacttattgaacgaagcggccttgttagctgcccgtcgtaataagaagcaagttgacgctgcggatctcgatgaagcagaagatcgggtcattgccggacctgctaagcatgatcgcgttgtgaataagcatgaacgggaaaccgtggcttatcacgaagctggtcatacgattgttggattggtcttgaatgatgcacgggtcgttcataaagtaacgatcgtgccacggggtcgtgctggcggttatgccatcatgttaccacgtgaagatcagatgttgatgtcgaaacgtgatgcgaaggaacaaatggctggtttaatgggtggtcgtgctgctgaagaaattatctttggggcgcaatcatcaggtgcttctaatgactttgaacaggcaacgcaaattgcccgggcaatggttactcaatatgggatgagtgaaaagcttggtcctgttgagttagaaaatgccaaccaacaagcagcttaccaacagggtatgggtgcgagtgccttttcacaacatacggcacaattgatcgatgatgaagtccggcgtttgagccaagaagcgcatcaaactgctacggatattatcgagtcacaccgtgaacagcataagttaattgcggaagccttattgaagtacgaaacattggatgaaaagcaaattctcagtctgtttaagactggtaagatgcctgaaaaggatagtaatgaatttccaagtgagaaagcagctaccttcgaagaatccaaacgtgaattggaacgtcgcgaagctgaaaagcacgcgcaaaaccaaagtgcggatgataagcaagcagactcagctgacactacgactaatgtgagtgttgctgaaccaagtttcccaagtgaatcggatgctagttcagaagttagtgctgacagtagtgtcaattcaacagctaattcagccactgaatcagctaccgacagtgatgtcgcaacttcagccaccggtttaccaaatgctgaaagtgccacaccatcatcgcaggatgatactaattcgcaagcatagtattgaataaagtaaaatgaaggagctgggactttgtctcggctccttttatgcgttatgatatttcaggaaaataaatcaattgcgttaattcggttatgagcgtcgggtcgcaattaaagacggattgagataggagtatgattaaatggcagattatttagtaaaaagcgtcgcgggtaatgagatgtttcgagcgtacgcagttagcgcaacgggcgtggttgctgaagcccaacgccgacatgatacctggagtgcagcatcagcagcgttaggccgcagcttggttggtacgttattattagcatcatcggttttaaagggtgaagaacaaatgaccgttaaaatcaacgggaacggtcctgttggtggtatcgttgttgatggcaatgctaaaggtacggtcaaggggtatttacagcacccccatgtgcacttgcctttgaatgataagcataagatcgatgtgaaggcggctgttggaactgatggctttttatctgtgactaaggatcagggggttggggatccattcaccggaacggttgcgttagtttctggtgaattaggcgaagactttacgtattacttagcacagtccgaacagattccatcagctgttggcttgtcggtgtttgtaaatgacgacaattcgattggagttgccggtggctttttggtgcaagtattgccaaatgcgacggatgaagccatcagctcgctagaaaacaagctcaaagacatgccattagtctcccaattgatgcgtgatggtaagtcaccagaagatattttggatttattatttgatggtgacgttaaggtattagataaaatgccagttaagtttgaatgcgattgttctaaagaacgatttgccgaagcactaatggctttgcccaagcatgaggttcaagcaatgattgatgaagatcatggtgccacggcagtttgtcatttttgtggggaccagtatcagttcagtgaacgcgaactagaagcagtgctctcacggtccaagggtgacgcttaatgaatcaagagtggcagatcggtgatgtgacgattcccaatcgtgtcgtagtggcaccgatggccggcgtgactaacgcggcctttcgagtaatctgcaaggattttggtgcggggttagtcgtttgtgagatgatttctgatcgcgggatcatgtatcataatcgtaagaccctggaaatgatgtttgttgatccaaaagaacatccaatgagtattcaaatctttggtggttcgaaagcaacactggttcaagccgcccagtttgtcgatcagcagaccaatgctgatattattgatattaatatgggctgtccggtgaataaagtggttaagactgatgcgggcgctaagtggcttttaagtccagataaagtctacgagatggtcgcggctgtgactgctgcggttaataaaccagtgacggtcaagatgcgaactggttgggacgcagagcacgtatatgccgtcgagaatgcgcgggctgccgaacgagctggtgcagctgccgttgcaatgcatggacggactcgtaagcagatgtaccaaggccatgctgattgggacgtgttaaaacgggtggcggatgccctcacgattccattgatgggtaatggtgacgttcagacacctcaagatgctgcgcggatgcttgatgaagtcggggccgatgccgtcatgattggccgggcggtagaaggtaatccgtggatgcttacccagacagtacactatttagcaaccggggagttactaacgccacccacaccgatggctaagatgcaaacggcaatggaacatttgcagcggttagtggttttaaaaggtgagcggggcggatgtcatgaattccgtgaacaagcgccgtactatctaaaaggcatcccaaggtcggcacggaccaaagtggctttaatggaggcaagctcgttagcagaaatgatgcgcattttaacgcagtttcaggagcagacggcaacttatttggctagtcacgcggtaaagtgaataattaacttgcattttggcggcgtgattgtcaaaattaacatgtagtgattgtttaggtacggaataaatctgtacgctaactagaaatggaggaacactagtggcacgacaagaacagacgatgaacgaccaactgaaggttcgtcgcgaaaaaatggatgaactgcgtgaagaggggattgatccctttggtcaccggttcgaacggactgatttagcccaggacttgcaagacaagtatggggatatggataaggacgagctagacgctaaacaagtggtggcaaccattgctggacggatgctagctaagcgtggtaagggtaaagtcggttttgctgatatctgggatcgctcaggtaagatgcagttatacattcgtaaagatgtagtcggcgaagatacttaccatatcttcaagcgttctgatattggtgatttccttggaattaccggccaagtttttaagacggactttggcgaattaacgattaaagtaactggtttaacgttcttatcaaaggcgttacgaccattgccagataagttccatgggttacagaatgtggaacagatctatcgccaacggtatttggacttgatctctaaccgcgatagctttgatcgtttcttgaagcggacgaagatcatttcagcgattcggcatcatttagacgatcaaggcttcacagaagttgagacgccaatgttgcataatcaagctggtggtgcggcagcacggccatttgtgactcaccacaatgcgttgaacattgatctctacttacgaattgcgttggaattacatttgaagcgcctgatcgttggtggcatggaaaaggtttatgagattggtcgggttttccgtaatgaagggatggaccgtgaacataatcctgaatttaccatgatggaaacttatgtcgcctatttcgacttccatgatgtaatggctgagacggaaggtatttttaaagccgcagcgcaagccgtaactgacgatggcattgtcacttatcatgatcaaaaagttgatttcaatcaaccatttaagcaaattcacatggtcgatgcgattaaagaaaagactgggattgatttctggcaaccaatgtcaattgaagatgcacaaaaattggcggatgaacatcacgtgaagtatgaaccatactggaaagttggtcatatcattaatgcgttctttgaagaatttgttgaagacacgttgaatgaaccaacctttgtttatggtcatccagttgaaatttcgccattagctaagaagaatgaagaagatccacggtttactgatcgttttgaactcttcatcttaggtaatgaatacgccaatgcgttcagtgaattgaatgatccaattgaccaacggcaacgtttcgaagctcaggctgcggaacggactgctggtaacgacgaagctgaacatattgatgaagactttgtcgaggcgttggaatacgggatgccgcctactggtgggttaggtatcgggattgatcggttggttatgttaatgacggatgcggactcgattcgtgatgtcttacttttcccaacgatgcgtccagaagaagataaataattagatttaaaacggcagttagcttaggttttcctaagctaactgccgtttttgttgggtcagattgagtaactttagttcggaaagcgatttattgaaaaaaagttagattatttttacccgaacattgttgagacatttggaggctaaacttaagtaaaagcggattttatggtggtggtaggtaggatttgaagtcaattaacatgattatggttttaaataccgtatattatcaaagtggattgattaacatgatattattgactggttatttttgcattttagggcttgcaatttatcaggataattggtaaattagtatacgttgttgaggcgcacaaagcggttagccgcttgcttccaacgaaaattaattataaaaagttgttgacaagatgttgataacttgatatgatgattaagttgcgttgaggtaatcaac

SEQ ID NO: 26 - DNA, 50177 bp, Lactobacillus plantarum
ggaataggacgatcattgctgacgaacagcaatccaaaaataagcaccttttaataatttttgaggcgaataataattagcagagtggatatatagattataattctatttataacaaggtgatgattagatattgttgaattaaaatctaaattgggctaaattaaatagggtagtgaggaggattggatgatggaggaatttggatcaactagtaactatttactttcgtgggaagagttgcccgcggtgcccgtttatatggaacagttgttgcaacttgttaatgaaacaattcagccgctggggttacctgccgtaacgaagacgatgattaatagttacgtgaaacaacattttttcagtcggccggttggacatcggtatacccggaatcagattgtggcggtactagtcgtttcaattttgaagactgatttttcattaccagtaattagtaaagcgattttgcaaattcgtgattcgcgtcagattgagccgcggtaccagcaatttcggcaagcattcgagtctacgcttgctggacaaccggtcgtcttgtcgacggttgacccgttagcacgggcaattcaattagcagctcaaacggtggcggcacatttattaacgatccgagcgcttaacgaattggtagattgagttgagataggcacataattgagaatagcgtttgataatatcgctatggctgcttgtagcgtattcgaattaaagcgaattaggcttagcagatatgattaggtatgaaagagagaaagagaatatgacaacacgcaaaaaatggacaattgcgctcattgcattcttgaccgtgatcgtcattggggtcgcgggcggtagtttttatttatatcactttgcatttgaacccaccccgaaagttttgaaccatagttctagtaagagtaaaagtaagttgaagcagaaccaagcgtggctgaaacgggtcaacaagcagacctggcatgagacgtccgcaacggatcatttgaagttagttgcggactatgtaccagctgcgcaccgaaccaccaaaacgattattgtggcgcatggttacatgggtaacaaggagcagatggcgagctatattcgattgtggcatcgccaaggatataatgtgctggcgccggatgatcgtggcaatggtcagagtcagggggattactatggttttggttggcctgaccggttggactatctaaagtggacgcgacaggtgattcgccgcgtaggccaaaatagtcagattggactctttggcgtttcaatgggtggtgcgactgtcatgatgatgagtggcgagaaacttccatcacaagttaaagcgattattgaagattgtggctataccagtgttggtgatgaattgggatatgagctgaatcaactatatcacttaccgaagtttccactgctgtatacggcaagctgggtagctcaagcgaaggcccacttcaactttatgacggcgagttcagtaaaccagctcaagaagaataagttgccaatcttctttattcatggtgctaaggatacttttgtccccacgaagatggtatatcagaactaccgcgctacgacggtcaagtcaaagcaattatgggtggctccaggagctggtcacgcggaatcatacacgcgttatccgcaactatatcaacaaaaagtaagccagttcatggcaaaatatttgaagtaagagctaacggaatagaataactaataaaggtcaccaagcagcgattgctgattggtgacctttattatggttaaaatatgctagtcggattagtgtttgtcagccggtccgcgtcctggtccgatctccgggactaagctgatagcttttgaacttgataaatagcgcggttaatcaaccgagtgttttgcaaatgggtgccgcatacttggtataaagatcagtacgccgatgaagttaagcagtaatgacaaggcggtgaagataaagacaccgttgtaatcgaaccagccggagacggcgccaccaagtaaggagccgagcatgctgccagctgcttggaaagattgattccaactgaaaatagtgcctgttaactcgcggggtgtatttttggataataatgtttgcaccgttggaaagagggccccgtcagagatcccaatcatgaagcgcaatagccctaatgtccacacactggagacgaagccttgtggaaagtacatcaggatggcaaagacgaaaccaaagacgaaaccaaagacaaggatacggtcagccccccggtgatcaccgagccgtccgagtcgcggcgccgataatagcgtcgaaattccgggtagagcggcaatgattccagcaacgacggtgattgggccgacgttatgcatcagttctttgacatatagactaataatgggcgtgatggaattattccccatttgaataatcatcgtggagacgagcagtgtgataatcaacgttggatttttaaattggctgagtagactgccgtcacgtttagcaatcggcgcgtcgctgggtttaaagctttcgtggacgagtgtcagactcaatacgaagacgatcagtagcaaaattccggtgataatgaaagtcaaacgaatagagaaaacttgggcgagtacgccaccgagaatcgggccgatcaagttaccagacacgtagccagttgttaggataccgattgcggtcccactactttccttgggagtttcggtggcgattagggcgctagcattgggaatgtagccggcacacaggccttgtaagaaccgaagtagaatgagtatccaaatgttatggacaaatcccatcgcaccgataacaaaggccatcccaagcgaagaacgcagcagcatgattttgcgaccacgccggtcagcgagtttaccccataatggtgagacaacagcgacgacaaaaaaagtcactgcgtatgtaataccactatacatcgtgagttcgtttttggagaaatcccccatttgaccaacgtataatgataagaatggcatgacttcagaaaatcccattccggcgataaatgttcctagccagagaacagcgagattccggcgccagcctgtcaatgcgcccttcacaatctgtcacttccttaattaacttattaagattattttaatgcgaatttaagttttgtgcaattaactaacttagttaaataggattgaatggcgactgacaatgaaccacaatgagacttaaaatagcccgtatagcagccttttattaatttttgagtgtaataagacacaataaggcacaaataaaatgcaccacaagtgcaccaaaaatgcaccacaaaattatattctcataattcactcatataacgagctagctttgaagcagtctcgttcttttgttttttggtgacgtgtaaataaatttgttcagtgattttaaggtcagcatgtcctaacgtcttagacacttcgttaattcccgcatgagcttcaaaagctagcgtgcagaatgtatgtctgaacgcatgaatctttatatggcgcaaaccgtattttttacagatactccaattaaaatagttaactgtactaggtgacatcagcttgttttgttggttagtaaataccagttgactaggatcattagcgttgaatccaagttcaaaacattgtctggcttgggtcatcttccacttgtgcaaccattgtgcggtatctgggtcaagtacaatagtgcgataactgctgttggtttttggtgtctgtatgatcgtacgccaacgtttacctacagcttgggttttattaaccgttagttcgttagtctcaaagttaatgtcgctccattgcaatgctaaggcttcacctcgccgtaaacctgtaaaggctagtaggcggaagaacataaatgcttgggggttttcatgttttgacgcacaatttagaaattgcactagctcggacttctcataaaaatctatgtgcggcgcttgtggctttgttttctgtttaggaatgctagttttagccattgggttgcgagtggttaattccattcgtacgccaaaatcaaaaacactaatagcatacgtcctaaaacggcgatacgttttgaaaccctgattaagccacttgtgcacgattgattgacattgggctactgtgatacgttttacccgttgagagcctaattcgggaagaatatgcaatctaaagatgtcgtctgttaccatgtacgttgattctttgacttgttccttgtaatcttcgttgaaccatttatcatagagttcggcaaaggtgatattattgcttgctatgaaaccattcttagtaaaatctgtctgaacattcgaagtccataattgggcttctttttttgtcttaaaaccacgcttgtgcatccgtttggctttgccgttggtatctttacctacggatgtgaacgcctcccagaacgcaccagatttcgttttatactgtttgaatgtagccatattgattattcctttcataccagctggcgggcaaggtatgtaaaagagaaatattaatcatcaggagtatatgaaggcatagctttcatttcttccaaaattgctttgtagttttcaacgcctattctttcaccttgtcgcatgaattctaaaacatcggtggcatcagggccatagtatgggttatcgatattatcatcttgataatctaatactagaagcttctcaattttattaaaggcatcattttgcacaattctattgtttcgaaaatgtttcaggatatctgcttcgtcaattgtttcgtatgtgaaccatttggcagtttttaaaagttccggatattcagaacttaacagttcgttatggttttcaatccatacggccagtcttagtgcagtttcatttgatagattgtcaaaaatgacttttctattatcgagcaattgtaataaattgattgcctcttgatcactggcaatgctgtaatcacgtttatcagattcacaaattagatattcaagggagactttaaaaaatttggcgatttctactaataatcctagttgtggatttcttttacctgtttcatattggcttaatgcgttatcttttacgtggattttttggccgagttgcttaagtgtcaatccatgttcacggcgtaattcaccaattctagttttcatagtgtcacctctcactttttgaacacaactataccattaaactcacaaaatgtgaacggaagtattgacactcacattttgtgagtataatatattcacataatgtgagtgaggtgatctatatggcagaagtttctagcaaactacggacggcattaggacgtaagcgtggtgaactgaatattaatgtagttacgttagcacaactaactggtgtgagccgttggacattagacaaaattttatctggagagcgaactagtgtgagagtgggaactatcactaaacttaatgattggctatataagcaagtttaaggaggccaagctatggatttagtaacactgacatcacagcggttggacgcggaagcatatacgactggcgatgtgattgcggagtatgcgggaattacccaccatgctgttaatgtaacaatcaatcagcagtatgagcggttggcgcgcgcaggtaatggcaaggtgtcatttaaaatgaagcctatgctaagtggtcaaaaagctaaggtctatttactcaacgagcaacaggctaccttgctgatcacgttcttaaagaacacaccacgggtagctgatttcaaggaggaacttgtcagacagtttacagttatgaaacgtgagttaattttgcggcaggctaagtttgaactaggcaaggatttttctaagtcgttgcatgaagcaattagagaaagcccggcgctaggtgagcatggtcacttgtatgtgaatatcaacaagttggtgtataagcaggcactaggggttaacgtgaatgagttgcgcaaagctcgcaatattcctaagaccgaggctattactcactacttaagttctagtgaggcggatgcagtcaagcgggttaaacagcaaattagaacgctgcttgaaatgaagatggactaccagcaagtcaagcaagctttgcagattcaaggcgtgatttaccgtattgagttgcaattgccggttaaagcatccgtaatgcaataacctattaggctaagtgctgagaggtggtgaggacgattacagaaccgattaaggtgttattaagtgatgaacaggcgcaagcactacgagacttcgtataccagctaaccacggattcaatcagtcaggccaagcgtgatgtgggtgctagtcagcagtggttacgcaagaagaaagcggcggcgtatgcggatgtatcagagggaacgtttgcaggctggacgaagcaaggattagtaggtcacgtcattaatggatcagtgctatttaataagcacgacatagatttttatatcaatcacaatggaaaaatgaagtaataaaatccggctggcgggcaattgcggttgatgaacatataataaattcgagtgaggatggtaattatgattggaacactattgatgagtttagttaagtttatgattatttcggcggttggcaacgtgtcatttaaattgattgctaatccgggtaagtatttcggttaggcagattaaggggttagaacatgaatgagcgtacaaaaaaagtccgtgttactcgccaaagtatcacacggacagcctgaaaacactactgttatgggctttttgcatactcattttactacaaaatgaggagtaaacacaatgggtaagccaatttatgaactatcaaagttaaatgatattagtaaggcgtgcaagcaggccgctatcacgatagaacgggttaatgtggcaaatgctagtatttcagctatcagcgaattagttaccccaaccttgaaacaggcaattactggtgacgataacgttaattattttgaattaaatgacgacgagttgcgagacttcatcgatgagcaaggcaataccatctataacacgatgtgtgtattaacagaaatggacgaattatcagcgcttattgatagcaaaacagccgctctaagcggggttattgatgacattaatagcactgtaaacgggattaatgatggtattaataccattttggctggtggtaactcggattatattgatgataactcacagggggcgactgatcatgaataatgcacagacacaattaaatcatgctaagacgactttacaaggcactttattgcaactggactacttacaagagctagtcaatcaaacggtaatgcaagacagtcaacgggctaaaattagccagcaaatccataacattgaagtgaacaaccaaggcgcattgaaacaacttgcatccgtctatgaagtcccgttagtcgggatagccaagtaggatggtgagcgaatgaaagcaaacgacaggctaatgagggcgctacaacttgcccgtgatggtgttgcggtttaccccttagcaagtaacagcaaagtgccgttaagaggcacacagggatataaggacgctaccacggatgtagaaacgattaaaggttggtttgagcatgtcccaagggcgaaccttggcatccgtttagaccaagctaagttaatcgtggtggatattgaccgacatggtgatattgatggcacggaaacattgagaaaacttaatcagcaaggcaaacccttaccgagtgacacttatattgaacataccccgaatgatggcttacattacttcttcaagttgccggttaagctagatatgaaacggcgaacaggtctatatccgggtattgatgtgctggctgacttcgtattagtagcaccgagcgtgattaatggtagtgcctatagggcggttgaaccaactaacgatattgctacggtgccccagtggttacttgatgatctgttacccaatcaacggatgaacaaggcaccgcagcacgcctcacagattcaaaaaacgtgggcgggacggatgcttgatgacttagtggctggtactggcgagggcagtcgcaatagctacctgacttcgttattaggcaagttactacggactggctgtaatggaatgacggcctacgagctactgcaatatgctaacgagcgattacaaccgcccttatcggataaagaggttaatactattttcaagtccatcattaaacggacgtaggaggtgtcaatgtgtcagaggataagaacttaaagcaagccatccaagaacatgacaagcggattaataacgtcacagctttaaagggtgatgattggcaagaccaactccgattaacgacccagggggctattcggcggagttcgctatacaatattttactgtttattgaaaatgatccgaatttaaaaggtgtgttggcctataacgagttctcggatcgagtggtgaagttacgttctaatgataaaacgggactaaaaaaaggcgattggcgagatacggatgattccttgctacggttctattttgacgcacaatataacattttgctgtcaaaggataacttgctggatagcattgttaaagcgtcacaagaacacgggtttgacccgatgaaagaacggatcgaaacggtgaagtgggacggccagccaagggcggaaacctttttcattgattaccttggtgccgaagataatcactatacacggatggtaactcgcaagtggttagctggggcgattgcacgggtttatcttcccggagtgaagtttgatattatcccaatcctagagggtgcacaagggcttggcaagagtaccttggtgcgtcagttggcacccgattactttagcgatgacatgaagagcatgaaagacaaagacgactatcaaaagctaatgggtagttggattattgaacttgctgaactgtcggccatgaacaagactgatattgagagcattaagaactttactagcgcccagtcggactattaccgcaacacttatgcacgccggccagaacaacatccgcgccggaatgtctttatcggttcaaccaaccatcgagactatttaaaagacgccactggtgaacggcgcttttatccaattaaatgcggagtacagcccgttactaagaacccactaaaggcgcaacaagctgacatgctacaaatccttgccgaagctaagacttggtttgatgctggcgagcagctttattttgaccaacagacacttaatgaggccaaagcctaccaacaagaagcccaagtcattgatcccatgagagacgctgttaacgattatttagaaatgctagtgccgactaattgggacaagttatctgtaagtgtaaagcatacctactatcgtgacttagttaatagtatgcggttatctaacgaaattgaaagtcaattaagtaaggaacgtgagccactacagcaaacctcagtacgagagatattgtcagttgtctttaatcaacaagtagatgattatttggccgtgcgaactaatagcaattctaaacgcgttaagttgttgttggataatttagaagggtgggaatatggacgcttgcgattaaatggaaagcaggttcgtggctatcatcgaatcctttaacacaaactttttgtggaatttactgtcacactgtcacaaagtcttttaaacgttgatatagaagcctttttaaacaaaatttactgtcacattactgtcacaagctgtcacacactgtcacagtctaagctaaaggtgtgacagtaaatgacagtgatgtgacagcgttgtgacagcagaaacgttgctatggcggtgcttatagcgattgtgacagtgtgacagtaaatttgaaataaactttaaagaattgcatttaaaaatgaatgacggaggaatttaaaaatgaaaaaagagcgaatttggacagtgcttcatggccaagacttggatcaattaattaaccaagcacatacagacaaacaaggcaaagattatcaagttaacagtattcaaacccagtatttaaacaatgagtacgtggtaactgtgattatggaacgagctaagccccagcattatgaattagtagaagaccaatggctagacggtaatgattccttaccagctccttgccggttgagtgaccagctaaagcaattagcaaagaatggtatggattttgaagtcgtcagttacaccaatgagaaccggattaatagtgatggccgcgatgttgaatactcaacggcactgttacgagtgtacgatgtctaatctgggtgtattgagttcatccgtcaaataagaaaaggtaggtgccattaaaatgacgttatcaatgactgaatttaaagtattaaacatgttgcctcgtggtgcgggttacccaatgacaacaccgaatatctgcaaggtaaccgggcttaaagaacgggatgtcagagaagccattagtatcttaattaatcaacacggcgtgccaattgtcgctaaccggagcggtcgtaatacgggaatgtttattgcaacggatgaagccgaattaaatatcggggtcacttcgtttaagaaccaagtaaccacgatgaatgcgcgtattagagccatagaacaagctgacttgaatggctgggagcaagccctaagaccagagataaaacgcctagacgcacaagtaagccacgataaggaggcgaactagtatgcgagtgctttaccctaagttagttgaagaagcctataattacattgctaaggctgaaccagccgttaagaatgcacctaacgctgttaagtcagagatatacagtaagatggttaatgacgggataattgatgagaatggcgagccaacacagacagctattgatcggggcttcgttgatggtgattgctacaattgattaagcccgtttacaacttgacaaaacatgacattgttttgcatgttaattgcgttaaacacgtcatggcctaatttgattgctacttaacaaaacttaacattggaaatatagtgacgcttgaaaacttgcatatttaatatagctatcctgacatttctgacgccctaaaaaatggacgggtaatgaattagtcggacaaatcggacaccatataataagcgacaagtaacccgacacagttagacggtatatttggtccgagtgctgttatatcaatacttatcggctaatgataactcgtgaaatgttggtttatgttggacttttttactggaaaatactggaaattgaacatcgctagttagttaatagcttgaatgcttgttatgactggtcttagagctgttttgaataaacaaaatgttagaaaatgttagaaattaaaaacggatgagtatgtcagctggcttagatggcgtttgactaccggttgggttactggttgggttactggttgggttatttgtgtgcatataatgcagacagctgttcggacagtcagacgtgctataattaactttgtgggaattagtcgtagtatagtcagaaatgtcagatacgtaaaaagggatgtttgcggggtggctagcgtcccttttttgatgattagcaagtggtatgatgggtttaaggagtagggctagaaaacgtcagctgtaaacgctggcgctttttagtcttttagggagcgaaagcatggaacagtggtatcgtaacgcgcgccaatatttaaagcagtaccgtttttaccatgggattgttgagcaggtagttaatgattggaaaggggcagagaagcccaggcgattgcaacaaatggagttgtattgtcagcgggttactaatgcaattgatagcatccgtgatgaacgtcaagccaatctattgcgtaatgagttcgtagtggcggatggtagccaacgggtggcctatgaactatcgggactaagtaagtcgcaatattatgtcatccgcaagcaagctatgcgtgaatggttgcagttaatcaatcaacacaaataagttagagaaaactggagctttagcgtgttttggattaatcgtaaacactgatatagcaatgccattgaaccctgttatcatagccatagcattgttattttattaacaaccgtacagagagtacgcctgttgtaccgatcctaaaatgttaggaaatgttagggtgcaagtgtaaccggagttacggttgtaaataacggcgcaacaaaaaagccatcctagaattaatcaaggacgactgatgttatagaatgattaacaggtcaggcttacgccaagtaatatgccaaccttagcaaaagtctatcaaaaaatttaatcacaagctaaagaaacgcgatagctacctagcaattaaaacgtcaccatttggcaaggtatactgtccgcctatttcaccaagttcaatggttgtgccgttgagctgagtaaacggtgaatttagtataataatctgcggatgaagtggattaagaaaatcaaactcaaattgtgctttgccagttattacctcgccagtgctaagtgtatgcttaaatagtaaaacgccagcgtcttcgtaagacggaaatttaacatgaatacttttagtggtcaaaggctatcactcctaacaaatttgtcttttcaattctattgtgccagttgtaggccaattgtttgatctggttaacaataaatttaccaatacttaaatttataaaacatcagccgcacttattatatgtattgcccgccagcatgattaatcggtaaatttatgtgttttgaagataaaatgcaccaaaaagtgcaccacaagctatttttattgttgaaaacggcctattatcgttgatatataagcattcttaaaaaatcactgttcaaactaaatagacttgaccaagcgtcactaaaaaaactacaatggaaaacattgtagaaagggtgaacgatgtgcagcaagagtcaaagtatcaaatagaagtggtggcgcctaagcaccgacacatgtctaattgggacatgtttgcaacttggattggcgccaatgccaataatggcacgtggtacgttggtggtgtattggctgcgtgtggtttattgacggcgcttaaagtgattgtagcatcgtccacgctatcgtatttatgtttatcgttagtcggcttcatggggtataagaccggggcggcgacgatgagcttgattcgtggttcctttggtgtgcggggcagttacgttccgtcctttgtgaacttgacccagtatattggctggacagcggtaaacacgttcattgcagcaacttctgtcagctatttattacacgatctagttggctggccagtctatggtaaacccggtggggctaaaggactgatcctcggaattattgtcatgagtgtgttgcatttattgagtgtttcggtcggtcaacggtcggttcagatgattgaacgtttaggtattattcttgtcatcttatttgttttatgggagacggtcgtcgtgttccagacggtctcagtgcatgatttgttaacgtggcaggcgccgacacatttacatatgacggcgggggctgggatggatacgctagcggcgttcaatttgtcttgggtgacagcgggtgctgattttacgcggtttacgcgcaaaaagagtggcgcgactggcatgccatttttaggggcctttaccggcttgttctggttcgcctttatcgggcttgccgcgacgatcagtatcgcgattacttctggaacttatgatcctaataactctgacccgagtaccattgcgagtcgactaggcttgggggtattagcactactggtgattgtcttaacgagtatgacggcgaacgcggtaaacttattggcggctggttcggcgctgtcgaatatcttcccacggattcggttacgaccagcactgtgggccgtgacaatcattgccacgttagtcacactgattccattaatcatggggagttttttagctgcattcacggcgttcctagattatattgggatggtgcttggaccgatgatcagcgtgatgttagtcgattactattggcggcatcgtcagcactatgatatcaacgaactggcgagctctaaggggcagtattggtatcatcatggggtgaattggattgcgctattatgttgggtactaggtgtggccatcttcttgttattgaagcacattgcttggattgcgacggtgactggtgcaaccttcattgacatggcgcttatcggggtcatttacgtggctttaatgcgaattttctacccgttacctgccaaacgtgtctaattggattacaatagataagtaaacgaaattagaacgaggggtgtcatgatgtttaaattaactgagatcgatgacgtattaaataatttaggtgaccacgcagactttgccacgattgccaaaaaagaagccgatttgggcgttcaacattttcaatatgatgttgctactggtgccacaacttactttggtgagaacggttatctcgtggaacggcggacgaatggcttagcagtccgggtcgctcgtgaagaagatgccgcggcagttgaacaaatcgcgaagcaatatattgctggccagctggctctaacagacgctgtcaagcagtttgccaaggctgggtgtcaagcttggactgctaacttaaaacgccacattgtcgattttagcggcgatgaaggtaaaataatggcagctgtaacattctaaatcaataataaagtgcaaaaatgcagactatccacttttaaccgggtagcctgcatttttgcgttccattaagtttaatagccagcttgatgatattgcttgcttaactggcgttctaagctaagtaaagtcagcggacttagccgccgtaactgatcagagtgatagcgcatgactaattgttcgggactattgattgtaatactagtgacgccgtttaggccttgaaaagcgctttgaatggcctgctggagctcgggatgttggggccagacaggggaggtcagcataactagaccatgttcaggatgttgatacgtaatctgatatttgttgagataacgttgaaacatgtcttctgggttcatgagcaattcctcctcggattggttactagtaacggtgagccgcagtttagtttataacccaaaccagacgacccaaacaaaaaagccagccaggcacaatagcgcaataccaatgagtgcccagatcgtaccgttcagctttttggtgtggtgatagtagtaaatactgagtatgccacacagtatggcaagaatgatgctggtgccaataattaaaccaattgtcaattccataaattaatttcgactcctcatattatcattttaattgtgcattaaaatgcgataaagtgcaattatttatcaggattcttagtatggtaagaacgctaagcattgcatggtgactgagtagtcttgggtggcttgctgatgagaagccacccaagactacttcaatgataatcgatcgtaaaataaaaaaactaggctgcttatgattaacagcgctagttttgattaatgacagttagttagtcgtttttttagacaaacgggttgcaagcaacaaaccggcgagcgctaaaataaacgtaaagtagaacccgtaatgggcaccgttgacgaacgcgctagcagcttgatgacccccattggcgtagtaagaagcttggccaatgcctaataagctcgttgcaatcgcggttgaaatggcaccaacgacttgctgtagtgtgttcatgattgtactaccatcggcggcaattggtcccgttaaggaatttaaaccatgcgtctgtgaaggggacatcgctaatggcgccccaatcattaagataacgtgggccaaaataacgtaccacgttgcactctgcgtggttgtcagtgccaacatgagggcaccaaccattgaaatcaagaaccccagcattgctggagtgcgggcgccaatcgagtcatataagcgacccgagacggccgacacaattgcgttcatcaagccaccgggtaacatgatgaccccagtcaaggcaacgggaatcaacagccccttttgaatgtacattgggagtaaatacatggctgataagataatcccaaagttaatcataacgaggcaagcgccaacccgaaaaccagggatagcaaatgtcttaaggttcagaattggcgattccatggtgagttgtcgatgggcataccaagccagaataaccagtcccaaaattaaggcacctagtacagcgggcgacccccaaccttgatcactagcaagactaacgccaacaacaaggctaccaaagccaaccattgaaagtaaaatggataagaagtccactttcggccgggttactttcgcaatgtttttaagtgaagtgacggcaaagataaaggcaataatcaagaatgggataaagagccaaaaaatccaccgccatgaagctagtcctaagatggctccagcaatcgttggacccacggccggtgcgaacatgatgactaaaccgaccatccccatagctgcccctaatttgtagggtggaaaaatctgcatagccacggtaaacatgagtggtaagatcaggccagttgcgataccttgaatcattcgaccgaataataacacgccaaagccaggcgctgaagccgaaataatcgcaccaacggcgaagtcaatcagggcaaataaaatcacttggcgggtcgtaaaccatttggtaattaagcttgaaagtggaaggacaatcccaatcataagcatgtaaccggttactagccattgcacagttgccgttgacacgtgtagctgagccatcaattgggggagggcaatgttcagtgatgtttcactaaacatcccaacaaaaccaccaattaacatccccatcatggctagcatgggatgggcaacgggaacgcgggcccgttgtttagcttgcgggctactttgtactgaatccattatattgttcacactcactttcctgaatacaatgggttagcataccagaaaattatttttttcgtaagtgttttttctgaaaaaagaggattgatttacggtagtttgaaaaccatcactcaactagtgcgtctgtgactgcaattgtcggcagtttcattgagcgagaaaggtagcacgtaatggttgttaaaatagtgtttttgtatgtaaataggccacctcagtgtcaaactaaggtggcctattataggtggttgctaagcaaaatcaggtctgcaggcggatcagttatgttcaacaatcgttatgttttcatccaagcacgatggttacactttagcttcgaattggtgtccacattgggggcaagttatccgaacgcgaccatgatgacgcggaatccgaatccgttggtgacactgtgaacagcggaaaaagcggtattgccaatgctgcttgacctggtattttaaacggctgaatgggcgaataatcggtgaccaaaagcgctgaaagccgcgattgatcgcaacttgctgataaatctttttagagaacaaacgccagtaactaataccgatgagcatcacggcaattaagagtagccacccggtgcgaatgaaaaaactgatgacgatcaatagtaaagcgagattgtttaaaaagcggtttaacgtatcattttgaccgtaccgcccacgcatccatgatcgtagtcgctgtaatagttttgagtttggtttcaaatgctgaacccccgtcactaaaataattaatatttagtagcataacatagtttttcaacagataaataatacctgtttgtgccactaacggtgtatacttaagcatattacagtaaatagagggaaaaacatgtcaacacaatcacaaatcacgcaaacgcaggttctcgatgctatcagccgtgcggcactgatgttggagcgccaagacgcagcgcaaagcgggttacaactgttgctcaatgaatttcggcggagtttattgcagacgagcggacaggccgccacgacggtattgtatcacggcaaaatcaagagttacctattacaacatccgagcaattatccagatagcgtcgcggcgttatcatcattattagatcattttgttgcggctcagtaattagggccgtttttttgcgccaatcaagttattaacctaactagtgatgatttgggtagtggttaatggcagtcaatgttgttattagaaagaaaattgcgctatgctagatggtgaaccatgcgagagtgatagttgcttttttacgtttacggttgtaaactacagttaatttaattcgaagggtggtcaaaccattggaagcacaaactaaaattgaaatcagtgatgccgaatgggaagtcatgcgggttgcttggacgttgggcaatgtcacgagtagtcaggtcgctgagatcatggcggataagatgggatggaagacagcaacggtcaagacactgcttggacggctcgtcaaaaaaggtgcgttacgtgctgaaaagaatggtcgagcgttcaattattatccaatggttgaggaacagccatcgatggatgaggccgtgggcaccctcttcggtcatttatgtcagatgcgcgttggtcaaacgttggtggaccttgttaaccaaacggaattgagtcaaacggatatcgccgctttacaggcagtattggctgaaaaagccaaggatgcgccagaaatggtggactgcgattgtgtgccggggacgcggtgttaatgtggttataaacgaatattgaaataacactgaatgtcatgtttggattttcttaatctgaacatgacattttttgagggaaatgatcttaaagatacttggctaactgaacatggggcattcgtgcaggccttaatcggaaccatcagttatagtgcgcctaatggaagggacttactttcaagataggatactcagaaaacagatgaatggcgacaaaaagtcaagaaagtgtttttcttgacttttatcgtctacaattgtaaactttagccataaattacagatgtagacaatccgactaggggaggtcgctattatgaaagacatggatatgcaacacatggcgcaccatgattcaaatgacatgggcgatatggatatgggtaacggtgagatgatgcacatgggcaatctcaagttgaagttttgggtagcgttagttctgacgattccgattatcattatgagtccgatgatgggggtcaatttaccatttcaaatcgtttttcggccatggtccgattatatcgtcgcaattttaggcacaatcctgtttctatacggtgggcaaccgtttttcagcggtgccaaggcggaggtcaaaaatcataagcctgccatgatgacgttgattacaatgggtatcagtgtggcgtacgtttacagtatctatgctgtggttgccaatgacttgttaaatgcaaaaccaatggtgaccgatttcttctgggaactagcgactttgatcgtcatcatgttgttaggccactggatcgagatgaatacggtcatgaatgcgggatcggcggtagataaactagcaaaactgttaccaagtacggcacataagttagttgatgggcaggtccatgacgtggcaattgctgatctagctaatggtgatcaagttcaggtccgggctggtgaacaaattccagctgacggcacagtgttaaatggtgcgactagtgtgaatgaagcgatggttactggtgaagctaagttagttgaaaaacgcgctaaggatcaagttgtgggtggttcagtcaatggtgatgggacgtttgagatgaaagtcaccgggactggtgaatccggatacttagcccaagtcatgaagttagtcagtgacgcacaggcggccaaatcgtcgcaagaaaatatggcggataaagtggccggactcttgttctacgctgccttgaccgttgcaatcgttgcctttatcgtctggttactcgtgggcaatctggcgttagcactatcaattgcggtgacagtgctcgtgattgcttgtcctcacgctttaggattggcaattccattggtagtggcacggagtacggcgattgcggccagccacgggttactgattcgtaatcgggatgcgatggaacaagtcaaaaagttgaactacgcgttgatggataagaccgggacattgacagctggtaactttaaggtcgctgattatcaaagtatcgccgaccggctaactgcggacgcagtcttggcgatgatggccggtttggaaaatggctctagtcatcccttagctgtcggaattcttgctgccgctaaggaacatcagttaacccctaaggttagtcaggatgttcatcagattactggtgtcgggttaagcggcacgattgatgggcagacgtatcagatcgtttcggcagcttacttggataaacaaaatttagcctatgaccagcaaacgttcaatcgactggcaagtgccggtaactcagtcagttttttgattcaggagcagacagtcttaggttttgtcgctcagggtgaccagatcaagccggaagccaagaacttgatcgatagtttgaaggcccaaaacattaccccagtaatgctaaccggtgataatccgcagagcgcccaagtcgttgctaagcagctcggaattacagaagtgcatgcgggtttattgcccgaagataaggctaagctcgttcaacagtatcaggctgatggtagccacgttatgatgattggcgatggtgttaacgatgcccctagtctggcccgggcagatattggcgttgccattgggtctgggactgacgttgctattgattctgctgatatcgttctcgttaagagtaatccaaatgatgtggtcgatttcttggctctggcccggcgaacgacccggaagatggcgcaaaatttatggtggggtgctggatacaatgtcatcacaatccccttggctgctggtattctcgcaccactcggctttattttgaacccgatgtttggtgcggtagtgatgtcattaagcacggtaatcgtggcaattaatgcgatgacgttacgattaaaagactaaggtaaactgattggcgtaaattaatttgtgcaaatgtgtgtttataatgggtttagatgctagaataatagtatttaaatcaaggatgtgaaacccatgtgtactagtttaacgattcaaaccacggcgggtgatcagtttttagcacgcaccatggactttgcttttgaacttggtggtcgaccagtggcaatcccacggaatcaccactttgacagtgttaccaatgcggacggttttgatagcccgtatagctttgttggaacgggccgtgacttaaatggctatatctttgtcgatggtgtcaatgagcacggggtcagtgctgctgcactctatttctcgggacaagctcactttactcagcagactaaggctggcaaggttaacttggcaccccacgaagttttaatgtggattttaggaaacgtgaagagcaccgctgaattaggcgaacggattgctgacttgaacgtgatggaagccgccgcaccactattgaatattgtggtaccactacactggatcattagtgacaagagtggttctacttacgtcttagaattggaaaatgacggtgttcactacatgaagaatccggtgggcgtcatgacgaacacaccagattttgaatggcatctcaagaatttgagtaattacgtcaacttacaacccggccctcatcctagccgtcaatacggtgacatgacggtgaatcctttcggtcctggaactggggcgttgggaatgcctggtgactatacgtcagttgcacgcttcgttcggacggtcttcatgcgtgaacatacggatgcagtaacgactgatgcagaagctgtcaacgcattatcacacatgctgaactcagtggagattcctaagggcgttaagatgcaagataacgggacgccagattatacccagtaccgcgcctatatgagcatgaatgaaccagcattttacatgcaaccatacgcggatcagacgattacgcgggtcgaattgacaccagctttaatgacggccgcgcaaccgactgaatttgaattaaagacaacccaacagttccggttagcaaactaagttggaatatattagggtcaaaatatgaaagcagcaccgttagcattttatgctaacggtgctgctttttttgattctaggcagaatagcactttcaatgacctataataattattcaaattaactttaataattaaatggtggtacactatactatagtttagggatacataacttatactcgataatgattacaaataagccttgcattttctttctgaaagatataatatttactaggtaataatgattataaagtatctacggaggcggcaaacatgaaaaaaagaatgtctttggcacagcgggttaatattttgcgagcaagtgtcatgggagcgaatgatggaattctatcagttgccggcattgttgttggcgttgcgggggcaaccaccaatagtttttcgattttaatatctggactagccgggatgttggctgggacgatttcaatggccatgggtgaatacgtctccgtgaatacgcaaaaagattcacaaaaaatggcgattactaagcagaaggcagcacttgccgatgattatgaagcagaagcgtcgctagtcgtacaaaaatatgtcgatcaaggaatcagtaaaccgttggcgcaacaagcaacccgggaaatgatggcggaagatgcgctgactacgacggtgcgtgaacgctatggtttcaatccgaaccagttcatcagtccgtatgcggctggtattgcgtcgatgattgcctttcccactggctcaattttgccattagtttcgatcacctttttcccaccacgggtgaaggtgttagcaacggtgttggctgtcggaattgcattaatgattacgggatacgttgcggcgatgctgggtaatgctaatcgtcggcgcggaatggttcgtaacgtcgttgccgggttattgacgatgatcgtaacgtactttattggtcacttatttgcttaattaaagggtcaaggggagcgagcttatgcaactgacaaggacaaagtctgagaagaccaaacaaacgatggatgagaagttaaactcattacgagcaggtgtcttaggttctaatgatggtattttaaccgttgtgggggtgctgtttagtgtggcggccgccacgactaatcagttcacgatttttattgctggattatctgatttattagcctgtgctttttcgatggcgtcaggagaatatgcttcggtcagcacgcagaaggacactgaaaaagccgtggttgaaaaggagcggcaattgctgaagacggattttgagggtgaattgcatgctgttcaacgccactatatgactcttggcgtgacggaagagacggcgatggcgattgcacgcgatttattaactaaaaaaccattggcaacagttgtcagcatcaaatatgatatgcaactaggacactatatgaatccttgggatgcagcgtttgcatcgctattctcagcgtcagcaggaggcgtcttcccgttgctcgcgatgacgtttgcaccggctcattggcagtggccggcaacaattatcgcggtgtccgttgccgtggccttaacaggatatttatcggccgtattaggtaagggcaatgtgaagacggcggtgattcgcaacgtgctcgttgggatcgtgacgatgttcattcactactacgttgggacgctcttttaagtacttctgtcttggtcagttcggactagggattgtcaacagtgaaacaatagctaaccaaacggcacttgaagtacggtgtgctggaaacggcatcagtatgggcgcaaattgttaggatcggtacgaacttaaatagcactggggcgggcaattactgtagttacctgccccagtgctatttagttgagggcggtttccgtgtaattgcgcacaattagtaataaaagttcggatttatcgttgcttatagatgatagaacttgattatgataaagattactgaatcttcctaaaaaacaacgctcgattttcagtgagttttaattaagtctcggtataatattgccattaattaaattgaggtagagcgaaattgaaaaatatgacaactaaccgttatatgaagggcatcatgtgggcgatgttggcctcgaccctgtggggagtctcaggtacagtgatgcagttcgtatcacaaaaccaagccatcccggctgattggttcttatctgtaaggacgttatctgctggaatcattctgttagcgattggatttgtgcaacagggtaccaacatcttcaaagtctttagatcttgggcgtcggttggacaattagtggcatacgcgacagtgggattgatggcgaatatgtatactttttacatcagtattgagcgcggaacagccgctgccgccactattttacaatacttaagtcctttgtttattgtactaggaacgttgctgtttaaacgggaactgcctttacggactgatttaattgcgtttgcggtctccttgttgggggtgtttttagcaatcactaagggtaatattcatgagttggcgattccgatggatgcactcgtctggggaatcctttcgggggtaacagcggccttgtacgtagtcttgccgcgaaagattgtagccgaaaattcaccggtcgtgattcttggttgggggacattgattgcgggaatcctatttaatttatatcacccaatttggatcggtgcaccaaaaattacaccaacgctagtgacttcaattggcgccatcgttttaatcgggacgatttttgctttcttatcgttgctacatagtctacagtacgcgccgtctgcggtggtcagtattgttgatgccgtccaaccagtagtgacttttgtactaagtattattttcttaggcttacaagtgacatgggtcgaaatcctcggctcgttattggtgattgtcgcgatttatatcttgcagcagtatcggagtgatccggctagtgattagttgtaatgatagttatcatttttgtttagtgagggcccttgaataagggctcagcaggacttgaccatttgtgaaatgaccaaaaataaaagctgcgtgtcagaattttaacattctgatgcgcagctttaatcataatttgagtagattaaagttatcttgggggacgatggttggtaagttgtgctacgccaacaccagtttccgggcgggggcgtgcattttaataacttcggcacccaggtcaatataaggctgaccttccgcaatcaatccgaacttctcgtaaaacttctgggcgtgcgtttgggcatcgatttcaatggtggcggcgctgtaatgcactttaagaattgccatgacgtgattcatgagttgcttgccaaggcccgtcccacgatagcaactgtcagtcgttatccggccgaacgaaacgaccccagcatgttcgtaaattcgtgcataagcgacgagttgcccctgatcgtaggcgaagacgtgacgcgcgtccaagtcagtatcatcagggtcttggtaagaccgatcttgttctttaataaaggtcttggcacgaagttgataaatatcgtgcagttgggtggtggttagaccattaaattgcttaacgtaccatttcaaattcaagtgaaagcctccttgaaaactgaagaatatcgccagttattttcaaattgagtctataatttaacacttgtatttttgaccgtcaattgcaaagacccgcgatttatcaatggttacaggtattacttttgatgaaaaaaacatgagaacggattgctggttataccagtgaattgatagcttgattatcagtcatcgttagttaactgtctagatattatcatttttctcataatttgatggataataaaagaaccaccacgcactgcctattgtggtgattctggttgatctttaaattgtttttttgacggcctggtaattaattaataccaagcaggtttgtcaccatcggtattaggtttgttaacacctaaagacgtgcgaatgttacttgtgggatcttgggttaatttaacgacgagtgccgcaatgctcttacgagaaacttcagttcccttaaacggatcgtgtcgctgggttatttcgtagtcgatttcgtccttattagtcaaccacgcagggcgaatgattgtgtagtcgagatcggaattttctaggacttcagccgcggcgtagtagcgcgtcaggtagctacccaacgttgcgttgttccattgaccgaacttgccgggaacttcgtcatagatccctaaagttgagatccaaatgagccgtttgaggccgctggtatgcatggcttttaacactgtttcagcctgctgtttgatgttttgaccagccaaattagcataaacgacatcttgtcccgtcatcgcctgggttaatttggcttcatcagtcgtatcaccatcgataatcgtcacccggtcagattgttggtctgcgacccggctactattacgtaagtaaagtgtcaaattatcagttgtgttggctaaaaattgctgttcggctaaacgagcaatttggcccgcagcccctaagatcaatacatttgtcatataatcccctcctgaacatattaactgtaaacttaattattacagaattcaagtaagcagtttcaaaaaagttaagcaaatttgtgccactttttgaatttagacttataatgaacatgtagcgaagttgtacttcgctgtccaagataaaagaggcgataatcatggcacaaaagcttagcaaggaacaaaaaaaggctatgattcaaaaagccgaagaagaacgtgcaaagcatccaaagaagaagagtggcgtttccggtttcgaaacgatcgatgaagatgctaaaaagttatctaataactaataattagcgtgattcttcagttagggcgagacattggtcgcgcccttttattttgtccaaaatgagtgcacgggatcgcctggtgatgattgactggttcgagcaaaattgcagttggcacggagactgatggtcggttgttagcagtgctatgacagccatccatttgaatagctgtcacagcagtcttgcagtataatagcggtaattaatgatgggggtgacgcaaatggatcaatttacagtgtttatggcgcagcttgataagacgttggcacaagagcaattatcgtctactgatctggtgtacgtgccagtaacctttagcttccataatcagcgcttacaggttgccattaatatgctccaaacttcatttaatcagggtaataatgtatttggggtgcctgatattctggatcgaatcagaatgttggtcggtttggaattagctgatcgcccgcagtctcgctggcctacgaagataacgacccagcaactaacaatcacgccacataaaatggtcagggtgatcccagttgatatgcgggcatatcaagtggagtgatttagcactctaatacggagagtgctaaattgttgcaatcttgatgaaagtgcttattattaatgatgtaaacaaattgaaagggtgatttcataatggctaacgatatgatgaattggcacaatgatttatttgatcggttgaatgactggactaagatggacgatttggttaatggattcggtcggacattcttaaatgctggtagtcatgggtcggtcctaaagactgatattaaagaaaatgacgatcagtacacgatgaaagtcgatgttcctggaatcgataaacagaatattgccttgaagtatcgggatggcacattatcgattgctgtaaaacgcgatagtattagtgatgaaagcgataaagatggtaatattatcgcgagcgaacgtcaaactggtcgctttggccggcagtattctttacccgacgttgatgttgacaagatcgaagcacgatatgaaaatggggtgttgcagttaactttgccaaagaaggcagctgcggatacccatcatattgaaattcagtaatggtttatatgacgacttgccgcgattggtggcagggcgtctttttattgtatttatagtggatgaaacggttacaaaaatttgtaaatttttgatgaaatctggagtcagatactcacatctttgctggatttctggtacaatttaatcctatcgatatatcaattgaactgaatattgataatgataggatatgtttgttgtcggatttgtaagaaagtaggaatgcgtgatgacggaaggttttagaccgagtcaccctaagattgagattgacgatgatcctggaatacgggctcaaatcgaagctttgactggtgaactctcacaacaacaattggctaaatgggcgttaattatcgccaagaaagccttgcagtatgttgataaccaacagaaatatgatcgacaattgcgactcgcaattgatgctaatgaattgtggcaagttaatcttgttagtggctaccaggtacggcaggcactggcacgattgactaagttaagtgcaacgacgacgagttccattggtgcggcggcactggactgcgttcgctgggccgtagcttccgcagatgcggatgaaaatgcgctgcgggcctcggaccaagcaattaaattggttaatttaacgcaaccaaatgacatggttgcggtcactgccgagcgtcagtggcagtacgatcagttagctggattagcagctaacattcagcaggggttacgccgtatgctataatcttcacagagattaaattaggtggggatattttatggcaacggtacatgcagaagcaaaggcggagttgttacgtcagtatcaagaaattgtaacgaagtatttaacgaatatttcggaaacagtggacgtgaaggcgcattttgaattaaaaaacgaaccaggatttaattattttgtggattatttgtttttagccaatgtttgttaccaagcgagtctggatattttgaataatgaagatcaaaaatatccagatattaataagcggctagcagcggtcatcttaaaataccccgagtatttgacattggccgttttcaatgccgatttccaggatgaaagtgtgacggatcactacgaaaaaacactcgtagatttggctaacactttggattaatttgtaaataaggtggtcacgaacttcggatagacgaagcctcgtggccttttttggagggttagtaatgattgaatgggatgcggcaacaattaaagattttcagacgacgctattagattggtttgatcacgaaggccgcgatttaccatggcgacatgaccatgagccttaccacgtctgggtctctgaaattatgttacagcagacgcaggttcaaactgtgattccttattatcagcgctttatggcactttttccaacggtagcggacctagctgccgcacctgagtcacagttgttaaaggcgtgggagggcctgggttattattcacgtgtccgcaatatgcaacggtgtgccaaacaattgttaaccgattacgatggacagtggcctcaaactgccgctgagctgacggagttgattgggattggcccgtacactgcaggagcgattgccagcattgcgttcaatgaaccagttccagctgtggatggtaatgcctatcgcgtctttagccggttgctcaagattgacgcggatattgcgaagccccagacccgcgctgtttttgaacgggtaatcagtcagattatttcacaagagcgacctggagattttaaccaggcgattatggacctcggttcaagctacatgacagcgcggcaaccagatacggctcattcgccggtcaaacgctttaatcaagcttatttggatggggatgagttagcctatccggtcaagacgaagaaaccgcggcccaagccggttgcttacgtggcggtattagctaagatgcaggatcagtggttgatgacgaagcgaccgagtaacgggatgttggctaatttatggacggttcccttgattccgattgcagatttagacttagatgatgattaccaacctgaagaactagttacggcggtagaaaattattttaaacgtgaatatcagctccagctaacggcccattatctgaccgggcggcctgtgacccatacgtttacgcatcagaagtggaccattcaaggtttgagtggtcaagttgggttaagtgacttagcctactttgctggtcagacctttacgttgattgagcggcagaaacttccaatgcctaaggttcaagaaaaaatttttgcacgctattcaattgattaattcagtcaacattaaatacttttcacccttcagatgtgctatggttgtggtagaatatagcaaatcaatattgtgacggagggtcgcgcatgttaaatgtatttgatatcgttaagttaacaaagatagaccataaagaagtcgacagtaatcaagtggttgttacagatggtaacggtaagcccaatgcgattttgacagaattattgaatgatgttgtgggaaatatgcggatctttattaacatggaagatgtttattcggtcgatgacttaatgcgcgcattggccgcccatacgccattgccacaagatgtcttagaagaatatgaaaaggtattgcgggaaccgatttataacattaattttgtgccgaaaaggggccaagttgaagttgtgatcggtgaaggctaacgtgattgtcataatcatgataagatgttagtcaactcattgtgatgaaaatcagggccattcgtgggacctgatttttttgtgctgaattgatgatagtggctgtcacgaggactgatcaatatgtggttgcgggaaagtgttggttcgatttaacgataccggcacctgcgttataatggagtcaacttatggtcatgaaatgtgataggttattgtaaatggtcatagattgtttaccgcatcgtacgataggaggagtgctcattatgcaattaaaattagaacggatttacacgaaaccagttgatacggatggttatcgggtgttggtagatcgcttgtggccccggggtatttcgaaggttaacgctcagttggacaattgggtaaaggaaattggcccgtcgaccacgttacgtaagtggttcaatcatgaaccggcgaaatatcccgaatttgtcgatcgttaccgggctgaattggatgagaatcccctgacggccagctttattagtcaagttgctgaacaactgacgaagacgaatgtgatcttattgttcggtgccaaggacgaacaacataatcaggcagtggtactgcgtgattacctgaaggatagtggtcaattaccaaccgcttaatataaattgcgtaatattggtatagatgaaattgggattaggcctgcaataaactgcgctcatcaaattattttaattattttttgaaaacgctagcaattagctgcgaattttgctatgattatgttgttaattgatgacgtcaactattacagtgcacaataatgggggctgcattgttaggcaagcaagattggggataattttatgataaacttatgtgtgttaccaagtaccgcaagttgtcgcaaggcccaccggtggttactcgaacaccggatcccgtttcatgaacgtaatatgaatgcacagccgttaacggagactgaaatcaagcacctgctacagtacacgtacaatggcattgatgatttgatcagtactaagtccaatgcttatcaccaactgagtaagacgacaccgattgaagatatgccattaagcgaagctgttcgggtattaagccaaacaccgcaattattgcggcggccaattatttttgacgatcaccgacttctgtgcggctttaaccaagatgagattcggatgtttattccacgtgaacagcgcgtactcaagatgcaagcaatgtcagaacatcagatggcttaaaatgatcggcttatgagttgatgccgtgtttttggggcgaaacattataaaacagtactacttacttgccagcgtaaactgattgacacagttaagcggtactgctttgtgtgtaaattgacaaattatagctatttagttagtatactaactaaatagcggaggatgaaatggataatattggttatttactaatgcagttttccaaacagttacgttatcagctaaatcaacggctaattgctaacggattgacgattcaacaatgggctgtgatgcaacaaatcagtctttgggtcgaaagaacggcgcaacagccgactgccaaccagctgtgccacgttctcgatatggaccggccgacgatgtcaggaattcttcgacgcttagctgccaagcaattggttgaacaggacgttaatccagcggatcagcgagcaaagctactacgcttgacccaagttggcatacaagaattgcaggccggtcagcgtattagcgatcaggtcgttgcgacggggcttcagaaattgacggctgctgaaaaacagtctttaagacaactgttaaaaaaactagggagcaattaataaaatgaaaatactggtgataggtgggacgggaaatattggcttaccgttaattcaatatctagatcaacaggtgggggtgcaagttgttgctggtgcccacaatttgcataaagacgagcaactattggctgcgtattcggatgttgaaattcgacgctttgattttttggacgagacgacctttgatgcggcgttacggggaatccaaaaggtttttttcgtgcggccaccacaacttgctaaacccaagcaagatatgtggcccttcctaaaatgcttacaagcacaccacattgagcaggtcgtatttgtttcgttgatgggtgttgagcataatccaatgacgccacatcatcaaatcgagcagatgatcgaacagttacagttaccgtacacattcattcgaccgagcttctttatgcaaaatttgaataccacgcatcgcgtcgacattcagcaaaatcacgatttgtttatcccagccgggcggtcgaagacgagttttattgatacacgtgatattggtgagattgcgggcgtggcgttactagatacacaatatttacaacagaaattgactgtgactggtccagaagcgttgacttatcagcaaattgcggcgctaatgactgaatcctgtggtcacccggtaacgtatcatcgaccgagcttatggcggtttcgccgcgtgatgttgaagcggggaatcaagaaggactatgttaatgttatggtaatgctgtatttgattacccagttgggcaatgctaaacgcgtgaccgatacggctgaaaaagtgctgagtcacgccccgcatacgatgacaacttacttacgagattatgcagatcagttacagtagttaggtcgaggagtaggcatgtcatttggcagttgtgggttaatttagtggtgagcatggtcaacaaaaaaacagttacctcattttgaagtaactgttttttagcggacatatccagtacagactagctaattcaagcaaacaggcattgaagtaggatgtctgctgatttttataagcgataacgactagcaaatacaatgcttaggcatacttatgtgcaattttagccgcaacggccgccgcaatcgcaccaactaggtcatcaataaacgtgttaacaacgcctgacttatcagtatctaacttcttaatgacgccttctttaactttatccacgtaaccataattagtgacgccgatggtgccgtaaatattcgccatattaagtgctaagccttcatcaacaccgaagacgccggcgtcactggcaatgatagattggagcggctcgtttagctggccttctgtggcaagtcggtcgagttctaacgcaaccatcgcattgttcaatagttcgcgcttgtgcagtacttcttgcgtctccatttcgcactcttcgatcgttaagttagggacgtattttgtttgtaagttataagtgatatgcgcaatttcatgataagtaatcccttttgaggctaaggcttgaatgacgaactcatacgcagccttatcaggatatttaaacgttggtttttccatagttaccctccagaaataaacaatttgagtaggttagttatttaacctagtaagtccattataacgagatggggggctaaagaatatgatttgggttcaatattcgttggtgcgggttaaaaaggcgattgttgaaaacgatgactggttattttaattgaaacgcgtaaaataagactgttaaacataatgaagggtaagataattttgatgaaacgttggcgaacggtgattcaattgttattgattgtttttgttatcggtgcggctgtgattttagttggggcccggaatcatgataccaagattacgaaagtaacgagtcaattgacaccgcgttctgcacgaatattaaagaatcaatatgaccagtcaaagacagcgacggtctttttacatggctacaatggtggggcgtattcgacgaactatctgattcgtaaagccgaaaaagcgggggctgcccaaaaagcgttagtggtgcacgtgtacaagaatggtgtgatggcctttaagggttattggcaaaagtcaatcaagaatccgatggttcaagttgtttttcaagataatcacgcttcacaaaaagcccagatttattggttacaccaagtcttagtccaaactaaaagcgaagtatggcgtcaaagcttataatgcggttggtcattccctcggggccaatgatattgtcaatcaggcattgaagtatgggcatgacaaacgcttaccaacgttgaataaaatcgtgacgattggcggaccgttcgatggcctgaccgggtttctgagcacgcagacggaagcaacggtccggcgcttggatgttaaaccaagtcgtttcacgaagcatttttcagaaatgctcaagtatcgccacaattttccagacaacgtgaaactactcaatgtctatggagatacaaacacggggtataacaatgatggttttgtgggtgtcgcttcagcgcgctcaattcggtacttgttgcgcggaaaattaacacagtatcaagaagctttctacagtggggaacaggcggcgcattgcgcgttgaatcagaatccaagtgtcgctcacaagatgattgcctttttgtggtaagtgttattgtgtcaggatgggtgcattaaataaatgaggtcgttcgggtaaatactcgggcggcttttttcgtagcgccaaattaggcggtcaaacgcagcaactacagctttggtgacgctttcaataaggaggacagctttagaaaacaaagtattgcgatctattcgtcgttaaaaacaggggttaacagttaaaaatcgcaattaagtgaaagctagagcgtgctataatgacacaacattaagatttaacaacaaagtcattaaaatttgtggagggatcttatgaaaataactaatgctgatggcacgatccgggcacttagtaaccggcatgtccaaatgattgcaattggtggcacgattgggacaggattatttcttggttcagggagtacgatttcaaagacgggaccgtcagtcatgtgggtgtacttggtgttgggcttcttcttctttttaatgatgcgggcaattggtgagatgttctattctgatcctacccaacacacattcgtggcgtttatttcccgctatttgggaccgagtgttggtcattttacagggtggacctattggatcggtttgatttttgtctgtatggctgagctgacggctacggcaacgtatgtcaaattttggttaccaaatgtccccgcctggctaattgagattagcttcctgttaattttggcgggcgttaatttaacggctgcacggttatttggcgaagcagagttctggtttgcgatgattaagatcgtcgcaatcgttgtactgattatcactggtattttcatgatggtgggacatcacccaaccccattaggccaggcttcaatcggcaatttgttccataattatcaggtctttcccaatgggatagctaattttatctcggcatttccaatggtcttctttgcttttcagggcattgaatttgtcagtataacgattggtgaggccaagaaccctcaccgcgttatcaaaaaggcggtcaatgaaactttgttgcggattttgttgttttatattggtgcgttaattgtcattatgggcattattccgtggacgtcactgtcacccgatagcagtccgtttgtgcaagtcttcaagttggcagggtacccagcagcggccgccatcattaactttgtcgtcttaacgtcggcagcctcatcgctaaatagttgtttgttctcagctggacgtcacttctatcagctagccactgaaatgccagttacgagtcgcatgcaccaaatctttgatcagatttcgaaaagtggtgtgccggcagcagcaatcgtgttgtccgcgatactagtgctagtgacccccatcatgagtttaagtgctgcaacgacggcagtttttaccgtcgtgaccgggatctctagtgatatgtacctgattgtttacacgctggcgatgctggcccatcggaagtaccggctatctaatgactatctggcggatgggtttaagatgccggcgtaccgaatcacgagcccactgacgattgccttttttgttcttatttttgccagtctattcttcattcaagctgatattgtcggtgcaatcggtgcgattatttggacgttactatttggtggcatcacttttgcccaccaagcgcgcttgcgagctgtaacgcggtcgtaaccttaaaatgagaattatattataaaatggcttgacgatgataaaagatggtggtattgttaatcacaagttaataactgtacgataacgttacatcaagtagacatagtggtaggtgtcaggaagccggtggttgctgcgaaccggtcagctactatgattgaaatacggtaaccgagtttcgactgaacggataataactagaaccgttatcttctagtgagtggtggattaagtgtcaataatccgcaacctgggtggtaccgcgactagtctaatcgtccctgttgttcatatgaacaatggggacgattttttttttgatgaagaggatgagaataatgacaaatcaacgctgtggtgggattgcacgatattaaaattttaatgatgaatatgcgtcactggaattttatcaatcgaaggggtaataaattatgaacaaaacaaaagcaccacaaattagtaccttagaagcagtcattgtcttactggtcgtcctcggaattatgagtgcgggtgtgattggttggggattatcgccccaagttcccgtattactcgcaatgggcgttgtcactgcttgggcgatgttgcgcggttttccatggtcagcagttaatgccgggattaaagagggcattgataaaggaatcgtgccaatcttcatctttattctcattggtgcgatgatttcaacttggattgcggcgggaacgattcccacactcatggtgattggattcaaaatcattaatattcagtggcttttgccatcagtctttattgtttgtaccctagtcggtgcggcggtcggcagtgcctttacggtaacatcgacggtcggaattgcctttttcggcatgggcgtgaccatgaatctgaatccagccttagttgccggtgcaattatcagtggtggaatcttcggcgataaattatcaccattatcagaaaccaataatttagcttcagccgtagtggatactgatctttttacgcacattaagcatatcttatggagcacgctaccggccgggctcatttcattaggcttgtttgctatgctggggcacagtaatacggagacaagcttagccaagatcaatcaaacagttgcggttttaaatggtcatttcagtatctcagccttggcattattaccaatcgtcttagtcttcatttgtgccgggtttaaaatgccagccattccaacgatgcttttaaatatttttatttcggcgggcctgattctatttgaacagcctgggctatcaatgacgaagttaaccgccattattaacacgggatttgtttcgaagacggggaatacgagtgttgatacgttgctttcacggggcggaatcgtcagcatgatgagtatggtagcgttaattgtggttacgctatccttaggaggattattggtcaagtttggactgatcaatcaaattatgaccccggttgctaagcacttgaatagcgatggcaagttagtattggcgggtgtattaacttgtattggtgtcaacgtgtttgttggtgaacaatttctttcgattatcttaccagggcgcgcttttcgccaggcattcaatgatggtggcttatccggaaatgcactggggcgggtccttgaagatggcggtacggtgatcaattacctagtcccgtggggcgttggcggcgtcttcctgacgacgacgctgggagtaccaaccgtccaatacttaccatttgttttcttcagtttactttgtccagttatctcggtaatcagcggtttcactggtgttggtatggcgcacttgaatcagcgaactgcagtgaaaactaagcatgtgactgcaacggaggtttaatcgttggtcgatcagttcactttagggaaggttgacgaatggctgttaaaatagttactttatgtgggtctagaaaatatgcggcagtatttgaagcggttgagctggctctgagtaaacaaggtgttattgttttaaagccagctttcagtgatgaagtattaacaccgattgagcttcagaatttacgccagacacatttgaaaaaaatcgacttggcagatgaagtagtagtcattaatgtcgctggctacattggtgagcggactaggcaagaaattggctatgcacagcgtcaacataagagaattcggtattacgcagttacggaaaacgaacattaattaaaatgaccagtatcgaagaatatcgatactggtcattttgcgttgatttagtaatctttacttgagtttagtagccgcttgaaaatctgcgtacatgggatggttcaaattgatcccgcgtgatttggcaatgaaccaagctaagacttggaacgggataatcgcaagtagtggggctttatacggatcagcaacggcttcgagctggagggtttgatcatcattgacggtcggttggtcaccagtgagactgatggtataaatgtggggcgttaatcgcgattcgtacgtcttgacggcctgtaattgggtcatgacagccgggtctgtattgatttcaagatagaactgacagtgatcttcatgcgtccccataaagccaccgtgggtaaatgaggctaatgagtaaccatgcgttggtacccggaggatttcggtgaatttggcttgcatttcagttagtgttccagctaggacgttagcaccgatagctgtaaattgaggggcgttagtgaaatcaatagtgaacttacggtagaagtcgttcgcccgttgaacagttggattcatgctttcaatcagaaaactgaactcgtctaattcttgattgactgctaagtcggttaaccgtgcttgaagggcagcactgcggacggcaagcaacattaaagtgagcacgatggcttgaaagcttagtgtaatatagggcactgattctttgccagttagtaagtcacaagttgcatcggccattgcggtcagagcagtcgatttttgattagtcacgataatgacatgagcttgactggccgtgtgggctttttcgattgccgcttgcatggttggatcatcatcttttagagaaatcccgataacaacatcgacactgggatcagcttcctcataagtgacgtagaggtcggccgcagcaatggtcacttggagggcggccgtcttttgcatgtataagcgggcggtgttggcggcgttgagtcttgaaccagttgcgaggatcaaccagtgttgtggatgatcaggggtggcagtcaaggccgccgtaatctgtttgggataattggttaacaaccgctctagtactggctgttcccgacgaatgtatgagagcatggtcggattattcatcatcatcaaaatcatcagctcctaaaaaatagttatgtatattaatattaatttagctttattgtaaacgtaaatgaacttatagtcagcaaaagaatgtttaaaaatatgactgttgattaatcgtagcgggtccgctttaaatcaaaggcgactgctcgcaaatcattataaaagacgacttaacggccgacggttttattcacgggcttgccattatcggaacatgttgcgtttcaatgtacgcagaacaacatcctaatcagcattctggttagatggcgtcaccagtaagggaccttgtcgcaaatcgtatgccgttcatttaaaatgccagcgctgcttgtggcagacccgacattgatttaggtgaatattcatgtctagttctaagttcattgtaccaatcatttatgataattagggcttgcatgtaactgaaaaggctggtaaagtaaggaacaatttatcaatacaactaattgcctatataatgccatgatatggatggcgagtttctacccagtgccgtaaacactggactataagcgaattgagtcgacgggtctacactgcttaatttgccgtgtggacccgtttgctttctccgtaggcagactgactagtgaggagaaaataacgatgacgaagacagttgaaatggtgattactggtgcacaagtgttaaacgtttatacccgtgaatttgaagccaccagtttgtggatcgatcacggccggattattagtaacttgcgtgacgagccgtacatagcggcccagcatgtcgatgcgaccggtcagtggatcgttcccggcatgatcgatgcacatgtgcatatggagagttcgatggtggcacctagcgagttgggaaaagtcttactacagcacggcgtcacgacaattgcgactgatccacatgaacttgccaatgttgcgggtattgctggcattcagtacctaattgatgatgcgcgccaaacaccactagatgtctgttttatgctaccgtcatcggtaccgtgtgttccctttgatgataacggggcaacgctacatgctgctgacttgcgcccactttaccaacagtcggaggttcggggactggcggaagtaatggactatggggccgttgcgcgtggtgatactgacaccctggctaaaattagtgatgcctatgcgtatggctatcatgcggatggtcacgctgccggtttgaatgcgcatcagctcaatgtgatgcgcaatgcgggactggatactgatcatgaatgtatgacagtggcggaagcacaggatcgtgtgcgggctggtatggctgttttcttgcgtgaagggacggttgaacgcgatgttttgccgacgattggtgcagtgaccgaagctaatgctagccggtttgctttttgtacggatgataagacgattagtgacttgctcacagaagggtcgatcgattataacgtgcgcctagctatgcagagcgggatgcgtcctgaactagcctacacattggctagtctcaacggcgcgatggcgcatcgtttaagtgatcggggtagtctgtcagccgggcagttggcagatttagtggtcttagatgatctcgaacacgttaggattgcgcggacgatgaagcggggacagtggatattaccaagcacgacaaaaccattgccgtttactgcaacgcgtgttcagcaccatgcacaactagccgacttccaattaccactagcgaccgggttggcaaatgtaattggtgtgcagccgaaccatatcgagacggatcacttaacgctcccgattgatgcaacgcagaattttgaagcggattgccaacgtgatattctcaaaatggttgtcattgagcgccatcataacacgggcaaggtgggcgtcggcttagttcatggcttcgcacttaaacagggagctatcgctggtacggtggcacatgatgctcataatattgttgcggtcggaacgtcggatgccgcaatcttacgggcggtagcccagattacccaagataacgggggaattgcggtcgttgacaatgaacaagtgctagcgaccatgccgcttgccattggaggcttgctgtctgcagcgagctatcaaaaagttgctgaacagttggccgaacttaaacgagcgtatgaggtcattagcgagcggccacttagctttgatccgttcattacgctatcgtttttgacattacccgtgattccaacgttgaagttaacggcacgggggttattcgattacgcgacctttgactttattccagttgcgattcaggataaccagcgccaaacagtttaagtacaatcgttcggtgactgaaattaggctatgatgtgtctgctactgaacaacgatgtagtttaaggcttgtgccgaaatatgtttaaagccccgcaatagctaaacgttttagttagctgctgcggggcttttactgtggttttaatgggctaaatggctgctactgtgaagcgtcattaatgcgggggtagctaatgggattgccactctcataagcgggaagatcagcgattccgcggtaaacggctcgttcaatctgctgcagcccgccgccatcagcaatcgttattttaataccgtaatgcttgacagctttattcagtgttttggaagtggcgtgtttattctgattctgaatcatgaccacgaggtctgcttgaccgatttgccggtaatagaagttggtgctattactgtgtttaaaagcatcaatcaataaggtgtgcccgttgtgctcatcaatgagttgcgtgatctgtgttcggcgcgtaccaacgtcgcccatgacgatggcaactgttttttcgtgcagatcaaagtctaaggtgcgcagcgtcactggcacggtggttgtgtggatagtagcctttttagctagtttggctgctttattcgaggtcggttgactcgagctatgatgaacgtaacgaataaccaccttctcaggccgctccttataccaagccaggtcgactaattgaccattactgatgcgctgatattgcgcttcttgactagtaaacgtaacatcgttcattgccggattgagcgacgataaggttgtgccgttataatcttgttcgatgtgataagtatcatcggtgtcttgataatgaacaacgaaaaatggtgcgacagtaatcggatccgctgtagtagcgtgactaacgattttatcaatataaggttgtcgatgttgccgtaaatttttttctaacaggacctgatcatcgtggtgaatcaccagttgtcgggccaaaatttcatcgtagtggtagcgtggtgtgccggtcggatcattggggtcgactaaatcaaaaccctttaaatcgcgctttacttgcatgattgtttgcccattggattgtgcagaagttgttttgacggatgatgatgaatcttccgcgtttgcttgcgtagccgctggtctcattgtgtgcgttactagtggctagtctagctatgcgtgtattatccgaatctacgatggtatcaggatcaagcgccaggtttaagatttcctgaatcgctttggcacccttggcgaggccttcatcggtaggttgaatcatggttaatgttcgggcaatggcggtacgataatcgcgatattttttcaaattaggacctccgttattatttagtaaattggtcagcgcagacatggttctgtgctgaccaaaaagatatttggtacagggtcaggtcataaccaacgatatgtatgtgttaataccacgagccaaaatgattgtgttatgctggtttaaagaaccaagtaggtcatcaattgccagtacttatcaactattgtgccatagattgtggctggacgggtataaaaaaacaatataaacgaattaatgaagtcttttcaagattagctgagctttagcgcaagtattggctgattggaacaatggtaattgttgtgaaaggtcggcttactaacacagcaatggtcaattgaattggctttacgggtgattacttataaaatgatatagcggctatcaaacgacaacgagtgcgttgacttgtttgtggattgcaatagtcgagcatcacattcaggataagtgggaatgaagttggaggcgcagcagatggcaacagttagatttgagaataaacgggtcaatatgagcaaactcagtcagtttggatttgaacccaatcagaatggtcagtatcagttccgaactttaattatgcaaggccaatttgaaatgataatcgagttgaacactgatggcagtctgaacacgacattaacggatacgacgactagtgaagtatatgttttacacctgacatcccaagcccatggtcagtttgtaggtcaagtagcgcaggcctatcaagatgttttatacaacatcgaacagcattgttacgataatgacgtcttccaatcgaccccggagcgtaagctgattgcgcaagtcaaagctgtttatggtgacgatcttgagttcttgtggcctaaatttccacaaaacgcggtttggcgacgctcagacacgcacaaatggtatggcgcattattgacggtaacttccgataaattggcgttgccgggcgcaacacatgttgtgacagtattagatttgcgagcgcgcccagaagacttatctatgctgattgatggacaacattatttaccgggctatcacatgaataagaaacattggtattcaattttgcttgatgatgtggtaccacttgccacgattatggacgacgtaaaagttagttatatgttggccaagtaaggcttgaatgtaagtggacggtctcaccctaaaccgaagcattgagcattaactaaaaaatcgttcccaagaagacatctgggaacgatttttttgattaatgattggtaaaaccatcgttagtgactattagattgaataattagcgcgaggcatggtgccgactgcggtaccaatcgaaggcgagcgttaatagcatgtaagcaaaatcaacgagaattgcttcttttagtggtacgttgagtaaaacgactgaaacgaacgttaaaacaacgacaaaagtcagtgccgattgtgcccatcgtaagagccattctggcatggttagctcacatcctttgttatgggagttgtggttgttgatgagactgatgattgtggccgatcccgtaatgcacgtagcgcccaaagaattgagaccgtatcaacaacttcttgaagcatagcgccaaagagtgccggaatgataccagtgctggcaatcaacatcaagattgtacagatagcaatcccaatccaaacggcttgtttagccacttgcatggtatctttagcaatgcgcaccgccgtgaccacgcgactgagatcgtcttttaagatgacgacgtcggccgattcactagcagcagttgagccatgggcgcccatggcgatgccgacgtcagcaacagccaaggaaggcgcgtcattaacaccatcaccaaccatgataacggggcgttcggccgctggtacagcctttaagtgggcaatcttatctgcgggtaggaggtcggcagcaacggtatcgataccgacatcggcggcaatatgatcagcaattgcctgttggtcgccagtaagcatcatgacgttttgaacgccctcagcgtggagtgcttgaagcgtggcggctgcttcggggcggacattgtcgataaacgtgatgtaacccgcgtactggtcatcgatgccgacgtagatagcagtagtagcaagtggcttggcggttgtagtcggtgcgacgaatttaagtttgcccactttgacctgttgctgctcaatcgttgccgtgaccccattacccgttacttctgctaattgtgttgccgggctgaggctagtggcactcgcatacttgacgagtgagcgggccaggatatgacttgagttttgttcagcgctcgctgcgaggtgcaagatttgttcggcagtaaaaccaggctgaggaacaatttggttgactgttaattgaccactggtaatggtccccgtcttatcaaacgcggcggacttagccgtagataacttctccaacatgtccccagtcttgaccacgattccgttccgactagttcggctcatccctgagacgagtgcaacgggtgcggcgagaatcagcgggcaaggtgaagccactacgaggacttctgcaaatcggtggggatcaccgctgaatgcccaagctactccggcaatgacgtatgctaccaaggtgaatgggactgcatagcgatcggccagccgtacgaatttggctggtcgtgattcggattctttaaccaatttgactaactgttggtattgactatcaatggctaatttatcaacaactattgtaacagcactatcgccgttgaccgcaccagacataatgtcatcgccaacgtgcttgtcgactggcttagattcacccgtcaatgaagattcatcaaagagtgccgttccttgaataaggtgaccgtctactggaactagctcaccaggtttgacgactagctgatcaccaatttggacatcttcaacggcaatatctgttaattggccggcgactgagcggtgggcaatacgtggtgaattatcgagcaaggctttcaattcggtattcgctcgtttggccgcataatcttctaacgagtcacccccagtgagcataattagaacgacaaggctagcccaatattcgccgacagctagtgttgccacaatcgccgtaattgctaataaatcaactccgtacttacctgaacgtaaggttttgatcatctcaactaacattgataaggccataagtgaccccattaatgtaatgatgatttgtgctgccaattggtagtgcaaaccaaactgtaaaataaccgcaatgataccgacgctgaccgttaaaattaatttatagtagtgccgcatgcagttcccctccttttagatgataacgtttttttacttgttacaagaataacatgaaatcggtttaattgaaacagataagaatgattctaaactaaaaactaattattacgaaaacttttaaaaagtttcagaaaaaatatgggtgtaaaactcgtctaatccttgacgggttaggcctcgacggctcaaaatggttgattttacttctgatttaatactagtatacttataaacgaacatcagatatcagaaaatactgaaatcagcatttgtataagccaacgtgcgctgtgcaggtggtaacttgttacccggtactaagcgcttttttggtgcaccaagcaattaatctaacagttgtgcggtgggcttatctggtgattcaagggggttatctattagcaagagcagtgtaaccattaatcgttacgtggtgtgacgacggtcgtgtgctaaaggcacgatggtaatagaaacactagctaaacaagatgaacaccaacgtcgattaagcaattaaaaatcatttgtcagtatggcgttgtccggattcaaccaacggaaagaaggaaattctgctactgattttgagttagcacaaacagaatgcggatgacaatgccggtcaaacctgatacagtcagggtgctgagtgctccgaggattaactcggaggggtgtaccgattgctagtcggaaatttacgcgtggggactaccattgctggtaggaagaaccacgaatttgatctaaatatagagagtatatgctcagtagcaggtttattattttaaaaagtaagaatattgattggtgggtctatttaccaacaattgggctctttgcggcggcttccgttgttttattaatggggggccattcgctggagacgagtttaagtggcatcttgaactggctcacaaataacatgagctggctttatatgtcggtatatgtgatcacttttatctttttcatttacttagggtttagtaagttagggaaaaccaaacttggtgatcctgatgacaaaccagaattttcaacgtatcactggggcagtatggtttacgcgaccgggatcgatgccagcattttaatgttgagcatggttgacccgttacggtacctccaaagcccttcattcggcgtcaagccgttttcaacttctgcatataattatgcgcacatgctgggacaatttaattggggaccaatggcgtggatgatgtttgcaccagccacgattgcaattgcctatgcaatgtatgttaaacacatcaaggttcagcggctcagtgccgcaatttcagtactacaaggtcctggtaagggtaagcaaattgcccggaacacgattgattttctcgttattattgggattatgggtggtgttggtacttcagtcgggatggaaatccccgtcatttcaaaagttttgagtgccgttaccgggattgccgatacgatgactttaaagttagggttatttgccttattattcgtaattttcgccatggctgtttttaatggcttgaagaagggaatcggtcggctaagtgctgcccatgtttggttagcgattggcttcctaatcgttgttttaattgttggcccaactttgtatattttaaactcagaaactaatagtattggcttgtttgtcaataagtttattacgttgagcacgaatactgcaccaaatggtcacgcaacggccatgcaacggcagacgatcttctactggggctggtggttatcctttatgccagtcatgggcttattcattgcccggatctctcggggccggacgattcgtcaggtactcggtggtatgttgctatggggctcattaggttgtgtcagtttctacgccatcttgggtggttatgccttatacttgcaacggatgggcatcgttaacttagttcatatcttaaatacgcaaggacaagccgctgtgattgcagcagtattgtcgaccttaccattgaagatgattatgctggctttgtactgcctatcttgctttattttcttagcaacgacggtatcttcatttgccttcattacctcgtcatttactagtaaaaagttggccgcgggggaacaaccaagtcgtttcaatcggatgagctgggtcgttatcttcctagtcttctcattggggcttgtcacggtcggtggctttgaatcgattcagtccatctgtgcgatgtctggcttcccattaacgattgtcgcgctcgtcttactgtactcgatccatcacgacttaacgactgatctagtcaaggaagctgcgaaagccaatgccaaagcagctgaattagcacgccggaaacggctagcacgtgacgttgaaatcacaactaaaactgactacgcacgcgaacggcgtactgcacggaaacgtgaaacggaagccgattagcgctactcagttgaactaaatatatcaattaaactaggctcgtattatggatttccataatacgagccttttaagattggcccacctgtttgaaataatggtagaaagatgccttttagggttggttttctgttcgtcagccggtgagcgtcctattccgacctccgg

SEQ ID NO: 27 - DNA, 37140 bp, Lactobacillus plantarum
gttttaagacggaccctagtaaaatgattcatgtggaaacttttctaatcgatataggccttcatcatccgggtagattcctccaggcttaggtcgatacccgaagtgttggtaaaataagtgcgcagtcacggacgctggaatttctacacggtgggcatgactgaaatagacatcctgttcaagggtatgcagaatttgacgcccaccacccatgccttgaacctccggatcaacaaaaatcgtgaacaggctgtactcacctgggcgcccccagtatgacccaatcgccccggtcgcaacgagttgctgctgaaaataaccgacataaaagtgcgtcgcagcagctttttggcatagccaagccggtgtcatctgggtaatgagccgatccaagtatgctttgggatagtcaccctgattactcgtcagtaatgtgcgcgcaatcagtgccgccgctgctggcgcatccgtagttttaaaacgtcgaatttgtaattgcatatgacaactcctctcgtattgcactattctttgctcgttgcaatgaacaacgaatacctttttgatcgtctgccgataccaatttaacaataaccacttaagcttccacaaaccaaggttctaaaatttttaacgtagcttgctcaaaatcgatacacacttgcgccccatatggaagtgccgttcgcggaaaagcgtgaccaaaattaatattgtacagaattggcaatttcaaatcggctgtctcatcgatcaaaatttggcggtattcctgataataatgctcattctgcggcttacctacaatcacggcggctacgtttgtcaaaatctcagcttgtcgcattcgttgcagcatccgcttgaacaaatctggctgcggctgttcgtcactcgtttcgataaacagaatttttccgcgccattcggctgcacatggaatcagtctgaactgttccgcaacttgccgttcgtctggataacgggtcgtggtcaataaatcataaaagctgtccagacaaccaccaagtagcgtcccactgattgtcccgtgaccacgtaacacttcgtaatggtgcatttcggtgtgggtcatgcgccgtgttccctgcgccgattcactgaaatttgttcgttcgtcataccacacaggactgctaataatgcttgtctgctgaggattttcaaagtaacgctgccaagtcttcgtggtatacggcaacatcgtcggccctaattcggccaagtcgcttaagaaattggggccataaaaagtttgcagtccaagctgataaaacatcaaatgattgatcgtcgtatctgaaaagcctgtaaacagtttaggcgaccgccgaaccgccgtcttaaactgctcatcagccatcaaaaatggcacggttcgatacgtatcatcaccgccaattgccgccacaactccacggatacttgggtctaagaaagccgtcttcaaatcggcggctcttaattcagggcgttgctgtaaaatcagtcgccctttcaaagcattcggcatcatgactgggacgagccctagttggcgcatccgttttagcccccgattcaattgatgttgctgcgtgagttctccgagcgtgccactcgaaagactgacgacagccacgtgatcaccaacgtgcaatggtgctggttttaacatattctcaccctttcctaatttaatttaaaattaattttatcatcattatataatattttaaattgttatttggtttttattcattttcaatgtaaccaacgactaaataggtcactgagtccgctgctctgcatgactcagtgacccgtcgccctattgtagccaatcttttatgtcaaccaagcgaatcttatgcgtacccgctgaccatcgttctggctgtgccttaaccattgtcagcaactctgttagtgactcggaaccaacaatcaactgttgcagtaattcagaaatcagtggggaacgtggttgcgcaccaactaataaacaatgttcaccttcaaaggctaacacgtcacctcccgcccgtaaacggccaaacgggcggtgcaacttgacggtacccaaaatcagcaagccaccttgttcaaataacgttttcaacaaccaataatcgagtttaaagtggttagaccgttgtcgtaaatcggccggcaatgctttagctaccggtataatcgttttgaaattccgactatactgatgccacgattgagcccagtcctcacgctcacagataaatcgccggggtaatgtcaattgacctgcataatcacaaacttttttaatagccggatcactcattattgacggactggcttcaaaaataggacgcaattgtcgtatcagttcaataaactccgctagataatcggcaaagcctggcgttgctaaattaatcaaaattcgcttagcgacgcaataagtcaccgcatcctgatacgtcaccttggcgtgctcaatggcatcttgataggctgtcataatatcaaacagtcgtgggttggtataatctaaagttgtcgaaccagcatgtttataataattataaaatggttgttgcacataggcgactcgctcacagtaactcaacatgtccagcaaaatatctaaatcctcgtagaccatccgctggtaacgatatttctgccaacacgaacgtgcatataatttatttccggaataagcattatttagaccgtatttaagataagtcgcaattgccacgtgctcagtcgcatctggcaagctcagcagactagttgtgcggtgagtcgccgcgtagattttacgaacatcacaaacgacgatttgggcatgactacgctcagccgttgctactaaggtcgcatacatcgtcggttcgacccaatcatcagcatcgacaaaacctaaatagcggccatgcgcggcggtaatccccgcattacgtgcaggtccctgtccttggttacgttgatggataacccgaaataggtgcggccagcgcgcacaatattggtcacaaattgtagccgtgccgtccgtactaccatcatcaacaataatgacttctaaggccgctaatgtctgtttttttaatgaggtcaaacaacgccttaaccagtgctcctcattatacgcagccacaataacagaaacttgaacttgcatactgattcccccaacactccaaatgatttcgcttacattatgacacacatgcttcgcatatcacagcacggatccatgatagggataatcatgcgcagtcgtggtctgatactctcgtaaatcgtcgatacgttctgctaaattaaaatgaactgctgaaagcccatcaaactgagtcatccggtcagtaacagcggtgaaggaccactgggcaaagatcatgttgtcagttgctgaccacaaccgctgaatcgaccacgccgttacccgttgaactcttaattgatgttcaatccaggcttgaacttccgctaatgatagatatgctggtccatagcattcttgataataacaatcgaccgcaaatattcttggtaacgcttcaaaatcacgagtgacccacatcgcaaaatattgctggacttttgcttttcggtcccgaagtagtgccgtttcgatttcggtcatttataacaccttccgttttaagattactttttagaggccgtaattctagttaataaacaggcgattaccattattttaacatcactaacaattaacaagaccaaatattgactaaacaagtctatcagttgtattcagcagtcatttctggcacagttaacttaatcataatattaataaagtgagccgataaatatgatcaaagttactaaccgacactttcaagatgtgcctgcgctggaagttgttactacaacccatttagaccaaccgctgccactagtgatttttttaccacggttggcagtccaataaagaactcgtcttgacccaagcacgtaaactggctcgcaagaatttacgagtcgtcttgcccgatgccatgaatcacggtgaacgacaccaaatcgttagccagattccttcatttactttttggaacagtatccaaggtaatcttggcgaattcgagctaattgtgaattactaccgggagcgcaaactcattttgaatgagcagattggtgttggcggttactcaatgggtggcatgacgactggggctttattgacccatcatcctgaaattaaagcagccacaatcattatggggacccctaacctgaacgcgtacgcccaactagtccgcaagcatgcgcaggcccatgcttattacattcccagtgatttagccctattgacgagttggctagatcactatgatcttaacctgcaaccggaaaccatcaatcatcggccacttttattttggcatggtactgaggatgaacggattccttattcacagtctcgtaatttctttgaccgcgtgcataccgccccgtatgctgaacaagtggcatttatcacgggttatcaagccaaacatctggtcaaagtgcctctgatgaacaaagttgctaatttcttcgattattatttaaattaattatcaaaggctcaaccatggttaacgttagccttaaaagagcgtgcttagtcggtcacccgattaaacacgctcttttaaggctactcaaactatctgtcacacattgtaatgatcgttattgtcagctacaagttctttgaatttcttatttgccaagcacaaccggcgcctatagctgaaatcaatgctgtactaaacatgactgtttgaaagccaattgcattcatcgcgggtacccgactacccactgtaaacaccaccacagcaattgccgtgccagccgcacctccaagtaaccgaaaaacgttgtaaattccggctgccttaccgataactgccggtgacactccccccaaaactgcatgctgtaacgcggggcccgccattgacaatcccatcccagcaattgccagcggagcaatcatcataacataagccgcatggttggcaactaggtaaccaagcatgaaatacccaaatgtttgagataatagcccgataactgccacaatcgcttccccgtagaggtccacagctttgccagcaaatggcgcaactaatactagtgtcccagtccaaggtaataaggacaatcctgcctcccacgcattatcatgctgaacaacttgtaagaattggggtaaaaagaaaacgactccgtacatcgcggcatataataaaaaagtcgccacatttcccatcgtaaaaatacgctttttaaaaagcgttaacggcattaacggtgcaacgacatgttgctgtcgcttgataaaccaagtgcctgcaactaagccaattatcaggccaacgaacggaccaattccattaatactagtcgaactggcagctaaggcccaaatgattgcggtcatcgctaacattgaaagacctgcgtccgttaaattaattggtgttgctaccccggtactttctggtaaatagaaccgggataatcctatgacaatcaggccaagtggcacattgatccaaaaaatccactgccaggttaatttagctacaattagaccacccagagccggcccgacaatcagtgccagtccaccgataccgctccagattcctaaagctttcccacgcttcgcaactggaactgcagccgttaaaatagccattgacatcggtgtcatgacggaggccccaatacctgcaatgacacgtgccactatcaataatggcattcgattggctaatgcacaaaacactgaacccagcgtaaaaactaaaatgccgagattataaacccggcggcgtccaaagcgatcacctaatgcaacgcccacaagtaacgttgctgcaatcgcgacattgtaagcgttgagggcccactgtaaactggcctccgagatgtcgaaatcaattttaattgctgttgacgccgttgtcacaatcattgagtccatcattgccataaaaaagcctaatgaagttaacgctaataaccagccaaactgtcgctgtcgattttccatgttttccgccccattatcatttattcagacttaccaatgctgaataagcctactcacaaagtttaaatctactatgtcaatctttttcttagatttagttgggtggccacccacaatagttcaaatatttttgaactattacagcgtaccatcccactaacgattcggcaacaaaaaaataccagttcaaaagaccaatcggcacttaagaactggtattagtcagaatcacagttgaagaccgcccaaaatactcagcaatttaaaggctttgataaaaatgggtaacatagtgatcaaaagttttggggttcaacatgacgtatttttcacgtgcaacttttttgacggttattaatcctgctttttccagcaatttaaaatgatatgaaccagcggttttactaatccccattgcttgtccgacttgcccacaagtaacggcctgatcctgcagcttcaaatacttaacaatgttcagtctaaccacgtcagccagcactttaaatactaatagctgctgggaatcaacttcagaccgcggtatttcatttgccaatatttttcacctacttttaccaacaaaggtcgcttgcttattccgtccgtgctggccgaattcgtttgccccaatattggaaataatctgtccgtaacgcaccgttatagagtttccggcgtttcgtggctttttgtccatagaagtcttcaaattctaagtcactggtcaagatatacttgctccaacttggcaatttactgtaaacttggcccatttgccgatagagaatccggacactatctcgatcgcttagccgctccccatatggtgggttcgcaattaggaccccgttgatcttgtcagtcgtaaagtctttgacagccagttgtttgaaatgaatgtcatgcaacagcccggcttcccgcgcattcagcttggcgatatcaatcattttaccgtcaatatcatacccactaatatccagctcagtgtcgtaatcggctaaactatcagcttcgtctctcaattgttgactcaggccagcgggaacccagtcccacttttcgcacgcaaatgcgcggttgaaccccggggcaatgttgcgcgccagtaaagcggcttcgattggaatcgtccccgaaccacaaactggatcaacaaatggattatccggataccacttagctagcatcactaaggcagcggccatgttttcttttaagggtgcgccccccttttcgactcggtaaccccgtttgaataaactagagccagttgtatccagcgttaacaacacgtgatccttattaatagccacttctaatgggaacaaagcgcctgtctccggaaggtgcccgctccgatgataagtatcggctaactgattaacgatcgcctttttgacgatagactgcacgtcgggaacactgtggagtttagagttgcgcgatttaccttcaactggaaattcagcgtccatcggcaataactggtcccatggcaatgcgagagtcttttcaaacaactcatcgaacgtataagcatcaaattcaccaacgatgatcttgattcgatcagccgttcgtaaccacaagttggtccgcaaaatatctttgatcgttccgttaaatcgaacccggccattttcagtttgaacttgataccctaaatctcgtaattcacgccccactaatgcttcaattccgctagcggcggtggcaattaatctaaattcttgcatagtttcctcctgcgacgcctgttctgtaggcgtatcttgttgagtaaatatttccactaaattggtttcctcacctagtttagcataagttgctagtttgctaactgatcgaataaaaaaactgggacaaaagcgaacttttgtcccagtctcctgtctaaatgtaaattcctgtaggccatgttttgtacctagttaaagtacagggtctgttaactaggcggtaatcatctatctcgagattactaatctccccccacatttagttcagttccttatgtgaagcgcccctaccgtagtttgggttgcccgctcgtggggtttaccgcgttccaactcaaccgtttccaattgagtatcgtcactgtggcacttttcaggaatactcgggcatagccgaagccttagccgttttttccgccgttaccgataaatcggtaccccggcttattttttcaccgagcacgaacactacaagcatcgcagcttgtgcgagcatggaccttcctcagccgacataagccgaccgcgattacccagaatttacatcgaatcacaattatagacggtgtgattcattttgattattatctaattgggcaccaaagacatgacgttccaagttagacaaacgtttcagaatatccatattcgtcaccgtactagtcggttgagaagatggactggttgcaccgacagcgacttgcttggtaagctcgtcaaccttggcccgtaaccgttcattttcatctgaaagttgttggttatctttagtaaatgactcatagtccttaatgacattatctaagaagccgtccacgtcggcaggatcataaccccgcatctttggcttaaactctttttgaaggatgtctttgggagtaaaattacgtttagccatatttaaaaacacctcattgttattcgcgcgatacccattcggcatccgcattacttaaaacattgtagcagactttattcaaaattaaaaccattattctgtttttctgcatattcattggcactttcctgtaaccagtcgaagtcgatcagggtcaatgggtacggatgagtgtcactaaagttccgaatcaaatcatagtcatacgtgggtttcccggggttatctggatcatataccagagtggccgcatccgtatgggtaaccataaattcttggtaattttttaattgttgcggattttcatacggttgtttactgactggtgcatgaaaatcgacttgggccagcaaagtctgtaatttagcttggttattttcattccagcgcccaccaaattcaccatatggtaacatcattgccactttcaattctggatatgtctttttgagcgttaaccctacttccgctgtccactgttcaataccgagctgaccacccgttatcagccaatccataccatcctcgatctgcgtcgttaagtaattagttaacgcaaacttaataacttttagtttatcatcctgatcaccaaagacattcaactcgtaactccggtaaccactaagccacaaccggctcataaaaaagtctcctttctgtcactaaatcggtctaaatcagttaaaaactcacagatatttcacattccctattagttaatggtaaaatgtaacattattaggaggttgattaatgtgacgattcgctatccaaacggtcaagtttatcgccaacccggcccaactaaatcgaaatcttccaaatttgccaacgtcaattttggcgatcgtggaatgagcttggaacaagaaatcaatgatagtaacgcctattatcttgaaaataatatcgcagttattcataaaaagccaacgcccattcaaatcgttaaagtcgattatcccaaacgcagcgccgctgtaatccgcgaagcttattttaaacaggcttctactactgattataacggtgtctatcgggggaagtatttagattttgaggccaaggagaccaagaacaaaacggcttttccgctaaaaaactttcatgagcatcaaattaagcacatgcgccagtgcttagctcaaagcggaatctgttttgttatcattcggtttgcgagtttggggcgcctatttttgttaacagccagcgacttatttacttattgggatcatcaaggagatggtggtcgcaagtcaattccactgacggatattgaacatttagccgcggagctacattatcaaatcaatccacgcattccctatttggatgcgcttgatcatattattgatgagacctcatcaattcattaaaggagaacatcatggcaggtaacaatgaacagaactcacgggttgctcgcagaaaaagccaacctaaaccacctaagaaacactggtttcggcggattattttatccttagctgcactgtttgtcatcggggtactcgctggtctagcacttttcttctactatgcgcagacggcaccaacagtcaaacagagtgaccttgtcaatacggggaccgctaagatttatgaccagaacgacaagtatttgacctctttgggaactaacgaccacgaatacgttaagtctagtaatatcccatccacacttaagaatgccgtcgtctcaatcgaagatcgccgtttttacaagcataagggggtcgattattaccggattcttggggctgcagtcggcaacttaaaaggtagctcacttgggatgcaaggtgggagtaccttgaccatgcaactcgttaaacttgcggtcttttccaccagtacttcggatcgaaatttgaaagtcaaagcgcaggaagcctggattgcgcttaatcttgaaaaacattacagtaaatctcagattctggaattttacatcaataaggtctatatgggtaacgggatttatggtatggggactgccgccaagtattattacggtaagtcattaaaagatctgagccttagtcaactcgcactgctcgcaggtatgccgcaatcaccaacctactacgacccgacgacttatccatcatacgcaactagccgccgtaatctggtgctggaagcgatgtacgataacaaggtcatctccaagagtcaggaaactgctgctgaaaaagtcagtgtcaagacgggcttaactagttcgggacgttcaagcctagcgaagcatgaaaagacaaataaaatcttggatgcttacctgaacgaagtccgtcaagacctcctcaaaaaaggttataatttaaccgatggcgagaaagtttatacgaacattgacatggatgcccagaaacggctttatgacattgccaacacgtctcaatacgtcaactatcctaataatggaaaacagactttccaattaggggtatcggttgttgactcatacactggcaaggtctcagctatgattggtggtcggaaaaccggtaatgtcacgtacggaaccaaccgagctgtctggacatcacgctcaaacgcttcgacgatgaaaccgattctcgattatggaccagccattgaatatttgaattggccaacttacaagtcgttgtctgatacgaaatacaaatatcccgggactaacatttccgtgcatgactttgacaataattacttgggcaatatgacgatgcgtgaagcactggttcaatcacggaacatcccagcaattcgggccttacaagccgttggtaaaagccgagccaaaacctttgccaataaccttgggatgaacctcaaaaccgttaactatgccaacgggatcggtgctggtgtttccaccttacaagttgccggtgcctacgctgcgttcgccaacggtggtgtttatcataagccatactacatccgtaaagtgactacttctgatggcgttacgacatcgtatactagcactggtaagcgcgccatgaagaaatcaacggcatacatgattactgatatgctgaaaggggtcatcaatagttctactgggacggcgacaaccgctaagatcagcggcgtttaccaagctggtaagactggtactgacaactatgcttctcagtataaaaacaaagtaccatccgatgccgtcgttgactcatggatggccggttacacgaagaattattcggtcgccgtttggactggctatgataagtccaccgaagctggtggttatctagatacctccaacgaaaagatttcacaacaaatttatcgcgccatgatgaattaccttcaacagtattcaccaaactctgattggaccaaaccaagctcagttggcacgactaagaagaacggtatcgaagaactttacgttgttggtcacctcttctccagtagtgaagcctcgtcaggaaccgctagttcagctagctctagttcaacaacaacgggtagttcaagcaccagcacagaagcaagtagtcgtagttcggaaagtagcagtagtagttccgaagctgcttcttcctcaagtagcgccgaaagttcatcttctgaatctagttcagaaagtagcagtagttcggaagccagttcaagctccgaagcaagttccgaagcgacttcatcggaaacaccgaccgctgataccaataacacgactgaaggacaataagaatcacccaagaccactgaattcgattcagtggtctttttttatgtgcactgttttaccgaaataacacacaaagtttacataaactaaactcaaaatcaacgttaacacggcgaattaccactacaatacaaagtaacttaataaactgagcaaaccaattaagacaaaggagttgcatatcgtggttgccattaagctacacgaattatccaaaagttttcaaggtccggtaatcaatcaactcagtctgacgattcctgatcaacaaatcacggcattaattggcccgtccggttccggcaaatcaacgctcttaaacatgattgcgggtctcacgacacctgacagtggtcaaatttcatttgataatcagcccatttttgacgccgcgactcattggaatcagccccctgcccagcggcacttggcgatggtttttcaagactttgccctgtggccgcacatgacggtccaagaaaatgtcgctttcgctttagaaaagcatctgaccaagccggaattgactgctcaagtcaactgggccctcgaacaagttagtctgattgacttccgacatcgttatccacgtgaactttctggcgggcaacagcaacgggtcgcccttgcacgggcactagcgacccaaccggatttgattttattcgacgaagctttaagtgcgcttgaccccgaactgcgcacacggcttcaattagaaattcgcgccctgattcacgaccagcatctgacggccatctttgtaactcacgaccgtccagaagccttgcaagttgccgaccacctcgtattactgcaagggggcaacgtggtgcagacgggcacaccagcacagctgtaccaacagccaaaatctcaatttgtcgccaattttatgggcacccttaatcagatcaacgcgcaccaggccattcgcccggaatatgtcgcagtcagtcaaacgggtactcagcagcccacttaccaaggcttggtgcagcgttcaacctttatgggcgatcattttgatacttacgttcaagtcggcgcctatgattggcacgtcaagacccagctaccctataccactgcaccgatcacattaagcatcgatccacatcaaatactaactttttaggagttgactcacatgtctaaagcagcaattatcacattatccacgctcggcgtgctcgcaattggcacgtcgctttatgttaatcaacatcagaaaaaaacgttaaccgccaatgcgcaaaccagtcaacaagtcttaacagtatacgctgctggacctaaacccctttctgatcaaatcatccacggttttgaagccaaaactggcattaaagtcaaaagttttgacggcacgaccgggaaaattttaagtaaggtcaagaccgagcaaggcaatccccaagctgatgtgctgattttagcttcaatggccgctggcgtcgatttacaaaagaatggccagctattaacctatcagccttctcaagctaaacacctgaataaacaatttaaagatactagccaccagttgatcaattacagtgcttcggcagtcggcatcacctacaatacgcagcacatcaaatcggcaccgacagactggtctgacttgacaaccactccgtatcgcaatcaagtgaccattccggacccccaaacctctggttctagcttggacttcattaacgcttatcaaatgaaacacggtacgcaactacttaaagcccttcaagaaaacggtgccgatatcgggggtgctaacaaggaagtactcgatgcagtcatcactggccaaaaaatcgccgtctttggtggggtcgattacatgagtctaacagctattaaaaaaggcgaaaaaattggtttcgtttatcctaagagtgggactttggtcaatccacgaccggcgatgattttgaaggctagtcgtcatcaagccgctgccaaacaatttattgactatctcttatcagctaaagttcaaagacaaattcaaaaaagtaacttaattccgggtaccacgagcactttgaccgatccacgcaatggcgaagccatcaaagcctacacggtcaattggaccagtgccaacgcggccctgactaaaaacgttgtcgcattcaatcaggtctttagccaatgagtaatcatcaaatccgcttgtccttatcaatcatcaccagttgcttgttggcaactctgattatcggcccgttagtcgccctgattggtcaaacactagtcgggcaatcgccaagccagctatggtcacaactgacgcagccaaccaaccgtgtgagcattcaacacagtctgttcctcagttgggggcacggtcgtcgggacaaccctgctagccacccctttggcatggatcatgacgcacacccgtttaacaaagctcgcctggttgcattggctcttgttagtgccattcatgacaccaccatatattaacgcgatgggctggttatatttctttcaaccacacggattactggctcagcttaatccgagttggcaccaccaatttcagtggctattttcaccgttcgggatggtcattatcatgagtctgcatttgtatcccgtggcatacttaggcttacgcgcagccctcatgcaattcaaccagcgctggcttcaagcggccgaagttcatggggtcaacacctggcaacgactagtgcgaatcacattaccaatcatgttagtcccatacttagctgtatggattttagtctttaccaaaaccttggctgaatttggaacgccagccacctttggtcggagcatccacttcgaagttctgacgactacgattcaaaaggacctcaaccagtggcccttagatttccaaaacggggtactcaccggcaccctcctactgaccattgccctgattgcctggggtatccagcaatggttgttacgccggccagctgttaagttcaccggacaacggtcagcgtcacaatatcggcagcttggagtgacaacattagcaggcactttcgtcaccctagtcatcagtattgctattgtcctgccattcagtgccatcgtgctccaatcgctactcaaacaacgcagtcttggttggagtccgtctaatttgacacttgtacactatatagacctcttacgctttgatagtcctgcctggcaggccattgttacgaccgtcggattggcattactgattagcagtctcaatgtgatcgttggtttattcttgagcgttgggagtttaacaaaacgttttcccaagtggctgcgacagttatgtcataccttgggcgcattgccactcgcaattccaaacgtcgtcttagcattgagcttaatgatgctcttttcacaggtgctggcgttcaccaaattatacggcaccctaaccatcctcctgatcgcggatgtcaccttatttctaccaacaacggtgcaatacttgacgaccgccctcaaggcctttgactcggaattgctggctagcgcacgcatcttcgaacctagtttcggccgcattatcctaaaaattgcacttccgattctatggcccgcgctactcaacagctttgtgatggctttcattgccacgagtcgtgaattagtcgttgccctattgttactgccttccggtatgacgaccgtttcaacatttatctatcaatcgttcgaacaaggtgaagcggccgccggtatggccctagcggtattaacggtagcactgacattcattggactgattgcagctaatcacctgcaatcagctactaagccagtacgccagccaaacggcatcagttggcactcaaatcggtaatcgtcagtagcggaaaacgactttgttttttcgtcatcgcctatcccaaactaaaaaggctggtcgcacgagcgtcaatgttgacgtcgtgtgaccagcttcaatcatcactgacaagttatttagaatcatcggccgaaacatcaccggtttgttcaacctcttcagcttcatcattcggcatgttaacaacggtgacgttagcctccgtattacgaacaacatacgctgtcgttgaacctaagaacaggcgagaaatcgcattagtcccagagcgaccaatcacgatcaaatcaatattttgagccttgggaacatcgaccgcaattgtcactttgggtaccccagtttgccgaattgtttcggcgtgcaactgatgggctgcaacttgatcctgggcccgctccaacagtttcttactctgggcttgatcaaaactcatcatatctggcgccgcactcgtaaaaacatctggactgtagacgccaaatcgattaacatcgatgacattcaataaaaataactgggagtcaaaaaccttcgctaaggcaatcgcatgttcaagtgcataataagcattatcggaaccatctaatgggactaggattcgtttatacatggttgagacctcctgataagttcaatgagttacaacatttattatcataatcataacttatctataatcatccagcacccaatatgcttattaattgtcaaaataagatagcggtttattgatgttaatcttagtaccgtaatatttttgcttgatatacttttgaatatccgcccgatggtaaagtttaactagtttaagataactagcacgatgctcgttcttagcggccgttgctaagatattaacattatccctagtactcttattcagactttcgtggaaaatcgaatcccgtaaaacgtgtaaatgtccttccaaagcaaccgtattcgaaatcaaaactgcatcgacacttttaatgatccggggaccagtagtatcatcgatctgtttgaatttcagatgacggggattgcttgtaatatccttcactgaacctaagacaccaaaattagctgccagtttgatcaggcccgctttttggagcagtaacaagcctcgcgaagcttgtgagggattgtcagcaattgcaatcgtagcgccatccggaatttcatcaacgctttgatattttttggagtagattcccattggttccaaataagtcgttcctaacgccgccaacttggccttgggattctgctgattataagtttggtaatatgaccaggactgaaaggcgttcacatcaacgttaccgtccaccgtggccttgttcagctgaacaccatccgtgatttgtttaaccttaatcgttaagcccatctttttggcatcttggcttttagcaatgtgctgccagacttcatagtccgatcccattgatccgaccgtaatcgtggcactctgttgtgtacgggccgaataactcgttatttcatgtaatcccacacaaataccaacaattgcagcaataccaatcaaccaccatgctaatcgtttcatcggctaattccccctttattaatgatgtgtgacgctcttaacgagccaatcaccaaacagctgtacagcaaagactaagatcaaaatgatgatcattgcgacaaacgtcacgtcgttttcaaagcgagcgtaaccaatactgattgcaatatcacccaagccgcccgcaccgatcgcaccagccatcgtcgtcagaccaatcaggctaatcaccgtcacgattgagacgcgaatcaaatcaggtagtccctctttcaaataaacccgaaaaataattgcaatgggactagatcccatggactgagcagcctcaacgattccttggtcaacatcgagtaacgcattttgcacttgccgggcataaaaaggaaaaataccaaaaactagtgggactaacgatgccgtggtccccaccgttgttccgattaaatagctggtcaacggcgaaattacggccaacagaataataaatggcaccgaacggagtaagttggttagcttgtctaacacttgatacgaggggccatcagctaaaatgccatggggctgtgtcaccactaacagtacccctaaacccaaccccagtattcctgcaaccagcgcggaaactgcggtcatatagagggtctctaacgttgcttgaataaattcagctttcatttgtaagacattcggaattaatgctgtcattagtccaccattcccttcacaacttcttcattgataatgcgagtgtggacaccttgagccgacatattagtgaccgccacattgaaggccgttaaatcccccgtaataatcgcaatcatgtcaccaacattttgaccatcgatctggtcgatattggcaaacaaaatgttaacgtcgacccccagcgtctgcgataactgcgagacaattccctgctttgttgattgaccaacgaatttgaacgcaatcagctcttggtccgctgctaattcactcaatttaatcgttttcgtgattcgctgaatggcggcccgaacattggtagatgtttccacaaaatcaacggtcagaggtgctttgggggctgtaaaaacctcagcaacggggccccgctcaataatccgcccatcagccataacggcgacatgatgacaaatactcttgatgacttgcatttcatgcgtaatgaggacaatggtaatccctagctcgcgattgacccgttgtagcaactcaagaattgccgccgtggtctttggatcaagcgcactagttgcttcatcagaaatcaagatttgcgggtcagtgactagtgcccgtgcgattgccacccgttgtttctgcccaccagataatttatctgggtaggtctgcgcatagtccgttaacccaacgagcttcagtagccgtaatgctttggcgcgtcggtcctgtttactaattttttgacccaataatggataaataacgtttcccaacacggtccgtgattgcatcaagttgaagtgttgaaaaatcatcccaacgtgtttcctggcttgacgtaatgcagctggcgatagcgtttgtaaggcctggccattgacgactacctggcccgttgtcggtgactgtaataaattgatcacccgtaccaaggtacttttgccagcgccggaatatccaataatgccataaatatcacccgtctggatctgtagattgacatcttgaaccgcgtgaacgacttggtgcccgtcgtcaaaagtcactgcgatgtcttttaaatcaatgattgcctctgtcatagtctgcttcctcccattaaaaaacgcccatcgtctctaatctgattatcagattaaggacgaatggacgtttttccgtgttaccaccttacttcaaatgaccctcacaggccaccgcacttcaagtaccgccactgaaaattcttagcgagactctaaccgcataacgggcgtagccgtcaacgcttaaccccgtcagctcagcgttgaaacttgcattataagaccatcttcaacgttgcgaaatggctacctcgcaccaaccggcagttctctaaggcattccaacaacggctactcatcttagacgtatttattaatatatttacttggttgtttacagtattgcgctattttaatgagaagtcaacatttaattataaccattttttaatttatagtggtgcccactgattttggtccaatgatgtgcatcccaccggcttaccaggacaggaaatcctggtggtcctgttttaacctcagtacgctgcgccaatgacgtgggcaaacgccattgatatgaaacaacgactaacccatcccgaaaaaaagtggtagcgacgcctcgcacaggcaatcgccaccactttatttaaaatcagttttccccgataagcttttcagcacagtgtttaagactggtcttcacctaatttgaataacggaatcttcggaccagcatttgcgcccgtctggtgttgtggttgcggagcggaattcaagcgttgctcaatactgcgttggcgctctgcttccacctgggcagccgtttttaagttacgcttctgccagttcaacagaattcggtccatatacgtcaagttatagacttgacgcagaactgcttcccgcaatgccaattcgataacttccggttcataatggtcttcgtcgaaccacttactaatactttccatttcgatcggtgataagtcacggccaaattccgtctgaattgcccgaaaaaccttttgccggctgttttcactcgtggcttgttccgaagcttgagtgctaactggatgctttttgagcgcaactgctaacttatcatacaggccgtcaaaattataacggtcatgaattttttggtcatcagccgtgatcgattcaatcgtcagcaattttttggctaacatttcatgtagccgctgaaaaacggcatttgtcgattcacctaaactcttggcaattaccgcagcatctgggaattgattaccctgatcaattaaccgtttgaactgcaaataaaccaataattcatcgtttgtgaccccaatttcacgatagtgggccaataatgcgttcgcaatggtcgtttgaccatcattcactaacgcggcagctaaggactccatctcgttatcatcctttcactattaagagcgtgagactaggtcccacgctcttaataaaactaaccttcaattaaagtttacgggtaaatccggttcaacaaccgtgggaacggaattgtctcccgcacgtgatcttcggccgtaatccaagtcaagaatcgctcgagtcccaaaccaaaaccagcatgaggaacactaccatacttacgtaaatctaagtaccaagcatagtcgtctggatttaagccggcttgtttgatctggtcaagtaagtaattgtaatcagttgctcgttctgacccgccaataatctcaccatagccttctggggctaataaatccgcacaaatcaccacgtcgtcccgggttggatgcggcttcatataaaatggcttgatggctttcgggtaattcaaaacgaagacgggttgatcgaagtgatcagccaagaaggtttcttctggtgaaccaaaatcaacaccccaatccacgtcaaagtcattttctttcaacaattcaatggcttcatcgtaactgattcgtggataaggtaacttggtgtacttcttcaacgtttcaacatcacgacctaaaatgtcgagtgcgtattgacaatgatcaatcacaccttgaacaagaaaggcaatataacgttcttgaacttccaaactttgttcttgatgcatgaaagccatttctggttcaatcatccagaactcaattaaatgccgccgagtcttggacttttcagcccggaatgttgggccaaaagtaaagacctttccgtaggccaaagctccggcttcggcgtataactgaccactctgtgataagtaggcatcccgatcaaaatattcagtatggaacaattcagttgtcccttcaggtgcactcccagtcaaaattggtgagtccatcttaatgaaaccttcttgattaaaaaattcatacgttccgcgaatgacttcattacgaatgttcatgattgcccatggccgcttagaacgtaaccatagatgccggtgatctagtaagaagtccaccccatgttccttaggcgtaattgggtattcttcactttcaccaacgactacaatgtcttcaacttcgatttcataaccgaactttgaacgactgtcttcatgaatcacacccgtaatccacatactggcttcttgcttaacttccttagcgagttcaaaaacttcttcgctaacttggctcttaacaacgacaccttggaaaaaggcggagccatcacgtaattgtaggaaggcaatcttaccacttgaacgtttattagtgagccaagccccaatctttactttttcgtcgacatggtccttagcatcgataatgttgatctgttgcaccatttacttacatcctccaattactttgcttgttcagcaattttttctgtcataaatttttgtaaccgtcgatgggcctctcgcaaggaatcgatatcagttgcatagcttaaccgtaaacaaccgggcatgccaaacgcctctccaggcactaaaccgacatgggcttctaataacactgccgtcacaaaggccggtgcatctgcatagcctgttaaacgcaatgcttccgtaatatctgggaacaagtaaaaggctcccgctggtttgccagcaggcatcttaaacccaggtaaacgctcgatcagtgggtatagttcgtttaaccgcgcttcaaagccctgacgcatcgtttcaacagatgattggtcaccactaaaagcttcaatcgcagcatattgtgatacggcggctgggttgctagcagcgtgacctaacacgacccccatcttagccatgatggtttgtggcccggcagcatatccgatacgccaaccagtcatggaataggcttttgaaaccccattgatcaaaaccacgtgatccatattagcatcatctaattctaacacggatgtaaattcattaccgttatataataacttttcataaatttcatccgcaattaccaaaacgtcgtgttcaacggcccaattcacgatcgccgtcaattctgcacggctgaaaaccagaccggatggattctgtggcgaattcaagactaaggccttcgtcttaggcgtccgctgcgcttccaaatcagcagtggtaaaccgcaactgttcatcggtgctaacttcgactggcacaccaccagctaatttaacttgctccgaatagctgacccagtatgggactggtaataacacttcatcgtcgggattcagaataacttggaataacgtaaacaacgccatttttgcgccatccgttacgacgatctgattaggatcaaaatggtagtgatggtcagcctcaattcgctgactgatggcttgttttaaagctggtaatccagttgccggtgtgtagaaactcgcttgaccattttgaatactatcaatggctgcttgcttaatgttatccggggtctgaaaatccggttcaccgattcctaaattgataacgtcaacgccgtccgccatcatttgcttggcagtcgcactgatcttcaatgtcgctgacggttgaacctgcattactttacgcgataattccatgtacatccgcactcctttaaccttaaatgttaataattgatttcagctggtttccattagaatactgcaaaatttcataacataaattctttttctggttcaagtacgtaatttcccacacgaccgtcccatcatacttcccaagcgtcgctttgataaccttgctaggattgcgtttagaccagacctttttcaaggctttcgtacgtgaaatcccagcggactgtttgataacggtcgttttatgatgtttattcgcgttaattaacgcgtataccggaacatttttactcgacgttcccgtaacgacgtaataactactggtgccattgtactgtgaaaaggccgtcgtggtctttagcttgcccttgctgacggccagactatacgccgtcttctgggcttggtgcattggccgttgtgcggcccataacgtgccatagaccgccacgataatagctaaaatgacgaccagaataatcataatgagtcgctcagggcgccttctacgttgaactcgcatatgctcttcctttcaaaaacagataaattaattatagcaaatttaactgattgcggaatggtttcttacttagttttgaaaaaactttgaagttcctgcgtaatcatcgtcaatgaaccggttgcgggcggcaacgttttcggtaaagctttaagaatcgtctgcccgtatcgtttcgtcatcaaacggtcatcgagaatcaccgctgcccctcggtcttcatccgtccgaatcaaccggccgattccctgacgtaacttcaatgccgctttcggtaacgcttcgttatagaacggattgagttgtgcttgccttagttgttgataacgggccttggttgtcgtctggtcgggcgattcaaacggtaattgcgtgacgatcaacaattccaactgttcttgtggcaagtcgatcccctcccagaaactaccggcacccaggagaatggcatcgtccccctgcataaagcgccgaagcagcttttcacgactaccattgacgccttgagccaaaatttcgcgatcaccaggtagatccgtttgatgcaaactgtaaaagactgcttcaatcatattcagtgaattgaacaagaccaacgtttgcttaggcgctgccatcacgatgtcgtgaatcgcatgcgtcaagtatgccacgcgctgcttgccactgggtgcttccgccgcagtagcatccgtagcgacgaatagccgtgcctggtgttctaaatcaaacggtgttgataatcggtgatgcttagccgttgcttggtcaatatccaattgcgaataaacgtactgagatttcccagtggcaaatagcgtggcaccagttaatagtggcgcactgaagtaaggatatagttgcgtcttaaaatacccttgcgtatcgatcaagctacccgcgagcgtgaggctgccgcgatcatgccattgattaaggctcacccagaagacccgttgttcccgcgaagctggcactaaccacgtttgtaataactcatagccctgacggagatgttgaagacgattgtcaaagtcgtcgaggacgtgttgttcactaggcaagatttgcgattgatcatgttgatactgctcatttaattgttgaaactgtaaaaaacagttttcgatggccgtttgtaattgtttgatcagcggattgtgggccgcaaagaaatcagtcaactgatccgtggtgattcctaattcagcaggctgattgccgcccttttgtgctggtacaaacgttctagctagcgccgcctgcagttgttgcaggtgtaggtcagtatcattcaatgaattatctaataatttcagacgataatcggcctgtggttgttccgcgaacagtgcccgtaaatttagactatgttccgtgtcaatgcgactgatcaagctgtggcaggtcgccatgtagccattgaaatcaaaggtctgccgtgagtcacgaacgacaccatctgccagatgctgggcctcatcaagaaccagcagtggccgctcttgacggctacccaattgggccacgtggcgcatcaggtaggcatgattggtaatgataaaagtcgcttgcgcggtcaattgatcccgaaagcgtaagaaatcttctttaaaaaacgggtcatcagctttcaacgaggccacgccatgatgggcgatttcgctaaagtacggcgcttgatacgtgctcaagtgcaattcatccagatcaccagtcgttgtcatcgtcaaccacactagcacgcgcaacttcaataattgcgtttgcttcgaatgttcatgcaacgccaagccacgggcaaaccggtttaaatcaacgtaatgctgattacccttaatcacaaccgccgtcacaggattaggcaacaactgattcaacaacgccacgccctgatcacgtaactgcgtctgtaagaccgtcgtcgccgtgctaacgaccacctgttgaccatcctgtgccaagtaggcaagtggcagcaaatacccgagtgttttacccgttccggtcggtgcttcaatcaacaatggtacttgttcagcagactgttttgagtagtgccgataaatctggttcatcatccgggcctgttgtggccgataagtcaagcgatcaccaaagatatgctgcttttgtgcttttgtcaacggatagcgtgccgctttacgacccgcggcttgctgtggcaatcgctgtttacgcagagcgagcccgtttttgatcactaagtcagttggtaactgctgtggatgttgtttgccctgttgaaaggcgtatgcaaacaagtcagccgtttcacgtggtaactccggtgctaattgcaccatttgttgtaacgtgatcaatggtaagtgtgcgagccgctgttgtaacgtgataaacaaatgggccgtagcaattgcatcactatccgcagaatgcggatgattatggtcaatcgcaagcaagtgactcaagtcccgcaaccgaaaactcgaagcagtcggtaacagaatttggctaagagacacagtgtcaacggcctgaattggtagttctggataaccgacacgctgcaattctgaattgataaatggcaggtcaaagttcacgttgtgggcgacaaaaacagtcccttgtaataagctgtataccgtaccagccagatcatcaaagggtggtgctttgcgcacccgtgcattgctgatccccgttaaattctcgataacggccggaaccgttgttaacggattaacgtccgtggcaaatgtattaattattttattattcttaacaaacgcgcaaccgatttgaataatccggtcgccgtccttcacactagttccagtagtttcaatatcaactaccgcataagttgtgtttggtttcatggtcatttccccaagttatggattgtaaagatgttcattagattggttaccgcttgaatccgtcatcaacactaacgctgatgttcgaccaactaatcgatctttatggcatatcacgtgcgatgtgtttgtaatcagactgaaggctggtccaagtagcgctacacttggtctcgaccactaactttaacggttcgtcggtcagcccaacttagctgagttcaacctactaaactgtgccagtgacacaagtcgtcctgatgacgcaagccgcttggctcatcctccacaccgatcgtcacacatacgtcacgtcgatcattgtaaattatagcatattcggcgtagggaactcagcccgaccaactcttaagccaaattcgtcagtctgaggacaacgggcagagactggtcaagagtatgattgagcaacgataaagttcatgaaagtgtctcggcgtacatctgccataacacagtcagctgagtacgcgcgcttgaatagccggcactgctacccaaaatttactttcctaattagtgaattctgggccacgtagtccgtcacaagcagctcaacttctttttcatcattatcggactgatttctaatcatttactaattttaacatagtaatcgatcttcgtctgccgttgataaccagtctgtccatacgcccctcacgtgaatgatttaatttaattaaattgttactttccaaaccagtttaacttacatttcaactgaattcagcgcgttcgccggggttagcatggcaaaagaagtgctaataaggtattatgaagctattattaatctacttacagaaaggcagcgacacgattgaaagatctagctaccggtactagtcatgccaaaattattttaattggcgagcatggtgtggtttacggacaacccgccattgccttaccgatttcgaccatccaaatgcaggccattattcaccgccgtgatgcagcgcagacggtcaaaagccgttacttcaacggcgactttaagatgatgtctgccaacttaggcggtattcagacgctcattagaaccttgcttgcacgttttgatgcccccgagcagggcttcgatattcacatcacgagcgatattccctctgaacgcggaatggggtcctcagccgcagcggccgtggccgtaacgcgggctttttatgatttcttcgaccgaccactctcccaccaagaattattggccactgccaatgtggcggaaagttacacgcatggtcaacccagcggcctagacgttgcgacggccagtgccaaaagtcccgtctggtttgtcaagggtcgtgagaactttccgattccggtaaagattcccggctatttagtcatcgcggacacgggtattaaaagtcagaccaaagttgcagtggcgaccgttcgcaacttactaatggttgagggcgcgacgattcaagcacgcattgatgacttgggccgattgactcgtcagacccgaaccgcgcttgaagatggtgacatgggggccctggcaacagccctgaatggtgcgcaagatgacttacgttccatgggtgtcagtcatcctgcccttgaacaactactcgcagtggctcgccaaaatggtgcactcgctgccaaattaaccggtagtggtcagggcggttgcttgatcgcgctcgctccggaagccagcatcgccaaccaattatcacaaaaattggccgcagccggtgcgactgcgacttgggtcgaaccacttttgtgcgatgactaattttaattttggaggaaaagacatagtgaaaaccgttacggcaaaggcccatactaacattgcgttagttaaatattgggggaaaaaagatgcggcgctgatgctaccacaaaatgggagtatttcgctgacccttgatcacttctatacccagaccagtgtgaccttcgatgagcatctcgatactgaccaaatttactttaaccatcaacacttacccacgggcaaatcagcacgaatcagccagttcctcgaccttattcgccagcgcagtggtcaaaccaactatgcaacggtcaaaactgaaaatcatgtgccgacctcagctggcttagcctcttccgcctccggattcgcggccttagcaggggctgctagtcgtgcggctggcttacaactagatgcggctgatctatcacgactagcacgccgtggctcaggttctgcgacccgctcaatttttggcggttttgtcgaatggcatgccggccatgatgatcagagttcttacgcggaagtcttacaagacccggtcgattgggacattcaaatgatcgccgttgttttgaaggccaccaaaaagccaatcagctcaacggacggcatggcacgggtcgtcgcgacatccccctactatccagcttggatcaccacggctgagacggacttgaagcgaatgcgccaagccattgccgatcgtgatctcactactgttggccaaattgctgaaacgaacgcaatgcgaatgcacgcgcttaatttgagcgctgaacccgcctttaactacttcaccgcggatacactgacggctattcaagcagtcaacgacttgcgttcacacgggataaactgttattatactttggacgctggcccaaacgtcaaaatcatttgtgcgggtcaagataccgacaccattatgaccgggttacaacaacattttgacgctgatcaattaatcgtcgctaaaccaggtccaggtatcacgataacggaaaaataattcagtttaatttaaaatgatcagcgatggtcatgaaaggatatgatggcatgataacggtgaaagcccctggaaaactctacattgccggtgaatacgccgtagtggaaagtggttatccagcaattattgttgcactagatcaatttgtgacggcaacgatttcacctagcgaaacgattgggagcatcgtttctgagcagtatcaagaaaactcaatcgtctggcgacgtcagggagacgcgatggtttttgataatcgtgacaatcccttccattatattttagcagcgatcaatctcactgaaagttatgcccatgaattagggcgtgaacttggtgtttatcatctcggtatcaatagcgaactcgatagtgctgatggtaaaaaatacggtctcggctcttcagcagcagtgaccgtggcaaccgtcaaagcactatgtcagttttaccatttaccgatggataaaaataaactgttcaaattagccgcgattgcccatctatccgtgcaaggcaatggttcgcttggtgacattgctgccagcgtctatggtggctggatcgcctaccattcattcgatcggcaatggttacacctacaacaagctcagtcaagcttaagtgatttgttgacaatgccgtggcccgacctaaaaatcgagttactgacccctccagtagccttacgtttgatgattggttggacgggttcaccggcctccacatcacacttagtcgataaagtggctttagtcaaggcgaagcaacgcagcgaataccagacctttctaaaagccagcaaagcttgtctaaaacgtatgatcactggttttcatcacagtgacttgcacgtgattcaaaccgagttgcgaacgaatcgtcaactacttcagaaattgggcgatttcagtcacgtgacgattgaaacacccctgctgcagcgtatgattcaactcgccgaaagtgctggcgcggccgcaaagacttcgggcgctggtggtggtgactgtgggatcgttttgattgatcaaaccatcgacccacgaccattattaactgcgtgggctcacgatggtatcgcacaacttaacttaaacgtgcatacggttcaggataccgttttaccaaattcttaagcagtttattgacgagcctggcagccttgccggactcgttttcagattctaaattaattggaggtggcaccgtgccacaaagtcaacaatctcatcggaaagatgaacatgtttcgttagctgaaaagtattttcatggcgaacaagccaatgcctttgaccaggtccggattcgccacgacgcgttgccggaaactgccgtggccgacgtcgatttagccaccaccgttggccagtggcattgggacagccccctctacattgaagcgatgactgggggctcacagcgaacgggcgaaatcaacgctcgtttaggccgcatcgctgcagcttgtggcttaccgattgcgaccggctctcaaagtgtcgccatcaaagatccccaagtagcccccacttttgccacgatgcgtgaccacaatccgaacgggctgatctttggcaatcttggtgccggccacccgttatctgcggcccaaacagcgattgcaatgctccaggccgatgcgctcgagctccatctcaatgtcgttcaagaaatcgtcatgccagaaggcgatcgtgactttcattggctaactaacatttcggacttagtccaagccttaacggtaccagtgatcgtcaaagaagtgggctttggtatttcccgccccacgatgcaacagctctacgctgccggcgtacgctacctagatttaggcggtcacggtgggactaactttgtcgacattgagaatcgccgacgtgctaaccgcgatatggcctaccttcacgactttggcctcaccacggttgagtccttgctaggcgttcagaaccgaccggatgatctcacggtcttagctgctggtggcgttcgacagccactcgacatcttaaaagcgttgatgttaggcgctgacgcggtcggcatggctggcaccgtgctacacgctttactccatcatacggacgacgaagtcattgcgatgctgacggattggcagtcgcaattaaaacgcctatttgcactcgtcggcgtaacgcgtgttgatcaattcaaaagtagccgtattcaggacaagattctgttatcacctgaacttgttaactacaagcaatcgattaaagattaaaacaaagcgtgtcatcacaaactacggaatgtcattctatacttgtgatgacgcgtttttgttataaccaagtacaccaaaaaagcagtgtgcccctatggcaagcactgctttttgatcgtggtaaagaaaataatttccatcatctattgattgctattttgacacgtattggtagcggttcacgtacgtccgtggctgaccagcccgtagaacaacatcgccaaagccatgatgattaatagcatccggcaaggtttgcaattccacggccagcgcatggtagtcccctaaacgatacgactgcgttcgttcgggattagcggtaaagataactaaaccattgcgatccgtgttgatgagcagtcgcccgtgagtcgttgccaacacgccagcgggttcatcctggtggtcaagcacatagcaatcatcgtattccgtcctgccagtttcttggatcaatcgatcgagctgcgattgaatcgttggctgctcacgaaagtcatacgctggtgacgggacgtagaagacgccggtcggaaccttctcgtgattcgtatgaactagcttggtcgagttgatacgtaattgctggggattaatcagtgcggcctgaccatcaagattaaagtaaacgtgacaggtcggattgaataacgtatcagcagtggtcaccccgtgatagctgatttgaacctcatcatcggccgttaacgtatagcttacagttaccgtcaagtcgcctggaaaaccatcgtcagcgctcgctagcgttgtcgtcaatgtgacagtgtcgccatcaggatcaaaacgagctcgaaaattatgcgtttgtaagccatgattgccaccgtgtagcaaatgctggccgttatttggtggtaagtgatacgtctgcccattcaaggaaaacgtcgcgttaccgattcggccagcaactcgacccactgttttgccgacttgataaggcgtctcgatataatccgccaagttatcaaagtgaagcactaatgagtgtggctggcggtcgacctgcacttcgaagtcataccacgttgccgcataactcaacacttttagtttgctatgatggatattttcaatcgtgtataaatagactgactcgccttgatacacaccaaatggtactgcagaaatcgtacgcctcattcccttcgatcagtgcggattgaactagttctgtgtcaatgtttgcgtggtaccatccacttgaacatcaatcggttccccggcaatcaacttcaaagtcgtcccatcgtgatcaaccgtgacttcaataatccgatcacggaagacctgacggaaagaatacttcgtccattgttttggtaagaacggccggtaactcagttgtccatcatgaacacgcatgccagcaaatccttggaccatcgcaatccaaccaccagtcattgaggtgatgtgaagaccgtcgaccgtatcattattgtaattgtcaagatcaagccgtgccgtccggttatagaaagccacagccttgtcttcatagtgtaagtcagcagctaacacggcatggatggctggtgacaagcttgattcgtgaaccgtcatcggttcgtagaaatcaaaattgtgtttcaattgtgtctttgagaaatcatcaataaagtcatacatcacttgtaacacatcaccttgcttgatataaggtgaccgtaagatgtggtcccatgaccaatgctgattaattggtaactggtcagctggaattgcggaaacgggcgttaaatccttatccagataaccatcatgttgaacaaagatatccagatccttgtcatatggtaaatacatccgatcaacgatatcttgccagtgggcacgttcttcagcagtcacgtttaaggccgctgcttggtcgtcactaacctgatctaaaatttcaagcgtgtacttcaacgtccattgcgccaaataattggtattaaagttattatcaacgttgttttcatattcatctgggccagtgaccccatgaatcatgtactgctgattgcgtttgctgaagtgcacccggtctgcccagaaacgagaaatctccgtcaacactttactgccttcatgtaagacgtatgatgtatcaccggtataacgcgtgtagttataaatagcaaaggcaatgtcgccgttacgatggatttcctcgaaagtgatttcccactcgttgtggcattcaatcccattgaaggtcaccattgggaacaatgccccatcaagcccttgttgacgagcattatgataggcaccatccaactgcttataacgatacatcagtaagttgcgggtaacttctggtttggtaatccccaggtaaactggaacggcaaatgcttccgtatcccaataagtcgcaccaccatacttttcaccagtaaagccctttggtccaatattcaaccgtggatcatcaccataataagtactaaagagttcaaacaaattgaaacgcatgccttgttgggcctcggtatcgccttcaatttgaatatctgattgttgccaccgatcggcccagcccgcttcatgggccgccaataaatcatcgaaagattgggcgctgaccgtatctgtcagacgttgaagtgcagtcataatggcatcatcagtcggataatcccgcgacgtaaccacgacgacccgcttttcaaaactaacgctggccccagcttctaacgtaccgaagtagcgatcaaccgtggctgtatcagtcacttcggccgctttatgggttaaactcgttacataactaacttgcatcccagaggtaaactgtggggtcccaaaatcatttggtaccgtctgagcaattaaccgatcatccgtaacttcgtggacgttccagaaatgttcatcgtagttcgcatcttcgttcttaacgtcagcatccagtgcggaagcaacttttaattccaccgcttgatcgctcaagttttcaaacgtcaccttctgaaccgaaagttctttttgcgcaacactcaagaaacgctcaaaggtcacgcgaacccgttgaccatcttgatcaacgataaatgatcgtgtcaaagtcccgtgttgcatatccaaatcaagtttaaaatcgctgaagttggcagttgccaagtcgatcttagtcccattgagtttgaaattgattttgatgaaattgacggcgttgataaccttgccaaagtattctggatagccattcttccaccagccaacccgggtcttgtctggataccagacaccgccaagataaataccgggaagcgtatccccagtataatcttcttcaaagaagccgcgcatgcccatgtaaccatttcctagactagtcattgattcttgcagccgtttgttttctggtttgaaatcagtcgtcaagacatgccatggattaacatcaaaaattcgtttcataagttaattcctcctagtttttgtacgtttctttgatcaaaccaactgtgcccgcacctactgcaaggacgatcccagcaaagatgaacatgttggcttgtgaattgccaaataatggatataatgcaaagctcaataaggacgcaacaatttgtggcaggcagattgagccgttaaagagacccaagtaagtccccatgtgttcgccagataaggcgttggttaccatcgtcaatggatacgtattcattgcggcccaggccatcccaaccagaataaatgagacgacaagtgctgattgactgtgaatgaagaaaattgagaagaagccaattgcaccaagtaataaactcaaagcataaccaagtttatgccgattattcggaaccttggctaaaacatatgaccaaacaaccgcggcaacggactgaacagcagataagatcccgtaccagttaccagcggcttggtagcctgcagaactggcattagtggtgtgccaaacgttggcagccattgcaccggttgagtatgtccataagtattgaaatgccatccagcagaagaattgaactaaggctactaaccagaaaacctttggtgctttcttcaagagtgccaaccagttaccaccagatttattagcgctttcatcaatgccgtgatacttcgcgtaagttacgggatcatattcccgcacccgggcaatcgtgataatcgttgaaaccactaagattgctgctccaatataaaatgaccagatcactgaattgggaataacacctttactagccgtattggcgaccccgaacaaggtcaacaggaatgggaagattgccgcaatgacggcaccagtattcaacaagaagctttgaatcccataggcgtaactcttttggtcatcgttgaccatatccccgaccatcatcttgaaaggttgcattgcgacgttagacgataaatcaagaaatgccacggtaatcgcaccaaaaactaaggccgccatggaagcgtaaccaaatccaaacgagccagaattgggtagtagtaacatcacgattgccgcaacgactgttcccagaatcaagtaaggtaaccgtcgcccgcctaaacgtggggcccatgttcggtcggataaactcccaatgatcggttgaacgatcaaaccagcaaggggtggcaagatgaaaaaccagccaaggttatttggatccgcgcctaaagtttggaagatccggctcatctgtgagctctgaagtgtaaatgccatttgaacaccgagaaaacctagactcatcatccaaatcttattggatgacagtttcggtaatccggccgttgttttagatgtttctttcacaataaagcctcccaaaaataatatcaatcgcttgagtacaagttagattataaaaccgcttccaaaattatgcaagcgtttgcgtgaaattgcatgaaggcgttttacttattgacatccgtgcctatttggcatgaaatcggctaatatcaagggttcaaatagtattagctgatacatcgattcatataaaattcacatataattcataaaaaagtcattatattgtatactgttgcatgaacaaatagatgcaggcgctgaaacgttgcgtgccgttgcactaataaaccgctccagccgacggatatcattttgtaaataaataataatttgccggatttaaaattgaa

SEQ ID NO: 28 - DNA, 35250 bp, Lactobacillus plantarum
ccaacggactaatgccaaaacagcattaatccgttggccaggcaatgctcggcttcaactcgtggcccctcacccagccccggaggtcggaataggacgcgcaccggctgacgaataacaatctaaacttggcacgttttaatcacaaatcaggacaaattaatttgcacaatgcgtgttctgatagatattcttatctgtgtttgtcggtttattgttgcggtgtttattttgaatagcgcgtccaaacgtggggtgcatggcattgccgagtaacgattcgagttgtagagaggtcccaatcaaataatcggttcaagaatttactatgaattcttgaaccgattatttgctgtgaatgatttagttaactttgaatgggggattacttggcatcatatgcggcttggaaaatcttgatgatgtcttctttagtacctttgcgtgggttagagaaagcgttaccgtctttaagcgcattagtcgccatgtgttcgaagtcctcgatcttggcgccaatttccttgatggaatgcggaatgccaacgtcttcgctgagttgtttcatcgctttgatagctaattcggcagcatcacgagtcgataagccatcagtgttttcgcccataattttggcgagctcggcgaaacgttcggggcacgcgattagattatattcttcaacgtagggtaagagcagcgcgcagcagacaccgtggggtgcgtcatattggccgccgagctggtgggccatggcgtgcacgtaacctagattggcgttgttaaaggccatgccggctaacatttcagcttcgaccatgtgtgtccgggcttctaggttatgcccattggcgacggcttcacgtaatgatgtttcgattaatttgatggcctggatgcactgtgaatcggtaatcggattgtgatcgacagaaacaaagggttcgatagcctggacaaaagcatccatgccagttgcggccgtgagtcccttaggaacatctagcatgagagtgggatcgttaaaggacacgagtggcatgttacgccatgaagcaacgacgaacttataatgcgtttcttcattcgtaatgacacagtgacgggtcaattcagaaccagtcccagcggtagtgttgaccgcaatcagtggtggtagggcattcttgagtgtttcgattcctgctaacttagtgatatcgtcgccgttagtcatgatgatgccggcaccttttccggtatcgtgggcagaaccaccgccaatagtaatcagggagtccgcttgattggcttgatataaggctttaacagcttgaatgttatgaattttagggttgggttcaacttgattataaattacgtagtcaatcccggcagcatccagtgaccgccgcacctgagcaacggcgccgtctggcagactttcaagaaatttgtcggtgacgatgactggcttgtgcataccaagagttttggcacgctcgccgattttactaatgacaccaggaccgaaaaagttaacgctaggcattaagaaatcaaaattacgttcagtcatattaataacctctttttatattgtaatcgctatcattactaatttacgaatcaaattatagtcgtaataattacaattttcaatactttttggctaattaattatatttttcacaatatcgtttagaaaaggtgcggcaatcacggcatacctgttgtaaccaagtgttaaatgacggtgaactatagtcctcatgctatttgatattactgcctacaaaaagacgactaattacaaagattcacaatcttagtaattagtcgtctttttagtgtgatccaatagaaaaattgggttagtaccagtgatgatgttgccagaaccgtttggccttgacccaggagccgtagcgcgaggcgacgtaggtattagcacgtttttcctgattgacgggtgacaagttgccgtgtaagtatgagcgcaacaattgatagcgaccgtagcagcggccattacgagccgtataactgtatccagattcacgataggcgatccaatttttggcagcgcggttggctttcgaaagcttggcgttgatcttggcaatttgctgggcttggctaagcttcttggaggcctgggcggtgattgtggtttgtggtccaagactagtagtcacgttaacgacgaccccgaagacacaactagccaaaactaatagcaacatggttttaaagttaaaatttttcatgatatgtataaccccgttttatattttccctaagctgataagtgtagaatacgccaattatgtgtcagctatgttaaagagaagttactatgttattaaatgaacgtttccgttatgaaatagtttttgtcaataactgttgcggcaattgtttagatgaataattgcgctgactatcacatgaaaaaatcataatattgttaggaaaactaaagcgctttattgccttcgttcggtaatcttaaattggaatagctttacaaaagtattaaaggagtaagtgagggagtgcaataatggcaacaaaagataatgaaaagattacattgatggcgctagtcatgatgatctttacgaccgttttcggatttgccaatagtacggtggcctattatttaatgggttacagctcgattctattttacctagtcgcagccgtactgttcttcatcccgttcgcgctaatgatggcggagttcggggcagcggttaagtctgatagtagcgggatgtacaagtggctggaagtgagtgtgaatgcgaaatttgcgttcgtgggcacgttcatgtggtttgcgtcgtacattatttggttagtctcaacgtcagctaaagtctggattccgtttacgaccatcttctttgggagcgatcaaacgcagcgctttgcgatgtttggtctgaatgcgacgcagatgattgggattttgtcctgtctatggatggtgctagtgacgttcgtttccatcaaagggatgaaaggcattgtgcgggtcacgagtttaggcggcctggcggtgaccagtttgactgcaatcctgttagtggtttcgggggtcgttttagccttgaatcacggacaattcgcacaaccgttacaacatgtgatgacgtcaccaaatccaagttatcagcatccagtcgggttactcgggtttgccgttttcgccatttttgcttacggtgggctagaagttctcggtgggatggttgataagaccaagaaccccgaaaagaccttcccacgcggaattattatttctgccatcgttattaccttaggctatggcctgggaatcttctgctgggggattagtacgaactggcaagccgttttgtcgaatccaacgactaacctcggtaatattagttacgtcatgatgcaaaacttgggctatgttttagggcaagcgcttggtttgagtacagcggccgctaagacaatgggactgtggtttgcacggtacaccggcttagggatgttcctcgcttacagtggggccttcttcaccttaacttattcaccattgaagacgcttatcttgggaacacctaaggaactgtggccgaagaaatttacgaagctcaacaaagctggtatgccaagttatgccatgatggttcaatgtgccatcgtgattgtgatcattttggtggcgtcctttgcaacggcagacgcgtcagccttttacaatgtgttgaccttgatggcgaacgtttcgatgacgttaccatacctcttcttgctatacgcgtttccgaagtttaaggaaaaccagaacattgttaagccttttgaagtgtacaagtcattgacttggacgaaaattattagttgggtcgtgttcattgtcgtcttaggtgcgaatgttttcacgttgatccagccaatcttggaaactgggcagattcaaaatacgatttggatgctagttggaccaattgtcttcggtgtggccgggattatttggtatcaagttcgagaacggcatgtcaattaaatagccaatttcaaaataccattcgattgctgactgataaaacagcattgaatggtattttttaagtgccttaatatgggaaatttagtacactcattagcaaaagctatctaggggggaatggtcatgacattgggaactgcgttaaagcaggcacgcaaagccaagcaactcaatcaaaagcaagctgcccggggaatttgtgcacaatcgatgctgtcagcaattgaaaatgatcgctacgtgccgaatgcccggctattactggcgctgtgtcagcgattaggggtcgcggttagtacgttgagcctagccgacgattttgagatcagtgccgagcaagcgtttaatgaccgcgttcggcagatgtgcaatgcccatcagtatcagcaattgaaggattggctattacagccaaccactttggaacatgttcaaacggatgagcagactcaggcttactattattatctgggtgtcgcctgttggcaggttgatcgcacatcggatgctgcacaacaaaatttacggctggcaattggtatggttgctcccagctcgccgccgacaacgttgacacgcttggccttgatttcgttagccgtcgttaaggcgcaccaccatcctcaagccccagtcgcggccttagtcacccgggcactcgctgacattgatgcgagtgcatatgaagaaaatgccaacattgttttttatcttgctgggttggtggcctatgaacaacatgattcccagttggcggtggcccgtttgacgcaggggttggcctttgcgactacacacgattcacactacatgctggccaatatttatcagttgatggcgcaactcgcaatggcggcgggggagactgccacggcgcaggttgccagccaacggtcacaagttttcaaagacctgtttaaagaacaaattaacgaccgcctgtaaattatcagtattctgattttatgttggcgtccccaccgtgtattttataagcaccaactaaatacatgtgcacttgatctaacggcccgttattgatttggagtggttgggcgtaataacgatgaccgggtcaggatgaacattgggggttataaaatgacaacagcattatttaccaatcaagtattaacacaggcaactccagcaacggtgcgagcattgctagcagatccgctgaacttaccagcatgggcgactgccattaccacggtcaagccaaccgcgacggggtacgtgttacagcggtccggttcggcttttgatcagccggaacagttgcaggttacagtcggcgctgaccaggtcgtttatcacagtgaggggggccaattgggatatgaaattgtgttcaccatgacgccattggccgagcgaactgcggtccaggaagaagtctcccttacgactacaccgccgagctggctaccgttgccactagtgaagcccgtcatgcaacgggactttcagcggaagttgggtcaattggcaacattagcggaggaacagccgaatgacgattaatgatgggatgacgttaataaaagtgttagtgacgtggtggtctgtcagttggttattacgggccactttggtcggcgttgttggaataattgcctatcgttttttgaagcagcgtcaatttaagtgagttaagacgatgacagcttttatgcctaatatctaatcgtaactattattatttagtgtgcgtttaactatcatccgaaaactaattccggtattctatgggtattcttttgaaggaggaaatctcatgaatcaaccagaattacgtgacccacgctatttatataagacagatggctttgataagcaggatcaggagacgcccgcactacaagctaagatgcgtcctgaacccgattgtggtgagaagagttaccaaggacatgataagttgttgaatcgacgcgttttgatcacgggtggtgattcgggaattggccgggctaccgcgattgcttttgcgcgggaaggtgctgatgttgcgattcagtacttgccgggagaggagccggatgctgaggcggttgccgaactagtgcgcgctgcgggccgtcaagcgttattattaccttgtgatttcaaggatgttgacgttgtgaccgacctcgtggaccggacaatcgctgaatttggtggtatcgacacccttgtcctaaatgcggggcaacagatttcacaaccttcactggctaagctgccgatcgaacaggtgcgtgcgaccttcgaagtgaatatcgtcgcgatgtttgcgttggctcaggcggccttgccaaagatgcccgctggcggtagcatcgtcaccacgacttcgattcaagcctatgcgccgagtggtcatctattagattatgctgcgactaaggcggccatcaagaactttacgattaatttagcagccgaagcggccgaaaaggggattcgggtcaatggcgttgctcccgggccaatctggacgcccttacaactagatcaaggccagccaatcgaggcgctgccgaaatttggccaagacaccttgctcaaacgagcgggacaacccgcagaactggcaccagtgtacgtctttttagcttctaacgacgcgagctatgtgaccgcgcaaatttatggcgtgactggtggcggcgtgattaattaggtgttcactgcaagttaattcctgattggcttgaataaatcataagtggctaccttggatggatacattcaaggtagccactttagtgtgtttaatgatctgatgaggcgttcattaagtaatccagcgctgccgttcccaccgctttggccgcaattagtaaacagtcttcattcatcataaaatcagggctgtggtgcgggtgggtctcacccggagctgtttgacagccggcatagataaaggtgctgggtttggcttgtgcaaaataggcgaagtcctccgaggggtcttgggggccacagtcgaaaattttagtgatttctggaatctgagcggcttgaatactagtgatgacgcgctgtgtcagggttgcatcattcatgagtactggataattatcatcgtaatcaagtgcaacttggacaccgaaagtcgccccgacgccgttcgcaattttagtaatctggtcacggatggtctggcgcgtggtttcgtccataatccggacatcgcccttgagggtgacttgcgctttgatcgcattgaaggaaccgacgccgtcgaatgagccgatggtgacactgccggtatcaaatgggtcaatccgacgggaaataacggtttgtaaggcggttacaaagtaacttccagcaacgattgcatcgtttgagaggtggggcatcgaggcgtgcccacccttacccgtgaaggtgaccgtaaaattagcccgcccggtctgcgtcgcatttaagtgataggcaatcgagcccgtcggcatggtactcatcacatgcagcccaatgacgttatcgatgccgtctaggacaccagcagccaacatacccttagcaccacccggtgacacttcttcagcgggttggtggataatgcggacgcgaccacgtagctgatttttcagcccgagtaaggtcttcgccagtaccatgagataagcagtatgaccatcgtgaccacaggcgtgcatgacattggcgttttgcgatttaaatgataagtggttgtcttcttgaatcgcgagggcgtcaaaatcagcgcgtaatgctaattgaggtccaggttgaccgctatcgatgtcgacgacgaagccgtacccatcaccataagcggtggttgagacgcccagttcacgatagaacgctttgatgtaagctgcagtttgttcttcatgaaatgaaatctcggggtgggcgtgtaagtggcgacgaatcttgatcatttccggttccgccgccgtgagttgttgcatgagttgtgcttgaagggtcattagaatcttcctttctgatcgttagtcaggcgctatcattagtgtagcatcaaacgagaagcttggtgttgatcatgctatggcagacagtcattagacatactctggcatagtgggcagcgtgaccatgtgtgagatgatagtattagcacgagatggtaaatgcgccaactgacgatgatgtggatgtcaaaatggaccggtagttgatcgtatcgctaccggtccatttttgaatttagtcgtaatctggattaaaaattagtgacttgtttaatgtttgcttttaatacgggtaatttaacagctgggctagttttcttattcgggacgcgttgagtaatacgtagcccatgactgccgtgttttagttgggcgttcgaaaggaaaaggttagttcttggtcgggttgctttaatggtcttgaggtaacgaccattttgcgtaatcgtgagtgtcgtgtgactggcattggcaaccgtataatggatgcccttagccgtttgttcagcactgatgactcttactcgcggcgccgcgtagcgcttggctggaatggttgctagtacttgtgagccgtcgacgagcttaaaggttccgtaaccttgaaacggctgagtaatcgtgaatttaccggctttaacggtcgaagttgcgaccgtttaccctgatagtttaagacgagtttggcgtgatgacttgtttggccccgaatgatcaaagtatgggattggaaactgtaagtagtcgtgaccttcttagtcgcggccgtggctgttgtcgtgagtcctcctaagctagcgactgtggtaactgcaataactgaaagcaaacctttgttaacacgcatggcgagtactcctttctaacaaggcgttcggtgtcttggctgattggattagtgctgtcgatgtggtggttaaatgcaatgacatggatacggttagcccccatagcttagttggattatagcagggaagcagtttgccagtaaaagattgtcgataattagttggttatctaaataattaatttagtgatgtgggaaaatatcacatgatgtaaatgtggtccttattctataggtaacggccgttgtaactgtgtgtgagtgttgaatggccttaaagggcctgttatatctgcacatcgtattcattatttctcccacacatactgaattattatcatcgtaatctgtttttgcaaaagatatgatatattgattgtcctgactgttaatttcaggtaccctaaacaggagaccacaattatgaggaggaacgattgatgaagattttgatgccatattttaagcggtatcgactagacgtctggattgcgatgctgtcggtcatcgtcttagtgtttgcgacgttatggcaaccgcgattattgcaagtcattatggaagccattatcaagaatgatcaggctatggtattccgtgaagggctgatgttgcttggcttggccgtactgggaatcattggtgggatcgtgaatacgatatacgcagcccgggtggcccttggtgtggcgaccgacttgcgagctgacctatacgctaaggtccagtcattagcctacgctgacgtggaaaaattttcaccgtccaacttagtggtacgaatgacgaacgatattaatcaagtccaacagattgtgatggctggctttcagcagattacccggattccattactattcatcggagcactgattctcgctgtgatgacgatgcctgagcagtggtgggtcattgttgtcatgatggcggtaatcttaggggtcgcactgattgcggtgcggcggatgactaaatactttgcacaaacgcaacaagatattgaaaacgtcaatacggttgcccgcgaaaacttaatggggattcgggttgttaaatcgtttgttcaagaaccaaacgagatcaaaaagttttcggccgcatccgatgaattaaccgctgtgaccgctaaaattgggtactggttcgctattctaatgccggcgttctttttgacggccaacgtggcggtcggggtcgccgtttacttggtcggtcaaacgattacgacgcacccggcctatttagcagctattacgagttttatttcttatttaatgcagattttatttgccgtgatcaacgggggctttctcatgacttttgcgtcgcgggccgtcatctcacttggtcgaatcggcgaagtgatgactaccgaaccaagtatgacctacgttgatggcgacgcggcgcccgtagctggtgatattcactttgaccacgtaaccttcacttatccgggagatgcgcagccaacgctaaaagatgtgacctttacggtaaaagcagggtctatgctgggaatcgttggggccactggatctggtaagacgacgttggcccagctgattgcgcgtttgtatgatccggatagtgggacggtctccatcggtggaattgatgtgcgggccttaccagaaaaagcccttcgatccacggtggcctatgtcttacaacggtccacgttattttctggcacgattgcgggtaacttacggcaagttaagccggacgcccagcctagccacatgcaatgggcggctaatattgcgcagtctgcggaattcattgaacggttgccacagacgtacgatgcccccgtggaagaacggtcacagaacttttcgggtggtcagaagcagcgactagcgattacgcgtggcgtgattgccaatccagaaatcttgattttagatgatgcgacttcggcactcgatgcgcgttcagaaaaacttgttcaagaagctttggatcgcgagttgaagtcaacgacgaccgtggtcattgccgaaaaaattgcttcaattattcgtgcggatcaaatcttagtgttagataatggtcgcatttcgggccaggggactcaccacgaattgcttcaagatagtgcgatttatcgcgctatttaccaaacgcaaaaagcacgggaggagggcttacatgagtgatttacgcaatgctggtaaatattactggcactatttaaaacgctactggttaggcttcttactaagtgtgattctgattgccttttcgacttggtgcattgtggtcgcaccgacttatctgggacgagccgtggaggagctgacgcagtacttgcagcagtggacgaatcaagcgactcgggcacaagcaagtttgcaaccattcaaccggaccctgatcatctacgtcttgttgtatgtcggtgatgctagcacgatttttattgcgagcttgatcttagcacgcgtgacggccttttcgaccgggacaatgcgggtaggcctatttcggaagatgcaacggatgaaagttcaatactttgatacgcatagtgacggggatattctggctcggttcacctctgacctagataatatttttaatgccatgaatcaagccttgctagaaattttattagccgtggctcagtttgttggcctgctaattgtgatgtttaatcaaaacactacgatggcgtgggtgacgatggcttctacgcccgttgcattaattatcgcggcgtttgtcatgcacaaggctggcgtcgcggtgaaccaacaacaggatgatatcggtcaactgaatggttatatcaatgaacaaattaccggtcaaaaagtcttgattaccaacggcttacagcaggactccttgaaaggctttcatcagtataatggtaaggttcgccagtcagcgttgacgggtcaaatctggtcaggtattttgaatccactgatgcaagggatgtcactgcttaacacggcaattgtcatcttctttggctcatggttagcgctgaatgggagtatgtcgactggagcagctttggcgctggtcgtggtgttcgttaactacgcccaacagtactaccagccaattatgtcattgactagtttatatagtatgattcagttagcgattactggtgcacggcgggtcgatgaagtccgtaatcaatcggatgaagtgagccccgctaacggtcaagcgctcgacgggattcatgatgaattactgattgataatgtgcgctttagttacttaccaggtaaagaaatcttgcatggcgtgtcgatccatgtgcaccgcggtgagatggtggcactcgttggcccaactggttcggggaaaacgacggtcatgaatttgttgaatcgcttctatgatgttgatagtggtgcgattacgtttgatggggtgaatattcaagactttgatctccaggtgctacggcaaaatgtcgggattgtcttacaggaaccccagttgtttacgggcacgattgcggataatattcgttacggggacccaacggctagtatggatcgggtcatcgatgcggcgaagcaggctaatattcatgactttgtgatgagcctgccagatggctatcagacgcgcgtttccgacgaacagagtattttttctgccggtcaaaagcagttgatgtcaattgcccggacgattttaacaaatcccaagttgctgattttggatgaagcgacttcgaacgttgatacggtgacggaagccaatattcaagccgcaatagataacgtcatccaagggcgaaccagctttgtcattgctcaccgcttgaaaacaatcctgaatgccgataaaatcgttgtattgaaggatggtcaaattattgaacaggggaaccaccatgatttattagcggcaaacggcttctatgcggaactgtatcgtaatcagatggtctttgagtaatgaaagtataaggagtcggacatggcagggcaagagcaacaagtgcgggtttcaatcccagtctcagcattaaaacgagccgggattgatcgcgatgatcagttacagttaaaggtgcgcaatgacgcactagtcttagagaagattaagccacgtcaaccacagtggcagcaatacttgataatctggccgctgttggttgcaatcctatcggggttagccagttacgggtactggtggtttcaaaaagtgcgaccagttccactgacaggtgcgcaatcaatcgggagtttgacgattgtggccggtgtggttaccggcgcagtgctatttgtcggctttttcttaaaaacgcgtaatgatccagaaaatcgattttcacgccatatttattggcggaactttccagttattacgattgcgtttattatgatcttagcctttgcgctggtcggggctttctgggtattagaattattatttccagatgtcatcttcgatcgctttacatctatgttgctactggtcttgtttacgtattttgcggatgcgttcatgattagcgctgcgttgacgataaatgcgcggtcgttatcaacgattttaacggtggtgattgtcagtggctgtgttatctcaatggccgccaatggtcaacggcgatggtggcagcataatttaagctttttagggacgcatgccgctgaaaatgcctggcaattcaacttgacactgattttttcggcgttattgatggtcgttctgattgactatctatttgtctcacttagtcgaatttatccgcgtacttggcgaacgtcaaccttgcggatattgttgacgttgaccgctgtcgatttcggggcggtcgggctatttcctaacaacctgacgtttcactggttacatgacttagttgctggtggcttggtcacgttgttagtcttgttgattgtgggggtgcggtggctattaccagccgtgacgaaagattttctgtggctctcatacggcgttggcgtggtgctattactactcaactttggttttcgctggtttgggtatccatcgctgacggcatttgagattcaagcctttgcgatttcgtttggctggttgctgatgctattttcacgtctacaagcgttagtcaatgaagacccggaattgttgacgattaagttggagcaggaaagtacggcagggcaataggttttatttcggtagatattgttttaaatattgattgctgatatgcaaaaagaggttatgccacatgcgtcagtgtgtggcataacctcttttgtgcaagttaagaagcgctattatggctggtattaagcaccaagtttccgggtaagaagacggcagattttctacatgaatttacgaagttggtcccgactgaaacgcagagccactcataaaatgacattaaaaaggcaactgttcgtggtcacggtacgtgctggtggacgggtgcctttttggggcttaagtctaatttgaagtctgcaattatttgttaacggatactggcattcaacctgattttaatttataattagttaaaagaacatatgttcttttaacgacaaattattgagtcaggtttcatccaaaagtgagtgtcatgggggcgagcgacatgcggctatcgttaaaattcgatcagcagcatgaggtttattttggattaccagcaaaatgttaaggtgaacaacgactgcgattgtgccgattaattggaagggagtcattatattgatggaacagcgaacatacatggcaattgatttaaaatcattctatgcctcagtcgaatgcgttgctcatcaactcgacccattgaatgccaatttggttgtcgctgatacgagtcgcactgataagacgatttgtttggcggtttcgccagcactaaagcaatttggtgttccagggcggccccggttatttcaagttgaacaacgggtcgcaactttaaatcgcgcccgtggtcgccagacttcctatcaggcggttcggcggcatcgctcaatttatcgtgatcagctcctcaagcatgctaatttgggtatcgattatcgggtcgttcccccacgaatgagttattacatgcagaagagtgctgcgatttatgatatctatttgcgcttcattaagccagaacacattcacgtgtactcgattgatgaagtcttcatggacgtcacagactacttaagtacttttcaggtttcaccgcacgcactggcaaagacgatgattcacgagattcaggccgagactgggattacggcgacggctgggattggtgctaatctttacttagctaaggtggcgatggatattgttgccaagaagattcccgctgacgctgacggtgttcggattgcacagatggatgagcagcaatatcggcaatacttatgggcgcacgagccgttgactgatttttggcgagtcggtcatggctatgctaagcggttggcagccctggggctcaatacgatgggtgacattgcgcgctgttcactaggaaccttgtcggattctcataatgaagaacaattatatcgtgagtttggtaaaaacgcggaactgttaattgatcatgcgtggggcgatgagtcggcaacaattgctgacatcaaaaattaccatgctagcgaacatggtatatatgccagtcaagtgttgatgcgaccgtatacttatactgaagggcaggccgtgttacgcggcatggtgaataatttgacactcgaactggttgctcgccacgtggtgacagatcagttgggaattcgtattgattacgatgctaatgcttcgtcagttggcacgcattatcagggtgcggtcaccgaagactactatgggcgacaagtaccaaagcccgcccataccacggtgacattagcgcaggcgagtgcttcacaacacgagctaggggctgcgtatcaacagctttatcaacaagtcgttaatcgtcaattgatggttcgacgtgtgaccgttatggcgaaccatttggtcgacgaacagcaggttaggcgccaacctcggtatcaacaaactaacttatttgaaaatccagaagtggcccaagcgcaagaacgagacgcacaacgcaaacgtgaacgcgatgggcaattgcaacgcgccattttgaaattacaacgtcgttccgggaataagaatgtcgtcattcgcttggcagatctaaaaccgagttcaactacgattgaacgtaatgagcagattgggggacatcgtgcctaatgacaaaggaagccagtactactgcgttatttaatgatacgagtcgctatgcggatattttagagtgctcgcgacctacttcaaggcatttaccaatgccccaagcagaccgtgctgcccaatttgcgccgttcgcggcgttgactggttatcatgacttgattgaaaaacacgctgcaatctatgcccataaacactatccaaatgctcaggataaaagagctgtggcgacccagttgaaacagattgcagcgttaccaaaactaccattgctcaacgtcgattattttaacgataccgttggctattatcagacggcaaccagccagttggtaaagctcgattggcatcaagcccggatttatctaacggcaccagcaagtattgcgatggccaatatccgtagcgtttctatagcgaattaatcttaattaaggacggttccaatgactaaaattagtcgttagaaccgtccttttaagattaatgattattttatttcgcggtgatttgcattcgtccgtgctttttagaatgatatagattggcgtcgacgcgctgataaaaggccgttggtgattggtcatcagctgctaattctgataggccaatcgagatcgacagttggatttgatgatcattaactggtacagcgatatgattgatggccgcaaatagttgttcagcgaccgcaagtgcttcggttaaatcatagttggggaagataacgttaaattcctcgccaccggttcgatatagtgagatttgcggattattagcatgaaagacaatcgtagctacttgggcgacgtgctgaagaattttgtcgccagccaagtgaccataagtgtcgttgacttgtttgaagtggtcgatgtcaaacatcagcatggtcaattgtgagccgtttttccgactgcttgtaacctgataattaatggctgttttgtaagctgcaaaattttcgattttggtcagagcgtcgtgattagcgaatgcgaccagattctgtttgaggtgtgcattggctgacaacatgctggcgtagatatagagcaaggaagcaaagacgagtaggtaggtccattcttgccaataagttgcccatgataagttgaacttaagcttcatgaaccaccagagaacggccccaaaaccagcacaagtgactaaataaagtgcgacttgtccctgtttcgtttggagtgggacgtgtttacgcaatcggccgagcgccgtaaagaagaggatcagtgtgacggcgtgcccccacgactcccagtaatacaaggagtgattgaagcccataaagataaagacaagcgggtacaagtagtaatagcggacacgtacattgagaaagtagccacaaaaagttagcccgatgagctggaaattcatgaaaatccaggcgtcgttctggcccacaacggcagtttgcatcccaaagacaaataacatcatgtagattaagccgtaccagtcggtaataagcgattggtcaacccgccaatgatgagtattgaagaagttgataatccaattttgtgatacccaaaaaagggtcagcacgcctaggatgaaaaaaacacttgtaataaatggagttatctcccaatgtgaccaagtcatacgcaaacacctttcaaatcgcaaaaactgcgttggttcgaattaaatgacgccggtataagtatatccctttaactgctaaatagcgactgtgattatggactttaattggctttttagccgttattatcagggaaaatcagcgggcctcgcgctagatacgccgaacggcaattaaagcagcgcaacaagcctgggttaaggtttaaaatgcccgagttggtgcggtgagcgtgggggcagcatcgttgacgaaggccggggagtcgtcgtaataatgcccagttggtcgggacgtgccgtaataaaaccggtgtttaccaaccaagcattaatcgttatcggaccgacaaatttaaaaccaacttgttgtaagtgctgtgcgatgcgatcgccagtaattgttgtgcgtgggagttcatcataatactggggctggataattaattgttgatggcccaattgttgccagagatagtctttaaaagactgtgtggtccgaatttgttgaatcaggcgagcgttgtgaatcacggcttcgattttacgacggtttcgtatgatggccgaattgctgaggagaccggtgatttgttctgggcgatacgctgccaccacctcaatttgccaggcgtcaaatgctgcgctgaatgctgagcgtttattgaacacgacggcccagttgagaccagcggcaaaaccgccaagactcagaaactcaaataattgttcatcgcgctgaaccgggataccccattcgtgttcaaagtaataccggtagccggcatcgtacggatagtaacgattgaatagtggatcatcatcaaaccagttggtaatcattaaacaagcctcatttccaaatcaattagtagacactaactaaatacggtaaatgggtcggaaaacacgtggataaaaaaaacttttccaatcctcctgagaatggaaaagttaacttgaagcgtgttcaacgatgatctttgattacaaggttagttggcatgtggcgaacggttttcgtcgcgtggtcacgcttgatctgagctagaatggtcctcatactgactgtggcagtcagatcttttttaaaagtatgaacaccaaagctgtcataagtgacatggtcatttttgagtgtgaaccagttcggctggagttgcttggcatctgccttaatgtgtttatcagaccaaaccagatacttagtttgcccctggtcagtgtaaatttcgacctgccaacccaagctgaaatcactaacttcttgccaacgctgaatctttaagtgcttgatcgcgtaataaataatgcagctgtattttaaagcaggctgtttagcaatggtcgtttcggtaatcggttgtggttgttggataacgcgtgatttgtgaaccgtagttgtggtggctcgcggggtgcggtgtagggtgctgagaccaacaatggtaccgataataagaacagtgataatcggaatcagaatttttttcataagaaactcctaacgaataaaattgtaaaacgtaaaaattactatttacaagaatgaaatttattgctattctttaaaacgtaatgattactatttaaaagggagtggcaattgtgaaacgtttgtggctattactaggtggacttgttattggtgggggcttgttgacgggctgtcagtctaagtcaacgactgctgaatcgcataaggtcaacattgttgcgacgacgaatttttatggtagtgtggcaaaagctgtcggtggcaagcacgtcagcgtgacgtcaattatcaacaaaccgtccgttgatccccatgattttgagccaacaccaaccgtggctaagacggttggtcaggctgatctcgtcatcgctaatggcatcggctatgatggctggatgaacaaggtcgtgcactcgacgcaacgagccaaattgattcgggtcggcgaggacgtgatgcatcgcaaggaaggggctaacgagcatctctggtatgacagtgcaacgatgcccgccaccgcgaactatctcgctaatcagttagctaaaaagcaaccccagtatcgcacgtattttaaggccaacgcccgcaagtacatcgccacgcttaaaccgattcaacaggaacaggccaagttacgagcgaaggctaacaagttaaagaatcggcaagtgttagtcagtgagcccgtctttgattacgcattgaccagtttagggtttaaggttgctaatcaagactttgaaaatgcgattgagaagggcactgacccagcaccgcaagttatccacaagatgcagcaggcattaaagagtcggcaagtcgccttctttgtgaataacagccaagttagtgataaattagtgactaacatggtgtcattagccaagaagaatcaggtgccagtgttgaatgtgactgaaaccatgccagctaagttgacttatcaacagtggatgttggcacagtatcgccagctcaaccagttattgtccgattaagggacggacctgcaaggcgacgacgcccgattgcgcaacttggacgggggaatacaacgttagcatttcttgaaccatctgtgttaccggcgttcccggggcactgccgacttgaacggcggtgtattcgctcagtaaggattcaaaactagcgaaacgcgtgatgtcgatgagctgagtggtgagctgctggccagtcgtcagatcgatgaaatttacaatgtcaccgacttgtaaggcttggcgttttgcatcgtttaaacggatttcaattgttttgagccccgattttattaacagccattgtggatgaatcaattgcatggtggtcattgaacgttctcctaatcagtttagtcttaattatagtggataactaacgaaataggggcctaaataatggcaatgatgtgcctgaacaccggatattagtggtaggtagctggcgcctgcctataattaggttaacaatacaaggggggatggcacaattggcaaaacgaacagcgattccagttagattacaaatcgttggcacgatgagcgcgttaatcatcatgtatgcgtggggccgctcactaatcggccagccgttgcaattgggcaatcaacagtttacttggttagggttggtttacttgaccggcgcttttctattcttgttagtggccccatggctgaccaatcgcttagcgttgacgccgtttgacttcatagcgatgacggatcatctggtaatggggtggttggggtatcttatcttaattttagtcgttccggtatggtttcagccggccaattctgggcttacactcggcgtgctttccagtgtggttggtggaatttgtatggatgttccgcagaatgtgacctggggtatccgggtaccctggacgtacaactcgccagtgatctggaagaaagtcaactggatgaccggactattgttattaatcgccagttacggcatggttggcatcggctgggtatggcccacactgttcccaatctatcaagtgagtgccattgtgggaattatcgtgattgcgttgggttatgcgcaccatttggcccacttgacgtaagttgtgttggtgattattaacacggcaaattaatatacgcggatcataattaggggtcgcgagtggcacaagtcacgttaatcgtggttagttgaagcgttgttaacaatcgttgaacggcaaaaaaggctggaaaattccagccttttttagtgtctttttaatagagggcccaggcttgcatgccttgtgcgtggtacaagttaactgcggcgtcgatttgttgttgaacggaaccaccactaatatggatgttttggaataaaccgtatgcaccgcttgcgccgttaacgacgtgtggctgccagttagattcacgattgatgatgtgattccaagttccggcgtcaacaccagtccgtgcttgcatttgaccgagcacgtaactttgtaggttatcacccgaatagctttcagttgccggggtagttgctggtgccgaagtaaccgtctcgttagtttgtgctggtgttgtttgagtcgtagttgcggcctgtgtttcagctggctgggttggtgtggtgaccggtgcctgctgaactggcgctgaaacgaccggtgtcgctgatgcttgactagtaaggtcctgggcgttcacccctggaatccgtaattgttggcctggtaaaattaaatggccgtgaatgttgttggctgtttcgattgattcgatcgtcgtcttatattcttgtgaaattgcccagacacagtcacccttcttaacggtgtaagttgcgtcggcgtgtgcagaaacagttccggccaatagtaggccaaccgttgcagcggatgttgttaagattgtggttaataattttttcaagttatactctcccattttttgtaagcaatcagcgtgtcgtacaattgttgatcaacaaaaattagtatagcggcgacttattactcgcatgtgtcgctaattttaagaagcgattgcgagattctgagaaaattatggggagtaaatattttactgaatagttgaagactatcgtgacgggacgtatcggtgacaatatatcggctactaatataaaaaatatgacagaaatagcaatataataattactgaaattaccgatagttgagccagttagcaaaaatagcggcaattacaatgtttaacgtgacattcccaatattaaatagttaataccggtattgttcttataagtttaaaaggatgttgattatagaaagtaatttaacgcaacaaaaaaagtcgggaaggaatcccgactttgtcttaatagttttagattaaagggcccaagcagccataccttgtgcttcatataaagcaacggcagcgttaacttgttcttcaacagaaccactgctgatgtgcatgttctggaataacccgtaggcaccactagaactgttgcggacgtatggttgccagttggattcacgcgtaataatcgtgttccaagtcgaagctgagacaccagtccgtgattgcatctgacttaaaacgtaactcttcaaattgctaccagtgtagcttgaagtcgtggagtcagttgaactcgttgaagtggtcgtcgcggttgtgttgctagttgaactagaactagtcgttgaagcacttgaactcgttgtgtttgaagtcgttgatgaggtgttgttatcagaactggttgaactcgtcttaatagatagtttttgaccaggtaagatgtagtgacccttgatgttattagtcgtttcaacatgattgatagttgtgttgaatttttgtgcgatggcccaaacggaatcaccgctcttaacggtgtaagttgagtcggcgttagcattgaggacaccggcgaataataaaccagcggctgcagctgaggtagttacgattgtacttacaagttttttcaaattagacactcctataaattttgtgattatcgattaaataagttactgacaaaaatcttaactgcgatgtcattcgcaatcaacagaacccagtctaacgcctccgtgttacttgttagtgtcgcgagttttaagaacgcaatgcaaagattacaagaatacggacttttgtaatcttcgtaaccgaactgtgactttgaaaaaggctggttaaatcggttgataggggacagtgacaagctaagttaaccaagttgaggcttacctaaaattaacattatgacgtgaaatcacccaaaattcagccataaaaaaagccgattattttagtataatcggcttttagtgcttgaaaatggcgtcaaacacggctatttaacagtttattccgtcactggaaatggatctgctaaaccgagggcttgtttttcagacttcgcttgagcaatttcctcttgcactaattcacgcgcgtgcggatcactatataggtttaatttgtaatccacttccttcagatttttcatgatttgggcttgctgagcaagaatggcattgcggtgggtcgtcagcagctctcgtcgttgtgcaatcgattggggacctgccatgacataactgatatattggcgaatagcactgattgccataccggtatttttgaggcaaataatcgtatgtaatagatgaagatcgccgtctgtaaatgctcggtagccggattcattgcgactgacaaagggaattaagccttgtttatcataaaaacgcaaggtgtacgcacttagtccgaccttatcagcgacttctttaatcgtataggtcaaaaagattcctcctaacacttgccttagagtattgtctaaggtttatattagctatattaacaagccatgatgaaaaaaacaaccaatattccgggggaattaaacatgaataaatcattagtattagtcactggcggtaatggcttcttagccagtcatatcattaaacaattattaacagcgggctatccggttcgggcaacgttacggtcgttaaataaagcagctggtgtgaagcagacgctagcgggtacacctaacttagatcgattgacatttgttgctctggatctgacacaggatcagggttgggccgaagcaatgcgtgacgtgacgtatgtgatgagtgttgcggcaccagtatttgttaatcaaggtcaggcttctgatgaggtcactagtgcggccaaggtcggcacgatccgtgttctaaaggcagcgacggcggccggtgttaagcgggtcgtcatgactgccaaccttggtgccgttggcttcagtcgtttggatcatgatcatcccgtcactgaagtggactggacccgcgaagaccaaccggggctttcgttgtatgaaaagtcgaagttggttgctgaagaggctggctgggcgtattgcaaggcgcatgctgatagtccagaattcacgacggttaatgccggtgccatgcttgggccatcgcttaatgggcacgtcacgggtagttataatctagttagtcggatattaactgggcagatgatgccaaaccttaaagtcaatgtcatcgacgttcgcgatgtcgctgacttagaggttcgggcgatgacggcgcctgcagcggccaatcagcgttttctagcagtggccgccacaccaatctcgatgcgggacctcaaaacattgattcaagaacaacggccgcagttggctgcaggcctgacgaaacatttgattccagactggtttgtgcgggggttagccccatttagtgggcaattacgcgagtctagtttgatgatccgcatcaatcacgaggtcagtacccaaaaagcccagcaattgttagggtggcaagcgctctcagctgatactgcggtattagccgctgtcgatacactggttaagaatggtttgaataaataggacgatcaaaacggtctagcagtagtatttactgccaggccgctttttgtagctactttagtggcaaccggacttagttattttaacaaaagtatatatttttaaagtaaaagtattgattttgaaatagaaataggatagtattatttcacgaggaaagcgttttccaaaataaatgacacagaggaggagtttgatggataaggagcgacagatgcccaaggattttttctggggtaattcagtgtcaagtatgcaaactgagggtgcttgggatgaagacggtaagggccgttcagtttatgatgttcgtcctgcgacagcaaccacttcggattggcatgatgccattgatgaatatcatcgttacgaggaagatcttgatttgatgaaggacttacatttgaatatgtatcgaattcagatttcatggtcacgagtagttccagatggtgatggtgagtttaatgccgctgggattgcgttttatgatcggctggttgatgcgatgctggcacgggggattacaccgatgatttgcctgtatcactttgatatgccgttagccttagctgaaaatgaaaacgggttcatgtcgcgccacaccgttgatgcgttcgtccgttttggtgaaaagatgattgcccactttgctgaccgggttaaatattggatcgtgttcaatgaacataatttatactttaccgacgaagtcttcaacatttcagggtacaccaagggtgatcaaagtgttaacgacttataccggattttccaccatactatgttagcacacgcgcgcctagatgactttgttcatcagaactacgatgacgtgaagattggtggtatgttagcttacaccccggtttatccagaaacagctaagccaattgatattatggcggctcgtaagagtgacgaatttttgaacgacaacttgaatgacgcttacgtgcacgggcactattcaccagaagtcctgcgttacgttgaacaacagggcatcgattatgatttgcaaccaggtgatgaagcaatcattggcaaaatgaaagcggattttttggcctttagttattatcgttcaacggttatcaacggggataaaatacccgttgatgccgttccgaatcgttatctcaattattcatttgaggccaaccgctttttacaagctaatgaatggggctgggcgattgatccactcggtttccgcaacttgattaccaagttgtatgaccagtacgaagtacccgtgttcccgattgaaaatgggattgggttacgcgagcactgggatggtcagcatatgatcgaagatgatgagcggattacttatcatgaagaacatatcaaggcgatgaaagatgccatgttgatcgacggcgctaaggtactaggttatctcggctggggcttgattgatattccaagttcacacgcagatatcgaaaaacgttacggagttgtttacgttaaccggagtaatcatgatctaaaagacttaaagcgggttcccaagaagtcatattattggctgcaaggggtcctagcaaaaaatggagatgaattgtaatggaaaatagtagtaatggtgctgttagcaatttcattaacaacaaagttttaccgccaataatgaagttcgttaacactaaaccagttaaagccttacaagacgggatggtctacgccttaccatttattatcattgggtccgtattcttgatcttatctaatattccaattccagctgtggctgctgttattaaggcctctggttgggcagcgttctttaaccaggcctatacagtaacgtttggggttctttcactttgggcggccgttgggattgcctatgtgtatgtgcgtaacgaagggtatgaaccactgcccgctgggttaacttccatggccgtattcttacttttgcaaacgcttaacattgccaatccattagtagctgcgatgggtaaagccggtactgggattaccaatgctgctgggaatgtcgtgatgtcaggtagcgccgtttcacagaatatcgataaattaccaaaggtcctacaaaattttgtgcaagcacccgttactggggttgttaatattacctggctaggtggtcaggggatgatcgctgccattattgtcggtatcttagttggttgggcttactccgctatgattcgtaaaggttggaagattaccctacccgaacaagtaccagccagtgttgccaaccaatttactgccatgattcctgccggggtcatcttgattgttgcaatgttaatctttgcggccttcagtgctttcggtaatactgacatgttgcaatttatttacaaggttcttcaaacaccgcttcaaggattatccgattcactcggtggtgcgctggttattgcgttcttagtgccattcttctggttctttggggtccatggtgggttgatcatgggtgccattactagtgggttactgattccgaacacgttcgacaatgcttcattatataaagcaggtaagttgaccgttgcccaaggtgcccacattgtaactaatgaattctacaataacttcattaacttaactggttctgggattacgatcggacttgttatctttacgttgtttgctgctaagtccgttcaatttaagacgattggtaaagttgaatttgtgccagcattattcaacattaacgaaccattcttgttcgggttaccgatcgtgatgaacccattcttggcaattccattcttcttgacaccggttatcgtggccttatccacttatctggtcatctacttcggcattgtgccaccattgaatggtttcgcggcaccgtggacgaccccagcaatcatttctggcttcctgattggtggctggaagatggctatctggcaaacaattacgttggtcatgtcaactgcaatttacttcccattcgctaagaagtacgatgctatcttaacgaaggaagaaggcgaaaaggccgctgcggaagctgctgctggtaacgctgaaattgaaaagatgtaattatagaaaggaattaaataattatggctgaaaaaattattatgttggcatgttctgcgggaatgtcaacctcactattagtgtctaagatggaagctgcggcaaagcaagatggtgttgattacaagatctttgccacctcagcggctgatattgaccatcaactgagtcaagatccgcatcccgatgtcttgttattaggaccacaagttcgctacatggcgaatgacgtgaagaagaagactgataaggctgggattccaatggatatcatcaatatgtccgactatggcatgatgaatggtgaaaatgtcttacaagcagctgaaaagttactcggcgacagataattaggatttaaccgggaaagtcaatgcaatcgtgaatcaccaacgtgtgcggtggttgctttaacatgattgggacttgtccgagtgataatcaaacactaaccaaatcctagattgttttggtggtgggcatctcaggatgttatatatgttacgattcctcactggctaattgctggtggggaatttttttggtggtggctgtggccgcgatacggtactgcgagggtgtgcaggcgagtaagcgagagaagcatgtagtgtggacgttactttggcagtgcttaattttaaaggacggctgctgattcaaaatggctattaatcaaacaaattaaataaaacccttgacctgaaacccgttcgagcagttaggataaaggtaatcaaagaacggtagctggccagcgccattatggaaatctattcatcaaattcgggagggttttatcatgggactattttcatttggtaaaaaagttaaattatatgcaccagtcgatggcacactgatagatttagccacagtcgctgcgggtcagacggggtttgcggtgacgccagaacgccaccatatcttcagtccagtaacgggaaccgtcagtgccctgattccagaacaaaatgcgatcgaactggcagctggaaagctgacggtacggttacgaatgggtgttaataccagcgcaactccggcaacttatgttcatgaaggcgaccaagtgacaccagaaacaccactcgcttttgtggatcaagagcaggccgctgaaaatggggaggatatgacggtgttggtggttgtggataaaggtgggcaacccgctgaaaaaatcagtttatccacaagtggacaagtgagccacgaccaagaagttgccacggttgttgctaagtaggacggatgatggggctaatcgtgtgtaattgtttgcgatgagctgagtcagaaggaatttcatcgcgtcaccacagttgattgatgcaaggtcaactagcaattgcaatgcagttgttaaatacgaaaacacacttcaaagctgctacttttgaagtgtgttttcgtgttcagttgatttttgattggcggttgcaagcaattcaatctgccgcagaatgagcctgtccttgtccacaagccatcagttcagcttggtaggcatcattgatgcgattgagtgcttggtgaaattccgtgataactttgttcatttggcgctgatacttttcatccaacgaataaccgttttgaacttgagttttaggccccgttgtttgattcaagtacgcctttaagtcatcgtctggctgtaacttttcgtataaatcgacattgtctagtaagcggacgatccggttgtatttacccgtaaaggtccgccgaataatctgtattcggtgacgaaagacatagcaaccggcctgaatgacggcttgaggttctgggtaggttgtcgtttgttggtagtgttggacgatttcaggaacaatctgccgaatcgcattattgatagtcggtgtaattaaggccgccgcgattttagttgggtcggatacgccctgttcagtctgtgaggccgaactgaacaagtcactagaaagaatgttcggattggtcgtagttaggtccacatattcccatagtaggacattgaattctgaatgattgagaccaccattttgaaagacagcggtgacatattcagtcaaactaccgtataaaaggtaattagtggatacgtcaaagtatgcagctactttagcgagtcggtccgcgttagctagcgtacgtcccttttcccagtcattaattgtgctttttccagccaagccaatcgcagatgcaagtttggccatacttaaaccagcggcaattcgaagttggtgaatacgattaccaacttgttgtttatcaatctgcaatttgatttcccccctgattggttcttagtatattctaacatagggagggaagcgctcgcattgttaacactgaatatattagcactttcgatgattggcgtggtaacgacagataagtagtatcaagtgcttagtgatacttatgaataattgtcataaaagcggtgctattatttaccggccagccgtctagttggatttcataaggttgttccgtaccaggataaatatgaccgggaatcgcaaccttttgccggtggtcgtgaatgatcaggaaaaacatcgcaggtcgacaaaggatggtcacgtgtgcggccaggcagtcgctaagcgtggctgctaaatgctggcgaatggtcgttagtcccgcagccccttcattaataacgattgaccaatcgaatgccaagtctgaataggcggctaatggtgttaattgttgcatgttgaatgcctcctccaaggtattaattagactaaatattactattagcatacatgcaaatagttgtgatgacgaccatctgcgcttgttatggtcaattaataagctggcttaacagagatcatgcgacaagtgtaaattgccagcgtatactagaagtattatgtgcaaaaggaagtgtcgagaaatgcaacaccggattgctgtgctggcagatattcatggaaacttgacggcgcttaatgctgtgttggcggatgcgcgtcagcaagccgcgacggattattggttcctcggtgatctattcttacccggcccgggtgccgaaaagctctaccagaccttagcggacactgcgccgtcagtatggttgcaaggtaattgggaacaggggattaatgcggtcatgactggaaacgggcgactggatgatccttcacagatttattttgcacgattgaccgcgtatctggtgacccatctgagcaaatcacattacgctgaattagtgcaacggcccattgcgacaacgatggtcgtgaacgggttaacttttcaactggcccataatcagccggaacgctcgactggtcacgacctgtatccggatgaacgccagtctaattttgatcacctagctggtgatgcggatgtggccgtttacggccatacccaccaacaaattatgcgggtgagtcagcggggccagctcattattaatcccggggcgacaggccaaccttatagtccatacgctaagttcatggctgatcagcgtgctcactatgcaatcttaacggtggatgacgcgggtcgaatcagtgtggattttcgaaaagttgattatgatattagccttgagttgaccgttgcgcgtgaacaacaattaccatatttagacttatatgaacatcttcgccggactggttttacgagtacccatgaccaagacttattgggcaaactgaacgctaagtttaattacgctaatgaggtacgacgattttttggcatgcaagcgtgatagttagtggtaagttagtgagttaactcttataatgattgaacaggatacgaggagggttttcatgaactttgcaccatcagaatggtttggctttaacaagcgagctagacatgatatgacgtttactaagactatcaatggcgagaccagtaccaagcaagtgtacgggcactttaacgtgtgggccctgttgttcacgtggttttatgcgctgttcagtgtgcggtgtcgaaccccgtttttcttactgaaaacggcggtgccattcttaggcatgctgtcgttaaatatggtgacgcagctgttttttagtgaccaagttgtcatgagtatcgggttactaggcgatatttggtatggttttatgtttgagacgtggtttagaaatcagctggttgcaaatggctatcaacaaacggcttagtgcgacaggaatagattagcttatcaggcttcccagcaagacgtggggagcttttttgattggggtcgttgacaagcttctggctagtaaagtatcgcaacataaataatatcgtttctttacaaacatctgactaaacactttacattccttaactattcttaaaagtgcagtttgttttacgataaaaaagatggagtgataattttataatgataaagccgcgtgttttaacgaccttattagtttgttcagcaatcttaacaacgacggtgaccccggccgtcgctgcagtaaccccaatggcgactccgagtgagcaagttgccgaaccagttgccagcccggccgttccaacagcaaccttgagtttggcaattcaaaatcaacaattggttgatttaattgggcagacgcagtggcaaatctatgggcagcctgccgtgacgaaggaccctgaatttaacgaccaagtgttgaacttggatggcaaatcagcgttttacacgaccttcacggatcagcagtttgcaaagttacagaatgggatggcgatcgaggcgtactttaaatatgatccagccgccgatgccaatggtgaacatgagatcttttctagccaacagggtggtggtttaggacttggggtgcaaaacaatcaagtcgttttcttcgcccatgatggttccggctataagactcctaaaggcaccttacataaggggcagtgggtgcatgcggttggtgtgatcgataagaataagacggctagcttgtatctggatggccagttagtccaacaagtggctatgcccggtgatttaaagctggcacaaggaaccaaagactttgtgctgggtggtgatgcggttcctggaagtcacgttcagtcaatgatgaccggtcaaattagacaggcccgcttgtatgatcagacattgacgtcgcaacaagtaagtcaattgaacgttgaagcacaggtcggcaagcagccggtcgcacccgtaccagtcgaccaaacgattgcgacgaagctcgttggcccgaagcgaattgcgagtgggcacacttatggtcttaatgtacacgcccggcaaatcaaagctaccggtgccgccccaatcaccatggatgtcgtgtatgatgcggctaagtttgactatgtcggtgcagaacgtctcttacaagggggaaagacgcagatccaactgattgcgcctggccgtattcgcctgactacgacggcgaacctttcaaaagctgaatttaaaatgtatgcgcaaacgcggttagcgcaccttaatttgaaagctaaggccgctggtgagacgcagatcaagtttgagcagctaactaaagatacaaccattgaactagggccagctcaaactgttgaaattcaaggtaagtacgcgctagattataacggtgacgggattattggtgttggtgacgtggccctggcaaacgcagccgataaagtggcagccgccaatgcagctgaaatcaagccttataaacacgtggtcgttttaacgactgatggtggtgggaacccctgggatccgaagggaatgtactatgcacaaggtgcggagcaaggaactaagactcccgtatggacaaccaacccagaaatcatgaagaaacgtcggaatacgtatacgatggacttattcaataagcagtttgcaatgagtacgtcagcgcgggccgtttcaccagcgatttcggcacaaaactacatttccatgttacatggtcggccatgggacacgctacctaaggaatatcaagggactaacgcgaccatgggacaagaatactttgcagactttaacaaaccacaagcaatgttcccatcagtatttaagatgttacaagccgataatccaactcggggcgctgcggctttctcagaatggggaccaatcgtcaatagcatcattgaaccagatgccgcggtgactactaaacagtcagcttcgctgaaatcctttgatgatgtggctaactatatcggcacgccagaatttcaaagtactgggttagtctacatgcaaagtgattatatggacggtcagggacacggtcacggctggtacaatgacaattactgggataagtacgcgcaatatgatgcgctgttcaagcgagtaatggataagcttgaagcaaccggtcacattcatgatacgttagtcattgccaacgctgatcatggcggttctggcaagaatcatggtggttgggatgaatataaccgcagtattttcatggcgttcggtggcgaaacggtcgataatggccgccgtttgcatggtggaagcaatgctgatatcagtgcgctcatcctgaatgctttgcaagtcccacagacaccacagatgtttgacagtcaggtctttgactcatcggcttttcttaagcagactgacctatcgaagaagaaacgttcagttgaaacgttaaagctcagtcgcaatgatcaggaagcaaaagttcaattgactcataaccaaaaccggcaactgacggcatttgatctgcaattggacttagcaggtcgggaagtcgctgacgttaaggttccaaccggcgtgcagattttacggcagacggtcgctaatggtcaattaagattaacagtcagtgccagccaacccgtgactgacctggtgacgattaaactcgtaccaagtaagacgcgtgcggctaagaccatcatgttaagtcaagcaatggctgccactgccgacggtacagaagtgcttgtggatttggataatgataatccactgacgagtacggctaaacccgacgaaaacggcagcacgacgactaaaccagatggcaatggtactgcggtcaagccggatgaaaatggcagcacgacaactaacccagat

SEQ ID NO: 29 - DNA, 3235 bp, Lactobacillus plantarum
cgacaactaaaccagatggcaatggtactgccgttaaaccggatgaaaatggcagcacgacaactaaaccagatggcaatggtactgccgttaaaccggatgaaaatggtagcaacacgactaaaccaggtggcaatggtactaccgttaagccggacaaaaatggtagtagcacaactaaaccgaatggcaacgggactgctgtcaaacccgacaagcatgaaactagcaccacggggagtgggacagttaatacatcaggtgcagacaaaacgagcaccaacgacaatggcacttcaatgacggccggtacagctagttcgcatgcaagtacagtcacggatcgggtgacgagtggcacggtattgcctgaaactagctcgagtgcaactactaatcatggcagtcattcgacaggtcatcatggtagcggctggttaccacagacaggtgaagcggtgcaacgctggctagcagtcgccggcggtgtgttcctcatgctgactggtgcaatcgcggtttggtggcggaagcgacgcgcctaggtaaatataacttggcacgataattttggaagtaagcacggatgaggcagtttctgggaacggtgtgtttctcgaaactgccttttgtgcacgctgatcaacggtggtgatgtcggttgaagtaccagagcgaaccaggttgtaatgtcactccttaataattaatttcaaattatttagcctaatagttagtttttgttgttatagtctaactaaagtgctatgataagattcaataaaaataaggtataagattttttccacagttgtttttttggtaaacttaatgactaatagtcacagttaaagcccttgatataaataaaggggagttggcacacgatattgacgtacagtaaggtagggtgagcgaggatgagctacttagaattaaaagatattcacaaggcctattatttaggcaaggaagctttcccagtcttgaatgggattaatctaacttttgaacgaggtgaattcgttgcgattttaggggaatctggcggtggtaagtcaacgttgatgaatatcattggtggcttggatcggcaatttcagggacaagtgttattgcaaggaaccgcgttagatcatcaccaagagaaacagatggatcagtatcggcgtgaaacagtcggttatatttatcaatcatataatttgatcaaccatctgtccgtgttagacaatgtcctgatctcgttagatatgaccaagttaaatcggtcagaacgtgagcaacgagctaagcaactgttaactcaggtggggttagcggatcaaattaaaaagtacccgaaccaattatctggtggccagaagcagcgagttgcgattgcccgggctttagcgagtgatccgcagattattatcgcggatgaaccgactggcgcattggattctgaaaataccacggaagttttgaaaattttggatcagattgcggcggaaggtcggcttgtaatttgtgtgacacattcgcaggatgttgcgaatgcgggtactcgaatcgtgcgcttagctgatggtaaaatcacggatgacgagcgggtgaaacccgcttatccggtcgatgaaaatcgccaacagattgcggcacgtaagttaccgtggtatgtgccactgaacacggcgtttaaacatctacgctatacttggacttggaacttgattattatcattgggacagcgattggtttattcgcagtgatgttgtttaacgggttaggtaatggcctcaaggggtatattaatcaggaaatcaatgatatggtcaatccccgtgtcgtgacagtgagtcggtatcaaaaatcgagtcaaagtcagcgaggcggcagccaagaaggtaaccagcaggcagctgccatgggggcgagtgtggcgacgaccaatcagccaacgttcagtacggcccaactgagtaaactgaaaaaagttgcgcatgttcagaccgttcagccaattttgagtgcaagcaacgcgacaattacagttggtaataaagactacaccgcttcatcgttaacaacgtggacggcttctaaccggaagtcgattattaaagctggtcacgtggctggtaagaatgaaatcgtcgtcgataagagtagtgtggcgaagaaatggtcatctaagaattggaagcaattggtcggtaagaaagtgactgtggcttttcagacaacgaataagagtggtaaaagtgtcacggttaaacggcaattaacggttgctgggatcacggacagcacgactggaagtggtgtgaacgccgtgacctacgccactatgaaagatatgcggtcagcaaagaatttaagtacgcagccaacttcagttgcggtgaaagttgattcgcgggagcataatgatgctgtaaccaagcagattaataagctaaagattgatggcaaacgggtttaccgtgccaccagtattgccagcatgcttgatacggtcaatacgtatgttaacttagcaaccacgattttggcggcaatcgctggaatttccctactagtctcagcgttaatgatcattgtgaccatgttcatgtcggtcagtgcccggaagaaagaaatcggaatcttacgtgcgctgggtgaaagtcgccgtgatattcggcgattgttcacgagtgaatcattgatcattggggtcatcagtgcactactagctactggaattgcttatggtattggagctgccttgaataaggtcctctaccaaatcgccagctacaatatgattgagattcaggtaagtaatattatctcgacctttatcattgccctggtgattgccttattagcagccatcttaccagcttggcgcgccgctcggttgaatccaatcgatgccctcgccgctgattaagtaattgtgagtcattaactaaaatagtctgttagtaaaacggtaatgaagcccagaacgggattcattaccgttttttgtgcgtggggcctttgatgctaatttgctttacatatgtcgaaattgacatataatgaagacaactaaatagaacacacattgcgcgagccaatttgtcatgaatcgtgattaaaatgtgcaaagtttttaagttcaaaagcagccagctatggaccgctgggaaagttcgactcagcgtaaacttgtttagttaattcgtcctacaccgacctccaggcatttctgccaattgc

SEQ ID NO: 30 - DNA, 34693 bp, Lactobacillus plantarum
agttttcagacggaccctagtcgtttctggaattcattgggaattctagagcggctagttttttgttcgtgttggggttgcaacttttcgtttgcgtgggggggcaagtcacacaagaagttttctaaaagcataagtccaagggtagcgctgtaattgccacacttagtcgtaggacgggaatcagtaaaggtatcatttcgtttttgacggatatgattgggtataatgatatttataccattattacggggaaagatgcgctactggtaagaagcgttctcgtttgaagggtgcgttttggacagccttgaactttgtgccggtcgggcaactaagcaggcaatgaagcgtgcggctgaggaattggccaaacgtaagccggctaggaagacgaccaagaaagcagccacgaagtctcacaaaactacaaagaccaagcatgggacatcaaaagtctaagccccaaaagacttctcatgcgacaaaacacaagaccaagaagcacaacagaagcgctacaataagaaaaaagttgcgggcaaggcaagaaaagcttctcagagaaaacaatcctcgcagaataaagatagtcatgggaaaaaggagaaatctagcaaggaaaaatcttcaaaagatgggaaagataaaaagacaaataatgtcccattggaaaatggctcttatattaggaacggaaaaccttatggacgaccaacattaaccgggaagaaaaaactcgaattcgagcaggaagtatataataggcaagctaaagatggagtgcttattgatcgaaatacgaaacaagtgatacattggaagccgggctaaccccgaaaaggaaaggtcgatctcggacatctaccgggtaagtcttataaggaaatgttcaatctatataaaaataggaagatgacattgaaggattttcaatttaatcccaaaaactctagattagaaactccgtctgctaatcggagtcataaatatgaaacgaggtaaaaagtgtgctagtttacaatgcttttagtgcggtaagagatggaacatttgatcagtttaaaaattattattctggcaatgtggatgagactgataagtttgaaggacttaatttattatgcatggcaatgacaaacgatgacaatcctgaggaaaagttaaagattgttcattttttgttacaagcaggtattgatgttaactttgtcaccaagagtgaacatcgaaacgcattacattatttttacaattgtgtatggcgtccaaatcctaagtttgctatggaaattacgaaactattagtcgagaacggcatcgatgtaaatagcgttgataagtatggacatgtaccactgttttatgcggtttttgataatgatttggatactaaggaaaatgaagagttatatttttatctattaaaggcgggctcagattatcgtttgcgtgatccatttgggaaatccattatagattatgcacgagaaaccaacgagaggactgattttttagatattgtaaaagagtatgaaaacggcaaaaaatgattgcaggttgaaaaatggcaacgattataattattggagtagtaattataggaattacgctgggattaggatactggagttatttactgggaaaaaggaatcaatctaattttgttggccctattattccagtagcttactttgctgttcgagcaatcttagctgtgatgacacaaactacgacacatgggctagtatcgtcattactcggtagcttgttattcagtttgatttactatggcttatttgttgggggtaagcaccgggccaataagtaacatgaattagtcagattaagataaccgatattcgacaaggactaattgccgagtatcggttattttatagaaaagtttagtcggtaatttggtaattactgttgtctatatcctattgtttggggacgacaacgattcaataagcagaagccaataaaataaattgcttgaaagctcagaacgattccaaaattactcgttctgggctttttaggtgtaagtagcgaccaatcaatcgaactttctggacgctacgtcgtgtgaacgatggattcccctggcacattccgtatctactccgttataagttgcctaagtttattgttctcgaattcgccaaatatgagctgtacagacaagataattggcaaacatattaagaaattccgatggtttagtaaaaaaatgtgaaaaaattagcttatttccgaacgtttgtgttatcattttgcatagactttaaaaatgatgatttaggttgaggtggaagttatgaaagtacgtagaagcgaacgtttaatagatatgacgcgctatttgttggaacgtccccatacattagtttcattgacatacttcgcggaacggtacgcatccgcaaagtcgtcaatcagtgaagatttaacaattttgaagaaagtgtttcaggcccggggaacaggaatcttggaaaccattcccggtgctgctggtggtgcacggtttattccttatattttaaaggaagaggcccaagaatttattgacgagatgaccactaaggttgccgacaagagtcgggtgttaccgggtggctatgtttatttatctgatattttaggccaaccagatattttgcgccaagtgggtcgggtgattgcgactcagtacttgaatcaaaaaatcgacgctgttatgaccgttgcaactaaaggaattccgattgcccaaagtgttgcgacttatttaaacgtgccgtttgtgattgtccgcaatgattctaaaattacggaaggctcgaccgttagtgtgaactatgtctcgggttcttcagaacggatcaagaagatggaactttccaagcgaagcctaacggaaggcgccaacgtgctcatcgtggatgatttcatgaagggcggcggcacaatcaacgggatgaagaccttgattgaagaatttgatgctaatttaattggcatcaccgtttttgccgaagccagttttgttggcaatcgtttaatcgatgactacacgtcgttattacgagtaaccaacgtgagtgatagtgacaaggcgattaaagtcgttgctggtaactatttggagaaggttttcggtgcggaagtctagcctggtgtgttatccagaccagttttttgatatgatggacttatctgaggactaaggagtaatttgtaatgacaaccaaaaatgcaatcatcatggccgctggtaaagggacccggatgaaatccaagctagtcaaagtattacatcaggtctgtggcaaatctatggtcgaccacgtcttgacccaagttgaagccacccacatggcaaatatcgtgaccattgtaggccacggtgccaaagatgtggaagcagccttaggcgaccgaactgagtacgcggttcaaacggaacaattaggaaccggtcacgcagtattacaagccgaatcgctcttaaaagatgcggatgggatgacgctgatcgtcagtggcgacacacccttatttaaagctgaaacttttgaagaactatttgaatatcatcaagctaagggtgctgctggcacgattttaacgtccaaggcacctaatcctcaaggctacggccgggttgttcgcaatcggttaggcatcgttgaaaagattgtagaacaaaaggatgcgactaaggaagaacaagaaattcatgaaattaacacgggagtctactgcttcgataatcagaagttgtttgccgccttacatgaagtgaccaacgataatgcacagggcgaatattatttgactgacgtgattcagatcatgaagaatcagggtgatgtggtcgccgcctatcaaatggatgattttgatgaatcaatgggggtaaatacccgtgcagctctagcccaagcaaccaaagtgatgcaacaacggatcaacgcgcagcatatggaaaatggggtttcaattatcaaccctgacgatacctatattgaagcgggcgttaagattggtgctgatacgattattgaaccaggcgtcttgatcaagggccatacgacaattggtgaagattgcttcatcggcgcgcactccgagatccatgacatggtgattgaagatcgtgttcgggtgacggcttccttcttggaagattccatcatgcacgctgacagcaatattggcccgtatagccatttgcggccgcaagctgagattggtgaacacgtccatcttggtaactttgtcgaagtcaagaaggctaagatcggtaatcggaccaaggtcggccatttgacttatgttggtgacgcaacgttaggtcaagatattaacgttggttgtggtgtggtcttcgttaactatgacggagtcaacaagcaccacacgaatgtcggcgattccgcctttattggtagtaactcgaacatcattgcgccagttgaagtggctgaccactcgtttatcgcggctggttcgaccattactgatgatgttaacttccatgatatggcaattgcccgggcacgtcagacgaacaagcctgacttctggggccgcttaccacatgaaccagaaaacatgtaattattatcattgataattgaattcagagaccatccaagtgcgttgttgctgggatggtctctttttgttagctcatcggcgtgacttgtggtgtaataagggctatttagctgctaaataggacaaagttgatttgactgtgtcagttcagggcaactgagtgattttaattaagtcacgaaattggtataattggcgaggagtttacgggacggggaagtttggaggcatttagatgcagacgaagaagtggattcgcggccttgtttgtggtctggcattgcttggcggttggagctgggcattaccagtacacgcaactagcgttaaaagtgagcaaacagccgttaaaaagatcgcgcaacgtgatttgaaatcactaggtgggcgctggtcggtcaaggtgacccgattaggtcgacgaaaactaaccgtgcaaacgggaaatcagcgcatgactcgtcaacgttctgctagtacgatcaaagtttatgttatgctgacgatttatcgacgggtccaacaacgaaagttacggctaacacagcaagatcaaaatgatttaaaattaatgattcataattccgataataacgcggctaaccggttaatcaaacgtgcggggggcttcaggagcgttaatgcggccattaagcattatcgattcaagcagacggttttacaacggtatatgcttgatacgaacgcgctacgctggggacgcgataattacacgtcggtggctgatctaactcgttttttaacgctgacatatcaacataagttattaggtaagacgtatgataagaagatgctgaccttacttaagggctgtcgcaaccacagcaagctaccatacttagttaaacacgccacggtctataataaaactggcgaatatcccgataagggtgtccaaaacgatgcggccatttttaagaccaaacaaggcacttatagcattgtcgtcatggcccagaatggcaagcagtaccaacaatatcaagggatgaatcgcttggggcgcgatgtcgtgacttatttaaatcagcaccactgagtgtgtttagataactgaacagtctagtagattcctgttcgtcagccggtgtgcgctctattccgacttctagtactggctacttttgaacgcgagaaacggcagcggtcaagtaccaactaagacaataactagtgcaatgcgtgtgtcagtaccaattacaactgatagcggtctcattaactaagattgttcggtaatcggggctcacgaaactttaatctttaatcacgaaggggcttagattgccgaaagtcgtgcttccagcccagtctcacgcaattttgccttgttgttgggacttgattttcactagcaaaatgcctattatttagtaagtaataaattttcgaatggaggaaattatgtcagaacagtattttgatccaaagttaaaaatctttgctttgaattcaaataaaccattggcagaaaaaatcgcggacgccgttggggttaagttgggtaagacttcggtcgatcgctttagtgatggcgaaattcgcattaacattgaggaaagtattcgtggtgatcaagtttatatcattcaatcaacttccgctcccgttaatgacaatttgatggaactattgatcatgattgacgccctacgtcgcgcgagtgctaagaccattaacgtggttattccttattacggatatgcgcgtcaagatcggaaagcacgttctcgcgaaccaattaccgctaagttagttgcaaacatgctggaaacagccggtgcaacacggattttggcactcgatcttcatgctgcccaaattcaaggcttcttcgatattccgttggatcacttgatgggtgcgccactgttagctgactacttcctgaaccaccacttggatgaaaatgctgtggttgtttcacctgaccatggtggtgtgactcgggcacgtaaattagctgaattcttgaaggcaccaatcgcgattattgataagcgtcgaccacgggccaacgttgccgaagttatgaatattattggtgatgtcaagggtaagcgggccatcatgatcgatgatatgatcgatacggctgggacgattactttaggtgcacaggcactggttgatgcgggcgcaactgaagtttacgccagttgtacgcatccagttctgtctggtcctgccatcgaacggattgaaaagtcaccaattaagaaattagttgtgacggattcaattgaattaccagctgctaagcgaatcgataagatcgaacaagtttcagttggtcaattaatgggtcaagcaatcaagtttatccatgaaaataaaccagttagtccattatttaagaatcgtttccataacgaagaaaattaattgacgaagcgtcaaattggcaattgctgatttgacgctttttaagttgcagtaatttctaaaagtgatagagtaaaggtgttgtttggtgggcattatgacctagtcaaggttggactggacgccgtatatcaacgaatctttcgttttggcgtgcttcaacattaattaggtgatggcgcggaacggataacggaccaacgtcgggctaccggcgtcctttttttatccaataaacactagcacgaatccttaaaatgattacaatataagttaagggggtgttgcgatgacaccgttttattggggtagtttggcccttgctagtgcgttgaccttgcaattgacggaccggcggcattggttaacgggacatctttttttgattgcagtcattggcattttgttaagcgcttaccatcgattcagtgcgcaggcaagtcctacttggcaattcatgttggtcggtgcaaaaattttggcttatacgttgttgccaattgtaattttgattgtgggcattagttttgtcaggtatagttaccgattgattcgcaaggagggctgggcgtttcattacagcttgctagcaatcgtcggtggtgtattagtcataatgctggtcttatcagtaatcaacttaggagtttggcattcgcgacgcttgtggcagttattaggcctagcgttattattgacggcgtattttgcgttcagctttatcgcgtatctattagcttgcgtcatgacccgactaggacgtcatcgacagatcgattatatgatcgtcttaggagcagggttgatgccaaatgggcagccaacgcgaacactggcatatcggcttcaggcggcagcgaagtactatcgggtgcaacgggcgcgttatcatcaaccaatcacgatcgttgtttctggtggtcagggaccggatgaggttatggcggagagtaccgcaatgcggcagtacttagtggatcaaggggtcccccgtgatgccattcaagaagaaaatcggtcaacgtcgacaattgaaaatctaaaattttcgcacgcattaattgtgcggcaacaaccgttttatcgcgccgtgattgtcacgagtggctatcacgttttacgggctaatatttttgctcggcaactgcacctgaacctaacgggaatcggtgcgcacacgccactgtattatttaccgtttgctatgtttcgggaatacttggccttaattgtgatgtatcgctgggccaacttagtggtggtacttggtttagcggcttattatgtcgcagcgttagttaggttaatttaacaaagccgctactcagagctttgaaaaaaatgacattgcgattaatggtataatggagaatgataaaaaggaggggtttgccgtggatcatgcctatcgatcatcttggccactgattgtaatcgtcctactcggattgattacactttcaggctgtgccaaaaataccggaggcgtaaccgcaagttcggcaacgaccgcaactggtaacagtacaacggccgttttaaccaaagctgatcagcaaatttcgcaacaaaaaattgccgctgcccagaagactttagcgggtgcttctgaatcaactccagcgatcaaaaagttagcccttgggttaaagtattatcaggaagctgaagaagcacttgataataatcagctcagtctagcaaagggttattttgacacgttaagtagttatgatggcacgactgacgccagttttattgctgctcggcaaaagctcgtcaagcagtaccaggcggtcaagctagccaatggttactataacgctgcccgtgatgaattaagtattcatgatttggccactgcgaaggccaatattgataagttggacgatgtgcaagccacacatccggttatcaaaaaattacagaaaaaagctttggcaatgaaacaagccattatgaattatgaggcgtcgcaatcaactagttctggtagtgatagctcaacggttgtcagttcgagttctgcggctagtgcgagtgatagtaggacgtcttcaagcagtacgagtagtactagtgccgatagttcaacgatgacgagttcgtcgaatagcagcgcgtctgccagcagtagttcttcagagctgacaacttcggcgatcatcaaacagtttcaggatgcgtccggtgttacgtttacttcggataccgaatttaatattactaaggagaccagtgcttattatcagattaccgcaatctatgcgacgaatgagtctagttcttctgcttccaagacagtaacggatacttatcgttattatccggatagtggtagtgttactaaggaaaatagtgcaactggtagtttcgaataaccagcattaaaaagtgacgatcaggtaatgactgatcgtcacttttttgtttgactggattgtttagaaaacgctgggtaacggtcataacagtgataaaaaagcaacgctcacggcacgttaaaaacgagccattagcgttgcttgaattagtttgaaaaatagtagcttaggcgagtgcccaagtgttaatggcgtgtgcgaccccgtcttcaacgttagtcttggtttcataacgggcaatttgcttggcctcatcaatggcgttacccatcgcaacactgttggttgcgtaacgcagcatactcaaatcgttaccttgatcaccaatcgccatgacttcatcagcagttaagttcagatggtcggtcaacgtggctagggcgttacccttgctagcggcgggattcatgaattctaggaaatacgcttcggagcgaacaatggtaaagcgcttggagaatgacgctggtaattgcttgatggctgcatccagtagtggggcgtgatcgatgaacatgcacttgacgattggtaagtctgggcgcatttcttccggtgtccggaaccgaatcggcatattgacgagtgcactttcgccgaccgtataagggctgatatttcgattggcggtgtagatatggtcttcactttcaacgtgacaatggatatcgagttttcggctgagcgtttcaatgtcgatgtaatcgtcatgtgacagggtaagtcctgtgatgatcttaccggtgattgtctgaaccattgagccattaaaagtaatgacgtaattatcttcaccagcgattccaagttgctttaaaaagggcgtgacgccacttaatggccgtcccgtacaaatgacgactttgattccttgcgcgttagcggcgttaatcgcttgaacggttgcgggatttagttcgctgtgctcattgagtaaggtgccgtccatatcgatggcgataagcttgactgacataataataattcctccaaaattagtgtggtacgaccagacgatcgtttaaaatatattgctggaattcttggtaaattggtttgaataaatcgttttcggcgtttttgctgagcatttcttttggaaagaaaaaccgctgatcgccagagactttcccggtgatggctcgcactaggtcactgacggtggatagttctagtaaggaaccgtctttttgttgcagttcaatctgggtacgcggcttcttcatcttaggatcgtaggcgtcgtaagggagatcgtaactgtcgttgatgtcagtgtagtagtgcgtatcaaagccggcttgttcaattaatttttgtaacgttggaattagcggttgagtcgttgcatcgactcgtgctgattttaagggacgccggtctaagaaacgggttgctaggtcagcgagaatttgatcacggctatcacgccaatggctaaaataagtgtttaagacgccatcgtctaaccgtaaataatcgtgtaacgtaaagttattattgaaaaacggcaataatatcactggtgtggcttcagcgtcgaccgcgtggctttgataaagatcgttagcccgttccagtaggcgatctaggatgacttccatggaacgtgatactggatggaaatagacttgcatgtacatctggaagcgactgacaatgtaatcttctaccgcgtgcatgccttccatcgcaaatgtaatgccgccttgatacggcttcataacgcgcaaaatacgggtcaaatcaaaattgccgtaattcgtacccgtgaagtacgaatctcgcagtaggtagtccatccgatcggcatcgatttgactagaaatcatctggacgacttggggattcgggtacgttttttgaatgacggccgcaacttgggccgggaagtcaggcgagacttgctgtaagacctgattgacctcggtttcaggtgatgtcaaaatctgaacagttagggcttcatggtcggtgtgaaagatgtgctcgaatgtgtgtgagtatggcccgtgaccgatatcgtgtaacagggcggcgcatagtgcgaccaatcgctcgtgatcatcccaaccaccgtcaccaggggcctgggtcgggtagttacgttcgaagttatcgcaaatacggcgtgtaatctcataaacaccgaggcaatgtccaaagcgggagtgttctgcaccgtggaaggtcagcgaggtcgtaccgagttgcttaatacggcgcagtcgttgaaattccgaggtgttgatcaaatcgagaatgacttgatgttggatataaatgtaatcatggaccgggtcacgaaagactttctccatgggtaatagttgctggcgataggccaaattaattccttctttcagtgatgcaagcgttgttgtcggcgttgcatttgttgataggcttgatttaagtgtgcttgaaattcaggttcttcggtgactaacggcaaacttgttgtgtcgaccgtcccatgttgagctaggatggctataaaacgagcttgtgtagcggtagtgtcagtcggcgctgccaaagcgtcagcaacggtcgtcatgacttgtggatcaacatctggaaaccgcgcgtcatggtgaccggctaagctgacttggtaaaaacgctgaatgagttgactacgggccatctgatcgccatcaacgctgacatacagcatgatgaccagcgcttcggcagtgcgccgttgcgacattccggcaattttacgaccggcaatactcaaatcataatcaccaggacaataggagcgtgtaatctcaccagtcgtgatatttaattgtggccaaactgcctgaacgtagtcgaccatcaattgatatgccgctgtaattggatagcgttcacgagttgctggaagaaataaggaaacgtttagtacaccagggtcagcaactacggctagcccacctgaattacggagcatgacctgataaccggcagcgtgtagatctgctaagccagcagttagccgtggcaagcgttggtctaataagccgagaatgacggttggctgtaactgccagaaatgaacgattggttgctgacgagccgccgttaaccacagcaaggcgttcgtatacgcaaaactatccagcatcgctgccggttcgtatttttgactcaaagttgcaattgttgattccgtcaagaaagccaccccgttatccgctattatcgggcacgagggatgtctcatgatgaaaccgccaccgttgtccgtatcatcactaattatactagaaaaatggtaccgttgcattggcttagacaaatcaacttaatctgtagcataccatcataggataatgaaacgtgcaagttagttggttttttgttcgtcagcaacgtgcggcctatttcgacctccggggctgagggacaattgttggaacacagccgactcaaaaagtttacgcgggttcgaacttttcccagcagatctaagctgaccgcttttagtcctatttttagttattttggcatgaatggcttataattaaacaggaagttttacgatgggcgtgatgggagtcgcgcggtcgtgaacgctgaaaaggatatagcgagtgtggtaacacggtgatcgtagacgggcgttcagcgtgtgattttgaaatattaggaggtccaaatatggatgatttaacaactggtgtgccagtggcgattcatttagagacgcaggcgcggcaagatgacgatacggcgaactatgcactggatgtcgatggtcaattggttcagatgggtgacgcgttttatttacggtataaggaagttaacgatgatgcgccagaaccgattccagtgacgattaagctggcagctaatggggacgtcgtgttgacgcggagtgcggagaaccgacttcggttgcacttttccaatggtaaacgggtgcgtgctcattatcaaacgcctatggggatgctacctgttgaaacggtgacgccgatgttacgagtacggctacgtgaacggccattttcaggtgaggtgaacgttgattacgatttatacgcgggtgagcagctacttggtaactacaagttgcgattgcaattcacggcctaatttggtattatgtactataaactgtggaaaggacgtgcaccagtttggaactaaaacaatttgatggacaaaaaaagtccgaattatctttaatcgaggttgctcacgcgatcttatcacaacatggtgatgtgatggcttttgccgacttgaccaacgctgtgcaatcatatttaggtaaaagcgacgaagaaattcgggagcgtttatcacaattttataccgatcttaatatcgatggtagtttcatttcgctcggtgacaatatgtggggcctgcgtgcatggtacccatttgaatccattgacgaagccgttattcatacggacgatgacgaagatgaggatcggccaaagcgcaagaagcgtaagaaggttaacgccttcttggccgatgccggggatgatgacgacgtgatcgattacgatgacgatgatcccgaagatgacgataactacgatgacgatgatgatcaggacgacgatactgatgattcagcaagcagcaagtacgatgaacttgcgggtgttgatgacacagacgacgatgttgctgatgaaacgttgccagacggtatcgagggtcaattatcagagttaaatgatgacgatgatgatgacgactacgatgacgaagacgacgaatcgaaataagcttttcaagatttttccttgacgaaaaggaaatctccttgtattatcttatttgggctctctggtagaaatacctgagacaaacgatcgtattagctccctatttctgttgaaatagggagctttctttatttataccaccccacgaaataaatctttaaggagttatcacatgaccaaatatatttttgtaactggtggcgttgtgtcatccattggtaaaggtatcgtcgctgcttcgctagggcgtttattgaagaaccggggcttaaaggtcacgattcaaaagtttgatccctatatcaacgttgatcctggtacgatgagtccttatcaacacggtgaagtcttcgtgaccgatgatgggaccgaaactgacttagaccttggacattatgaacggtttatcgacattaaccttaataaatattcaaatgttaccaccggtaagatttattcagaagttctgcaaaaggaacggcggggcgattatttaggcgccacggtgcaagtgattccgcatatcacgaacgctatcaaggaaaaaatcatgcgtgcgggtacgacgacggattccgatatcgtgattactgaaatcggtgggacggtcggtgatatcgaatccttgccatttattgaagcgctacggcaaatgaagagtgatttaggttccgacaatgttttctatatccataccacattgatcccatatttacgggcagctggtgaaatgaagacgaagccaacgcaacattctgttaaggaattgcggagttatgggattcagccgaacatgttagttgtccggactgaacaaccaattacgcgggaaatgcggaataagattgcgtccttctgtgacgtggaaccagaagcagtcattgaatccttagacgttaagacgatttattcaattccgttgaatgttcagaaacaaaacatggaccaaatcgtccttgaccattttgatgtacaggcacctaaggccgacatgagtgaatggattgacttagaacatcatgttcagaacttatcacggaccatcaagattgcgctagtcggaaaatacgtcgctttacaggatgcttatatctcagtgacggaagcattgaagcatgctggctatacggatgatgccgacattgatttgaagaagatttctgctgaagatgttacgccagaaaatgtcgaagaactactcggcgatgctgacggaatcttagttcctggtggctttggtgatcggggaattgaaggtaagattacggcaatcaagtatgcccgtgaaaacgacgtgccattcttaggtatctgcttgggaatgcaaatggccagtgtcgaatttgcacgtaacgtacttggattgaaggatgctaactctgctgaaatcgatccgaagacgccggacaatattattgatttgatggccgaccaagaagacgttgaagacatgggtggaacgcaacgtttaggcgcttacccttgcaagctgaagccgggaactgtggcggctaaagcttatcacaatgaagaagttgtgatggaacgtcatcgccaccgttatgaattcaataataagtatcgtgaagcaatggctgctaagggcatggtcttctccggaacttcgcctgacaaccggctcgtcgaagtgattgaattaccaaagaagcgcttcttcgtggcctcacaatatcatccagaattcttatcacggcctaaccgtccagaagggttattcaaggcattcatcgatgccgctaaccagactggtaaagtgaaggcataaatttagtacggtagaattaagaataaagcacgccagcgaattgttggtgtgctttttttgttgggcggccacgggcttgattaggtcaccgatattcacagtgacaactggtgttgcgaaaatacatggtaacaataaatggttctcttgataatagaaaaataaaatgataataaaaaactattgacaataaatggcgggaggtctagattataagtgtgaattgaaagcgcaaacataatgggttagtagttaatctggttatttagaaagccaacggttgctgaaagttggttgattggactgatgaatccgccatttagcgtttgacttcatttttaagaggtcgcggtgagacgatatactcgtagagcagtaaattgggtggtaccacgttgataaaaaacgtcccatagtcttttaggtgaagactatgggacgttttaattttaaggaggcttttcgtatgttaaatccaaagtttgttcgtaataacccagaacttgttaagactaagctccagactcggaaggttgatccggctgaggttgatgaatacttacagttagaccaacaaaaccgggatgcaattaccaaggttgaaggattgaagaaacagaaaaaccagttgacggaacaaattgggcaaagtgatccgcaatcggaagcgggccaagccctcattcaacaagtcaaacagctgaatggtgatattaagagtacggaagcggcccaaacggaagtaaacgatcggcttcattacttagcgattcgcttcccgaatttacctgccgatgatgtaccagtcggtcctgacgaagatagcaatgttgagatgcgtaagcacggcgatattccaacgtttgattttaaacctaaggcgcactgggaattgggcgaaagcttaggaatcttggattttgaccgggcagcaaaagtcgcgggcgcgcgctttgtttattataaggatgcgggtgcactcttagaacgggcggtttacagctttatgctagatctgcacacacaaaagcaagggtaccatgaaattattccgccatacttggtgaacgctcagacaatgtatggaactgggcaatttccgaagttcaaagaagacgtctacacggttgaatcttcaggaatgacgttgatcccgacggctgaagtaccgctgaccaattactatgcgaatgaaatcttatctgaagatcaattgccaacgtacttcacggcgatgacgccttgttatcgctccgaagctgggagtgcggggcgtgatacccggggcttgattcgtatgcaccaatttcacaaagtcgagatggtcaagtactgtaaacctgagaattcatacgatgagctcgaaaaattaacggataatgccgaagaagtgttgcgcgaattagggcttgcataccatgttattaagctttcaacgggggatactggtttctcatcagccaagacctatgatgtggaagtatggatgccagaacaaggcgtttatcgggaaatcagttcatgctctaactgcttggacttccaagcacggcgggcgatgattcgttaccggaaagctgatgggacggtcgattacgtccacacgttgaatggttctggacttgctgttggccggacggtagctgcgattttggaaaattatcaacaagccgatggcacggttaagattcctaaggtgctccaaccttacatgcatggtatgacagagataaaataaaattattatgagaataaattattattcaaataattcatttgaatgttaaacttaatatcactaggattgagatggatacaggctaggactgttatgataatctcagtcctttttaatttggtgttaaaaatacttgatttttataatcgaaatcacatgaacggtaattgccaccgtgataatattttatcatgaagaaaaggctttcacggcgctaaagtgatgtttatcacaaagtggcgttttacaacgagtcgagacgttaaatctaatgggagggttattcatgcaggttatgttagcacattctctggtgtgaccagaacaacgttataaaaaggagatttaaaaatgacaaatatatttaagggttggagaaaaaatgatactttttggatgctgagtttgttcggaacggcgattggggccggcgtgctattcttaccgattggagttggcacggcaggtattcttggtatcatcatgatacttattttggctttgccaaccacattttttgctcacaggggcctgagtaggtttgtcttgtcggctaaaaatgatggtgatgacattactgatgttgttgaacaacattttggctttaagattggattgctttttaccattatttatttcttctccatttatccaatcttattagtttattctgtttctattacgaatactgtatcgaaatttattaccgaccaaatgcacatgcaaacaccacctcgttggctgttgtcgctagtgcttgttgggatcctcgttggaattgctcgctttggtacctctttgattaccaaagttatgagtggcctggcctttccatttattattgtaatcgttctgttttccttttatcttattccacattggaacggcgcaatcctctcaacattttccagttccgtatctgggggacatttggttggcactttaggaaacttgtggttacttattcctgttatgatcttttcgtttaaccattctccgattatctcttcattttccgttgccgaacgtaaagaatatagtggagaaggtaaggacaaagtcgataaaaagatttcgacaattctattgtcggccgaaacgttgatggtcattgtcgcaatgttctttgttattagttgtacattggcgttgactccagatcaaatccttgaagctaaaaatgaaaatgtttcaatccttgattacgttgcgactgctttcaataatccaattattaaatatgtttctcccgtaattgcctttattgcaattgctaagtcctttttaggacattatctaggaacgagtgaaggcttacgtgggattattcgtaagatggaagaaaaatctaacaagacgctttcaagtcgaactgtttcgacaattgttgatcttgttctgctactaagtgcctggatagttgcctgggtcaatccttccattatgggaatgattgaaaccatcattggaccaatcattgcgtttatcttgttcttgatgccaatgtatgccattcataaaagtcctaagttacagcaatatgccggcaaacacagcaatgtctttgttgtggtaattggattaatcgcagttagtggtatcctgttcaatatcatcaaattgtttatttagtaatctgactaaaatacgagatgaattcacattggttaatattattgaagccaatttttgtcataaatctcgttgctagtgctattgacgagattcgcatgacggtgttggggttcgtgagggtcgcgaatcgaatgaccatactggaggctggattaatcacaacggcggagttaattcagaaatgaaagctttgatgcaacggctttatgttttctcatcagtacaactgtggtgcttgcttgtaccgtaacttcaagattcataaagtttcgaaacgatgtactgacgatgaatgcgcaaagaagcgctagttgcccgtgccaaagcttaatttaacgtgatgattcaaataggaggatgactaaaatgacggtgaattacaagagtgtttttgatattattggcccgattatgattggaccttccagttcccatactgcgggggcgtgtgcgattggtcgagcagcgaatagcatttttcaggagaaaccgacagatattgtcattcattactatgaatcatttgcgcaaacccacaagggccacggaacggactatgcgattatcagtggcattcttggttttgatcctgatgatagccgggttccatatgccattggtttggcccgagatcaggggataaatattacctttatcgaagagcctggtgatagcccaatcaaccacccgaacactgccatcattgacttaaaaaatgatgataagcaagtgacggtcgctggatgttcaatcgggggtggaaccatcgaaattcgtgaaatcaagatggatggttttgatgttaaacccaaagggccacttcctatcttgttagttcaaggtggtgagaatgaccatcagcacgtgaccaaacagttggctgatctgactaaagtaaacgaccagcagcagtacaagacggctcggggcaatttatatgaatatgatttggatcgccgcctcaaacaggatgaaatcaaaaaattagcgcagggacacgcaaatttagtttacttataatcagggaggtcagttatgatgtacatgagcgtagcagaactggtaacagcggccaaggagaccaagaagccgatctacgaattaatgattgaacaagagatggaaacatcgcaaacgagtcgcgaagaaatctggcacacgatgggccggaatctagacgtcatggaagcagctgttaataaaggggctgcaggcgacggggtctattcaacaactggtttaactggtggtgaagctgttctcttgaaaaagtatcgtcaaaaagggcacactttatccggcgatacgatgatgcaagctgttcagaacgcaatctcaaccaatgaagttaatgcttcgatgggagtcgtttgtgcgacaccaacggctggatcgacggggacactacctggtgtgattttcacgctgaaggaccgaatgaacctcaaccgtgaccagatgatccaatttctatttaccgctggcgcttttgggatggtcatagctaataatgctgggattgctggtgcgactggcggttgccaagctgaagttggtagcgcttctgcgatgggcgctgcggccgcggttgaagttgctggtgggacgcctgaacaaagtgctgaggctttggcgatggcaatcagtaacttgatgggattagtgtgtgatcccgttgctgggttagttgaactaccgtgtgttaaacggaatgcgattggggtcggtaatgcgttgattgcggctgacatggctttggctggctgcacgaacaagattccagcggatgaagtcattgcagcgatggataaagtcggtaagggcttgccaaaggcacttcgggaaactggactgggtggcttagcggcgacgccaaccggtattcggatgaaggaaaagatttttggacgatcgactaattcacaagttcatgcataaaaatgtcgcagaaagatgatgagctgactaaaggcggtatcatcttttttaattagatgtttatatcgttacatgtattaacattttatcagtgtgataaaataatattaagtcataacgttgtaaaaaaatagtgaggtgagtgccgttatgcaaaaaccattaacagctgagcaagaatacgtgcgcgagtttattccgtttgttgattttttagcagatatcttaggccccagtagtgaagttgtcctgaacgacttgttggatttaaaccactccgttgtggcaattcgtaattcccacatatcacatcgacaagttggcgatcctgcaactgacttagcgttgcgaacgatgaaggccggtaaagctgaaaagcgtgattatctagccaactacaagggtgtttcgcaaggaaagcactcactacgatcatcaacttattttttgcgattagatggtgaaatcgtcgggatgatttgtattaatacggatgatagtgccctagacgatctgcaggaacaagtattgaaggtaatggcgagttacaaacatttgaactcaccaacgattaatcaactcaaaggaacaccagctaacgagaaggcccatgacacgccggtcgcgccggaacatctaaccacttctatcactgatttagctcgggaagtgacccaggctgtctgtgctaagtatggcgtctctgttgaatatttaaagcaaaatgaaaaattagaaatcgttcgtagcttataccaccaaggttacttcctattgaaggattcagttagtgaagccgccaaagtgctcaaagtctctgatccgagtgtttatcgttatttgcagaccgtcaaagatgaggatctccagcaggattaaacgatgtaattgtaagcgattaacgtcatgaaaccctgtcaaaatttagttcagccatagtggcgaaactgtgaggaagctactctgagttcccggacaggtaagaatcatggtcaccaccgtaaaaatgcggcagccaacacaaccagtttgtgtgcgggctgccgcattttaagtagttaaataaactgagcaatcaaatcccccgttgttcagtggtggctggtcgcaattggtgtggcgattagtgccagaggagcgcgtgtttttatgtgattcaggttggaacgtagcccctttttatgataatttggttagaatgacatctttgaggatgtcagtgggaattttctaggtcttatcaaaagggaaattaaagattttattaatttggttatcaactgattatcatcataataaatctcatgcaattttcattagctgacagcgagttgaaaggctgatgtagcgggggtcaattgcgattattatcaattatcaaagattatcaaatcgtatcatggaccgttgattggcgcattatatggtattatggtgaataataaatggaggtgatgccaatgttgacaccgaacgaaattcgacgccggttacgacgcgatttggttacaattgccgaagcttatcagattggctttgagagccgtttatacacggaagccgagtatgaaaacttaaagcagacgttattgcagttgcgtgaacttaatatgaaaccccaacatatggaacagctacttgcgattaacgggtaacggaaggttattaattaaataaggaagtgattagtcatgaatactgatagtccatcaggttcaattcagtccagagagtgctaatgccagtgaaatttatcacgcgcattagcacttttctatttttctatcgggcattgtgctaatagtcgttctgggcggggcatgattaaagtggaacgtttaattgaattattattcggcatcatcgcgctcccaagcatcgtatggggtacatagtatgacagcagcaaaattagtgaggaatagtgacaataatcatgtgaccatgttaactgttaatatcagaataaactgtgtgatatcggcgactttgacggcaccttaaattgtgcagatttagcttaattatcttaccaaatcattcatgaaagcgtttgaattagtcgagttgatgattttattgcgtaaaaaggttacagtttcctgatattggttgtatttttgacagacattctttattatggttaatgattgtatgatacagtgtgacacttatttagcgaggaaagttatgttatgaaaaaaatgataatccatggcggaaaacgactttctggggaattaacgatcggtggcgcaaaaaatagtaccgtcgcactgattcctgctgcgattcttgcagacactccggtccaattcgatacggttccgcacatcttagacgttcacaacttacggctcatcttagagtcgatgaacgtccattccacttttgaaaacgatgttctaacaattgatccaacaaatattgaagaatctgaattaccaagtcatgccattaaaagcttgcgggcttcttactactttatgggggccttactcggtcgttttaaccgtgcaacggtgactttccctggtggtgataatattggtccgcggccaattgatcagcatatcaagggttttaaggcgctcggcgctaacgtcgttgaagagaatgactctgtctttatctcaacgggcacagagggccttcacggagcgcgtatctttttagacgtggtttccgttggggcgacaatcaatattattttggctgccgtcaaagctcatggtacgaccacgattgaaaatgcggctaaagagcctgaaattattgatttagcgacttttttgaataatatgggcgctaaaattcggggtgctggtaccgacgtgattcgaatcgaaggcgttccggcactgcattcgcgggcaacccatacgattattcctgatcggattgagacgggaacgtatctatccctggctgcttcgattggggacggtattttgttaaagaatgtgatccctgaacatatggagtcattcacggcaaaactagtcgaaatgggtgtcgatttacagattaatgaagatagtatttacgtcccacggtccaatgatttggacccaattcgggttaaaacaatgacttacccaggctttgccactgatttgcaacaaccaatcaccccattattattgcgcgctaacggtagtagcgtggtgattgatacgatttatccgcaacgcacgcaacacgttgaacagttacgtaagatgggggcggacattcgcgttcaagataacttgattgtcgtgggtcattcttcccacttacaaggtgcgcatgtcgaggccggcgagattcggtctggggcggcactaatgattgctggtctcgcggctagtggcgttacggaaattagtcgcgctgacaatattctacgtggctatgatcgggtcatcgataaattgcatacacttggtgcggatgtggaaattgcagccgacgaagaagttcccgaaaactaacgatgtacagctaagaaagaacagtggttatggaaaaaattttaacaatgcacgatctcgagcagaaaacgttaaaagaaatttataactatgctcgtgagtataaaatttcttattattcgcaaatgaataaaaaggaactctcattagccgttctccgtgagcaggataaaaagcggggctttgtacaaatggaaggcgtcttggaaattattagccaagagggctatggctttttgcggccaattaattatgggccttcgcaggaagatatttatatttctcagtcgcagattcatcgctttggtcttcgtaacggagactatgtggctggtcaagcccggccaccgcgacctaacgaacggtattacggtttaatgcgggtagggacggttaatggtaaggatcctaatgaggccaagcaacggccccattttccagcgttaacaccactttatccacaaagacaaattaagttatcgacaacggccgccgttttagcaacccgtttgattgatacttttgtcccgattggcttcggtcaacggggcttaattgtcgcacctcctaaagccggtaagacgacgctgttaaagaatattgcaaatggcatcgtcgccaattatccagacgctaagctgattatgttgctgattgatgaacggcccgaagaagtgactgatttagagcggtcaatcaagggagaagtggtgagttctacttttgatcaacaaccacaaaatcacgtgcgtgttgcggaattggtgcttgaacgtgcgcggcgcttagttgaagacaaacaggatgtgattatcttattggattcgattacccggcttacgcgggcatataatttggttatcccgtctagcgggcggacgttgtctggtggggtcgatcccacggcgttttacaagcccaagcgattcttcggttccgcgcgcaatatcgaggaaggtggtagcctaacgattttaggcaccgcgttagtcgatacgggtagccggatggacgacatgatttatgaagaattcaaaggaactggcaactcagaattacagctatcccgcgagttagctgaacggcgggtcttcccggcgctagacttgaagcaatccagtacgcgtaaagaggaattgttggttagtcgtaagaatttggagccagtctggcagattcggcgatcaatgactggcaacgcgttagagtacaccgaacagcttttacaatttttaaaacacacgaagaccaacactgagtttgttcgtgatctagctagcttaaagttcactggtcaatcaacccggcggtcgcgtcgttaatactggcaggcaggctactttgtaggttgacgggaagctgtgattcgtgataacatgtttatcgttggttaaaactatgataatctctgtttcagcaaatgattcagggcaaaggagcgaaatacaatgcaaaaaggaattcatccagattaccatttagttgtgttccaagactcaactactggttttaagtttatctctggttcaacagcaacttcagcagaaactgttgaatgggaagatggtaatacttacccattgatccgtgttgaaattacgtcagattcacatccattctacactggtaagcaaaagtttaccaaggccgatggtgcggtcgatcgtttcaacaagaaatacggtctcaaataagcagacaattaaacggcgttccggcttcggctggggcgtcttttttgtatgtgcaaatcatcgacactcacaaacaaagccgcaccagttcgagtaatgaactgatgcggctttgtctcacttacgatatgattagtagcgcataatcgcgagagcagcggtttctacgggcatccggtctgcggggatgattcggatttgcccgttcatggcaatcacgacatcgaccaggtcgtcaattaaattatcaggagcagcaattggatcatttaattgaacatcggccgctggtaaggagccggcaacattcgcgtctgcggcgacaatcaaggtgtcgatccgcccacttagtgctggcttgatcatgtcaaaaggatcggccaatgctaactggcgggacttagcctgatcataacgttctagtaaaatgtcggctaattgggtatgccacatcgtctgaacgggttctgtggctgtttgcattgcgcccaccgttaagtttttcggtgacttattgatcatgaggtgttgtgacaagtacggattcttgttgacggcacggaagactgcctggttatgtggtagtcccattaagatcaatggccgtcgcgtcttttgtgaatgggcctgaacgtactgcgccacttgttggtaataatttcgttggtcaatatcgcgttcttcggccttcgcattatgaccatgatagttggcaccgtgaacggggctggcgttgaaattcaggtcaccgccacgtttttcagtgcccaatgcttctgtcagggtgcggggggcctcagctggcaaatcaagttcgacgaaactgccatcacgttgggcgtagagcgccatgctatcttcattgagtgctagcaagtcgaagtcgaattgatgctggcggtcggctagtactgggcgaatagctggcatgctattgacgctgacatggttgtcagtgggatattgtaagtcgaaaatgtgtaggtcacgactgttagtgatgatgcctgtctgagggccagtgtgctgtaaccagaaggcgttgtcattaattaattgctctagttgcgtcgcgtatggcgcaaattcggttttcggaaagtggtgggccatctgggtttcagcttcattaactaattgtttgaattgtaagcggcggcgattgaggtcgttgagcacaacggccgtgttgaggtaaattgcaatgtatgggccatcctcacgttgttgcattagttgattgagatcgttttttaccatcgtttccataggtccaacctgctttctgtttttgatacaattagcataacaagaatctgattacggacgcaaatataatgattatgataagctatagataattctaacgaactaaacgaattcggggctttattatgcgaactaattaaggtatatttaccgtagaacctttgataaagggcgtaaacaaattaggaggcgggattaatgaagtccaagcaacatcccgggttaaagtggttaggtcggggcgtttttgtcctgctggtgctagtatcattggcattaattttcaatgaacagatcaagagctggttagtgagttcatactcgccgaccgttacggctaagacggttaagcagaatacgaagaagaagagcgattttaacttctcaaaggtcaagtcacttgactttcagaccgttgccaaggcccgcatgaataagaatgcaatcaacgtgattggctcgattgcgattccgtccgttgatttgtacctgccaatcggtaatggtgtcagcaatgaaacgttagcattggcggctggcacgatgaaagctaatcagaagatggggcagggtaactacgcgttggctggtcaccatatgatcaagcatggtgcactattcagtccgttgtactataagagcaaggttggccaaatgatttatgtgagtgatgccaaaaagatttatgcgtataagacgagtcagcgaacattcattaaagcaactgatgtccaagtaattgatgatgttcctggtcagaagctgattaccctaattacctgtgataagaccggggcgggtcgcttaatgattcgcggtaagtacgaacagcaatggtcgtttaagtcggcgccaactcaggttcagaaggcctttacaagtcattttaataacaaatattaacaattattacattctaggggtatcgatatcttctaacggaatttcacggtacaatataacttaaggtcacatgtctcagataagacataatttagagggggtctattgatgatagctttaattatcgttgcggtcgtattggttttgatcgcaatttacgtggtaatttataacggtttagttaagtcacggatgtatacgcaggaagcatggagccaaatcgatgttcagctaaaacggcggactgatttgattcctaatctggtcaatacggtcaaaggttacgcgaaacatgaaaagagtaccttagcggaagtgatttcattacggaatcaattaacgcaagtgccgagcggtgatcaccaacaggctatggcagtttctgatcaattgacaaattcgttgaagagcatttttgcgttagctgaaagctaccctgatttgaaggctaatcaagaattcggtaagctgatggaagagttgaccaatacagaaaacaagattgcttattcacggcaactgttcaactctagcgctgccagctataacatgaagttacaacaattcccgtcaaatattattgctggcattcatcacttcaagaacgttgaattcttaactgttcctgaagcagaaaaagcagcacccacggtttcatttgaagattagaggttatgcccatgttatttgagcaaattgcccgcaacaagcggcacacgttatacgtgatggccgcttttgtcatattacttgcagtgattggtttagcagttggctacgtgttttttaatagtgcgattgcagggttactagtagccttgattgcagcggtattttatatggtattaatgattagtcagtcgaccgacattgtcatgagcatgaatcatggacgtgagctgcatcaagctgacgatgatcccgagctctggcacattgtggaagacatggcgttggttgctaaagtaccgatgccacgcgtctttattattgatgatgagagccccaatgcgtttgcgacaggaaatgaccctgagcatgcggcagttgcagtgacaactggtattcaggcacgattaacgcgtgaagagatggaaggcgtcattggtcacgagatgagtcatgtgcgtaactatgatattcggttacagaccattgccttggctctgacagcggccatcagtttgttagtcaattggggtatgaacgccttttggtggggcggtggccggcgcagtcgggataatgatcgtgacggcaacggtgcccaggtcttactaatgatcctagcgattgttgtcattattttagcgccgctagcagctagtttagtgcagatggcgctatcccgtaatcgcgaatacttagcggatgctggcagtgtggaactgactcgtaatccgttgggcttaatcagtgcacttgaaaaaatcgatgacagccaacccatgcaagcggcggatcctagtagcgcggccctctatatttctgatccgtttaaggcgaagagatcatggacgcacttattcgatacccacccaccgatggctgatcgcatcactcgtttaaaaaacatgtaataaaaaaatgcgtttaggttaataacggattataatgaaaacaaatagaaagttgaaagagtgagacggttgcaacgcaaatatatttacgccaatttggaaaaactggataaccttgtctttgcttacgggatcgaccagagcgactttgtgcatggtatcaagcgcttgccagctaacttggtctcgttagtcggtgttgatgataacgagcatgcggtaaatgctcacacgggtctgaacgtcattaatgatgaaaatgaaattcggcgatatttgttacagagtcacgcgttacccgttaagtggcttgattatgatgaagttggcgatttggattttctaaccgcgactgagattgccgagctattgtatctcggacatatggatcgtccaattcgatcaccgtttaattacaaactgcgcaaccactacgttttcttggaacaacgcaatggtggtatcaaagtgtacttctattatatttccgcatttagccatattttaagtgctgccattgtgcggcacactttggcagcttaccgtggccggcgtatgtttatgcgttcactgagcgttccacgagtacctgaggcgattctcaagcaactcgttcaattgatgccagatggtttgttcatttactttgatcagtcaatggttcggcaacgccaattattggtgccggtgcacacggagacgacaggcaatgaaatcgaagtttttgatcccgctcgtggtggagagaatcggcgaacccaccatgtcgcgacccttacttttaacttgaattcaggcgtgtgggacttgcaagtgcaggaccaggctgcgttcgaagaacatttatagtattatcatcttaacgcttggctgatcattcagcgggcgtttttaagtcgtttggggcgggatttaggggctaaattggtctagccatagagtccctggggtcaaagtggtataatttttatgcgcgtagcttgaattgggctacgattcgagaaagtggaaccttagtcagaacttggctgaccgacaagtggtcgccatgaatggagagtttaatcgatatgaagatgcaagttgccgaaattgctaaggccgttcaagcggtcaatgccgaacaggcgtggcccgatgttaatgtaacgggtgtggcgtttgatagccgaaagctccaagcaggggatctatttattccgctgatgggcgctaatgatggtcatcaatatattcaaagtgcaatcgagcacggggccgttgctaccttatgggccagcgaccatgccgacgacgttccagaagacttacctgtcattatggttgctgatacattgacggcactacagcagctggggcaatactatttacaaaaaattaatccgaaagtcgtggctgttacgggtagtaatggtaaaacaacgacgaaggatatgattgcgagtgttttgagcactcagtttaacgtgacaaagacgcacgccaactttaataatcagattggtgtgccagtgacgttactcagtatggaaccgaatacagaagtggtcgtcgttgaaatggggatggaccattttggcgagttggatttcttgagccgtctcgttcaaccagacgttgcggtgattaccatgattggggaagcccacattgagttctttggtacacgggatcgaattgctgatgccaaaatggaaattgtccacggcttaaaagaagatggtacgttcatttttaatggtgatgaaccactgctacaagaacgtgctaaggaagtcagtcagcatcaacggacgtttgggttggatgatacgaacaccttagcaggcagtgatatcacgactagtcgggctcaaacgcaatttaagacgagtctgtggccggacaacacgtacacaattccgatgatgggtgcgtacaatgtcaataatgcattggcgtctctcttggtagctgatacttttcacattcgaccagccgctgcacaacaagcaatcgccagttttgtgccgacggagaaccggacggaatggttaactggttaccgtggagaagccatcttaagtgatgtttataactctaatccaacggcagctcgacgggtcctagccgcttttgcggcggtacctactaagggtcagcgaatcgctgtactcggtgatatgcttgagttgggtgaccagtcggatgcactacacatgagtttagccagtgaattggatccagccacgattgccagcgtctatttgaatggtgaacatatgcgagcgttggcagaagtgctacaagaaaagtacccagctggtgcggtccactattatcaaacggatcaacagccccaattgattgccgacttaacggcgacggttagtgcgaatgatcaggtcttattgaaggggagtcacgggattcaccttgaaaaggttctgacggcgctggaagctgctcctgaaaaataaaatttaagtgattcgattaagcaggcccctcgcaatgactgggtaatggtgacgctaacattagactgataatgttgtttcccttccggtattgctaggggctttgcttgcttatttagaataaccggtgtatgataattcagttgtaccatatgaaagtcagaccgttggcttacatgacagcgtcttacgggaaacggattttttcctagctggcagtaatcccatggtgtcatccttaggaggaaacatatttgaagtttacagaactaggcttatccgatagcctacttaaagcagttaatcgggccggatacgaagaagcgaccccgattcaagccgaaaccattccaatggttctagaaggcaaagatgtgattggtcaagcacaaaccggtactgggaagaccgccgcgtttgcattaccaatcttacaacgcttggattttgataaccataacattcaagcattagttgtttcaccaacgcgtgaattagcaatccaaactcaggaagaaatcttccgcttaggtaaagacgaacgggcgaaagtccaagtcgtttacggtggtgctgatattcggcgccaaatcagaaatctgaagcaaaacccacaagtaatcgtcggaactcctggccggttgcttgaccacattcgtcggggcacggtcaagttagaccacgtcaagatgttagttcttgatgaagctgacgaaatgttaaacatgggtttcttggaagatatcgaatcaattatcaaacaagtgccggatgaacgccaaactatgttgttctccgcaacgatgccacctgaaatcaaacgcattggtgtgcagttcatgaaggaaccgcatcacgttaagatcaaatcaaaagaaatgactgctgatacggtcgatcaatattacgttaaagccaaagaatttgaaaagttcgatattatgacccggttgtttgatgttcaggcacctgaactcacaatcgtgtttggtcgaacgaaacgtcgagttgacgaattatcaaagggtctcgaagcacgtggttataatgccgctgggattcatggtgatttgagccaacaacgtcggacgcaaatcatgcgtcaattcaaggctggtaaattggatattttggttgcaaccgatgtggctgctcggggacttgatgtttctggtgtgacccacgtttacaattacgatattccacaggatccggacagttatgttcaccggattggccgtactggccgtgccggacacaagggtgtttcattaacttttgtaacaccaaacgaaatggaatatttgcgggtcatcgaaaagttgaccaagaagcggatgttaccattgaagccaccaactgaatctgaagcttttgctggccaattagctgctgcagaagcgaatgttgattcgttagttgctaagacttcgactgaaaagtatgctgatcaagctgctgaattattacaaaaatacgatgctactgatctagttgctgccttgttaaatgacttaactaaggacgacgcctcagccgtacccgttaagattacgccagaacgcccattacctcgtcacaaaggtggcggcggtaacaaccggcgtggcggatatcgtggcggtaatcgcaaccgcaataacagtcatggcaatggtcgtggcggttattctcacaatggtcgcaatcgcgaccgtgatcgtaacggtggccgtggcgatcggaagagcaatggttataaaggtcgcagtcgcgatgataaccggagcagcaaccgcaaccatgatgaaggtcgcaagcaaagcagcaagcggagctatacgatccgcaccaatgattaaagtcaacgcacaaattaagttgaattaaattaactttgcacaaaagccgagcgcatgctcggctttttttatgccctacaatgttagaatacaagtagtcggcagatgttcgtatgaattattgttaaaacgttccaatttaattggtttgttgttcgtcagcacttgtgcgtcctatgccgaattccggggctgggtgccaattgctggaacgcagccgac

SEQ ID NO: 31 - DNA, 34368 bp, Lactobacillus plantarum
aaaatacagattttttcacgtccattcattttatgataaaataatccgccgtgcaacttttgccaccgaaggcaaccgtaaaaaacgggttttaattgccatgcaggattttttctggtatctttaattactttgattattactggaataccagtcattagagctaaaggagtttacttatgccaactaaaacaactgatactttctggaaaagattcttcaagggcgtcgtcatcgccctcggttttattttaccgggcgtctcaggtggggttctcgccgccattctcggtatttacgagcgactgttgggctttatggcccacttccgtcgtaactttaaacgggacttctggtactttgtccccgtcggattaggaggcatcgtcgggattgccctgctttccgccccgctggaatacttacttgcacacgctcaggtgatcgttctctgggggttcgcaggggccatcatcgggaccttaccagccctgatgaaaactgcaactagtcgggcgccacgtgactggctcgacggagtttggttcttcgggaccttcattattagtgccggcctactttactttatgagtgagctgtttgggaccttgcccgctaactttggtggtttcatcgttgcgggagcgctgattaccttgggcgtcttagtgccgggactgagtccttccaacttgctacttattttaggccttttcacacccatgctgacgggctttaaaagactagatatcgtaggcgtctacttaccgatcgccatcggtggcatcctggcgatggcgttgttctcgaagttgatggatcacctattagtgaagtttcattcccgagtctaccatttcatattaggtattgttctggctagtaccatgctgatattgattccgaatccatatgcggctgagagtatctcatatgcgcatgccacactcagtacctacctattcagcgccatagctcttgctgtgggaatcgcgctgggttactggatgagtgctttagaaagtaaatataaatagtgccactgaccgttggcaatcttgacgaatgccgttgtgcggtcacggttaaccaaaaaactgagcgtcggaatgtgaaaattccaggcgctcagtttttttggttaactactcaatcagccaccttaactttgattgcgacgtcgccgcggctgcaatcgtcgcaattcgttgacttgtgcttgaatctcacctaacatttgtgtttgcattttctggatttcaagcatgtttggttcatcttgttgaattaaatgatcgactttcgagtgcaggacccggatctcctcttcagacatcgagttcactttaaaatcattggccgcttgtagccgatcatactcagctgcccgattctgactcatcatgatcaatggtgcctggattgctgcgaccatgcttaaaaataaatttaataaaataaagggataagggtcaaaatgatggctaaaaattggtaagacgttgagcaacatccacacgagcatcaccacgacaaacgaaatgataaacgcccagctccccccgaaccgtgcgaccccatccgcgacccgttgaccaaatgtcaatgaactttccagctcgctattaacatcgacgacccgatacgtgtggttagcgagaatcttagataattgcgcattgaccttatcattttgttgataatcgttctcgatcatcgcatccatctttgctaagcgataatgtacgagatgctcactacaaatgaaactgctattatgggcctgcggaaaatcttttaaaatcatttgccgcaaactagtttccaattcttctaatcgcataccgtccacaacttggtaacgttgttgatcgacaatgcacactgctgttttcgccattagacacacacctttctctgatcccggcgtgagaattacgtgaacaatgcggcccccttgattagcaaccggaacctaacatcgcaaaaccacacctcacaccatctatttaattatacaaatttaaggcgcatctgcccagttaaagaccaccaatcaaaaagcgattattcgccggcctgaagtgacgagtttcctcgtattcagctcattgaataatcgctgcgttcagacggagagttcgtccatcaacatcatggtctgatactgaccatcgtctaagactgccaccgtctcgggaaactcccgttggtaattgactggtaaatcgaattccatgatggcatcgtgctgcgcatcaaaagccacggtgacttgcccattacgtgcgatcagggcaaattgcaggacccgtggcaggcgaacgaccccctttagattttgatcaataatatcccaaatgccatcaatcaccgcgctcggtagcttggcggctaaccctagcgttgcaaaccgttcttcatcttgatcaaacatgctaatcacctcattactcaattcggcttagttatcacgaacaatcactgcgacctctttttcaatccggataaataagccttgtgaatcctgtcgaaaatcattttctaacgtggcagacaacggtttaatgcggccaacgacggtgccagttgtcccatagagttcgatagtctgaccatctgcagcccacttaactgtccagtaactaccttctaaggcctcatcgacgaagtactgagttcccgccagcacagcttcattaatcacgctactttcatccgcagtcattcccgcgtctaattcccacttaagtttttgattaacttccaacatgtctcctggaatcaaattttgcataattattcctccacttttgttcatttacttaacatcataccacaatcacaactaatatcaggcattcaaacttatcggtatcagttgtcagtcagaaattgatatggtattgttatgataagaaaatgagattattagaaagtggtgaatgacgtgttggctaaattttcagcttggattaaccttaagcgcacaatttttgcagttatggttatgtcaggggcgcagtctgcgctttttccaagttgaatgaccactagccattgcgaagtcacgagcagctgacgacaatgggtcgtctttttttgtccgctcgtggccgctaaaggagtccaatatgttatcaccacttacccgtcgtaacctaaccctcagttatggttatgcggcctgtgctttttttggtatcaacaccctctgggtgatctttttacagcaacaaggcatatcactcgttgagatagggctatgtgaaagtgtttttcatctgactagttttctctcggaagttccctccggcgttatcgccgaccgctttggttatcggcctgtcctgatcattagccgcctgatggctatcggacacgccctcatcatgttgacggctcacagtctcggctggttgctcctagcattcatcctacaagcctgggcgtataatctccagtctggtacgattgaagcggcacaatatgacagtctcgtcaatactcaggccacgcaacattatccacgcgtcacgacgattctcaacacgacaatcgaagtggccgatacgttgggtgtcgtgttggctggctggttaatgccccagcatctttcagtgacgtactgggtctatttagcggcagctctcattgccattctggcaatcagtgggctgcacgttccccagcgccagttgaccaagactcattcaacacaaccgtcgttacgaacgatccttcgtgctgccgcgcatctgttagtgacccaacgtcgtttacggcttttaatgatctttgacgcgctcttttcggcactcggaacaacttattactattactttcaaacagtgatgactgctcagcactttagtgggagactaatcacgacgatcctcattgcgagtatggccctcaatattgtggcgatccaactgacaccttggctacagcgacatcaaacccaacatcagttactttacgggctctgcctaagcatgattatggccctacttagcgcatttagtcacgccatcggtctactggtcctcatctatttagtcatcaatagtttgatggcactgattgagccactgttttccaactactacaatcagctgattccaaacgggcaacgggcaaccctactgagcgttgccagcatggtctttagtttagcgatgatcagcgcttttcctctgattggctggttaattcaacgggtggggtttgccgttactttcggtagctgtggcctgctgacattgatcgccttgctgagtctttacggctatgcccggcgaagggccgtccagcattgaaaaccataactaatcactgacattactgctgagagatgttcccccacgacttgaccggttgcttttgaccaccccatactaatcgcaattgcgtcaccattaatcatgcacgtgaacggtaaagtgaaggcccccgagaatcgaaaggattcctgggggccttttccgtcgtttggggctgttcggcctattagctagtttgagtgagccagattcgatcgttcaaactgttgccgaatttcctcagcgatggtgcgcattcgctttggcgtatctgcttgtgccagccgatagccgatatagtatggtgagacattaaatagtgggaccactttggcaacaatctggtcatcccgcggatagaaaaataggttataactatcacactgcccatgaaaatacgtatttagcgtatactggacgacctgttgcacagcatcggctaacggtgcaatcgcggtagctggagcagcaacgttgatttcgacaaatcccatgataggccgatcagaaacagttacttggacctgatcgaccgccaacactgaatagccagtcaaattggctgctgtcacgttagcgtaaccatcggcggccattaaaccaacgatttgcatgtgtggatgccgtaaacttccacccgagtgtgggccaaaatttttatagcacaacaccgatttgaaccgaccactcgcaattgtggcttgccagtgcttcagagcaaacgcgaagacagcgcggttttgtgcggatgagtaagtagcaatatcgccatcatggcgggccgcctcgatcacgatcgtttgccaggtagcttgcaaggtcggaaatttattcaatagccagatacgatctgcatcttgcgcgataatatcagtcaactggcccggatcgcaaaaaggacaggcattgtgcgggtgccggatattttctggcttatccttcgcaatggccgtatcaaagattagtggctggtttggcaaggtttctcaacttctttcatgaaataagaaaacgggtccgaaacaccaattaggtgccgacccgtttgccttttatacgcattagttcattggttccggtgtatcagcgcccggaccaaactggacatccgccatcgtgatccaaacaacaaattccgttgaagccaaccgccagtactgcggatccgacgccggcgggagtgattgttcaaagagcgcaatagccaacgcgttcgccgcattgtccgcagcaacttggacactcgccccaaaggtctgggcggcaggcacgtctggaaaacggacattccagtaggtgccttcatcacgaaaaatggctggatacttaacttccacataattgtgattcaattttatcactcacttcttacaatcattttaaggctattataccgaaaacggtcgcaaaagcccagctcaaacatcatgattgcaattaaaattaatcagcctttgacacgtggtacgagccattgctatccgtcgtgaccttatagttcccactgattgagttttcaccatagtccttcgcgtcatttaaattatcgtatatcgagccggcatgactactactgctactcttttcagtactagttgacgccgtttcactctttgatgagctgctggctgttgaagtactgtgagaggtggcgctacttgtggtcgtttgatgactggtcgtcgtgctatgcgaactagctgtcgtattgccagcggtcgtattagtggcagttgaactgctatacgcacccgtcgtttctgtcccatctgtgctagtgtcggcatccgtacttgcagccgtcgtttcgctagtactttcactacttgagcttgaatgcttcttctttttcttcgatgagctagatgatttcttcgaagatgattttttgcgcgccttgctgctacttgaggaactcgtggtttcgactaagtcttggttgctagctgctttgacaaagtaaacgactgttccaccgagcgcaatcacgattaaagccaatagccataacgaaacgtgatgttttttttgcggtgacttaggtgcttgcggtttctttggatcgttcggttccttaggtgcatgggatccctgtgaactcgccttacgtccccgcttgccacccgtagcctctcgcgcttttaagcgtgacatgcgcgtctgtttttgttcaggcattaactatcgcacttcctttcttgcttccgccagtttaccatattttggcgggcttgtcttaatgcttaataaaagaaacaatattatttgtgtcgatttttaatatcgacgttcattaattaattgcttgtaaattatcataatagttggcaagtacaccataaatatatggtaccaaccataactggccgattccagccgttaagatactgagaagttcccagcccaaaaagcttaaatgcaacacgaataactgccacttgtgcccgtgcatcaactgacggctacgggtgaccgcatcacgatagcgtggccgtgcttgaccagcaggtgttgcagttaacaagtccttatacgcataaaaagtctgtgaataagcgtacgccttaataatacccggaaccaccaatagcaggctccataggaagataagcacagttttataaataatcagaccgaccagtgcccacccataacgtttcgtgaacccgaccgttgagtcactgaccggatggatctggcgttctggttgtcggacccagtccaacatcgcataactcgtcccaatccgaaagatttgaacgaccagccagacaccaacttgaaccagtaaaaacccagctattacagctaaaatcaacgatatatcagaaccagtcaaggtccccaactgcttaaaagtcgtgtcgtcagtcgtggaactgcccgacgacacgcgatctgaataattggccatcaccccgaaaatcgttaataagctaataataatacataataagatggcatctttccaacgccccttaaagagttgcttaatttcggttttaagttcggccctcgttttttgaatcattgcgccactcctccactacttgtttaatttagtccattttccgtgttttgtccccgttagtcaacggcaaaaccctaaaaaagcgctggcaaaatgccaacgctacgagttgaatcataataattgcttatgcataatcacaacgggggccccatcttcatcatacgggccggccgtaactcgataaccacacagttcgtaaaagcgctgggcagtgagttcaccatgaatctcgccatgagtaaaaccacgttgcgtggcccactcctcagccgctgtcaataattgacgaccccaaccatgaccgcgataggccttccgagtgcagactcgaccaaatcgcatcacgtggtcagcttgtggttctaagcgtaacgttgtaattggtaaatcaggctgtaaatatagaacagcgtattcacgctggtctgtatccttgacgtcaaattcaacgtcagcactgattccacgctcttcaacaaatacagcctgacgtaacgcgtaggccgctgcccgattggctggtgatgctgaaaaaataattttcattttagtaggccttatcaatgtccttcaaccaggctaacgctaatgacttgtcacctaaatgggccccaatcactggaccaaagtacgtgatatcgatcggcatgtctggataaatttgttgtaacttttgtttccaatcttcagcggcagccaaattattcccctgaacgataattgctcgcagcggatagtcgacttttgactgtgcttcagcaaagaggtgctcaactcgcgctaaagctttcttagttgaacgaactttctcaaaggcgacgatttcatggctctgatcatcaaaagtcaacagtggcttgatccgtaacacgcttccaatgaaggctgacgcattcgataaccgaccaccccgaaccagattttgcaaatcatccacgataaagtattcgcccatcgaggcccgcagatcatctaggcgtgccaggatttcttcaacactgtgaccagctttagccatccgcgcggcttcaattgccaaatagcccatcagacggaccgtgatctgggagtcatacggataaagtttgatattatcgaccatatctcgcatgttcatcaagctattataaaaaccggaaatcgtgctagcaagatgaatactgatgactgcatcataaccttgttcacccaagcggttatagaatgccaccatttcccccacgggtggttgggacgtacttgggaacgacttaaatgatttcatatttgtgtaaaagtcggccgttttaatgtcgacaccttcttgatacacttttccatctataataaccggaatcggcacgacatgaatatcgttgtccgcgacctcttgcggtgtcaaatagctcgtgctgtcagtaacaacagcaatcttcatgacttacacctacttctcatttaaataataacaaatatcatagcataaaactaagttatactctaccttcgaccgtttggaaagtcatggctcgagaattcggctaactgacttgtttaaccgattgagcagaatccggagaaggttttgttcatcttgtggccatttgtcaaaaacttctgcttcaaactgttgataatccgcattaatcttggtcaatgccgctgttcctgccggcgtgaccgtgtaaataagttggcggcggtcacgaccaatcgcttccttactcaaacgttcttttttgactaggctagccagttgccgacttaatgtagatgtatcaagctgcatggctgtcgccaatttttcttgcgtattggcccctgctgccaactggatcagcagttgccattccgcaacggtgattccttgggccttagtaatttttttcaacatggcagtttgcaacttagcgatttccgctaaggccgttaaacttgacttcatgacagttcattcctctcaacaataattcacattggtccattgtgacttgatttaccccgcctgatgattaaaaacgtgctaattttttagactcaaaaaaactcaactgagctttgctgacgcaagcacgcttcagcgtaaactggctgatccagtgcgattccatcgtaattagcacgctttaaccatcacttatgcgaatagcagcacccacaatgaatacatttgtattatacaatatagagtgtgtaattacgactactttttatttaaaataccgttaaagtagtttttgcatataacatttttagattcaaagcgttcatccgctaattgcttgtttgacaactagcagcgtcgacgcctaactttatgcgtcagcgtggggcgctaacttgtttttacctgttcaaaaacggtatactagtacccggttaactgtatttttacagtgataacgaatatcttagaaagcgagtgatcacatgtcctttgatggtttatttacccatgccatggtcaccgaattacgccaaacactagttggcggccgtatttcaaaaattaatcagccataccaaaacgagttgattctgaccattcgtgccaaccggaagaatcacccagttctactatcggctgacccgacgtacccgcggattcagacaacacaaatcccttacgttaatccggccgtgccgacgaacttcgcaatgatgatgcgtaaatatttacaaggtgccatcgtgaccgatgtgtcgcaggtcgccaacgaccgggttgtgcacctgaccgtgacgacccgtaacgaactcggtgatgccgagacattgacgttgattattgaaatcatggcacgacatagtaacgtgatcctagttgataatcagactggtaagatcattgacgtcatcaagcatgtcggtgcggatcagaatcgctaccgattacttctaccaggcgcgacctacatcgagccccccaagcaagacaaacaagacccatttacaccgaatactgattttcacaccttagtcacggattaccccaacgaagacgtgttggcaaaacaattgcagcagcattatcaaggattcggccgtgatagcgcacaacagttagctgccgacttgcatcagcctggcgaccttgatcaccattatctggcctttttggcacagtttgatcagccgcaggcgacgttgatcaccttaccaaatcataagaccatgtttgccgcgggaccgtttgaccattttggcaaagccacgcgccagttcgactcattgagcagtctgcttgatttttattatgcagacgcagcccaacgggaacgagttcaacaacaagccggcaatctgattcgggtggtcaaaaataacctgaagaagaatcgtaataagctcaaaaagttggaaaaaaccttagctaacaccaagcaggccgatgagctgcggttaaaaggtgaaatcttaacgacctatctacatgaagtcaaacgtgggatgactgagatcactttaccagactattatcacgataacgcgccgttaaagattcaactatctaatcagctctcgccttcccggaacgcgcagaagtatttttcgcgttatcagaagcaaaaaaatgccgttggcttcgttggtgagcagatcagcttgacccaagctgaaattgattatctggacaatatccagacccaaatcgagcttgctagtcccgctgacatcaccgaaattcgtgaagaattgacgcaacaaggctacttaaagcaacacaagactaagaaaaagcaacgcagttcacgtaaaccgagtcaaccccaggaatttactgcgagtgacgggacgccgatctttgtcggtaaaaacaaccggcaaaacgatcagttaacattgaaaacggcccgtaagagtgactattggctgcatacacaaaaaatcccaggctcacacgtcatcattcattcagatgatcctagtgaccaaacgctcacagaagccgcgaatctcgccgcatacttctcaaaagcccgcgattcagcaaccgttccggtcgattacgtccaagttcgccgaattcgcaagcccaatggtgccaaacctggctttgtgatctatgaaggtcagaaaacattgtacgtttctcccaatgctgagcttgttgaacaactgacaccgcacgcgtaaactggttttaagagtacgcagtgatcaatcattaaccaacaaaatcgcgcgtccaagataaaatttctggacgcgcgatttttagtacttactggcagtgcttcaaacggtaacggttcaaacttcccgccgccgaaagaatagcaggcctaacactaagaataaaataatgtatgcaagattgccccaaaacaactggacatccgtgagattggtaattttactcagcgtcggtaatcccaactgggctgaaaagttgaacatgttgagtgggttccatttgagccacgtatacttccgaataagtgcgatcatgggaatattaaccattcccagaacaaagtatccgatgattccgaccgcgactgccgcaccagaactcttgaaaagagcagcaattagcagcactagacttagcagtaaccacgtattgagaaattcaccaccaacgcccgccaaccaatcatgccaaaacttggcccgcgtaaagatcgcaaatttatcatttactaagcagactttaagtaagatggcaaacagactgctaccgacatacaacaatagactgtaggttaacagcacgagccacttactaaccaaaacgagtggtcgtgaataacgctgcgttaacacgtgcttgatcgtcccaaattgaaattccatcgtgatcatcgtggccgccgctgctaccataaagaagacgatgaactgctgcgcttcaaaattagcggcaaacatggttttggcgggaaaaatcgtcggcttgatccgcgccaaaatcgcaaagatcagcgctacggtagccaatattagtccacaccaaatcgtagacttcttcttaaatagttttgtgagttcttgtcgatataacgtcatcatcagtaccactccctaggcgctggttgtcgccagtaattttaaaatcgtactttccaaatcagccgcctcatgccgaacatccctgaccgtcagtccgtgactagtcagaacatggagcacatctgccacctgatggtccggtgctaagtggactttcacaaccgtgtcggcaactacttgatagccggccgccaccaaaaccgctttcgcctgaccgtcatgatcagttttcacaatgacaaaatgatcggtcgtcgttaacagtgctgtcatcgttgttttctcaataattttaccgtgatcgataatgactaaatcgtctgctagcttttgcaattcactgagaatgtgactagaaatcaaaaacgtgacgcccgcctgtttttgcttcaagataaaatcgcgtaactccttagtaccttgtggatccaaaccattcatcggttcgtccaaaatcactagttgcggctgattcaaaaaggccagggcgacaccaagcttttgtttcatccccaatgaataatgacgcgttttttgatggatatagtcggtcatgtttagtgcggacaccaccgccgccaatcgcgcttgggcatcgggcccgtccgcaaacaaacgcaagttgtcccaaccgctcatatacggataaagactcggatactcgattagtgaccccaccgtcgccaagatgggatgatgatcgaattgcatcgattcacctgcgatttgaatctcaccatccgtgctaagtagccctaaaattgctttcataattgtcgtttttccagcgccattcgcgcccaccaggcccacgatccgtccctgggtgcattcaaaactaacgtcacgcaaaactggctggtggccgtaacttttattcagatgtttaacggttaaaattgcatcggccatttaaatcccctctctttcaagatggcaaacgttctcataagctgtcgacacgttgcgtccctccttaaacgataagtaaccctgcctaggaaagatcaccattcagacgttactgaattatagctcgctattcatttaaatgttggttttctcgggcgcacaccagtattttggtacttttaacccccaccacgcgaaacgacgattaactaaccaatcaacgtcgtcatttttgtcacattaggactaagcacacgcccgcttaaacgcattagttgtgcgcatgaatcaaaaataggtgaacactagatcagccacattgccaacctagtgttcacctatttttcgcttttgaaatgaaatttttggcgccattccgggattagctcaggtcaataaaccggatgatccagcacggtccagtccgggtaggtctgatcgcttgggtcaaactgcccggataacaacactgcctttgcttttaaaaccagcggtgacgcattagcttcagtcaacgcatgcaacggcacccgtgatgctccatgcgaatcttgaccatcaaagttagcgacatgttcggccagctgcccagtcgtccgggtcactcggtaaaagaccgccagatgttggttcattcgccactgcttgaactgccagggataccgaaaattcgtgatacccaattgcgtcaattcagtcgggattaacccggtttcttcttgaatctcacggcgaatcgcggcaagtaagggctcaccatcggccaaactgccacctggtaagtcgtagcgattcgtatagggaccaccaaactttttagtaacgaccaacgcatgctcatcgccaataatcccataaacaccaaatgcacggtgataaattgccattgtcccacgtcatttcacgtttaaacagcgtcgttaagcgtaagcgctagctatcttggtgtcaaggcaaatctaagtgtttactgtaacgggaaacatatcaaacgattgtaagtttactattttagtaaacattaattcatcgattatgtttacaaatacagtaaacagtcttataatcagtaacattggaggtagcctcatggacttaactagtttaacgattgatgatttaaaacgcggctggcatcaaacagccactgcccggtattgtaattactgtgatgctagctgggaaacgactacagcggcggccacgatcgaacaacacttaacgatcgtccatggtggtatccagtcaccactgattcacttagcgagtcgctacaatactttaaccactaaacagcaaaatttactgactgcttttgcgactggcatcaaggatgccgacttggctaaacaatttcaattagcggcggccacgattcgacatcaaaaatttacatttcgtgaaaaagccaaacaagctaaattgtacctggccatctatcaatccgtctttgagagtggtcagacgcccaatgatttgattgtcctgccagaacaacctggaattattgatgaccgctttgcgattactgaagacgaagcggtccaaacattgaagcagtacttcaactttgatcatgacccactacaattgaagcggtggcccaaaaagcaaaagacgatcgtcacaattctaacgcggattattgatgaaattccgatgaaccggccaatcaatgaagacgagctcaaccactatttacaaccgatttattttgattacaccacgctgcgccgttacctgatcgactacggcttcttaaagcgtaccgtcgatggccggcaatactggcgcacaactactaaggaggactgaaccatgcaaccagtcgaaaaacatcgcttacaacaaaaatacaaacttgccccaacttattacggcgtcattcaaattaccaacgaacgcaatcataaaatttggattgacacagtgcccaatctacacaaccgctgggccttttatcaactaaatcttaataaaaacttttaccggtccaacccgttacaggctgattggaatcaacaaactgccgctgacttttcctatcaaattctgtggcaaaaggaaacgaccgatgttactaatatgcgtgccacgctcaaagcactcaaaaccaaatggctgcacgatttacaaccattcgatgaccatggctataatcggcgccctaaagattggaaggaaaactaaatgaccaccactaaaccaaacatgcacgccgttgctattaatcctgaagcctggccgcgccaaacttatttttactatttcaccaagatagcccccagcggttttagtctcacggtaaatatggatattaccgccaccctagcttggactaaagcccaccacgttaaattcaacgcggtatatctatacctagtgagtcgcttgttgaccacacatcccgaaatgcgcatcggctatttgaacgatcaactggtgacctttgacgtgttacatccgtcttatacgatcttacacgctgaccggacaatggctaatttatggacgacttacgacaccgattttgaaacgttctatcaacactatttagcagaccaagctgaatttagtgcacttccagggcccatgccgaaaacaccacaaacacctaatctggttaatatcggctgtcttccaggagtccactttagtagctacacgcccctcccattcaaaccactagatagtttctttccaatttttcaggctggccagtttaagaaggacgctgacaaaacaatcatgccgctaagcattacggtcaatcatgccaccattgatggcgatcatctcagtcgtttttttaatgaactccagtcatgttgggaacaaccaacacaatacttagcctaaccatatagtcaaggcccgttatgtgcatttgttatccagcttaaacaccgctcgtcaagtctttttttgaagcgaatgagtcactagcttaatcagtgttatttaccggtgtttgttcgctcatcagattgcgcctttcttcaagcaaccacaccgtaaccgctgtccaagtagtgccggccctcgccagtacaattctaagaaattcttatgttagccttatgaaaacgcagtagttgagtctgcttcaaatgggtaaactaaagacattaattaagaaaggaactgatgtctatgcgtcattcacaagtcttaacgatcacggtgaaacaaccgcggcctcggagtgctgatccagctgtcatttatagagtcgatcgccatccttactggcattggaacctaatgaactaataaaaacgaaccgtgcactgaatcgtagtgggctcaaatgcgcggtattaaaaataatcccgttcgatcagccgtgtgggccacctgattgaacgggattatttttggttgcaagctctgcgggtatccggtacactgaagccatcaatgaatggaggaaatgccaatggctgagcaccttgacgctgacctagctgttttgacaccatatctggaaaagctgggtgcaacaccccatcgcgcccaactgattaccttgctcaactgggtacacacgacttttccacaactcaaggcacgggtcgcctggaatcaaccgatgtttactgaccacgacacatttatcattgggttcagtaccgccaaggatcatctgaacattgcacttgaatcacatactttggatagctatcggaacgcgatcacggctgctggtgataaaacaaccaagatgttatggcaagttgctttcgatgcgccaatcaatcacaagctacttgcagaaatcattcaatataatatgactactaaacaaaccatgacgaccttttggcgcccttgatgcgtcagcgttcacgaccccgctttcatgcctgaatccgagtcgtgagcgctttttaatgcttaaactcagactgagtgtcaacgcacttaaatctagttgacataattttaatttttatcagttgcagccaaattaatgattttttcaaatgtgaagcggcccgcgtcatactggtacttgatgactgcacagttatgtaacacgatgccttgccgctcaatttcgtccattgaaagccattgccgcaaaaacatgaagctagccccaccgtgactgaccgccaacacctgatgatgatccggacgtgccatcaccgccgtcaacgttttgacaacgcggtcttgtacctgcaaatcactttcgccaccgtactgacagaaaaagtcaccatgactgcggcgcacggggtccggttttggatttaacacttccgactcaccttcgaaaacgccaaaattccactctttgataccctttaaacgctcataaggttgcttggtcactaattctaacgtgtcactagctcgttcctgcgttgagctgtacgcatgatcaaacgtaatcccttgcgcctgaaaatacgcacccacgcgttgggcatccgcaattcctttgggggttagcggcgagtcacacgccccctgaatcttcttcagccgattaaaaagtgtttcaccatgccgcatcatatataatgtctttgccaatttaactaacctgcctttaatttgtctttagataagcataccataaatgaaagcgctatttaaagcgtcctatacattggccagttagagcctacttttgcctacgaacgcgcaaaaaagcacaaccagattttagtctggctgtgctttaaatagcgatattgatcaaaagctcagactaaaaatccgtatcttcatttccctgattcaacgctgtcaacgccgcctttaacgtgtcgccatgtgcaatcaccgtgccggtagcatggcccggttcaccggtggcttccacttcatcataaatttgtaaatgattgtagggaaatgtattcgcctgaacatagactggctttagccggttaacatccggatagtcgtacatcaccttagtcagtgcttcgcctaattttacgtgaagtaataagcgggtcacgctcgacccactggccttactgattaacgccatcgtagcaatgctcatcggttcaatcgtagcaagttgcaaagccgtatcagcaattgctaaccgaactgtatagagcccgggcgcacccatggcgagcactcgttgcttgatttcagcgtgtaaagctgtaattgcctgattttccgccttatcacgaatcggaaatacttggaccgcaccacggacattgccacgcaaattatttcccgcaataatttcacttaccccaaaaattgtcacatcggtgccgtccgtaatcacctcgacggcgggcgaatcgttggtcctgatctgctcgcgcggcaagctattgttgatttggatcacttggtagccatcctgtactaacttctggcccagccggtaatcatgataggtggtaaaaacgatcaacggcttttcaatcgctaagacgtttaaaatatccgaatactgtttaggttcaacgtaacgttttttggccaatcgcggagtcatcgccacactattaggattagcgttgatcaaaacaggctcataatcagcctttttcaagtagaacaacagttgtgagaccaaatagtcgttcccatggttggttccgatccggttagcacccgtgccaatgacaacgactcgccgaccagtagacggttgactttcgttatcaaattcgtacgtggagtaataagtactcgtctgctcagtaaattccccggcagtcggttcgacctccttaaaagtcggttgaatttcattttccaacgcaaagttgcgaaccttagccacatccgtttgccaggcagcggccgcatcttcatcggtaaagccaaaatatttggctcggcccagcgcgtggacgtcaaacggccgttcacgcaaggctcgttcaatttctaaaatatgactcagtttataaaagtaaaaagcatcaatcttggttagctcggctaattcatcgatttgataaccacgattcagggcttcaagtaaaatcagcatgcgcccagcttgcggatgaatcaaccgttggatcagttcaccctccgaatagttctggggtcgattagcaatcacgtgatagcgagattcgtccgtagaccgcaaccccttcaacaaggcttcttccgttgaacgaccaataccgatcactgagcctgtcgattccgtcacggtgtctagttgatgactaactttcttcaacacattaaacggccaaactggtatccggcaaacaatatgatctaaaacgggttcaattaaagctgtttgtttacggtaggctccgggcagtttgacctctgccaaacttatcccgaccattagattaccaacaacttgtgctaacggatactcggttgcccgcgcggctaacgccatcgtccgatcaaagtacggtgtcactttaatcacgtaatagttttgcgtggtcggatcaagtgcaaattgaacgtgacaagagccggtcaagtgtaacttgcgcatgatcttgagtgtcgctgagcgaaactgttggtattcttgatccgtaatcgtttgcgttggggcaaaaacgattgaatcagcggagtgaatcccaactggatcaaaattttccatcccactgactagtagcgcggtgtccttctgatcacggacggctacaaattcgagttctttatagccgacgatactctgttcgacaatacattgtttggtccctgaaactttgaatcccattgctagtgcccgttgcagttcgtcttcatcttcacatagttggcgactcgcttcgattcggggtgcgaccgacttgacgatcactggaaaaccgacgtggcgcaccacggccatcgcctcagtcgtgctagccacaacttgtgaggcaatcacgggttcacccatatctttcaaccggttgctcatcagcgctgggttgacaatcatgtcgaccacgtcttgatcccactgtagcaacttcacgtgattattttttaacacattgttgcgaatcaacccttgaattagggtgactgtttggacgccaccaagtgaaggaatgaggccatcaggctgttcagtttcaataattttggatagtgcggcgacggtcagtggttctaaataaaccttgtcagcaaaccgattttcagccgccacggagtaagcattgttatcgacgaggacaacagcaatgcccagacgccgaattgccgcaccgatttgggtcaccgccgcgtcgtgttgtccctctcggccaatgtcattatgcccagcgccgataatcaacactttttgtaaggcttgattgttcaccagattggcccccttgcttgttgcatcgactcaacaaattcatcaaaaatatcgcgcgtttcagtcggaccaggagcgccatctgggaaaaattgcactgaaaacgctggaaagtcccgtagacgcagtccttgaatcgtcccatcgatcaagtcaacaaatgtcgtgattaacttattacgatcaacagtatccgcatctaccgcgaacccctggccctgagctgcataaataatttggttcgtaatcacttcgcggattgggtggttagccccatgatgttcaggtgataatttcataatttgggcgccattggccatcgcaaatagttcgtggcccagtccgatggcaaacagtggcacccgattttgaatgttcttgatcatctcagtcacactggctggtaagtcctgcggtttgccgggcccagtcgatagaatgacgccgtctggatctaagtttaaaatttcctcagtcgttgccgtataaggtaagaccgtgacgttacaagcacgcttactaagttcgcgcaaaatcccgtgtttgaggccaaagtcgatgaccacgacattgagccccgtccccggattaggaaatggtttcggtgttgcgaccgctgccacctgttgattagtcagcacggtcgcacccaattgatcaaaggcatgggcatctgcaacgtctacgatactggctttcatcgggccacttgctcggagttgcttcgctaagtgccgtgtatcaatatggctgatgccaggaatattttgttgctttaaatattgatccagtgaccagcgccgctgccggttggtcgaaatgctagcaacatcccgaacaacgacccccttaacggtcggtaaaattgattcgtagctatcgtggttgatcccatagctcccaatggttggctgcgtaaaagcaacgatttgattatgataaatttgattagtaataatttcttgatagcccgtcatactcgtgttgacgacgatttctccggtagaaaccgctggcgagccaaagccttcacctaaataggcgctgccatcttcaagaatcaaatagcggtctgccattgcgatcccttctcatctgtttgactttgtcgtactagttaataatttcaataccatcgtgaccgtcgatttcattgaccgtcactttgatgcgttcttgacgcgcggtgggaatgttgcgaccaataaaatcagcgcgaatcggcaattcgcggtgaccacgatcgactagcaccgccaaggcaatgctctggggccgaccgccacccattaatgcgtctaaagccgcgcgaattgttcggccggtaaatagaacatcatcgactaaaatgacccgcttatccgccaccgaaaacgttaactgatagtccgttgaaagccgtgcttgatccagcggctgatcatcacgaaatgccgtgatgtctaactcgccaactggaatcgcagtaccttcaagctgttgtaattgggctgcaatccgctgcgcaatatagacgccgcgggttttaacgcccactaagacgacatttttaatgcctttgttctgttcgataatttcataggtgatccgggtcaatgcccgtttcatcgccattgaatcaacaacttctttttgcataattgcctcccaatttgtggttatcgcttttttgagcaacccgtacgacaaagaaagacggccggacaaggtgtcacggccgtcgacgaaaagttattgttaacagtttgcctttcagtctcgcagggccggattaaaggacgctcattactgttagattaatgattcccatcggttttgtcaagcttagccaaggttgtcgtaaagattggtggtagtggtgcttcaaaggtcaataagtcacccgttacggggtgcttgaatcccaataatttggcgtgtaaaaattgaccgtgccccttaatcgtctttttggggccgtacaggggatcgcccaccagcggatgtccaatagattgtaaatgaacgcggatttgatgcgtacggccagtctccagccggcaactaatcaaagtatagtgctgataacgtttcagtactttaaaatgggtgactgctggtcgcccggtcttaacgatggcttgctttttgcgatccttcggtgaccgaccaagtggcgcattaattgtccccgtatcctctttaatcactccgtgaacgagtgcgacgtattctcgtaagttagttttcgccttcagctgggccgccaacgattggtgagcccggtcattttttgcgaccatcaataatccggatgtatctttatcgatgcgatgaacgatccctggccgaaattcaccgttgatcgtcgacaacggactatgatacagcaaggcattcaccaaggtatggttagggtgcccaggggctggatgcacgaccatcccctgaggtttattgacaaccaagacgtcatcgtcttcataaacaatgtctaatggaatgttttctggctcaatcgttgtttgttgaaccgtctgtgcggcaacgacaatttcgtcacctggtttgacgtgatacttgctcgcctcgagctgaccattgaccgtcacctgatccgttttgatcagcttatcaacttgcgaccgcgtccagaccgactgtagtgccgctaacactttatccaagcgccctgtttggtcagtaatcgtgaattgttgttccgtggtcgctcctgccacgttatcagctccctgtaacttatttttcaaaactatcatcccgcagcacgccgatcaagataaaaatgacgcccacggttaaacatgaatccgcaaaattaaaaattggaaaattaataaaatcaagttggaacatatcgacgacgtacccaatacgtaaccggtcaatgaaattccccaaagttcccgcaatcatcagtgaaataccaacctcatatagccatttgccacgtaagcgccacagcaagtagcccatcacgatcaaggcaatcactgaaatcaagtagaagaaccacatcttgccttctaagatactccaagcagccccgttattatgtaaatttgtgagtgataataacccggtaacaatactcgtactggcacccaacgcaatatgactcacaatcgctgctttgataacttggtcaataatgaccagcgctaccattaaaattaaatagatccacatattctgtcctcacatttcgctaagctgtgtttaattataccaaaagacgtcgtccttgtacgaaactccggcaggaaaagcgcggtttttattgcagacttaataactaagcacctttcgagtatcctcccaaaagcatcggcacctggttaaccatcccccagttgaagcaacgagcctgatgattggttgcaccgctcagctgctaagcgagttagtcatcatcggtagctcacaaattaaacgtgtgtgattgattcgctgtcgcagtcttccaaaaacaacgcaaataaaaagccgacccccactagcatcgacttatcggtcaagctttagaacaaacctgagatttttccatcatcactaatgtccatatcgagtgcggccggatgttttggcagtcccggcatcgtcaacacattcccggtcaaagcgacaatgaaacccgcacctaacttcggcacaaattcacgaacattaattgtaaatccggttggtgctccgagacgtttgggatcatcgctcaatgagtattgcgtcttcgccatgcagactggcaaatgatcccacccttgcttagcaaacgttctcaattggcgctgagctttcgctgaatattcgacattggctccaccatacgtcttagtgacaatatcgttgattttcgtcttaagatccgcatccgctggtgataacggttgaaaatgacttggctgagcacataaatcaaccactgcggcagctaagtcggttgccccgtcacccccacgaccccagacatcagccaagactgcatcgactccaaggtcggcacaatagtctttgacggcttggatttcggcgtcagtatcggccgtaaattcgttgatggccaccacgactggcaccccataacgttgcatggcatggatatgatgtcctaaattagccgcaccggctttcaaggccgccacattttcggttgccaaatcttgcaaagccacgccaccatgtaactttaaagcccgaatcgtcgccacgattaccacggcattgggcgcttgtccgaccgctggcacgttaatatccatgaatttctgaccacccaaatcagcaccgaagcccgcctcggttaccgtatagtcggctagattcaatccggcttgcgtggcaagtacactgttacaaccatgcgcgatattggcgaacggaccaccatgaacgagtgccggggtatgcgccagggtttgaactaaatttggacgtaacgcgtctttcaaaagtaacgtgatcgcgccaccgacgttcaaatcagcaactgtcactggttgacggtcatgtgtgtagccaattacaattcgattaacacgttgtttcaagtccgcgatattttctgaaagacagagaatggccatcagttcactcgcgacggtaatgtcaaacccatcttcacgaggtacacccgacgttgcaccaccaaggccaatcaccgtatgccggagcgcccgatcattaatatccaacgcgcgcttccattgaattcgacgctgatcgatacccaactggttaccttgttgaatatggttgtcaattaaggccgcgagcgtgttgttcgcagccgtcagggcatgcatgtcgccggtgaagtgcaaattgatatcttccattggaatcacttgtgagtacccgccaccagtggcgccacccttcatccccataactggtcctaatgaaggttcccgcaatgcaatcatcgttgacttaccaatcttagtcaacgcgtcacctaacccaatagtcacggttgactttccttcaccagcaggcgtcgggttaatcgacgttactaaaataaggttgcgttgagttttcttaactggtaacggtaatttaagtttagccttcgtgctcccatattggtcgatctggtcaaccgtcaagcccgctttagccgcaatcgccgtaatcggttctggtatcacttgctgtgcaatttcaatatccttcatcaattctccgcccttctgtttttacttactccattataacaatcttcctgaaattatgaacattatttgtatattgattgtttttattcgtatctatcgactagttgctaggccaatcaactgattgcgcgcctttttcaacatcaaaaaccgatattgattaccatcgatttgaactttcaacccaccgcgtatcgggacgatcaattcgagttgatcacggggaatcacaagccaagaatggttcaagaccgtgctaaaaataatgaggttatgattgattgttacgcgccgcaagctgatttgaatcgcgaccaaggcaataaagagcgccgcaatgacgagtaaccaccacttaaacttcaagatttctagccacaaaataatccccgccatcaatactagtgccgtccacgaccagacgataacacttgacgctagcattggttggtatttaaaggtatgcttatcgttattcacagtacaaaattcctttcacattggagtgagtttgatgcaattatatacggatgccgcgaccacacccgataatcagcgcagtgccgcgggaatcttaattattgatcagggccaacaacaccaattcaaacaggtcttgccagacagtgataatcataccgcagaatttcttgccgccattgctggctttaaaactttattagattcttatggtccgcaagtcagcgtctttttctatacggatagtcaaatcgtcgccgaaagtgtcgccaagggttacagcaaaactttcagtgtcgagctggcgactttgctgcacctgcaagaccagtgccaattagtaatcacccagtggattgccgaaagtgataaccatggcgcccatcaattagcacaacaaggcttacatcttagtgactaatcagccggggccaaataagtttcaattgatcgttgatactggtcccagtcatgagcaccagtttgaacataatcggctaacagcttaccaatcatgggtcctgttgttaaaccagatgaacctaacccgctagctaccaaaatatgtgggttatccggaattggaccgaagaacggcgcaaagtcacgcgtgtaggcacgcgtacccacttttacctgcgtaatttgatccttagtcaggttggcatcaagtttgagcccgctagcaaagagatcatcttcaaccagacttgaaacctgcaaatcgtagccctgatcattttcgtgcgtcgccccaacgaccaatttgctgcgcgtaaagggaataaagtctcgttcaccttcaggcatgagcactggaacatcgtcagcccaagtctcaggtagctgcatttcaatcaactgccctttttgtggccgaacatccgcaacaatcttcattggcaacaataacggctttagccacgccccgactgctaaaatcaacgtgtcatagctttgctgaccattaaccgtcaatagttggccctggtcacctaaacgtaccttacctttatgacggaccaggttccgcttttcagcgtatttcagtaaattatgtgcaaacttatcgccatcgacccgcgcaccaccactcacaaacacaccgggttggggcgccgttagcagtgggatccgttcttggacttcttcagcagttaatttctcaatcgttcccatctggggtgccgcttgccggcgctttagagctaaatcgtatagcgcctgcagatcatctggatcggcacgagtcacaatcgttcctgcttgttgataaacagaatagcccatttgcgtgtccgcaacaatttccggatacaaagcagccccggccttagcgagttgataccaacgctgattacgacgtttggataaccaaggtgaaataatccctgctgaattcttagtcgcttgaccaataccttcatcataaatcgtgacgttcaggtcagggttctggcttaaatagtacgccgtgaccgccccaacaatgccactaccaataatcgttacttgtttttgcattttccaacgcctccacaaccaatctgctttcattttagcatactcgaatttgttgcgggtggctgattcagttggattaaagtcagaccattggtagatgttgctagtactagctttgcagcgattaatttaataccgtggactggctctttgccccctatgactgggacagagcaatcaatagttgttgccggacaaaattttcgttcgtccagtgtaaataatgctgacctggtgcatgaactaggtgaccaagctggcaccacggtgattgttggtacgccgtcaagcgttggtcagtgactaaaacttggattggcagcgtcagtacccgcttttcagcggttcgaagcgtcgttactaattgtggtaagcattgcgcttcagtcagaatactcgggttcgcgtaagctgctaaatcaatacgggcattggcgacacgttctgccagtaggtttaaaggattaacttctgctaagagttgctgaagtgtcaaagtttgtcgctgttgtactagttgcggatagttttcaataaaagattggacgtttgcaagaagttgtggtgccatcgcggcatagggtggttcaagcaaaactaagccacaaacattgtctaagtgctgctgggcatataagaacgcgtaactagcgcctaaactgtggcccaccaataataagttgctcacgtgttcatggtgaaccacatcctcaagattggctaaaatatgcgggacagtgcgcaccatttgactatgaatgctatggcccacaccaatcgtgccattaaatgcttaaaattataatcagtggcgtcccagccaaacgccggtaagcacatcaacgtcggctgttgtggtcccgccggtcggtactgatagtacacttgtcccaattccgtcattaattgattcatgattactttcctcccacaatgacagacatcgtaagtagttccaaatgctttttattacagataaaacacagctttacaatcagtcatgcatagtctagtccacaactgatcagtagaaaatggtttttaaccgcttcgttaaatcaactgaccattaaaaaagttacaagatttaaataatcgtcacattttgaccatattttcgttttacacttattaatacgcacgactatattgttttaaaggacttttgccatgttagttattgtttggattcttttagttttattgttagggctcatgggttggttggaataccacaatcttcagcatccggtcatccagccagctaaaaacctggcgccgcgcgcacagctccaattgcaacatcaagtgcggcaacacgtgaccgatcaagcaccacgattgaaatggttatattatggaatggcagcttgctggtggctcggtgttatcagtttactagtcagttgctacttggtcagcgcaaaattaaccctgttgatttttccgattcggagtgttgtcacaagcatcgccttaatgatcgttggcatcatcttgctaatgattcctgccttagtgtggccgacgcaaagttatgattacttgattggtcactcaactcaagaccatcattggcagctagccgataccgccacgttcgaacactatcgtcgctttcagatttggttggttttggcattagacgtcttcatcctgattggttggattagttgggcctaccgggtcagcaccgttcccatggtcactattgagtacctactaatggtggtggcaatcgccgtaccagttgtggcattgatcacgctgttagcacaactgccatacttacatcaaaaccgatacttgattccggtcagcgggcgctttggcacccagcattatcatgcgaatcaggcactcatgcaacaacaaccggacttaaagtcacggctaattatcgttaatgttgttcggattattggttacgcgttggggttgtatgctttatggttgttatatgccaacattcttgcaccggcctttacggtcgataccagtatcgtttaccccgcagcggcgtttgccatcatcggattgttaatcgtgttaacaacgggcggtgtgtggcttccccgtttctatgattacttgcaattattagataacaagaccttgacgttcaaattggccggtagcgaccgcttccgtcgttttcgttttcatttgtattacttcaagttggcattcagtattttatggatcgttatctgggcattgatcatcggttatatttattactttggctaggtacgctcaccaataatacgcaaaacggtactcaaactaatctgagtaccgttttttagtgtcattttatgagacttgccagcgaggccaacttgagcgccaaaggactcaaaataagtgtcgccattgcggcgcaagagccattactgttatattactgcgttttgaagagcgcaacaaagtcagcttgcgcgctcgcagcttcaaacgttcgcttggacagtgtcgtcacctgccgatcattgagccacagcacttggtaatctgtaaaagcatgaaggtcgcgaacgtcatgtgtaatcatcaagtaggttcgctcaggatgggcttgcatgacctgaaacaacaactgcacgttttcccgatcgaccgctgctgttggttcatccaaaacaatcaattcgcgatcaacttgtaagaacagcaataactgaactaatttgcgttggcccccagaaagctgaccataatgctgatcccacaacggggccaagaattgataagcttgggtatcaataagttgttggagctgttcagttgtcaatcgtagtcgtccgtgctcgatgcccaaaaccagttgggcaacgtcccgcacacgaattgaagacagtaacgggagttgttggttcaaataaatggctgctttaggtaggtctaattcaccttgtgccggccgcaaaccagtgatgatatcagccagcgtcgtttttccagcgccattttgaccaatcaaaaaattgacaccgggactttttaattgaaaactcacgtccttgaagaacggttgcccatttcttgaaaagtaatatgctaagtgctcaacacgcatcattataagccctccgttggcagaatcttaatgtgccgatagctaaatccgccgataaccaataatacaatcagactcagaagataagtcgtcataaagtggctgacggggcccacgctgatcatcgcaaaaacattggtaactaagtaaatgggactaaccaggttgagtaatgggttattggcagacactgccagcatgttactcaacataaaggtacctacgacgacgatcagcgccagtgcatttccaatcatatcgacagttttacgtcggagtgccaaggcaatcaagggtaagccaaaacaagtgactggtagatacgtaagcaacacagtcaaccataagcgacctagcaacgataaaaaggccaacttgaaagtaatcgcgctcaacagggccaccaacaataaagtcatcaaaattatacccaagctgaccagcgcttgactgacaagaaaaactgcagggctaaccaccaaggttcgatattgtttgagataaccctgctcgcgaagaatggctacattgctggcagtcgttagacaattggaaaaaatcatccaaccaatgtagggcacgacttgagccgtataagttgtcagcgataaaggtttaaagaaagcgctactgacattcatgattaaaaagacaagtggcaaacagatcgtgtaaattaacaccccgggagtatcccgaatgaccttaaaaaaatactgcgtgtagacccccacttgaacactatatttgtgcatcaccatcacaccccttttgttaatctaattgttttattatatgtttatcatttatcaaaaagcaagtattcttataccaggcatgtaagtatggccaatttacaaagtttttgagcttgctaaacgtctttaattgcaaaaggtagtctaaaaatgactaaacgtcaccgttcgagcctgcgcatcaatccggacatccgcccccaatggcgtactgagcatggggactgtatggcagctatcgtagtcgtaaataattggtaattggcgatcccccagcacctcctgtaagatatcgattggcaaccgcccgctgccttgatcatcgtacaacgcgtgttttcccaaaataatgccagagatttgatcaaaaacaccagccaacgctaacattacgaaatttttttccagcgttgctgcagttttctcggcatcttcaataaataaaagctcgttaccagttaattttggaaaataaggtgagttaaagaagccgtacatggtgttcaagttcccaccgatcaaacggccagccaaaacgggggtcgccgtataatgccaagtatttgcgtgcatgtgtttcggatgttcaaaggtctcccaattgatcgcttcatccgtccactgtgccggtgccggtgccggttcggttacggcctgccccggtgctgcgcggtagactgtcagaaaattttgccaagtagttgtcacgatctctgactctaaggcgccaagtgaggctactaaggccggtccgtaaatcacacgacagttaggcgcgtgcgtttgcaccgccaataacacggccgtcgcatcggagtaaccaacaattgttttgggatgctgattgagatactcgtaatcgagcattgctagaaccgaatttgcgtttgtcccaccaatcgttgccatcaagatgtccagcgaatcatcatgaattaacgcgttgatttcggccgcccgttctttgatggaaccagcacggtaactatcccgtcgtcccgtcaaattaccggcaactaaggtcactccttgggttgccaagaaccgtcgtgcgcgagcataacggtttggcgataatgccgtaatcggcgttgatgcagaaaatgtcccaattttcattgtattcccaccccacaagattaaaatataattaaaataagtgtagcactttttaatcttaacgtacttccaatcgacgtatttcctcaaaaaaacgactttcagctaataacttgctgaaagtcgtttagtaatcaactggctatgctcgttttgagcgacttaattgacttattgtgtgaccacgtttgagcggttggctgaaacgtaattccctttattcgttaaataatagcgtgagccacccgaccgtgagtaaaccttcgttactttaattcgatcaccagcggcgtggtaagcgtgtcgattagacttaacaaagtttgaagatttataggtgtagagtcccactttagccttgatccagccactggaaggtactgattcatagtaccaatgatcagatttggagaccttcgccgtgatataaccaccactcaccttaattcgatagaaattcccacttttaaccaatttaccactgtagatgccaccctttttcaaggttttacccgtcgaggttgtcaaattaacatctttgaacaaagtgctcttttcacgaagttgatataatccgtgttggccgacccaatagccggtgacgtcctgtgataagacccatttattcagaccacttaagtaaaccagctgtttggaacgactcttagtgactgacttggttgctgtgaccttgtagtattttttcttagcgctactgggcacttttgtgccgtcataatagctcgacgccccattattgaggtacacatgttgccctttcgtataactgctgtaggcatacgtcgtgctagttgaactggtcgacgatgatgtcgaagtcccggaagtccaccagcttaacgggtggtatgtcgtcacggaagcactgtcatacaaactgttatcaacatattgtcctagcgaagataaataatagctactggaatattgccacaatgagaacgaaatcgtcggcttcgaggagtaatttgcaatccactgggcatcaaaactttgccgtgccgtgttggcgtatgtggttgcaaatgactggtacgaataaaaaatcaacttcttgctcgttaacgaccgcatctcagtataccaagccttgacagccgcgttggccgccgtgctactcatggaagtcgtttcaaaatccaagacgtagaacttcgtgttcttatttgcgcgttgatagaacttatctgcctcggctttggcagtcgcggtactcgtaaaggtcgcatagtcataggacccgaacggaacaccatatttcacatagagactctcattagaggtgtggtagagagcctcataactgctcccatattgcacccggttgatgacaaaatcagcctgactcttcaaactttgaacctcggtactcgttaactgaccttgccactctgagatatccggcaccgccgcgtgtgcctgaacgactccggtaccacctaaaaaacaacccacgagcagcagtatcaaccgccactttttctgcatgaccaaattactcgccttcccatcattagtttgatatgtacgtttactgcacaccttatcctaccgataaaatgtgcagataagttctccaactgattgcagtcgctttacaatttgtttacattataaactaatgcaggaaagtgtgatttactagggactgtctgaaaa

SEQ ID NO: 32 - DNA, 39982 bp, Lactobacillus plantarum
gattaattttacaatctacctaataccaaacaaaatttaaccacttttcaaattttgacctataatcaaggtgtatcaaaaattagaaaggaagttgttttagtatggctgcagcagttgaaatgaacagtatgttagacgaaaagatgacggacgtgtttgattggagcgactctaagttacccgtacgggatgcgatttggaatcactttatggacgctgatagtcatgatactgacaagacggctgacgaagtagcgccttatatgagtatggacgaagctaagctcaagagcgaagttgaaaaactcttaaaggcttaactagaataacgaccatgacggcctaatttttgaatgggaactgattgccagtttagtaatcagttctttttttatgcttttaatccggctgaataagctggttggtcaggggggcctctcaaccgaagctaatcaagaccaaaaataatttttttgaattactgtcgacactatgagcccgtagtggtttaccttttaattaatataaaaacaattaaaaattcacttgacttataattaaaagttaattaatctaagaaacatcaacattacaaaaacttttgaaagcgaggcgcgtcaattatgaaaattcaatctaacctaaccaacttgttgacaacccttgctgttcaaaatttagccttattattaacgaagaaggacccggtcacttgaccttgagtataactcaaaattcaagtgaactgagcccttctttcccattgtggtaatgaggctcagttccgggtaaaggcctcattcactacggtggatgaggcctttttgtgacttaaggaggatcggggtcaacaacgtagcaataaaaaaacgaaagtgggaataactaatgaaaaaatgggaaaaacaaacgatgaagattgcagcacttggtgcgatggcgttgacactggcagggtgtgccactgccaaatcaagttcaagtcaaggaaataatcctggcaagactattaaaattggggtcaatatggaattgtctggatctgcggccggttatggagaacagcaaaagcaaggcattcagttagccgtcaagaaaatcaataagagcggtggaatcaaggttggggggaccaagaagaaaattcagttggtgatccgggacaataagacatcgaacacgactgctgcttccgtggctgcccagctcgtgaataacgataaggtcgtggccgtagttggtcccgcgacaactagcgccgggactgcggcgatccctaatatgactaaggcggcagtaccatcagtcagtccatcagcgaccgatccggattatacgttgcaaaagagtggcaaagttcaaaagtacatattccgagcttgctatcagaataattttcaaggagccacggcagcaacctttgtgactaagaacttgaaggcgaaacgcgtcgccattttgactgataactccagtgattacggcacgggcctaacaaaggcgtttaagaagcagtatcggggcacggtcgttagcagccaaacgttccaagagggcgataaggactttaatgccatcctaactgcgttgaaacataaaaagatcgatgccatatatgcgcctggttactattcagaaatcggtctaatcgttaagcaagcgcggcaagcgggaatcaaggctccaatcgttggtagtgacgggatggcggatgctaaattagcccaaattgctggcaagtctaatgctaccaatgtttattacacgacgccattttctactaaggcttcggcaacgaacaaagttgcttcgaaatttatgagtgcttacaaggcaaagtatggtagtaccgcaccaactttttcagcactcgcttatgattcggtttatatgatcaaagcagccatcgaaaaggaaggctcggctaattctgttaaaatcgccgatggtttagccaaacttaagaacttcaagggtgtcactgggacgacgactatcgataagcaacataatcctgaaaagacgatttcaattgaacaattgacgaatggcgtggtcagcaaggtttataacgtcaaatagtcagactagtgaaagcgtgggggaacacatatacagacatttggacaacaattgatcaacggactatcgctaggaagtatctacgcgttattggcgctaggctacacgatggtttatggcattatcaaattaattaattttgcacatggcgatatttatatgttgggggccttttggggctattacagtttgaagtcactacactttaactttgttgcggcgctcctgtccgcaatggtgatctgtgcagttagtggtgtgattattgaatatttcgcgtaccgcccattacgccattcaccgcgaattaccgcgctaatcacggcaatcggtgtttcattcttgcttgagaatggaatgtcatactttgttggtgcgagtgcccgttcatttccccaagcaatcaaagtggtgacttatcactggggcggattgcgggtatcgaatgtgcagctactgatcttaggaacggcgtgcctattaatgattctattggaattaattatcaaacgtaccaaaatgggtaaagcaatgcgggccgtttctgttgatcccgaagctgcacagttggtgggcatcaatcttaaccatacgatttcgttcacgttcgcattagggtctgcaatggccggcgctgccggagtcttgattggcctatactataattcgattgatccgttgatgggcatgacgcccggtatcaaggcctttgtcgcagccgtgattggtgggattggttctgtgcctggggcttcattggggggctttattatcggcatcctggagactggtgttcaggcgattggcctatccgcatacaaggacgcggtggtttactttgtcttaattgttattttgctcgtgttgccggctggaatattcggtaaacgaaccaaggaaaaagtctgagggaggcgccaaattaatgaaagcaaatttgaaaactaacatggcgtggctcggtgtgatggttatcggctttgttgtgattgacggtttagagctgatgggcgtcattaactcgtttattgaaaatatgctggtgacgattggtatcaacgttatattggcggtgggactcaatctgattattgggtttgcaggccagttctcgcttggtcacgccggctttatggcaattggcgcctacgcgactggtattatgacccaaacaatggcgacgcccgcgggattttatctgtcgatgatcgtcggcatggtgattgccatggtagcggcggtcattgttggcatcccaacattacgattgcgcggtgattacttagccattgcgacgatgggggcggccgaaatcattcggattctaatcaataatctgaaaattacgaacggtgcagcggggttattcaatatcccggcacttgcttcgtgggcaacggtgtatgtcttaatgtgtctgacaacgattatcacggtcaactttattcacagtcgcggtggtcgggccgtgatggctgtgcgggatgatgaactggcggctggtgccatgggaatcaatacgacgcgctggaagttggccgctttcgtctttggcgcggcgactgcggcgattggtgggtcgttgcacgcggcctacattcagacgattgcgccgggtgattttaatatcatggcttccattgcgattctgattattgtcgtactcggtggggtcggcagtattaccgggactttcgtagccgcaatcgtattaggagcgctcgacacgatcttacaaaacttcggtacgatccgaatgattatttattcattggcactgattttgattatgatttttaagccagccggactgttaggaacgtgggagttctcattcacgcgtctattcagacggcgatcaactaaggaggcggttaaccatgagtagccggttattagacgcacaagggttggtcaaaaactttggcggcctgaccgccgttgctgacgtttcactccattttgatcaagacgagctgattggtttgattggcccgaatggtgctggtaaaaccacgttattcaacttgttgactggtgaaacgccggttagttcgggtagcattagtttctacacagatcagggcgtggtgtcgttaaatggcaagcagcccgctacgattgctcgggttggtatttcacggacatttcagaatatccggttgttcaaggagatgagtgtactcgataacgtgcgcattgcaatgaccaatcattatcatgaacggtttttgactagcatcctgcgcttacctaagtattaccagactgagcgggcaatgacccaggcggcgcaagccttattagcgatgtttgatttgaccgccgtcgctgatcagcccgcaaagagtttaccatatggtattcagcggcgattagagattgtgcgggccctggcgacgaagcccaagttactcttccttgatgaacccgcagcgggtatgaatcccgaagaaacggcggatttgacgcgcttgattcgccgaattcaacaagaatttcatattaccgttgtgctaattgaacacgacatgtcactagttatgaacgtagtcgagcggctctacgtgttggagcacggggcgttactggcaactgggacgccaaaagccattcaacatgatccggccgttatcaaggcctatctaggaggggtgtaaatgcttaaagtacgtgatttagtcgttaattacggcgcgattcaggcagtcaaaggtgttagttttgacgtgcaacagggtgaaatcgttacgttgattggtgctaacggcgccgggaaatctacgttgttgcacacgatatctggcttgatgcgtccggtcagtggttctattcactatttggatcaacccatccaaaagacggccgctcctaaaattgtgcgggcgggtatctcgcaagttcctgaaggacgccatatttttcccggcctgtctgttcaagaaaatctacaaatgggtgcttttttacggcaggatcggggtcaattggctcagacttatcagcaagtttacgactactttccaattttgaagaaacgtcggcatcaagatgccgcgacgctctcaggtggtgaacaacaaatgttggcgatgggccgcgcactgatggcgcagcccaagctgatgttgcttgacgaaccttcaatgggattagcgcccatctttattaatgagatctttgagatcatcaaggcaatcaatcaggctggaacgacggttttactaattgaacaaaatgccaatcaagccctgaaaatcgctgaccgcggctatgtcttagctagtggacaagtcaagcttagtggtcggggttccgaattattagctaattcagaagttcagaaagcttatctagggggttaagtatgagtgttgcagattatatgacaccacgcctggtcgttgttagtcctaaaacgacgatcagtgtggcggtcgaattaatgaagaaaaatgcgattcatcggttacccgtcatggcaggtaatcgaatggtcggcttgatcacgcatggtctcattcagcgtgcgatgccatcacaggccacgagtttgtcggtgtatgaattaaattacttacttacttactaagacgacggtggatcaaatcatggaaacggcggttcaaactgtcgcagcaaccgctcagttagaaacagcgattgcaacgatgcggaaaaataagatcggcgtactaccagtcatgacgggcgaccaagttgtgggcatcattactaataatgatatcttggatgcgttcttaaatattgctggttacggccagccgggaatcgtaactcgggtggtggtccatcatgaccatgtcggcgtaatttttgccatcggaaaggtcttaacagaacacgatttaagtattcagacgttaatggtcgtaaatcaccaggctgaaaaagtgattgagctccacgtgaatagtgaacaggccgccgatgttaaccaagtcttgacagcagcaggttttgaagtacaaccggtcagtgattagctctggcggctattgtctattattggagattaggtggctaaagacatcgcgttgtacaaagttatagggcgtggtgaaagtgtgtggtcacaaaaaagattcaggatgattcaatcctgagtcttttttttcgacgtattgttacttaaggctgcggtcgactgaatgttttatagacaggacattcgctagctaatgggaaattacggcaactaactagtacttgtgaggagtagtgataactgattggattcgttattaccatgcggttttgagcggtacacacaaatttaagaccggataataaaattgatagcaaaccgagactgatcaagaagaacgagactgacctgaacgtcacaataaaaaaaattattattaattggattaaatccctatctgttgttttattaatgttgtacaagtattagaaaaacagcggatagaacgttttttaatgtaaaaatgatgaaacaaaaaattaatactgcatacaaaatacggccggaacagttgacctggttgattttcacgggttaacaaagaagcaactcaaagattaaggggttgtaattgttgggaagtgtggtaaattattagtgcagttaatgaattaggcaaactaaaggggatgcacgatatgaaaaaagtagtaggcagtttactcatgaccagtaccattttattgggggccttaacgccaatcgttggtcacgcggccgatggtgaaaatcggagtgggacgacgaatgcaacggcaacgtttacggcaaataccactaatccagttgatccggtcgatccgactgacccaacgaaaccacttgaccctaagcctggtgatggcgataacggtgccaattccggtgctggtttgtcactgatctatgcgcccggtaaacttgatttcggttcgcatgaaattgacgtgatcaataaccaaagctataaagcattgactggtagcgatggtagcacggtcaccatggggtcaacgggtaaagttggtttacaagtctctgatcaacgcgggacgaatgcgggttggacattgagtgttgccgctgcggatggcacggatggtaacttaagtacgcttaagggggccacggtctccttacctgcagggacggtcatttcttccggatcggaagctagcaacggcagtaccggtggtaatggtgcggtcggacaagctgttgaacttgacttaggtagtcaagcttcaactagtgccggggcgtcctttacggggacaacttctgggaatgtcatgacagcagcggataagagtggggcggggattacgtctgacttgcttgatccggctgcagtcaagttgaacgtcgtggctaacacggcggccgctacgacttacaagggcgtcctaaattggacattaacatcatcagcagataattaaattaatgaacttggagatgaccacgtaatagtgggcgtctcttttacataataatcgacggggggacgcaataatgaagaaaatgatgcggtggttaggggccatcttagtgatgatcagcggcttgtccgcggtggttccagcacaggcagccaatacggacaccagtaataatattggttttagtgtcgcggcccaaacgccgaaaaaccaaattgataaacaggcaacgttttttgacctcaaaatgacggcagggcagacccaaacgttgcagacgcgaatctataatacgactaaccgggatatccgcgttgcaatggggattcatacggcatataccaacagtggcggcgcaattgaatacgtgaccccggcgaaaaagtatgatgcctcactgcagtatcgggtcgaccaattgactaaaatcaaggggccaacgacggtgacagttccagccaacggttctaagctggtcagtgcccaaacgaccatgccgactaaggattttaacggtgccctgttaggtggttggtattttaaacgcgtcgatcaaaaggtcactggtgaagtgaagggtgctacgaatattagcagtgaatattcttatgtggtgggcatcaagtacagcttagggactgcgcccacgcccgtcttgaaactaagcgatatcgctgctggaatggttaattatcaccggagtatcgtggtgacgttacgcaatactgcagcagtgatgataccacgggttaccatgaagacgacggtcacagccaaagatagtggcaaaaccgtcgtaaaggcgaccaaacaaggcgtgatgttggcgcctaatacgacgtttaattacccattgttactcaacaaacagaagcttcaagcggggacgtatcatttacacttggttgcgcacaacagcgctcataagtggacttttgaccgcgacttcaagattagtgccgccacggctaagacgtataaccaggatacggttgatgataacggcatcagtatctggtggttgattggtctgggcgcactgggcatgttgattgtagtcttactgattttgtggttagtgcttttcttgaagaagcggcggcaatcccaagattaacagcaatcggctcggtgtttagtttgggactgctaagcgtcatgaacaattagtagctgggtaaaaaagggggactgacaaatgatacgatggctgttgatacggggcttactgggcttattaatcggcctaggaccatccatcgggggagctgctcagacggtgggcacttcgtcgacacaaatacagttctatacgtcacgttcagcggacaaacaaacgcctacgacggtgcaacaaattccgcagggcgacgttgtgtacgcaacgaaggctgtcaaagccacgcccaatcgctttgtcggtcagtggcaacaggtactagcaacgggccgtttgccccaaaccggggtccaagcgaatcactattatcagtggctcgggttcctgaccttaatggcactcttattagggtggcaggtgcttaagttaatgcgtgaaaggggggcgaacacgtgaaacgactgcggcatattaagctaggcatgctgttactgagctgcttagcgtttatcagcatgctagcgattacgagtcaggcagcggcgcccgtgacgtctgcgacaacgacaatcgctaattcgagtaataagtactacacttactttaatagcggtgatgtcgttgggttcaatatctcgggtggaattgggatatatccaagcttaaccaaagtgacggccaactatgcggatcagggacgtatatcgactaagactaccacaataacgttgacctttagtggttcgttgtttgcgaatagttcggagattaaaacgctatattacgatgtcttttataagcaagcaaccgaagaatttggaacttcactagtgaccaagactccgacaaatatggcgactggttctagtacggtatcgatgaatactagcaagactttgacagtcgatatgagtaagttaaaggataatttgccagtatatattgggtttcgattaactacagtaaagggtgagacatccacgtaccgcttggcagtgtttaatcggattagccttaatacgacgctgaatacgccaacaacgacggataccactctgacaggaactgggattgccggtaataccgtcagcacgacaattaatggtaagtcgtacacggcgacaatcggtagtgatggcaaatatgaaattaagttaaatgatggcctcagtggggtcacttcagtcacagtaacgcagacgggagaagccgattatggcgaatccgaatcggtgactaaggacgtgacgataccaccgctgacaatcaaaagtagcagtacagcggtgaatttgtccgtgagtgatctagcggcgttgacgtctgatagcgatgctgttaattggttagttaagcaggctggcgtggttgcgacgaatcctagtaacgctaatgacacgatgacttatcatgcaagtgagagcggtctggtcgcgttattcaaggggctcgctgataatcagagtaccacggtccacatctatgcgacgagcgccagcggcttaacatctgataaaattgcgctacaagtaactaagttagcagggacgctgtcgtttggtcaattaacgaccaatatgagcttcggcgatttaaaggtgccgttgacaccacaagtctatcaaccgactaatccactagccatcagtgtgactgatacccgggcgaccggggctaagtggtatttgtacgttagtgccacgccgctgacatcgacaacggtcagtggacggacgttgaagggcgatttggtttaccgtgatggtagtgcacagaccgtcttaacgaatcaagcgacgttggtccaacagggacaaaaagtcgcggggacgaccgatacggtagtcactgacgattggtcgacaacgaagggaatcggattatcagcgcaaccaggtatttacgctgatacttatcaaggtaccttgagttggactctgagtgatacgccagataaataagttagcgtgtatcatttgggtgacggggactttgaccaattgcacttaaattttttactggttcgcagttgacaagttaggtgtcgtcatggtttactattagctataaattgaaacggaggatgactaatatgtcattagcaactaaccttcaattaaataatcaatttgcctttagctttttctttagatagcgtttgtattcgtttgatggatacaagcgcacgcaacgcgtttgtatctatcgagagctaaagttattcaacatgacttaaacgccaggtagatgcagggacaatctatctggaaaaatatcgggcccgataaaacaccagttagattcttcccagaatctaactggtgttttttgttttcaatccggttcatcaagacgttgatgaacgttgggcgaaccagacaatttttaaggagcgtttcaagatgaaaaaaacaactttaggggtattaattttaggtgctgggttactattagctggttgtggcaaacaagcaacgagtggtcagcaaagcgtgtcggtgggcatcttacaggtggttcaacatggttcactagaccaagcgcgcaagggcttcaaagccggattacaaaaagaattaaaagcgcataacagtaaaataacggtcaagtatcactatctaaatgcacagggtgatcagagtaatttgaatacaatgagccaacaactcgtccaacagaaaaatgatttgttagttggcatcgcaacgccagctgctcaggcattagccaagaaaacgacgacggtgccgaccttggttacggccgtaaccgatttgaaagcggcggggttggtgaaaagtgatacgaagccccaaactaatgtgagcggcacgagcgatttaatgcccgtcggcaaacaatcacagttattgaagaatatgagtacaggttataaaccgttggggattatgtataactcgtcagaagaaaattcagtgctacaagtcaagttggcgaaggcttacgcgaaaaagcacggtatcaacttaaaggtcgttagcgcaacgagtactaatgacgttgccagtgttttggccggtttgacgggtaaaatatctggcctttacttaccaaccgataatttgatggcgagtgcgatgaagacgattggtcagaagaccaaggctgcaaagctaccagtggtaacgggttcgattgaaatggctgaagatggcgggactgcgacgtatggtcttaactattacgaattaggtgaacagactggaaaaatggcttaccaagtcttaatcaagaagcaaaagccgcaaacaatggcggttcaaacagctgacaagttacacctctacgtcaataaagcgaatgctaaggcaatcggcttacaaccaagtacaatcaagcaaccataagaggggagcgaggtaatatgttaatcacgagtattggacaaggtttattatgggcgccactggttatcggggtgttcctcactttcagaattttaaacatccctgatttgaccaccgagggtagttttccattaggggctgccgtgacgattagtagcatgttggccggacagtcagctatcgtggcgagtttattaggatttgtcgccggatgtttggccggttgggtcacgggggtattagatactaagcttaaaatgccgtcattattggccggaattctgacgatgacgggactatattccatcaacatgcacattatgggcaaagcgaatattcccttgcttgaccagaaaacgttgatgggatggttaccagcgagctggtctttgaatttacaaaccatcgtgattgggtctgtggttacgctggtcgtcctggccgggttgatttggttattccagacgcgtttgggactatctttgatggcaacgggtaataatcctgcgatgagtgctgcgaatggaatctataccgatcggatggtcattattggctatatgttatctaacggtttgattgctttatcgggtggtctgattgcacagagtaacggttacgcggatattgggatgggaattgggacgattgtcatcgggctggcttcagtcctggttggtgaaatcttcttacatggtcgtcaaatctgggtccgtttgactggaatggtcgtgggcgccattatctatcgttatttgttgactttggcaatgggcttaggtttccccgtcaatgacttaaagattttatcagcggcgattcttgtcatcgtcatctgcttgccactattacaaaataaataccggacaaaacggcagttacgccggtaccttaaagagattggagtcgatcaacatgccacaaccaactattctgaacgtccaacacttgcaaaaagtcttctttcccggaaccagcaacgagcggcacgtcttaaaggacgtgaatctaacgattgaacctggcgaatttgtggcggttattgggaacaacggcgccggcaagtcgaccttgctcaatacgattgcaggaacgttaaatacggatgctggagagattacactagccaatcatcgtgtgaccaatcgtcccgttgcgtatcggtcacggtgggtggcccgggtgttccaagatcctaagttgggtaccgctggcgaactaagtgtggcccagaatctcacgttagcccaacgtcatacggggagcttgagtctgcgccgttatcgccaacgtggacaggaagaacgatacttaaggttgctggctagtcttaatatggggttagaagcgcgactgaatacgcaagtgaagtatttatccggggggcaacggcaagccttatccttactgatggccaccttgagccaaccagagctgttgttgctggatgagcatacggcggcgcttgacccgaagacgagtgcggaagtgatggcgctgacccaacaaatcgtgacggccaatcatctgacaacgatgatgattacgcacaaaatgagcgatgcgttgacatacggcgaccggctagtgatggtacaggatggtcagatcaagttggacgtgcgtggtgccgaaaagcaagcattgcggacggatgacttggtgacgatgttcgcagctgaggtgtgaggctgtcgttgcaaaaaacgacttgcaacggccgatgatcagttagcaggtcattatcttacttaacgaatttcgcaatcaaataaatgatcagtcctaaactgatgagaccaccgatgatagatataatgaaaattaaatcgccaaaatacattggttttcctttctagcttagcgcatgctgagcaataccaaaatataattattgtaggttcggttagtcaccgcttcgtgcaaatcatgattaaggcgtgctgttagtttagattgcagttcatcaacacgtgttcgtccgacttccgaggctaggtgacaatcgttttagcataccatattagtttcgtggcgataatattcatatgacgtataattctggaaaaataagttaattgaataatccataattgccggtaaacgttgctaaatggcgaatgagttacgttaagggaaatttaaagaattgtccggcgactagattatcgaaaatagccctctgcgtatcaaatacgtagggggctattcatataattggcgcatgtaacaagttatttcgtcgtgaccaacataatctcatcactgactttgacttggttggtcaacatcttgaatttcatcaaattgacagcatccatgttagtgatgataaccatcatggttgtggccttaccagcagccttaatcgctgccaggtcagctttggcaactacttcgccatggtgaacgggttgaccggtttggactagtacttcaaagggagcaccgttcaactcaacggtatcaatacccatatgcagcagaatttctaaccctgaatcggttttaaaaccgattgcatgcttggtaggaaagacggtgctgaccgtcccgtcgaccggcgtcgtaatcgtcccgtctgcgggatcaattgcgaagccatcgcccaacatcttcttagcaaatgtgttgtcggcgacgttttcaatatctacgtactgaccgttagcgacgctgtaaaagtcggtggtcacaccactagtgatattagtcgcagttggtgctgtcgcaacagcttcatcgctagtcgtggtcttagtaatgggtgcgttcgtgagctttaagtggctcaacacgtcggcgacgaattggacttcggtcccaataatgatttgtagattatggtcgtctaatttgttaataccagcagcaccactgtgtttgatagcggcttcattaatggttgacgtatcggctaattgcaatcggagacgggtcgtgcagttatcgacaaccgttaaattatcggcaccaccgagcgcagcgtaaatttgcttggcttgacgtgtgtatttgtcatcatccgcatcagtggcgatggctaaatcatcggcatcatcggctgtcactggttcgcggcccggtgtcatcaaatggaacttcttgattgcgaagtcaaagccaaagtagtaaatgacggctagaaccaatccttgtaagattaacattaaaggttgattagcaatcgggtttttaaggcttaaaatgtagtcaactaacccggcggagaaggcaaaaccggctgtccagtgcatgaaggcagcaaaggctagcgataaaccagtgaagattgcgtgtaaaacatagagtggccaagctacgaacataaatgagaactctaatggttcggtcacaccggtaaagaaggacgcaaacgcaccggccatcatcagggatgctgtttcaactttacgttctggtaacgcattgcggtaaatcgcgtaggccccagctggtaaaccaaacatcatgactgggaagaaaccagcttggtacatcccagtcacacccttgatccccttgtgtgctaagaatttaccaatatcattgatgccagcaacgtcaaaccagaaaacggagttgagtgcttggtgcaacccagttggaatcaataggcggttgaagaagccatagagaccggccccaacggcaccgagacccacgatgaatttgccaaaggtaactaatgcatcatagacgggcggccaaacaatgagaagcgcaacgctgactaataacatggtcagcgcggctaagattgggactagacgtttaccactgaaaaatgaaagagccatcggtagtttggtctcgtggaagcgattgtaaagagctgcggcaatcagaccagagatgatcccaatgaagacgttgccaatttgaccaaacgctggattaacagtggctaccttgatattcaagagtgtggcgaccgattctggttttaaaacgttagttggtaattcaaaggcaactaaaccagcaagagcggctgcgccatctttatcttttgacataccgagtgccaaaccaactgcaaatagtagtggtaattggctcagaacagcgttaccaccggcttgtaagaagtgtgcgacgatgtcgttactagcagatgcccaccagttaccaattcccacaagtaaagctgctgcgggtagaacggcaacgggtaattgcagtgaacggcccatacgttgcaaataattcttcatgtacaaaatccccctaaaaagatagttttgaataagtgcaaccattgttgtacggtggtgaaagcgctattacaaccgctttttattggtatagtccattggtttaataagattaacagtacaattgggagtggtctaatataaatacaaatacggaactacaagtccgacaagcataagtaatactggtataaacgatgaccccaggtaatgagcataaaaaataaatattggtcggaataataggtgctaatgatagcgatttcaaaataattgtgaaaacaaatacaaaatcagttataataagattgattaatgaatttgttacttttaaaaaaggagttgtttaggatgccaacaaccatgacgactaatattaaaaataatgattttaaagacgtggtgtttaaccgccaatcagtacggcagtttgatccgactgtcaaaattgaccgtgaagaattgcaaacgattattgatgagacaatcagtgcaccatcagcatgcaacttgcaatcctggcactttgtggttgccgatagtgcggacggtaaggcgaaagcaaagtcggttttaatgccgtttaattatccacaaattgattcttgctcagccatgatttttgtcctaggcgatacgcaatcgcatttggtctatcgggacgtgtggaataaagcttgtgaagaaggacgcattaccccggaaaagcgggatcaaatcttcaagacgttcttaccaatgtatgaaaatgcgagtccagaatttctacaagccgatgcgatgattgatagtagtatggccgcaatgcaattactattgattgcccgcgcacatggctatgatgctaatccaattgcgggttatgcggcagataaagtcgcgacgacctttggcttggatgccaagcgctatgtaccagtgatggctatagcacttggcaaggcggctagcgaaccgatcacgacaacgcgttacgctggtacgcaggttaccgaattcatttaattgagctaacctttttaactcgcgaaaatatcgcgagtttttttgtcatcgggcttgttctcgaacgcgtttgagcaggtatactaagggtaagattaataaaataattgacgggagtacattggcatgattaattatttgttttcagatttagatgggacgctattgaattctcaaggaattgtgagtccacaaactgttcaagcagtgcgagaaagtggcttaccaatgacgcttgtatcagctcgcgcacctattgaaatgcgtgatacaattcaggcactagggttaacaggtccccagattggctttaatggtggtttgatttttgaatattgtcagaatcaagttaaggcgttacaagcagccccgttagatcagaaattagcattacaagtgctcgagtttgttaagacggagtcgccgacagttagcctgagctgttacacgcaaacggattgggtgacggaaaaagttgatgctgggactcgtacagaacagcagctgacgggacaaatagtaacaccgattacgagttatacagatcactttcggcaatatcctgcagctatttttaaaattatgattatgaccttagacaaacatgttatggcaacactcgcaatggcccttaaacaattggtcggtagttacgctagtgttaaattatctggacagacgtatttagaagtaactagtgctcaggcacaaaagtctcgtggaattgcatttattaaagaacgatatcatttaacaactaatgagatagctgcctttggtgatggtgaaaacgatttgccaatgctgagggcggttggtttaccaattgtaatgggcaatgctgattcaactattcagcaatatgggcatcgtgtgaccaaacgtaatgatgaagatggcgtggcttacgccttgtcacatttaatcgggaggtaatattgatgacgaacattcatgatattgcccgtttgtctggttattcagtttccaccgtttcgcgcgtactgaatcatcaaaattatgtttctgccaaaactcgtggagatattgaagcggtaatcaacaaattagattatgttccaaacgccgtagctcgtaacctgagtcggggggcaacgttaactattggagttgtgctgccgcatgttgatcatccatactttactcaactgttacatggaattatgcgagctgcttttgctgcgaattatcacattgtattactaccatccaaatgggactcgcaattagagttgaaatacttggaggcactccgtcagcatgcttatgatgcactgatttttacatcccacgggttgccattaaaaaaacttgcagtttatcagcgttacggacgaatcgtattgtgtgaaaatccccatgactattctttaccagctgcctatgcccagcgtacagcgacgtatgttgaggcgtttacgtatttaaaacagcgacatcatcagcgaatcgcgatattaacaagtcgaccgctggaggttagtgccacgacacaggcgatggttggggcctatgaacaagtttatcagcggacattgtcaccgaagttattgtataccggaatcattacggcggaagatggcgagcatgctggaacctattttgcccaacttactgaaccagtgaccgcggtactgactaatggtgatgacattgcagtggggatgcgtcgagcttatttggctgcgcaacggcctgttccacttttgattgggcaggagcatcagttgtctggtgaagtgttgggcattccaaccattgatcatcattttgaagtcgtgggagctcgggcattagaattagcaatcagtgaacatccgcaaagtattgctttgccggccgaactcatcattaataattaattacactaaattgaatagtaataagtccgctctttctgagaactgctggtcagaaagagcggacttttaagttatcgtgcaaatcgtagtcttgataattgaggtaaaagcaatatcgttaatgatagttgcggtgaagtcgcaattggacaggtaaaaaaatgtttatataattagttagcttttgttgcatttatctaactatagtgctaacataagcatcattcaaatcaaggaggacaaaaattcatgacagttaataatcgtgatttatttagtagttttgggaagttatttcaaaatcgggccttcgtcatggcggttgcccaacaatttcattttggagaccatggttctgagcgtggtcaaatgggaattttacgggtattggcggatgcacccgctggtttaaccaatgctgagattgctgagatcttggatattcgaccaagttcagttagtgccacgttgaatcggttagaagacgggggcttgattgaacgcgaaccaagtgcgcatgacaaacgggtggtgatcgtccggttaagtgaccgtggtcgtgagatggcggaccatcgcgcgcaaggaacgagtgatttagcggatcagttatttggtaatctgacggatgatgagcgcgatcagttacaacatttattagataagttgcgggccaatgcggatgacatcgatattcaagatttaatgcaatttggtcaacaacacggttttggcccacgtcccggttggggtcatgggcatcattggtttaattaaattttagaaacacgaggcataagagcagatggaacgaccacaagcagcatactcgcgtccggcgggtggtaaatttgatttaaaacaattcttacagttgattcggcacgctagccctcgttattggcaactctggttgggcttggcattaggcttattggcgactggtgcgcagttgatggtgcccaagtttgcccaaacgttgattaatgggtttagtcacggcgttaatcagaccttactaattggtgtgattggcttattcttgatcagtgcagtcattagcgcgttatcaggttccttattggggatttttggtgaaaatgttgtcgctaatttacgggggactttatggcataaattagtccggctcccggttcgctactttgacaacgttaagacgggtgaaatgacgtcgcggttggtgaatgattcgacgcagatcaaagacttgctcgctaacgcatttccgcaagttgtgacgtcgctgatgcaactagttggggccatcgcaatcatggtcttgatggactggcgaatgaccttgattatggtcttggcgattccagccgttttattagtcatgtttccaatcatgcggcagacgggcaagattggtcatgaacgccaagatgctttagctaattttagcgggacggcagaagaaacgctgagtgagattcgcttagtgaaatcgtccaatgctgaaccagtggaaacaacgactggtgcacatcagattaagacgttgtatcgaattggactacgcgaagccatttatgattccatctcaagtccagtgatgacggcaacgatgatggcgttattcgttggggtactattgtatgcgtctgcgcgggttgccagtggaacgatgacgatggggactttggtctcatttttaatgtatctgttccaaatcattggcccagctgggatgcttggtcagttcttcaccacgttagcaaaggccagtggctcgacggcccggattcgggagttgttgaatgaaccagaagaacaattgacggttggtgttgaacacgcagtcgccaatgagactttggcgatgcaccatgttgactttgcctatgatgatgatcaacaaattttacacgatgtcagttttgaagctaaaccaaatacggtggtggcgtttgcgggaccgtctggtggtggtaagtcgactatctttggccttctggaacgttattatcaaccaaccgctggtgaaattagtattggcgagcaagatgttaatgaactaagtctcaatagttggcggtcacaaatcgggtatgtcagtcaagactcggcaatcatggctggcacgattcgtcaaaacttaacgtacggtgctgatcggttatactccgacaatgagttgtggcacgtcttagaattagcttccgcggctgactttgtacgcgccatggcagatggccttgagacgcaagttggcgaacgtggggttaaagtcagtggtggtcaacggcaacggttagccattgcacgggcttttctacgagaccccaagattctaatgctcgatgaagccactgctagtctggattccgaatcggaggcgatggtacaacaagccctcggcgaattaatgaagggccggacgaccctagtgatcgcccatcggctgagcacaatcgtggatgcggatcagatttacttcattgaagatgggcatgtgagtggttcaggtacgcatcaagagctgatggcgaacgtcccactctatcgggattacgttaaaattcaatttaaagattaactaaaaatagttggttaccgagatattgatgtatagtatccaactgacttgttgatttaatagatatcagatattttgggagatagattagcttagatgagtgattgagccagttatttcgcgatggctggtatttgaatgaagacgctgaatttggaagcatggaaattatcaaagctcaatctttccaaatgtaggtgttataactaagatagttgctgagttcggattgctgatttgaaaatcatatgcaacaactgaatcatgcaaacacagtttgccaatcaaaagcgcacattaaaaggccaccatttctggtgaccttttaattgtgattcagaaagctagcttttagatatgtaaggcgaaaggtgccatcactggcgacccttcaatttattattatagccaagtcaattttctgtcgttagactgaatagagcatattgatttctagtgaagattataatagtgttgcgcagcaactattatcggttatggccgaaacaaaccatgtatgtcattaatgaaatgctaataatcatgccatccactaaaatagttttaagaagaatctgtttaagccagaaaacgttagctgatgatagtcgaaactctgaatacccacttttattttgctcccaataattcctcgtaagttttgaagtacgactgaaccaccaagtgaatccataagcggcgcaattaattattgtggcctccactggatatccatttgccattatgaaaatttgtcctccagtactgagagccgctatgaagctactaataaaatagccgattaggtacttctttgctgttggattattttttagtggctctaataaatatttttttctggcgttgatacgtgctcggaggttgaagaaactggctcgcatcttaatgcttggcaaacaaagaataactagccctattataaagagatttattaacgctatgaaaatcacagtactaagagtgtttgcaaccgagttagattgcatttgcatcccccttacatggtcttaattataatttttggtactcaaaaccgttattatcaagcaacagccgctaacaaagtgataatgaacatcatcataactgctaaggacgattctgttgaagctggcgtgggtgtgaattgtaaatctggatgcaagttattaatatagtctagagcatttgcgggaatactcaaaatagtctttagattattattataatcagttgcctgagtttgagtaacattaactggtaggggcgctatgaattcatggaagtgaatgtcaagtgtaatttcatattcaatagaatatgttttcccattgctggcagtgtgctcaaacgttgatttaattttcagggtaatcgtcatgagagaagttttaatagatgtattacttgaaatatcaccattttttatgacacccgcaatttcgttcatagcatttgtcatatcagatgaacctaatgcagtttcattctgtgtaagtaactcttggactgcatcactaacagaaaaactggtactaccatcatttaccttatatgtcgctgacacggtaccatcgtcgtcactaatgcttccttctaaatcaacttttaaagaaaaatcagcagcgggtgttgaaattgtgtacgtgtcactaaacgcttcaactgagacggatttcacaaaattaaagtaagtatttgtattgcctagtttctgaataatttcattaattgcgtctaaatcatcgcttccaccaacgctactaccagctgagaagtcatccactgccgtcgagcggctactgttagaagctaccttatcaatgtaaaaatcatcaaaagcaacctcattaaattggtcaaaggcccattcactgggcattggaaacccgagattacccgaaaagccagtagacatatcggatacaaaagctttttcggctaatccatccacaataatcgtattggcgacgtttcttgtggcgtaaataccaacttgaaacccgaaactactgatcccacttgccacgccagtgaagtatggttcgaccgtaccagctatgtcaccatcctgaatatcgacgtccacggcaaagtagataattgtatcatccgggaaacctaattgcatcgctgctaagccagctttacgcccatcactactgcccttagtttgagtgaagtagtcttcatcatcggatgcaccgtcttgataaatagggaaaattttcaaaccagcattagttaatatactgatttcactggtggttaggtttttatcaacctcactgcttccagtaccggctgtcccagttaagtagcgaccgatgtatttgtaaccagcagagctaagtgcggcggcttcactagcatcaatttggtgagatgtctcgcaagcaacagcatcgcggtcagggttaccggcagaggttagaagactcatgaaaacgtccaatcctgctgatgcaccagttgtttctggtagggccatatcgttttcaaaagttgctactgagcttgatacatctaaagaataactgccatcaaaagcccccgtatacgcttgattatttacataaagaccccattgtagtatacgaacaagattattattatcaccagttgaaacagttggagtcagttcttgcgtcattggcccataagttccagaggcagtgtcggtatcaagtccttcttcggcttgtaaagcataaatcaaagcggtgtttgtatcgcgttgataaacgccatcacagggtagaatgccagtataggcgagatagtcatgatttaattgttgttgcatcgtacggatcttttcatagccatccgcaaccagggtgaaggcgctcatattgagtagggcagccatgaactgagaatccagggtaccggatgtatcacttaatccagcgtattccttcatggttgtaactgccgatacagtatcgctagtgaactcgccatcaaaagcggcggaatcaatgcctttacaccagaaaccaccctgtataatatatgcgatattaccagaataaccaggtacaatatcatcagcaatttcatcaaagagctttgcagttgttggcccaaagttatcaactaaatcagtgattcccagttcatactgtaaaccacgagtaagaccgtaaattgtgtcccagccagtaagaccattttctggaacactaccaaatccagcgacgtcaccgtacgtggagtttaaccattgttgagtatctaatactagttgatcagccgtagacacgcctccgtagatttattttgataaagctttattatggactgtttcaccggataaacaagtctagctataaaacatcacctaaatttcttggaatgttcataaattcaaaacgtcatctttggaaatttagtcatgcaatcttctataattggatggaaaaggtgtttttatcaataattcaatgatgcaagatttggaattactgttgcctattcccaaaactatgataattaaatctaatgaccaagaaattaccgcatccgtcacagatttaaataactggctatgcaaggacttggaatggaaaactccaagtgaatttttttcagtaagtgaacccttaaaattggacaatttgtcatagtaaaaaggactgcttaacttgattttaagattcgcttagcttctttattgaatagggttcgaaaatatctagttggtcataacactacaatataatagtgataagttgttatttccatgaaaataatcagaaagtattttaggtttagtttgcggtctggtctgtgattttcaattgttggaacggaactgacatcgacttagaccgttgtttgtagttgatacaactagttaaagggcatgaaagataattgaaaactactgtatttgaagtttgacaaaagaatatacattttgttgattaagcgctatcattgttatgataactagtttaattgataaaggaatggtaaaacgatgcagtcattaggagttattgatattggtggaacgaccattaagtttgctgtgtggcaagatcagcaattagttgctaagaccaaagttacgacgcccacaacgctagctgaattttacactttgctaaccacgcaggtcgcgcagatgaaacgcgattatcaaattgctggtgtaggcattagttcgcccggggctgtcaacaaggcaactggaattattgagggtgccagcgcactgccgtatattcataattttcggattcagccggaattacaacgccgttttgaattaccggtcagtatggaaaatgacgccaattgtgcggcgttggctgaattggcggatggggctgggaagcaggttgctagcctgtgcttcttaattgtgggaaccggtgttggtgggtcggtcattgtgaatcatcaaatttggcacggcgcgcacttattcggtggtgagtttggattcacgctcatgaatgaccatcagatcttaagtgagttaggcaccgcggtagctgttgcgaagcggtacaacgcgagccatccagctcaacctgagctagacgggcaagccgtgtttgaactggctgccaagggtgatgttgatgctcaagctgaagttcaagttatggttcgggccttagcgcgggccatctacaacttacaatacagctttgacccggaattgatcgtgatgggtggggcggtctcgaataatccgcatctactcccagcaatcaatgctgaaatcgaaaaattgcgggcaacggtcaaaattgcttctataaaaccagatgttgtggcttgtcatttcaccgatgaagctaatttacggggagcggtcgttgacttttgtcagacgtatccggacattcaaaaataaaagtctgaaaagtcgatggcaagcaagttattcgcattccaacgcaaacttacttagaatagtcataatgattataaattctaagtaaggaagtatggactgatggtaatgcgtgatctaaatattggcacgaaagtcgggttaggcgtgctcaatgaccggtgggccgcgttagtgctgatcaacctgaaggcggcgccaactgagattatgaatttgcgccagcgagttaggggtcttagcacgcttaaactactgaatgttttagctaaattaaccgaattaggattagttgcgactgcagggaactatcaatttcagttgacgactgcgggcgttagttttcaaaagcaactgcatcagttggaagtgtggggcgatcaaatgatcgtgaccatgcactgaatataataagtattgactgtcgtgactaaaagctggtcgtaatccacaattatgggattatgaccagcttttagtttggcttctagttattatcgtccccaagcggacggtcggaaaagagatggtaagcctcggtgtagcggctctgaacgataatgttggcgaccacttcaggtggctccggatggggtttagtcagccagtgctgaataattgtcagcacgccactaaagtagattggcatggcgtagtcagccggaatcgactggaaatattgatgatttaagggcgcctgctcagtagtggcgagtaaattatcaatgagaccggcctgaagctgatcaagaaactgtggatcaccatgggggccaagcaaggcctgaaaactagccaattgggtgttgatattcgttgttagttccagataggttggataagcattatgcaggtccggatgaaccagggcagcttgaatcccttggttaaggacttgctttgaaacggttgcttgttcgattaaagcatgttcgaaagcgtgaatgaagtcgtaaatatcttgaaagtgactgtaaaaactcccacgactaacgtgggctgctttgacgaccatggtgacagtcaatttaaagatgggggtcactgtcagtagtgctgggacagttgcgaacattttctgtacggcaagcggatagttagttgtcatcatgtcacctcctgtaaatggtcaatttgacatcaattgtacatttccaacgcactcgtttggtcttagactatggttattctaaaaaacgaggtgcagataatgtcaaaaattgattttcatacccactatttaccaacgagttacgttgaggcactaaagcgtcatgttccaggtgatcctgatggctggccgacacctgagtggacaccacagcttacgcttaactttatgcgtgataatgatattagttactcgattttatcgttatcatccccacacgtgaacttcggcgataaggcagaaaccctacgcttagttgaagcggctaacgacgatggtaaaagcttagcccagcaatacccagatcaattaggatacttggcgagtctaccaattccttatgaactggatgctgtcaaaacggtgcaacaggctttggaccaggatggtgctttaggcgtcacagtgccaaccaactcacgcggactttactttggatcaccagtcttggaacgggtctaccaagaactagatgctcgccaagcgattgtggccttacatccaaatgaaccagcaatcttgcctaaaaacgttgatattgatttaccagtgccgttgttgggattttttatggataccacgatgacgtttattaatatgttgaagtatcacttctttgaaaaatatcctaatatcaaggtgattataccgcatgctggtgcttttttgggaattgttgatgatcgaatcgcacaatatgcgcagaaggtttatcaggtggatgtttatgatgtgatgcaccatgtttattttgacgtagctggagccgtgctaccacggcagttgcaaactttaatgagcttggctcagcctgagcacctactttacgggagtgatattccatatacgccgttagatggctcgcggcaattaggtcacgctttaacaacgactgatctattaacaaatgagcagaaacaagcgatcttttacgataacgcccatcgcttactgactgagtaagtgatgttaggataactgttgaatttttggcgtgaccaatattaaaaaccggaacacctgttaattactggtgttccggcttttttacgttattgttagcataattagttgggctaatctgctgtacgggtaatgcaagtaatcagaaccctcgtctaaaaataaagtggctatggtgttgctgttttagccattgtctgaccgactgttgcggtatattcacgttcaccaagactgttgggatgtaaattatctttgacaaaccagttgtcgttgtcttgcgcaacgtatagccaatcaatgagatgcacattgttatattttttagcggccgcggcaatcaattgattgttagggtcttgccaatctttgcctggaacgcgggtgttgacccagtaaatctggtggttgctgccaatctgatcaatgatcccatcgatttcggcggcacttgttggaccgttcgtccccaagttgatcagcacgtttttctgaattgcattatcagcttttaattggctaatgacggctggtgcttccgacacttggcgaccaaccttggcgttaacgttaaaatggtcaaagatttgttttaagtcactcgtggtgcggaccatgattgaatcaccgatccccgtcactttaagtttgcgcaggacgtgaatttcactagtggataattgatatttttcaccaagggcactatccgaaacggcgtgtgtagcgcccttagttttagtattccccgtaatggcgttgccaatactgacaacctgttgcttaatggttggtgttggaatgattaatgcgccaccaatgaagacgacagcaaagattccgaccaaccaataaattaatttttgatgtttcatttggcacctccataccccgctataagattagcttaccaccattacagtgtcaattatgaaatttatcataaggtgcttaaagtggtgtgatggcaggtttgtcagtcggactgtctaagttgaatttgaaaagatcattggaaagtcaactggtgcttgttagactaaggctagtgcttttggaggtggttaaatgcaaaagaaaacggtgggactgttattagccagtgccgggccttttttgtggggaagctcgggaacggtggcgcaacatctatttgacaccacaacgatttcgccgttgtggttagtggcggtgcggatgctagtatctggaggtctgttaattttatatggatttagtcgccggttaccggtcatggccgtgtttcatgactggcgggcaacggtgcgtctgattgtgttcagcctgttcgggatggctggcgttcaattgacttattttatggcaatcagtactggtaatgcggcgatggccgcaatcttgcaattcttgtcaccggtgatgattattatctttatcaccgccacgacttggcagcttccagggaaagtggacgtcatttctgtggtctcagcaatcgctgggacggttctaatcgtcacggaggggcacactgactcgctggctttgccagtaattgcaattatctggggattgttggccgcggttggtgcaaccatctacacattaatgccaacaaaattattaaaagtgtatggcgccacacccattgttggttggtcaatgctgattggtggtggcttggtgctagtcggaacaggtgcttggcaccattcgccgcagctaacctgggtggcgtgggggcaagtcggcttcgtcgtgatttttggcacgatgctggcctacttgttctttttacagagcttggaatacatcctaccaacgactgctagtgttctgggagctattgaacccctagcagcaaccattttaagcgtcttatttttgcacgttcactttaactgggtcggactgattggggcgataatgattgtcggggtaactattttgcaatttgcagcgacacgcgccaatcagtttgtctctaagtgagcattgattggtatagatgggaaccaaacaatatatgaacatattaatcgttttattcacaaattctattgaaaatccatcttgctagcgtatacttttcgatgaaggatattatgttacgagggggatttttttatgaagttaagtaagcggggactattctggctacttgggttagtaagttttgcaattttactactatttagtcagccactaggggcccaagccgcgactaattatcatgcgaaggattacacaaccgccgcatcggtcatcaatggccctgattttaagcacgcagatactattcaaattcagtatcaaatgagttttggtgatacggctttcaaagcgggggacacagttaccattgatatgccggctaatttggaaccacggaccgttggggctacttttgatgtgactgatactgagactggtactgtgattggcacgggtgtcgtcggcgggaatggtcaggtcgtactgaccatgaattcggcgattgaaggtaaaactaatgttaagattgatgttaacctgggaatgaagtaccgttatgatgacttaggggaacaagacgttgtgtttgatacccaagacggtcaagatacatcagtgatcaatatggttgctaatgaagctaatatgtctaaaaaaggcaccattgataaagaaaatggcacgattaagtggaccttacttgttgatcggcgtgaaattaccatgaaaaacttatcgattgccgataccattggtgatcatcagcaaatgatcaaaggtattgaagtctacaatggtgaatggtcgagtgccaacacttacaagcggcgtgataagcttagtgacgatgcttatcaagttaactacagcgataatggttttgacttgaaattcaacgatacagtcagcaacctagttgtcatcgattactatactaaaattacggatacagaattaattgatcaaaattatcattttaaaaataaagctgtaatggaatggggcggcggcacgtccggtggcaagaacagcgaagaagctaacggtaaggtctacgaaaaagtcgttaacggtgggagcggtactggcgacttaagttccagttcgagttcgaacagctctagctcaaataattcgagtgacgtcgattccagttccgaccattctagttctgaaagttcaagcgctgtggactccagttccgaccattctagttcggaaagttcgagcgttgtggactccagttccgaccactctagttctgaaagttcaagcgctgtggactctagttctgaccactccggttctgaaagctcgagtgatgtaaatactagttctgagagttctgacaatacgactacggaaccagacaatggccatcagactggtgacattgaagatcccgaagataatacggcggtttatccagatatcgatgaagatactgggaccatcgatgttgatggtgggttcgatagtaactacgatgggagtacgacttccaacagtactaattcgtcaaaaccattgaaagattcaacttcgagtgtctttacgagtacgcccgctaacacaacgacgggccaagatggtgctgatcaaacgccagcagcggatactaaaaagtctagtgctaagacaacggtatctgaaagtgacgcgttgacctcatcaacgcctaaccaagttgctaaattgccacaaactaacgaagctaagatggacagtcaagcgcttcgttcagtcggcattttgttaggtgtattaacgctaggtggcggtgcacttatccgtcattggttttaaggctaactgatagccctaaaatgatgcacatataatgttattttttaaaacggccttctgttaatttagaaagccgtttttagttagcggtcatttaatagctaacttgaaatagttagattagttagcaatggcgaccatggtcgttagaagggctcactggttaacgcacggcaacattagtttatgacgggttcacaagcggctgctgactacgttaatcgttattagtcgcaattggcataactggttgcgcaattcgatttgattttaactggataatgggggtaaagtaacgaatagatagaaatggaggtcacaagatgagtaaccgattgatttttgatgctgactggctggtgccggaacaggtccaagttgccgggcaggctattcaatattatgctgcccgtaatattcagtacgttcagcatccagtcgcagcgattcaggtcctaaacgtctttgtaccagccgcatacttgcatggcagttcagtcaatggttatcagcgggcaacggcgccaattctgatgccgaatacggtcggcggttatttgccaggaccggcggatgatccgcaacgtgtcacttggccgacgaatgcagggacgattcaacaggcacttaagcgcggttacgttgtggtggccgctggaattcgcggtcgtacgacggttgataagtctgggcaacgggtcgggcaagcgccggcttttatcgtagatatgaaggcggcaatccgttacgttaagtataatcagggccggctgccaggtgacgcgaaccggatcatcacgaatggaacgagtgctgggggtgccacttcggctttagcgggtgcgagtggcaattcggcttattttgaaccagccttaactgcgctcggggcagcaccggcgactgacgatatctttgcggtgtcagcttactgcccgattcataatctggaacacgcagacatggcctacgagtggcagtttaatggtattaatgactggcaccgttatcagcctgttgcggggacgaccaagaatgggcgaccaaaatttgaaccggttagtggtcagctcacagttgaagaacaggccctttcgttggcgttaaaagcccagttcagtacttacttgaaccagttgaaactcacggccagtgacgggacgcacttgacgcttaatgaggcgggaatgggttcatttcgtgatgttgttcgccaattattgatatcatctgctcagacggcattcgatcaagggacggatattcataagtacgcaggctttgtcgttactggaaatcaggtgacggacttggatttatcagcttatttgaagtcgttaactcgcatgaaagccgtcccggcgtttgaccaattagatttgacgagtccagagaataatttgtttggcgatgcaacggcgaaagccaagcactttacggccttggcacagacgcgaagtacggtgactgcacaactagcggacgctgagctgattcaggcgattaatccgctcagttacttaacgacaacttcgtcacaagttgctaagcactggcggattcgccacggtgcggccgaccgagatacgagttttgcaatcccgattattctagcaataatgttagaaaatcatggttatggcattgattttgcgctaccgtgggatattccccacagtggtgactatgatttaggcgatttattttcctggattgatggcttgtgccaatgatttgaatacgatgagtgaaagcgaccagcgagggcatcgtgcctggctggtcttttcgtttagttggcaacgataatgtgatgaaaatacgttgacaattttcaaaacacgtggttaaatgtagctattctcatttttatctaatcatattcttattaatttaaagggaggcctacatatggaagcaactacgaccgcggctaccgcgacacataagatgagtaccatggattacgtttataaagtttcggcaggtgtttctaatgctattttagtttgtttagggattggattgttattgcagtcactcgcgaattttgttcactgggcggcattataccaagtcggtgcgattgcgcaagtgttattgggaccggcatttggagtcgcgattgccacgatgctcaacagcaacacgttagttacgtttagcgccatgatttcgtcgacgatcggggcgaacgccgtctttttctcgcagtccgcaactaacggcgtcacagcgacggggcatacgttggcccaagcagctcagagctcgatctttaccaccggtcaaccgatttcggccgttgcggctgggttagtcgcggttctgatcggtaattatttaactggtaagacgccgcttgatatgatgttggtcccgttagcggccacttttgtcggtgcggtggttggtctcgggttagcagccgtaacgacgcccgcattggtctggctgagcaagttcatcgcgacttcgatgaaggtcaacccattgatcggttcgatggccgtttcacttgcctgggcgttatttttaatgacacctgcgtcttcggccgcattggcggtggcggtcatgttagatcccgtctcatcgggcgcggccttaattggaacaaccgcccagttcgtgggctttacgattatgtcttttcgccaaaacaacttgggggccaatatcgcgcaggggattatcacgcctaaagtccaatttccaaacttgctggtgaatccacggttagcgattccaccaatggttgctgcggttattgccgccccggtagcgacgattgcctttcatttttcaaccagttacaagctggccggcttaggattgaattcgttaattgcaccgatttcgttagcatcgacgaactttaacagttttatggtctatctcttgactggggtgctgatgccagcagttatttcaatcgtgctgtaccgcattctagttgcggcaaagtgggtcgaatcgcagcagctacagttggaaatcgtttgatgtccagccgatattaagagcctgtttctatgactgatgtgaaggccatggaaacaggttttttgtatagtgttagctgtttgttcaggatagggtgagtgctcaggactatgaaatgggacgtaaatccactatattaaaggtgtgaataatgaataagtgagatgacatcgatggaatttaagattaaacgggatgggttggcgttacaggcaaggttggagactccggcggcaccgagctcaacgctagtcatcttaatgcatgggtttacggccgatatgggatatgatacgacctaatttgtgccgcaattggcgcaggcattagttgctcacggcttggcagttctgcgttttgacttcaatggtcatggccgtagtgaaggtcggtttcaagatatgacagtgattaatgagattgcggacgctaaagcagttttagatgaagcgttgaccttacattatgaccacattgtcttggcagggcattcgcaaggcggggtggtagccagcatgttagcaggatattatccagacgtggtcgacaaactgatcttgatggcgccggccgcaacgttaaagtccgatgcgcaacaaggtgttctgcaaggtgcgacctatgatccacaacatattccggcctatttgaatattcgtgatggccttaaagttggtggcttttatttgcggaccgcgcaacagttgccgatttatgaggtagctcagcagtattccggttcggtgacattgattcacggtacggccgacacggtggtctcgccacaggcttctgaaaagtatcatgaggtctatcagcacagtcagttgcattgggttcaggacggtgaccatcgctttagcggcgatgtgcgcgctaccgcgatccaattagcactggccgcgtttaaatgatgacttacgccagttaatataatgttaggttagttaacgttggtgagtttaaaggcggtgctgacaaattagtttaatgttcaatgaaaataaccttaatcttttaccggaagacgcctatactaagagtagttagttttctgaaagtaaggtgtgcaacgtgaaaagtgaagtacagggaatcattcaagatttatatcaagaattagcaccaactgcggcgaatcaagaaattcgggcagcactattgaaggcacaccaacaattgaaacaggcgccccagcttgatcatgcgctaattaagcggttaacgaatgacgtgacttataatatttttactaaacagttgcgcttgacgccaactgaaaacttattggttagtgagttactatcggtcagtcatcggttgagtgcgtaatggctgaaccagcgactcattttggaggtgggacgatgcgccgaatcatcgcaatcgggaaagcactagtgacggccggatggttaataacgattattctggtgggttacggtgttagccgtcagctcaagcggacactattcgagtagcaccctgttatcggttacaaattaatttgctcaatctaatgaatataaaaagcctcgtaaattaacgcattatcataagcgttaatttacgaggctttatttgtgataccttcgaacaactagtattgactaccgaacaagttaccaatttgattggcaaagtcagttgcgtgactgagaagtgcagtctgtaaatcctgcagaataattttatccataaagtagaacagcaggctaacgactagaaccgcaataagggctaggtagacgcggctaattaatggttgggtcaccgacttgttaatgacgaagatcaaacctaattgccagacaaggacactgacactcaacaggataatcgaccatctgaagctagccgcaatggtaaagaagttatcaacactgaagttaactagggacgaagcaaaccataataataggttcacaataattgcgtaattggttaactgaccgaagcgtttcatataggtcgtaaagccgactttggtcccacgacttccaagtaagcaagtgacatagccgacagccaggtagaagcacatgccgattaggagacataagaaaatctttaagtcggtggaaaaagctaatttactaatgtggaaatagctttgactgtcattggcagtggtcagaaacttattactaatggttacagcggccaacgtcatgaatagtgcttcaatgacaaaggaaatgtaactaaaataactttcagttcggacttcacagctaggatttttccagctagccaagagccaactaaaataattcttagcagatgattgcagctgttggacttgttggttagtagccgtccgtgtcgtatcagcagctgctactgaacgtgatgctgtttgtttttcagcgctggccgattgttgttgattggctgaagctgtgctggtatggacagctgcttgcgtcgttgcagtcgttgtttgggtagctgtggctgaagtggcgttggccgttgccgaggccggtgtcgctttggttagatcgtaaccacagtgggtacagaactttgcattggcagcaatctcagtgccgcagttgggacattttttcataagttaaattctccttcattaatcatcagaatcatcggatttagtgtacgatcgaattttttgggccggcgtgattttaacaatcttgtagtgccccccggttttctcgaccgtcgcggtgtaacgaaagacctgaatgcgttcatcttcagagttggtaaagtcatatttgacgtcataagtgatctggctttgttgcttagctgctggaaccgttgataagacagtcggttcataggtgacatcgaggacgtcatcattgtcgtagtagcccttcgccatttggaccagttctttgtagtcagtgttatcggtaccgttgacgaagtagtcgtccaaagtgcggtcatcgtaatccgaagcatccgataggtcaccggtggacgtataactgctgacagcggtgaagataccgttcaggtagtccgaggcagtatctttactcatcacaccagcaaatttgaggtccacgtcttgaccctcggcgtcactaacgttagtctgtttggcggtcaatgtttgtgaaccggctttgtatttaccagtcaacatcatgcgattagaccagggaatatcattcagcgccagtgtgccactgctgttaatcgttccttcattttcgccattgatataaacggtggtattcggtgtaccattaacggtgaaggaaattgtacgtaaatctaagtcgtaagtttggccgtttgcccggaggtaataggtgcccttattggtaatctgatggccgctaaccgttcccttggcagtcaaggtgtatgaaccaggaacatacggcccgattttatgctcgtaagttgctttattagatgttgcgacgtgcttaccattaacgctgagtgcaacgttacggtggttcgtcgccagtgtggcataaacagaagtgacttgtagttgatacttatcgaaaaacaaccaggatttacctgttttaacgaactgaataccgtaatcattagtcgcagaacgacttttaagcgaactagccagtgatgctaatgattttcgattgtttttaaagtaagtgaccatcggcttgacgctatcatttgtaatcttgagtgatgggtcagtgctagttacttgcttcgctaaaccttttccagtcttgagtgcggttaagtcacggtcgagctgattgagcggctgataataattctgtccatacagatagccgccaatcagaatgacaacgataacggcaatcagaccccaaccccaagttggcatatggcgttggggttgttgtcgaaccttgcgcgtcgaacttgttgttgactgcgcggtgtttactgatggcgatggctgatcagtggttgcgtgcaacttaaaaccgcaattaggacaaaattcatccgttgcggccaccgcttgcccacagttaggacaaaacgatgcttggccgcgacgatcgtcagcggctttaaaaaattggtgctgtttatacattccccgatgctcctccaaaaatagattgattagtcgacaataaaaaactatttactggagtcttcacagtaaatagccgctactatcaatcgagttaaaattctgaataagacgtgtcacttgaatatgaataataagtgctaatcgatgaataaggctattggatgactaatcatcgttaataacttaagaaagtctaaaaattattaacatattttaaagtataaacatgattaaactgtttatcaatgtttacacggcgtatttatttagtaatgccccagtttgcacaataaacgacacgtcacgcactaaaaatacgactcggctaaatactgtgccggttcgttagtcatgaattatgattgaaacgtgccaagtttagattgttattcgtcagccggtgcgcgtcctattccgacctccggggctgggtgacaattgctggaacgtagccgacgtcgatttgagct

SEQ ID NO: 33 - DNA, 31277 bp, Lactobacillus plantarum
agttttcagacagtccctagaatgattgacaaaaattcacagtacttttcttcaatctcagcccatgccaatcattgaattcacgagcactgccttatccaccaaataggacgatccagctaaccataacagtttcaaaaaccaggataatattcaacgttcgatacgctgataatcggtccagtttatattggaaaaatttccgaatactaatcagaataaataaaatatttccgattacctccattaccacgggggtcggaaaattttctaaaaaaacaatcatcacaaaaactaattgctcttctggtgaataatcctcagtcgcaaacttaaaccgactcttgggcgtggttttccgccatctaattattcgcaacaatccaaatgccattagagtaattattaattccggcacaacttggagcacagcactgcgggaatgaagcagacgaatgtaggcaacgccacacaagactaggtagattgctaataaccaataatcgatttttaacaattgctgctctgataaactgccatattttacttgaatacgttgtaataatcgattccagcgcttcatcaaatcacccttacaaaaactattatcgatgctgaatggagactatcaatttaaactttataaccgctgagaggacttcaaacaatctttattatgtattgtgactttttcgaagaataatttagtttaaagtcaatatctgcgctaacatttcatattttgacatcttccaaatttgagtatattcattaaaaccaataacccatctcaacgatattcaaaattactggttttaattttctcaattcaatagcgacacttttcagtaacaacacctcagtgttatggttactaacattcacctgctttaacacaaagtactcttttcaaaaattcatacattattctaatctttttcattcaatgcttaattccatcaactaacataaaacaataatagttaatagaatgttcaaaatcatcagataacgatacacgcaatgttcaattcaccacattaactattcgttcagtttaatgtagcacattaattattctaagcgagaaaaattcccagatatgggaaatcatcagcaaatccagttatttaggagtgtccagtttgtctaattcagcttcaatcggtgcaactgtcaagatggttcagcatgctaaaagactatcagtcaatgatgttactaacaatgaacgcattatctcaaagtcaacttactatcgcttcatcaacggtcacagcaacatctcggctgtttgctttttacagctactagagcggttagaacttacccttcaggaatttgacttcatcttacatcactatcaaattcccccggttgaacaattgctgcaacaaatccaaaacgcagtcgtcaaagaagatattggcgagctttggaaattaaagaagcaaattgacaagctatttaatgcaacgcatgctcatcgttatcaacagttactaacgctaacccacctggctttgcaccacctagaaacaccacaacaggcactggattcaacgttacgagcagcgattgacgggcttattcaagacctattgaatcttcaactgtggtccaaatatgatttgatgttatgtcgccaaatcttcaccactcttacgccagagcagcaaatcatcctattaacaagcgctaataaaagtttccacaaatatcaacggttgactgacgaagctttaaccttcatgacatttctagccaaccagctgttcgttgctgttcacgataaacagcccaagctaattactaaaatatatcctataatgacaacgatcaactttccctctgaccaactcgtccagcattactactaaaattctgtcagggcattacggactacgtgactaagcccaaccagccattgaccgcctgtagtcaagcacttgatattgtgcactgtttacacatccaatactgggacacgatttttcaaaacgtcttactggacctaaaaacaatgccaatataaaaagcctgggtttccccaagctttcaagcaaaattaatgacgtacacgccgccaatacagtcccgcatacaccaccgtcatcacgacgaccacgcctaacatgtatacgggcaatgtcacgatactaccgtggtggagccaactcattaagtaagttagcacactcactagtagataataacccaggctaaaccagccactggcacttcccatcaccgtttcatagccaatcaaagcacgattcaacgcgtttggtagggtgatgttcagacctaagaaggctagaaaaatcccaatcagcatcccaatgacgtgattgccaacagcggtcatcaccaagccaactgccgctaccaaactcaatcctaagccacttaaagcgacctgcattggtgaccaatagttgacaagccaattcactagcaacgcgcccagcagactggccgcggctaagactaaaccgagactaccgtattgcacagcactaaagccgaagtgcgtttcaaaaataaacggcgcttcagcgtaataactaaacaaaataccattaataccactaatcaataggccgtaacaccagaccacgggatcgtgcaataaccgtgaaacgacaacgctttgttgccgccaagaggccactttgaccgtttctggtcgagtctctggcaagcaacaccccgcgtacaacagtattacgactgctatcatgatcaagaccgagaagacatgctgatagccgaacacagtctggacgccacctccgatgagtggcccgagagcgggtgatagtgccatggccgcactcaccttcgcaaagatttttgcaccagtaacacccgtaaagctctcacgcatgatagtctgtgtcacaaccgaaccagcactagcaccgaaagcttggatcaagcggcaaaccaataaccaagtaaagcccgggctcagatataaccctaagttaccaatcaaataaaaggctaatccacctaacatggcatcacggcgcccgcgatagtcagcatattgcccccagaagagcaccccaactgcaaaagccacaaaataactgctcatggttagctggctgtggctggcgctaacgtgcattgcctgactgagtgctggcaagatcggcgtaaaaattgattcactgatttgtggaaaacccactaatgtgattaatagtaataatgatggcacttgtttttggacgtttttcatttaattaagtctcctaaatttaattaattttcggaaaaacgtccttttccatctacggagacgcatacgagaatctgttcatacttcatatgttctcacctcatttcttgttcgtactactgtacgggagattaacccatttgtcaaaaacaactaaaataacaattgaattacaaataaaaaatcgagctcactagtcagtgcgcccgattttttactcaacatttagtttttacgaaatcaatgatccgtttaccatattatctggtaccgtaattaattgcacctgaccgtcgtgttctgctgacagtaacatgccttggctcatttcaccacgaagcttccgtggctttaagttaccaacgatgataaccttcttgccaatcagttcttccggttctggataccacttagcaatacctgaaaggatttggcgatgatcagcatctcctgcatctaaacggaattgtaggagtttgtcagcccctttcaatttctgcaccgtaatgacttcagcaactttcaattcgaccttgtcaaaatcatcaatggtaatcgctggtttagtgaggttcaaattagtctcagctgggttccagccttgttcgacttcagcttcatgtttcgcgttttccatggctttacgccccttctgtttgtcggatttcgtcatcttacccttcaagaattcaacttcggcatccatatcgacccgtgggaagattggggttcccttagcaacgacttgtgcgccagccggcaaatcagccagttgtaagtcggcaattgctaaagttgctgggtccaaccctaattgggtaaagatttccttaggtgcatgcgtcatgaccggactgatcaaactagcaatcacccgcaaactagctgctaaatgggccatcacactggctaacttatcagcatcattcgcatcgtcactcttagctaattgccaaggtgccgtttcatcaatatacttattcgtccgactgaccaacttccacacttcagccagcgcatctgataaatgcaggctgtccatgcaagcgttgaagttcttaatagtcgtggcagctgtggcttctaagtcagcgtcaaattcagtcacaccggctttgaatgctggtaattgaccatcttcatatttattgatcatcgcaatggtccggttcagcaagtttcccaagtcattagccaagtcatagttaacccgcgccacaaagtcctctggtgtgaataaaccatcgttaccataaggcatggctttaactaaataataacgaagcgcatccaagccgtaatgttcaaccaatgtttcaggataaatcacgttacccttagacttggacattttgccgtccttcatcaataaccaaccatgaccaaagaccttcttaggtaatggtaacccgagtgcatgcaaaataattggccagtaaatcgtatggaagcgcacgatttctttaccaaccatttgaacatcggcaggccagaacttgttaaacaagtcttcggagtcgccggttgcgtaacccagtgccgtaatatagtttgtcagggcatcaatccacacgtaaacgacgtgcttaggatcactcttgacagggacaccccaagtaaagctcgtccgagaaacggccaagtcttccagacctggtttaataaaattattgatcatttcggtcatccgattagctggttcaataaagtcaggatgactttgataataatctaacaaccaatctgcgtacttactcatcttaaagaagtaggactgttctttaacaagttcgacttcatgaccactgggcgccttaccaccaataaccttgccgttatcatcacggaaaacttcagccagctgcgtttcagtgaagtattcttcgtcatcaacggagtaccagccttcgtactcacctaagtagatgtcaccatttttaagtaaccgatcgaaaatttcttggaccgcgcgttcatgataatcatcggtggtccgaataaacttgtcattagagatttctagcaattgccataaatccttgatttgttttgccatcccatcaacgtatgacttcggatcagtgttcaatttttctgctttttcttcaattttgaggccgtgttcatccgtcccggttaagaagtaaacatcgtaacccatcgcacgtttgtaacgtgctaaagtatcgcacgcaattgtcgtgtatgaattaccgatgtgcaacttccccgaaggatagtagatcggcgtcgtaatataataagttggttttgtttctgccatgacgtaaattcccttcaaactggtttatgattaactcgttaagcatgtctttgattaaaatccatgaacaaatcacacgcgtccaaacaacacgtcttggtctaaaataacatgttgctgggccaatgtgtagaatctcttatattgtatcatatttcctgtgtttattaagaaacactaacaaaagagttctccacacgcaaagatcgtggcagactagtcaactaccatgcttcaaatggcccaaccaaccaccacaaaataaccgattaaaatcacgagttgattttaaccggtcatttattggtaatctattattattcaacaacccacgaatatcgggccagcgcttcacgaacgacttccgcgatccggctatcgtccggccgacaccacttataatcataaacttccgagtcgactttgagcgcgccactccccgcaactaaaaaacaatttaactcgactatttttcccggttgattataggccgtaccacggtgggtgaaggcccacttaaaccgatctggcgacacaactaatgacaactcttcttttaattctcgctgcagagtctgtgttagcgtctctcccacaccgaccttgccaccaggaaaataataagctgtgttttttgattcccgtgttaataagacttttccatcagcgcagaaaaccccatttgcgcaaataatatccggttgcatacccaatccgccccaatctatattgttatgacctaacattcgattctcaacaacacttcaacctgccataactatctgcaactcacataatggcaggcaactacttagttgcttgaactgaagtcagtgtatcttaatcacgcacttttctcaatcaccctaattcacctaagaatcatgaattaaggtacttataactgcctagttttaaggcagtcccaagccatcgtatccacgaccaacgagataattattaccaaaactaaacaggaatttacataaactacttcttgactttacactaactttacttccaaatgatgtatcccaaccgttcgctttcaaatcagatggctaaggccatattgattaactaaggtgtaagtgcaaaaaaatgtagcggcagctcacattattgaatgtcccaactaccgctacatttttagttgtcatgattcatcaattaaagaatattcaaccgtactaccaaatttcaacggttcacggtcatagtgactgtattgatccaacatagtaattcaactgataactcgttcaattaagcaaagtatcacatcaatcactcataaatcattttaaaacaagtccagttgatgcggtcctaaatcaccaaacgaaacgcctagcaactctttgagtgccatcgcgttatcggccgcgtcaccaccagaattattattaaagatgacgcaaacctcgtccgcctgctgttgtaactgttccaccgtttgcttgaattcagctagttcttgatcactataccgatataaagtccgttggctacgccagttagcgcccttggctgaccagccctgctggttacgaccatgtaagcgtaagagtgccaatttcgaattcgttacgaccggctcgaaactaacgccatcatttaaagcgtgcggctcatcgacaatcacatgggtaatccccagatccttcagaaaactaaagaccgcatctttgacactctcctcgtaccaactctggttacgaaattcgactgcgattggaacaccgggtaaccactcgaccatccgttgtaggtaatggaagttgcggttcgaccgttcaaaaaacggcggaaattggaagagcaccgcttttaattgctggtgctgcgttaacggtttgagcatcgcacggtattcccgataagctgtctttagcgcatccatcgaaaccccttcgtcataagtgtcatgcagcgtcatcacctgatttgctttcaaaataaactgaaacttatcagggacggccttttgccacttcgcgaccgtcgtcactttcggaataccatagaatggcgtgtccacttcgacgactggtaggactcccgaatattcagttaaggtcagcttttcagtaccacccagtaaactagggtgttccgtccaagttgttaagccaattgttatcatcagacctgcaccccctcgaagaagtcgaccgcatcttgttgcaccatcgtaaatgcaaatggcaactggagcggttccgcattgattgcaagcacttgagccttcggattacgatagtcaattaggccggcgaacgggtacacccgaaacgaggtcccacaaataacgactaggtcagcctgctgtaaatattgaactgcccgttcgatattggcactcgcaatcccctcgtcgtacaacaccacgttaggccgtaagtagccatggtctgtctgatggtaaggagacttcaaatactcatgccaatcgacatgctgaccacacttggtgcagtagacctgatagagattaccgtgaaattcaacgagctgagccgttttagccaccccatataaattatcaatattttgtgtaatcacactggcccgcccttgctgagtcagtgccgccatcttttgatgaatcacattcggttgggcgtctggataatataaatttgattgtaaatattgataaaattccagcggatgctccgccaaaaacgcgtggcttaaataatactccgcgttatggtgttcggtatacagtccatttttagaccggtaatcaggaattcccgagggcgtcgaaacgccggcccccgtcataaaaacgatatgctgagcttgttgtaaagttgtttgtgctgctgtaatgtcactcattctgacatctccctgcttagcttaccgtaacgtatagggtagattcatttcttggaataattctttgaccgtcttatcgtacacctctttgaaaaaggcatcgctcttcttttgcgccggtgctggtaggacaaacgcattctgacggtcactcttatataacccaatgtacgctcgggtatgtttatttttatctaatagatctgaatggtaaacgtcaaataactgccggacttccagccgctcttgccgttcactgagcacactctgaacggtcacaaattccgttccgtgtaggactggtaaatgccaagccgtcatctgatcatcaaaagccttaaacagctttactacggcacaccgcatcgcaaacggggtgtcaactggcttctgactgattacggcgtatagcttctgtgcagccggccaagcttgtggataggccgttgtcaccttttgcaaatcatcagctggtaattcaccattaaagaaaacgagtaggtcagtcaatgttaataaccgtaacgtcatcatcgcatccgccttgcccgcaggttccggttcgattgtggccgccacaccttgcatgtatagcgtttcaatttgctcatcgattaagttatgttcacgttgtttgcgtacgaccaagacgtggctcaccatgtcataaagttccatagcgattgccatcaattgttcgtccagttgttgatcacgcgtggttaaattaaaggtaatctgtggaaagccttgtaataacaataatagatgtaataattcatgtgacgctgtgtaattaggagccgtaatatcgctaacccgaacggtcaggtcaccatcatctaacacttgttgtgcttgatcatggcggacgtaacccgcttttgtgtcaccaaaacgaacactaatattgcccggatataacgaattggcggtacttaataaatctgtaacagtttggttcaatttaatttcagtcatcagtctcttcctttgtttgccgcaattccgcaatgagttgttgcgtggttgcgaggtcttgttgagatgctaattcaagtcgttgtaagataacggggagttcctcaggagtcgctcccgctgccatcgcgagcgatttcaactgtaggtgcatatggccctgctggataccagtcgtgaccaaggcgcgtaaagcggctagattttgggctaacccgatggcaaccataattctttccaaatcacccgctgtttgaatacctaatattcgttgattcaactgggctaactcgttaattttgattgaaccgcccacaatgccaaccggtagtggcaattccagttcaccgtgcagcatccgaccatcactggtccaggtactcatgccacgatattgaccgtccttaacagcataggcgtgtgccccactctccaaagcgcgccagtcgttgccactagcaatagcgacagcatcaataccgttcatgatacctttattatgagtcgtggcccggtacggatcaagctgagcgaccgtgctggccgacgcaatcttctgggcaactagtttgccggcataccgcccagcctgtaataatccgaccggaatgtcacaaatggccttgactaagctcgccgttgcataattcgatagaatactcattaaagcgtcctgcttcgtcatcacaccgatggactttgccacggcttccaacatactattgagcatattggcccccatagcagcctgcacatcaacgaataggtcaattgataaatagccttgtccgagaacacgcgtacgtaggcgccgagcgccaccacctcgtttttttaaactgggatgggccgcatcagctacttttaataatgctgcagcgtgggcttcaatcacggcagcggttgcagccggatcagacaactgctccagaacgatttgaccaatcatttcacgttgattaaggacggtcgtgaagccccctgcacgcttgacaattttagcgccattacttgctgccgcaataacagaaggttcctcagtaaccattggaacaatgtgatccacgccatcgacgactaagttgacagccaaccccatcggtaatgggtaatccgtcaaataattctcaataatttcatgatgttgtggtaaataatattgtttaaataacgcctgttcagctggcgttaaatgggcctgttgcgctacgatggcagtacgttccgcccaatttttttgataaaagtgccgaaaatcagctgtcatattctcattcctattctctccattcgactcatctaccgaaccgacctattgattgaggtgttctgaaataattccctcacgaacaccactttcagaaaagatcacccgatcactatccaacatctgtaataacgtcactagcggtaacattccaccaacaataatgtccgcacgatcatattccattcctgaaatttcctggcgaccttttttcgaccgtgacagtaagtccaaaaacgtgtggaacaccgtctctgtcttcagacgatacccgtgaatatcttcaacttttaacttttgttgccggcgccgattaatgcgggctaaggttcggttggcaccacccaatagaatgattgggaagtgcactgcttctgataaccaccaaatatctgccagtcggttacgtaggaacatctgcgcccgaaatagactcgcagacggcactaagtcgtcgagaccgaattgttccgataatgtcaccgcgccaaatggaatgctgatcagttgctgtttgcggccatttttgaccaagatcagttcacaacttgcgccacccgtgtctaagattaggcaatcatggatgaccaatgaattggcaaccccaagataatcgtaataggcctcatcgtcaccagataagacccgtaaatcgagccccacttcttgcttgacttgattgagaaattcagcctgattttgtgccatccgaactgcagctgtggtgatgccaataacatccgtattgggcattttttcataaagtcggcgaaaattgagtaacgccttgattgttcgctcaattgcggcgggctggagtacgtgtgccgttcccattccttccgacaaacgcgtatcttccttaacacgcttgatttcttgagcagtgccgttagcgtgcaaccgactgaccgccatccgcgccgaattggaccctaaatccacaatcgctaagtttctcataacaccacgctcacttttcgtttataaaatattagttaggtttattctaacatttatgatgtaacactgtgacttctagggccggattgcacaccaaaaaatatcaaaaagcccaaaatgaacgacgctagtgttttgactagggccgttcattttgggttcattagactagctagttggcagtaacgaaggcttgtaacatggttttcttgataagatgacaacgttacaatcattgtaaatgatgttacaagcatccagattagcttggcgacaggcgaacaatcagtcctccaatgatttgaatacaattgtcatacccctttagatacaaaaacatcccaacattagcactcactgccgatatcgagatgtttctatataataagattgaagtttattaacgtattactgccttaatcaacctgtctgctgctgacactaactgtgattggtcacctgcattttggcttgataagccgctaaaattttgcgtacatcatccgttgacttggcatccatcatcgtgttacgcaggtcagtggcgcctagttctgggcgcgcatagattttaaagaaccgttttaaggacggaaaacgtggcacgtcataacgggtggcaaagtcatcgaacaagtcgagctgcatgttcagtaaacctaatagttcatgcaaatcatgcgattggggatgggactcaaatgcaaacggattcgcgaacactccccgaccaatcatgataccatctaatccaggatgtgctttggctaacgccaccccggcctgataatcagccacgtcaccattaatctggagtaacgtttccggggcgatcgcatcacgcattttaatcaagtcatcgataacttcaaagtgtgcgggtaccttactcatttcctgtttggtccgcaagtgaacggtcaagactgccacatgttgcgataacaacgttgcaatccagtcatgatattcagcaactttactgtaacctaagcgcgtcttcgcactaacggccagtcccgacgtctttgcagccgcaatcacgtcttcagcccactgcggattgcgaatcaaatcgctgccaccatgatttttgatgaccgtcccatccgggcagcccatattgatatcaactgcttcaaagccccggtcacgaagttcagctgtagccgaagcaaagtcagccgcttcgttaccccacagttgaacgaccggtttttgcgactcagctgccgccacgtacaaccgaccatgcaccggaaacttcgtattcgggttcgtaatactcttagcatagacgaattcactaaaaaacgtatctggagcagcggcatggctaatgacttgccgaaaaacagtattactaacggcttccatcggggccatcgtaaaaaatggtcgcccgtctgccttggcttgggccgcaatttgcgaccagaatggtgttgctgtcacgttctcatactcccttatcactagtttaacttttggattgaatgcttttaattttagcattgatatgcctgctttgcaggaatgacgtttgctggccgttcgtccgctcccaagcatcgcttaaccaaccgataaacgcgaactttgccacgattggttggcgtcgcgaacatcacgcctagtcacactattggtgaacactgtgactaagcgctattttaagcaacatgctatacttcattagcattaacaacatcgttaataacttgtagtgtctgatctaatatttgcttatcgacagcgccaacctgacgcatatcccgacggacgtaatcaaacgtgtgaaattggagtggattgatatagccgtcgactttcggtgttttgattttgatcaacaaccccaaagccgtcatccggttattggcagtatgggtaatgggacaaactagcgctagctttgttaatcgcgcatacttttgattactaacaactaatgctgggcgatacttttggatttcgcgcccagcactcggattaaaattgattaaaacgatgtcacccttacgtggaatatactgattagtcccattcactatcgacgtcctccatgtccagggttatgtcagactgctctagttggtcattaaaccaatcaccctcgaacggattgcgatgtttcaatttgaataaaatcgaaccatcatctagctgctctgcttcaaactctgtgccattcgcaacattgaactttttaggaattgtcaatgtcgttgaattaccaaccacccgtgctttcattacgcatccctcccgtgtatcttgagtatacacgaagttacgctcgttgcaactgattagcttccatatcttgcctggacacaaaaaaggatttcgaaataacgaaatcctttttttcagttcagcaacttacttattgattataactagcagccatctgattcatcatcttcttaaagcggcgtttacggaaccatcctaggaatagcacgccaagcttattattggcattcgtcttcttatccttgcctaaaaaggtttcggcatattctaagacagtttggtgaccatcagtgtccggtacgaattgataatcgacgccgtaatgatcgtggggcgtttctaattcatacgcatatcgaacaccgggttgcgcgtgggtaatcttcaaattaccggtcagaccgttggaccactgtttggcatactcatagccttgtaagctctgccgtggcgccggccgacccgtttgctgctgaatatcagcctgcgcggaatcgatcaactgttggtataaataatccacaggggcgttcaaagttaatttaatctgcattctggtggctcctttctatctgacccactcgccgataaacgacgaaaagtgctgcgctgaccgctaaacctaatccgagcgtcacccattgaccggtcgttccggccaggggacttaagataacggctaataatccaaggttcatcccgatgagtaaacactgctttaagcttttcatgacaatctattctccaatcgctgctggtttaatcttgttggcagccttaacgaatggcacgtaaatcgcaaaggcaacggcggcattaaataattgtaagaccactgaccgccagtccattgtggcaactaaggcgttcataatcggtggcattgaccaaacgatattgttcgtaatcggtgcgacccacccagctgataaagcagcgtaggcgatcgaaacagtcacaactggtgctaaaacgaacggaataaagtagattgggtcaagtacaattggcatcccgaacatcacgggttcgttaatattaaagaatccggggccaatcgccaacttagccactgaacgttggtcgtctcgtttactaaacactaaaatcgctactaataatagtaaggtcgagccggccccaccaatccatgcatacaagtcaaaacagttccgcgtccaaacgtatggcaaggctttgccagcttggtaagcgttaacattagcaagctgagccgtcaaccagattccgtccaagattggtgccaggacattggaaccatgaatcccgaagaaccagaaaacttgaactaacagcgtcattaagaggacggcgccgtacccttgactcatattcaatagtggttcttgaataatcttcgcgatccattcaatcaccgtggtgttgaatttactgaagatccagttaataatcccaacgacataaaatgcagcggcggctgggataaccccagtgaaggcgtttgcaactgccggtggcacagaatctggcatcttgattgtaatgtgtttcttcatcaaagcaatgtaaacggcacttgcaatggcccctaaaatcatgaccgtaaagaaaccatacgaaccaaagtacgtgttgaagttgaagtaaccccaagccgtcacttttttgccagcaaccgccatgccagagtccgtcaaaatcttagtagcgcccttgctcaacgtactcgtcaacgtgccggtaaagttttgtggcaaactcatgatgaaagttccaagtgtcacgatcccaccagtaactggttcaactttgtactggattgccaattgatacccaaatgtaaatgagaaaatcagacctaagatggctaacgtccccgtccaaaccatcgcattaattccaatcaaccactgcatcgaattaacaatgcccatccaaccgaacttcgttggaatatctcgaactaaagcgttcagaaccgtggcgatcgacccggccatcattgccggcataattgctataaacgcgtcacgtaatgcgatcaaccaccgaactgcaccaatcttggccgcaactggcactaagtgtttgttaagccattcgataaatgaattcataatatacccctcactcctaatgtaggttttcgctagttagtgacccaacacaactgttgcgtcacccccgtactagttttgtaaatcaatattttcggtatggtaatagagttccaaatctggatagacgaagaacgtcctggagaagttaaagaccgtcccattagccaagtaattgattgcttccaagcacaacgttttgtcaccatctgggcaaccgatcaactccgcccgttgcgcgtccacccgcacttgatggacgtagttttccgtggtgctccccgtaataccatatgcctctcgcaagaaggcgaagattgaatgctgcacgctctcactcgataagaacgggacgaccgttcgcggaaaataagactcttccaggtcatacaagatgtcattcaaataacgtaatcgcaccacccgataaacctcgtcaccaagcgcaatgttcccctgttgtgctaaagtttcatccgctgtcactttatcaaacgtgacaacttttgatactaatggtccaccctcaaccatggcggactggtcaaatccaatcgataagttgagcactttcttcgtgttctgcggttgtttgataataaaattgccgctcccctgcacgcgacgtaacaacccatgccggaagaccacatcaatcgctttacgaatcgtattgcgactggcgttgtactgcgccattaacactttttcggttggtaacttagtcggatattcatccgccattatcgatttaatgattgcctgcgcaattgcctgatacatgactaaacctcctttcgataaattagtaggcgcttgtaaaacttgtgcccacaaattatattatcacagaatacatgaaaacgctttatttttcgtaattttataccaatgaatttatattatgactaaaggcagccacagcaagcgctttcgaattccttaccaccccttttcttgccaaaaacttattttaacaagcacttttttacaatcattcatgtaagaaagcaaacgaaatcagcctaattttcaatttagtctgccttttctttttaattcgcaaccgtgatgcgttgggccatcgttattaatttaccggaaagtcccatatattaagggtctacaaaaaagtgcaactcaccgtcttcacacatccgacggtcagttgcactattttctaccataatttatttaaaataattaattccaatggcgtcttgcatttcacgccacgtttggtcagcgaccacgttcgctttcgctgtaccatccttcaaaatttgtaagacttgagctggatcagcttcgtaaattgcacgccgttcgcggattggccgcaatacaccgtccaacacgtccatcaagtagcgtttaatcttaacgtcacccaagccaccatgttggtaggcggccttcaagtctgcgaccttggccttgtcttcatcaaaaatatcaagatacgtgaagaccacgttaccttcgaccttacccggatcttccatatgaatatgatcaggatcggtatacatggacatgactttcttcttcaaagtatcagcatcgtcagaaaggtaaattgcatttcctagtgatttactcattttggcattgccgtcaagtccagggattcggcccaagccctttggtgggaagtagccttcaggttcgaccaacgtatcagtttggtaagtcttattgaagctccgtacgatttcacgggtctgttcgagcattggttcttgatcgtcaccaacgggaacggtcgtcgccttgaaagccgtaatatcagcggcctgactgactggataaacaaagaaaccggcaggaacactttcaccaaaagctttttgcttgatttccgtcttcacggttgggttacgattcaagcgcgctaccgtcactaagttcaagtattgattcatcatgtcagttaatgctggaatttgagactggactaagatcgttgacttttggggatcgattcccactgccaagtagtccatcgcaacttgtaataaacttttacgaatcttttcgggatcatgcgcattatccgtcaacgcctggttatccgcaatcataatgtatgaatcatagtccccagaatcttgtaatgcgacccggttacgtaatgaaccgacatagtgcccgatatgcagcttaccagtggggcgatcacccgttaaaatcactttttttgtcattgtactcatcctttctattggcactaaaaaagcgcctgatcaactaatactagttaattaggacgcatcaccgtggtaccacctaaattgcagaaagcttgtctctgccactcattgaccgataagggtgggtccccggtgttcaccgaatctccaaaaagccaattcattagtccgccccagctttcagcacgtgctaggtctctgttattggacgccttactgttcttttcttcaacgattaattagttctagtgtactggttatacctgaccgtgtcaaaataaattctgggcatcattcgcgttaactagccgctaccatttcatcataccgaccgtcatttcgacgtttaagcccatcgaaattcaagcgggcgttccttcaacaccattaaaattcagttaagtgctcccagccccagtccccaatttacgcttcagtataattccgggcgccggtcttcaaacactagaatctgaccacgaacctggtcaacttgtgttaaatcaagctcggccgtaatcaactgggcatgggcaccaccgatagccacaatttggccgagcgggtcaataactagtgactgaccaccaaattgattatcaggatcactgccaacgcggttaaccgcaaccacgaatgcttgattttcaatcgcacgtgcttgcagtaatagccgccattgcatctgccgcactgtcggccactcagcactgacaaaaatcacttgggggccacgggctgcttgtttacgaagccattctgggaaacgaatgtcataacaaatcgcccccatcgcaacagttccgtcgagttcaaaaacgttctcggtctcaccagcggtaatataacggtcttccgccattaacccaaaccggtggactttatcgtaacgactcagtaactgtccctgacgatcgacgactaacatctcattatagtaatgcccatcgcgagcgaccgcgactgagccaccgacaatgttgacgcgaaactgccgagctaacttgctgagtaattgtaacgttcgctgcccatcatcatccgccaagacattcaggcgagttaacgcataaccggtattccacatctccggtaagacgatcacgtcgacagtttgctcagctgcccgttgaatggccacttcaatctgctcgtagttggcatccggatctccaaactgaatattaagttgtgctagtgcgacacgcattcgttccacccactttattagaatgattaaaatcatattagaataaatagtcataggttgcaagtttcagccttgccatcgtaaggctgccgaacttgcccaccgttggctagcacgccttagtgccactcataatcacatttcacaacaattactgataaatcagtgaatttgcaggcgctttgattgacatcatccctaaacccgcctaaaattgttcaagcgatttagacgattatcagacgggaggccctctacgtggcaacatcagatcaagagcaacaacgcgaacaacaacgggttgatcgagtcatcgagcaagttaaagaacgggcacaacagaccgacgacttgctggcaaaggctcatcacgaaaccgatgtcattcagaaaaactatggtgataataattccgtcaacacgtttgaagtcgatgaccggattgaaacgaacgcggaactgcaacaacaaaagcaaatggttgaacgcgccgtggaatccgaagccatcttgaaacggcaagtcggtgtcttgaaagatctcagtaactcaccctattttgggcgcattgatattcaagatagtcccgacgaggaagccgaacgtttatacattggcaccgcctcatttgtcgacgctgaacagaatttcttagtttacgactggcgcgccccgatttcctcagtctactacaatggtactctgggtcaggtccagtaccaaacaccggccgggcagcagacgaccgagctgatcaagaaacgccaattccagattaatcatggtcagatcaagaatatgttcgacacgaatgaaacggtcggtgacgaaatcttgcaggccgtccttggagaacaaaatgatgcctacatgcaaaatattgtagcaaccattcaaaaagaacagaacgatattattcgtgacaccactagtgacttactagttgtccaaggggttgccggctctggaaagacgtccgccattttacaacggatcgcttttctgctctaccactcacgggcttccctagaagcggaccaaatggtattattctcgcccaaccgcttattcagtcactacatctccgaagtcttacctagtttaggggagcgcaatatgcgtcaagtcacgcttgccgaatttctcagtgcacgttttcaaggcctaaccgttgaaagcctctttgagcgctacgaaagtgaccgccagcgtgaacaactgacaccggcaattcgcgattttcaagaaagcgccgactttatgcgccaagtcgatcaatattgccatcagctaccagccgaccaattacgcttcaccaacatcgtctttaatggcgaaatcttcttcgctaaagaggtcattacaaagattgcgacggccttaccagcagcgatgcaaccagctgaccgtttcctagcaatcaagaacactttaattaaacgcttaaagcatcgcattgacgatgaagcccaagctgactgggtcaatgatatcattgaccaattgagcgacgaagcttaccacgacttattaggttccaagcgccgcggtgattttcaatcactcgacgatgaagtcttctatattggtaagcaaatcgtgaccaaacgactgcagcaagtctacgatgcgatctataatggttacttcttagacacctatgaacaatataacgatttcttagcgcaagttgatcggcccaccaccgtgacgcctgaccaatggcaacaacgaattgccgcttaccaggccgccgttgagtaccatcggattgctctggttgactgcgcgccactattgttattacgcgatgtcctaactggcagtggtcagaaccggcggatgcaatatatctttgtcgatgagatgcaagactattcgctagcacaactgttatatatcaagcacgcgttcccactagctaagttcacactgttaggtgacagtgaacaagcattattcaaggggattgagttaccacagcaattactggaacgcctcaaggatgctttcaatgtccgacgggcgaacttgattacgttgaataagagctaccgttcgaccgaacagattacgaactttgctaaagcgctattacccgacggcgaccagattcaagcgttcacacgtaaaggcgatttacctaaggtcatgattcgctatggcgaagacgccgctctcagcagtctgcgtagcgaagttgaacatcagctcaaggcaactaacaccgttgccgtactaactaaagatttagcagaaagcaagcaggtctaccaatacctgaagcgctatacagtaacaacgttgatggccgatagcgaccgtaccatgccacaaggcgtgattgttatgccaatctaccttgcaaaggggttagaatttgacgcggtggtcgcatacgatgtctccgctaccaattatcccgatgcggattcagttggcatcttatacacgattgcgtcacgagcgatgcaccacttgacattgctcagcatcggtgatgtctccccactaattgcccaattggacccgacattatttacgattgaacatcaggtacgagtataactgtaataaaaaaacgactggaagtagcccagcggtattacgctagctacttccagtcgtttttcgttatcacgaaactaatgcttgaccatttttctcacgaccagttaacccagtagtgaaagtgcaattagccaactcaatgattatcaacaggtggataatacaaacgccactgctttatccacctgttgataaccttaaaatttaagatctgctgcttatcagtttaggttatatttgcaaaaaccgtagtacgctaccaagcaactacggtctacgtccttatttaactgacttgatacttttttatctgtgcatattcagcaccatgtatctgtttcaaattacgaatttcaatatcattttgaagttccaagaaataacgatccgacactccaaagaatcgtcctagccgcagcgatgtatcaaccgtcacctgtcgacgatcatgtagtaagtcttgaatccgtgacgtgggtaccccaatctgttgagccaaaaaatatgcagagatatgcaagggagccataaactcttcttcaagaatttcactaattttaggtgttgggatttcattcattttttggtctcctaaccatgatgataatcgactatttcaacatcataaaactaaactcattaccatttcgaattgcaaaacatatccgatactgattattaatcctgatgctatattgcccttggcgatcatgacttaatttttccaagtgattggcaggcggtaggctcaaatcattaattgtttccgcatgatcaatcattagtaattttcgcaatgctaatcgctgaatggttggtggcaattgtttagagaatttttgttggtaaaccttgtgagtttccttatctgcaaaattcttaatcgattatacccgtatcacgtgtatatctcaatccatccgactcttgctcctattattagctgaccacacccaaatatccaattcatctgagtacccgactagtacgacccctattttagctaggaaccaaccagagtatccccagatttgctaacatatgtgtcacgctattcacacgaatatcatgcttagataataggtagatggtccccagcaccatgccgaacagcgtgtaatatgctaatggcaccaagctatttccgctatgcagataaccgaaaagaagcccattgataacaatggtagctgcttggtactcccggtcaagatattggtctgacaagacgtaactaaagaaaaagcccctgaaactcagctcctcagcgattggtccaaaaatgacggcatcgagtgtcatcgctaccggatttttccgcaacagtaaatccaatgaacgttcattacccgattcagtgatgtgccataccgccgtcagcttagcatagccaaaagcaagcgccacgataatgactgcgccgatcatcatgaatagcaaggcccgtttatttagccgcgttcgccacggtcgaaaatcaaattgccgtaattccgcggtcgtcttatagatgttgtacaagaaaacgataatcacggcatataaactgaagctaactaacagtgtaaaccaattggccgtaatcaaataaatatacacgggtaaggaactgatattgacaataatgacactcaacacactcacaattagtaaattaccaataaaccgtaaattcttctgtaacatttcatccactccatccaaacaaccgtaactagaatgttcactaacgggcttttaaatcaacccactcaagttacttgccaagtccatctggcctcatgccattagcatgaggcccagattagctgtgacgtgcacgacactgttaactcgaatatcccggccagataatatgtaggttgccgcgagtacgagacccataaccgtatagtatgacaactgcacccaactaaaaccgccacgcagtagaccaaacaacacgccgttaacaataacggtaactagttggtagcgtggctgatcaaaacgttccgccagcgcataactgaagaaattgccgcgaataattaattcctcgcaaatcggtgcaaaaacacccagggccaacgccatcaatatcggtgagcgctgagacaatgcttgcaagtcagcaacattctccgcgattggatagacagcatcactaacaaatttaacttgcaccgctgccaaaatcagcatgaccaccattgccagtaccgtaatcactaattgacgcgcgctcggcttagcaactattttcgtaatcttaaaatgattattagtaactgattccagataaattcgatagaataaataaattgcaaacaggtagacgaccaagaagatcgccaccgttatccagttatacttgagtgttaaaatatcgatgggcgccgtactaagccccatcacgattgctgccaataaactggcaagtagtaatctaccaataaatttgacgttttgatgtaccatgctccttcacatccatttcctgataattatccccaatggtaactaatccacaacttgcggtttgaccggatatcactaactgaaacttatccccacatcatgttaataagtgtgaccagccagttcaccagtatatgacatcccattgcggtactcagttgttttgttttgagtactaaccatgaaaaaccgcatcctgtaatgaagatgcccaccgtactggctaactgataaccatggccgagtgcgaatactgcgtttgtcagcataatcgcgcccaatactggcaagtatcgtcgcagcgtattttgaacaattccacggaaaagtaattcttcgagtacggggctaacgatgtttgtgcacactaatgttaataaccccaatggactgtggatcagtgccatgatttcatcattttgtgtttcggttggactgactagcagaccacttatccccatttgaatcaccacgaccaccactgccactaaagcagtcagccccatcattgaccaagaaaaataccctaacaggactggcatctcaaaataatggtgatagcaacgtactagtacgaccgcaacaccaacggttaaaacgactaatgctccccaatgataaccgacgttgatttgttgcgggcgttcaccccaccaattccaatagccatccgctaacaccggtaattgaatgaatataaatagccctaaacccgctaacacataaccaaataccctgatcaatcgagcaaccataccaagcctcccaagttatcccctgtggataaaccaattcttatgttttaattttttatccacaacattaactcatagccgccaacgcgaaaactgccaaattagtccccatgtgcaccagaatattcattctaatatcgcgcttagccaacaaataagttgtccccaagatgccccccattaacgtataataaatccacggctcccaatttgcatcaacatggacacttgcaaatattaagctattaataacaaccgcgatcatctgataattacggtgattatactgattcgttaacgcgtagctgaaaaagataccgcgaaaaatcaattcctcacagatgggggaaaatatcacgaccgaaacaatcatgggaagcggtgcttcaccgagcatccatgccaacgacctggaattgctggtctcgggaatatttagcatcgcgctcaatttaagatcaacaataatgagcacgaccattgtcagcatcgcaataatcacagttcctaattgtgcaatgttcacccgggacttcaacgtcgcgacttggtaatgcctaattcgtgctgtatgccaataaagccaatatagcccccaagcttccaaggcatagattacaaaaccaatcgtgatcatgaaccaattattcttaattaggaaaagatacgccggtgccatactaaagctcaccaatgctaagctgattagactggcaatgactaggttaatgatgaattgtttatttgagtgtgccattacttacctctttcgtatgatatatgtgcttctagataactttactttaccacagtgatatttagtcagttagtactgatggaccaccatcaattattatccagcaccttatctttataataatcaaaccaagtcaccttgcccgtaataatcgccgtttgcccaatcatcccgtagcgcagtaactgtgcctgatcggctgtaatcggaacggccgctgtcacttcataaaaagtcgctttactctcctcgactggtgagaccccaatctttgtgaccacaccgtccaaaataattggcttcggtacgttccgcgtgactttgaatctaatggcttgcttgactttaacggaagaaatatccgccgtcgaaatatatagcttaacgttcactcgccgttgttgcttgattatcggtaaaattttagcgatttcagctcctgaactaacgtactttgcaccacggtaattgtctgcaacgtgtaggacgccggttttggttgccttgatcgtgtaaaattttgattgtgtcgttaagctatcaatatctgctttcacggtccgtaaatcttgctcggctttcattcgtttctcagcgacttcgcttaactgatcattctttaacatggctaatttggtattgttagtctcaacactgtacttcgtatcatcaaagccttgtaattcttctaactgcactttagctgaggacaacgaatcctgaagcgtatctatctgctgttgaatgtctgctaacgttgcagatttaacttcttttttatcgtttgcgttgttggcctcctttgacttagcgacatactcattaaaaacagacccatacttggcactattggcatacttgctaccattagccaccgcattgtataaggcttgataagcatccagattggtcttagtatttgataccacttgttgcgcggtcttcgttagcgtggctttcttagtactagcagcgctcgattttgctgccaacatttgattctccgttaaatagatttgacgctgttttaaataactttgcaatagttctcggtacccaaattcatcggtcgttggaaaaacatcactgtcagtattgatgccatctttaaaatgatccaaggctgtcacttggcgttccaattgccgtttgctgacattatcttcgcgtaatttattgcgattaaaaacgttagtataaactaatagattttggcccttcttcactcgcgcaccttcaactaaataattctttttgatggcactattaacagtcgcttgaatcaccggaaccgttccggtcggttgaacagttccggtaccattaataacaatctcgcgcttagctacgagtgaaaacagaatcgtacccattaacaatagcgtcactggaataattaataatgttgaaaaattttgaaaccgaatcccgtaaaactcgccactttcgagcaggtcttttctcattattcagtttccccctcagctattgatcaagtcgtaatagtaaccatgttcattcaacaatgccgcatgggtcccctcttcagcgacccgaccatcatgcagaacgatgatatgattcgtccgctttgcaatcgacaaccggtgggcaataaaaataatcgtcttgtcagtcattgccactaaattatcgattaattgtttttcagtaattgcatccagtccactcgtcgactcatcaaatatcaagacttgagcgggtgataataacgctctcgcaatcgttaatcgttgtcgctgaccacctgatagtgtattaccattctcatctagcttagtttggtattgcatgaccattttattaatatccgtatcaattaacgccaattggcaagccttcgcaatatctttctcagtaataccgctgcgattacctaatcttaaattttcttcaatggtcgctgaaaagatgtatggttcctgcgggatgtagttaatatgggtccgcaatgtatgcttatcgatgttcttaacgttgaagccgttcaatatgacatcaccactatttggttgataaaaatcaataagcaatttaactaacgtggacttgccagagccactcatccccacaattgcaaccttatcatgttgtcgaatcgtcaaattaacatcatctaagacattttcaccgtaaccataacgatagctgaccccttgtaacttaatatcaccatttaattgactttcattatgaattggccgtgacgcctcaaattcactagcgaccaaatacacttcatttaaccggttgttagcgaccttagcgctttgaagcttagtctgcaaattaataatattctgtagtggattaacaaaataggctaataaagcattatatgtcatgagctccccaactgataactgattatgaatgacgagattggcgcccacccatagaacaacaacttctaagactaactgtataaacagttttaatgcctgttgcaaagtatccgctttaagataggctaaactcttacgtagataatcaacaaattctgaatcaattttctgataacgttccgtctcaccattcagcgccttaacagtttcaatcccatgaagatcctcaataatggctgaactcaaaatagcattgctttccatttccttttgattcaatcgttcaaaggatttattaaaggctaagatgacaaccgcgtagattggcaacgagagtaacgtaatccaaaaaagtgtcatattctggattaccaagattgcccccataataataacgatgctgacatctaaaaacagcgaaacaattgtgctagctaacgcatcaataatcttactggcatccgtaaaccttgaaacaatttcccccgtccgccgagtggcaaaaaaactcattggcaattcaaagacgtgccgaatatagcctaaaataatttcaatcgaaagtcgttgacctaaaaccgccaataaaaaattctgggcataagtaaagatagcctgaaaggtataaaaaacgattagaccaatggccaccactgccaatgtactgtgcatattattgggaatataagtatcaatcaccgcttgtaagaaataagacccacagatactaataatcgtgattaaaactgcagcaagcacaatattaataaccagtcggcgctgctttaataagcttggaataaatccccatagtgagcccttatcttgcttaactggcttatattccgacttcggtgcaaagaaaagggcaactccggaccattcgctttcaaaccgttcctttgacatactgataaccgcaactgttgggtccggatcagcaatcacgacatgcgttttcgaggtttttacaacaacataaaaatgctgtagatccccatttttggtaacatgcacaatgaatggcaatggtaaatcttggacatcgaaaagactcatatctgcttgaattgctttggtttcaaaacctaacttttcggccgtttttactaatcctaatgccgtagtcccttctaaactcgttttagcaatatttcttagataggccaatgatgttgtcgaaccataatttttcaaaatcattgctaaagctgcgaccccacagtccatctcgtcaacttgcgcaacatagtttctccaatgcatacttgtactcccctcaccaattattaaatatcggtatctatttaattatgggctaacaaatgttatcgtatgccaactatctattaacgtacataattttatgataaatgtcctcatcaggcttaacggttaaacatcaactagctaacattggtatttgacgttaagagaacgtttttttacttttataattttttcaacaatctggtaaaaaaataaattaaactaaatttgttccaaataacatcatacaagggggattatttatgctacagtttgagaagttacaatattccaggttgccgcaaaaaaagcttgccaaaatatctggtggttttaatcggggtggttataactttggtaaaagtgttcgacattgatgaaattggttcagttgcaggcattcgtggtattttgaaaagtattcgttaattttcttgggggagatcaacaattatgaaaaaatttctagttttgcgtgaccgtgaattaaatgctatttcaggtggcgttttccatgcctatagcgcgcgtggcgttcggaataattataaaagtgctgttgggcctgccgattgggtcattagcgctgtccgaggattcatccacggatagttcaagccatcaagtttaagcactataagaaagcactcgatttatgactgggcctgcagtgctcagccttttaagtttatatggggggaattttaactatgccattaataaaagtaataatcacagctatttactacctaatagtgctctttttaatgaatcctttgactgatattatgggaataaaagacggaccctttcaattcatattaactgaatctattatattaatcgcgataatcattctgaataggcgatatgttaagcaacctatccactggctacccgttaatatcatgtcaatattaaagaagaatagtctgcctttgagcctagcaataatatttctacttattttctttcgaaaccacatgtatcaatttttaatctcattattactttcgttgattgtagcgataactgaagaatacgcttttcgtggcatgatattcagaacgcttttagcactaaaccttaaaaaatttgccacattgcaggccaccatcgcttcgatgatgactgcttcgcttatttttgcggctatgcatttggtcaaccttttatcacagcccgtatggtcagtattgtgtcaggttctctatgttattgggttaggtattttacttgcagcaatctatttaaaaaccggaagcttactggctgccattagtgtccattggttgatagatttttctagtttctattctcaaggtattgacccaactcaatcacccattaacgggccaatggaagctcttctaaaggggctctttctaaatattttattcattggcattgctacgtttatcctatcctctaagcattggaagttattgagtatcctaaatatttaagataaaatagacgagtaatcatccattctgaattcctataaattattgtttgcagcactacaatttcaattatctctgaagttttgggttacgctaagagctagtcatatcgctaactaaatttcacgtcttaacgctatgctaatatactttacgatcgagtactgtgcttactttttagtcattttaatactcataagatcacagagccctactccaactatcttcagcgccgagagcgtaaaatatcttgt

SEQ ID NO: 34 - DNA, 30936 bp, Lactobacillus plantarum
ttaattttacaatctacccaaacaataacttatttagctggtaaccatacaagcatcaacaacaataaggcaagtccaagtattgcaatgagcaagctctggtgattctcgctcgtttgtggtaacgttactgccttcgaaacttgaccggattgatctgtggccacaagctagtagttaaaaacaaattgacgttgacccccaaaatctctaaaattaagccattagtctttttactaaattaactttaaggagtatcttcatggcacaaatttatattgctagtccgtttttcagtcccgaacaagtgacgcgggtcacacaacttgaggaagctttagcaaaaaatccaacggtcacggatttttattcaccacgtctacaccaggacgctcaagccgaacagttcaccaaaacttgggcgaccgaaattttccaccgtgacatggcccaaattgcggccgcgcaagtcatcgtgactgtcttagactttgaagccaaaaacttagattctggtaccgcctacgagctaggtgtggctaccatgcgcgacttgcccatcatcgccttgcaggaaaaagatgaggccgtcaacctgatgattaccgaaagcttacactggtataccaaacaagtgagtgattttgaaacttacgacttccaacaattacctaaaggcgactttatcggtgaaattttataataaaaaacgaagccagactttcgactattatcgaaagtctggcttcatattttgtagttcttaattttacttaccagtgggccccaatcgtctgttgccaagcaaagtacggggtgccctttgtcaatgcttcaaattgatcagccgtcaaattgggccagtctatgtcactggttgccaattgtaacgaatcggttaagtgaagatgaaagtcggtgatccaagccaacagcggtttcaacactgacaaatcggtatttaacatctgataagtagcggtatcgctggtcaacgtcaccgccaatgtgtaacgggccttcattcgtacgccattaccaagttgccgcacgattgagcgatacaatcccagctcgacgtccgtgatgactgtgggtattggcgccaaggtttgaaagactgtgccgcgctcatcggccaaactcagccgactaggcgtgatcgtcaaacgcccatgagcagccgcgccctcattcaacgctttcaagataaacggcgtctttttgcgcgcggtcgaatacttgtgatcatttaaaacaatcgtcatataagctggttggtgcgtaatattgtccgcaatgttcgtcaccgcgactggcattggtttttgcatgtgataatctcccttgtcgatctgcttctctctacggtcgattatacactaacacgactcaaccaacgtagcgacttaataattgccttaggccgtcaccggatcaacgtgctcagcaacagcatgagccgccgcgattcgaccgaacgtaaagatatcactaagcgagttaccacctagccggttacccgcgtgaattccaccggctacttctcccgccgcgtatagcccgtcgataatctgaccgtccgtatttaaaacgtgagcatccggatcaatcttcaagccccccatcgtgtggtgggttgctggtttacgcggcgttgcgtaaaatggtgccacggcaactttcaaatcaaaggccgtcttatgaaattcaggatcctcgccggcatcaacgtaacgattgtaatccgcaatcgtcttggtcagggctgccgggtccatgccaatttgttgcgctaaatctgtcaaagtatcagcacggaacaaggtcccattcgccacctgctggtcaattttagcttgtgtcgtgttgtaagccgtctttttaatttcatcatcggcaattagatagaagagactcccattatcaatggccgcctgagttaactcatcacgactgccgtactcattgacgaaccgttttccttgctggtttaccatcacaaagtttgccggtggcacttggagcccactgaataattcgccggtctccggatcagataccggcatcatttgtgagaagcccatcccaactaatgctgcaccaacactagtccctagccgaattccatcaccagtcattgcgggggaattagtcgtcttgacatcatcgtcgatggccgtccagtacgtattgtacttttgtaacattttagtattcgctgcgaaaccaccagaagctaaaatcaccgcatcagcatggacaataactttttcatgagccgcattagtcgcaatgacgccacgaacttgcccatctgtcaccagtaattcttttaccggcgtttccgtcataatcgtaccaccctgttgttcaacaaaggcccgtaaagtcttgatgtaagcaaaccctagatcgcccattggcttatgcccgcgccgccagatggctccaactggcattgtcacttggctttcatcaaatttcacaccaatcgattgtaaccacttgactgaatccagggcgttatccgtcaattcttttaccaaatcatactgaccgtgaatctcttgaccgttcaaatcagtccgttgaccacctaaataagtttgaatccgatgtaacaaggttgaatcaaataaggtgcccttttgattggtattggcagtcaggtatgcgtcaatctgctgtttcaatttacggaaatcagcccgatattcaggtgcaattgtactttcatcacgctcactcagatccttcaacgtttgcttttcacctggcaaagctacaaactgtcgttgccaatccggatcagccgcattcatgggccccccagcgcgaacggtattaccaccgacagctgggtatttttctaggacaacggcttgatgaccagcctgtaacactttggccgctgccgtcataccagccccaccagcaccaaccactacgacatcagtcgtcacttctttgacagcaggttgagcgacctgcttagtcgcacgccgtttcttcaaatcatcaggattggcaccagcttctttgaccgcacgagcgaccccatcgataacaccatgactggtaattgaagccccggaaatcgcatcaacagcgagcgtttgacccgcaataatctccttgggaatgcgttcaaaagccacatcggcaatcccctgcgtttcactactggtatcaatttcaatattttcaatccggtcagcggagagggtcactcgcattggcaattcgccattatgtccagtggccgtcacctgataagtacccggggcaaagctaagcgcttctggtgcccgcatctcggcgacgatggtcgcaaacttctgaaactttgcaaaacaactgtccagaaaatcaaccgtcccttgcacctttaaattaccttgatcgtcaaaagccgtttgggcacgacctaataagaattctgaaccgggcatgacactggcgttaacaccgggagcgtctaaaatctggcgcaggtgtagttgcgcgcgtgacgatccttggacactgtatgaagccccaacaatcattactgcttgaccatctaatgggtgaattttgaatgataaccattcaataatgcttttcaacgcggaaggcacggaatgattgtgttccggtgaggcaatgataaccccgtcagccgccgcaattttagtggcaaagttttgaatgatggtactgtcagtttgatcattcgattcatcaaacatcgggacatcagtcaattctaaaatttcgatttcggcttgtgtcgcaaaatgtcgttgcataaattccagcaacatccgattgtacgaatgctgagcattcgttccaacaattccaacaaatttcatgtttattcctccccagtcacttgccgccacgagaactgcttactcttttcgaaaaactgactcgacggcatgattttattcgttaaatctacaaaatcaatgaattcgccaaacgcattgtctaattcctgaactttatccggataagtcaggtcgccctgatcatcaaaagcttgtagtgaacggcctagtaagtattcaatatttggcatcaccagtgcttttaattccggcgcctctaaaatctggcgtaagtgcgcttgagcgcgtgaggttcccagtgagccgttcgaggccccaacaatcataactggtttattaattaacggccgcgtggtatatgacagccattcgattgcactttttagtacggccggaattgaatgatcatactccggcgtggcaaagatcacgccatctgctgcggtgatcttatcactgagctgttgaattgctactggtgctgttcggtcttccggttcattaaaagccggtaaatcttttatttcacaaatttcaatcgtggcttgttgctgaaaatgccgttgcatatattgcagtaactgccggttggtcgatttggttgcattcgtcccaacaatcccaacaaatttcataatttcagatcctttcaggatgatttaaacagtcgttttcgacgagtagctattgaatgattggccactcttaatactgattagtgtacgtgaaagcgctccgcttgtgaaatatttatttatctataccccgataacaaatttactatgtcgacgattcgcgttaaaattaatcatgttaaaatggttggtcataatgctatttagccactatcgccaggatgttgacagaacttattgaacatgttttgaacgtccttatggcgatgcaactaactcaacatgaccaaatcagcaatcaaacgaatactcacctaatcacaatgcgagaggaaggcgctttatgccaaaatcagattctagcgaaatgcgacggtttttagatgtgttgctcaagcacggcaattttacccgggcggctaaagatctctacatttcacaaccttacctcacccaaagcatccgcaatgttgaaaaagaattgggcgtcaccatcatcaatcgtgaagtcacgccactgcgactgaccacggctgggcggacttattatcaatatttgacggcgctcgaaaacgagaaggattactttaataagcaaattaggcaatacacacatgccaaccagcaagtaattcggctgggcgtcttatctagcctcggctattacttattgcccctattcttacctgcttttttgaaagcccacccggccactaagatcgaattaaccgaagatatcgctagtcgcaacgaacagcgcgtgctccacggtgagctggacttcttaattggtcaaaatccggaaaccatcgcgccggggcttgaaagttatgaccgcggtcgggacgggtactacgcgattatcccgaacaccgtcaactggtaccaactccatcaggccttcattaatccgggagcgctaccccttaacgacctgctacaagcgcctctagtcttgtctccccacgggtcatcgattcgacgccaagttgactacttattacaaaagcacaacgtgacaccgaatatcgtaattgagagcacgaataccgccaccatcaccaaactagccactgctggactgggtattacctttttaccagacagtgtgcatacccagcctgatccagaacgctataacatcttacctttgccccaagcgttaatgtccctgaattatttcattgcctttccagccgagcattcactgaaccaggtggaaaaagacttggtgacgatcttattaacccagttagaagccgatctggcacaatcgtcaacaatttcatgatacaacaaatacccatctgcttagccgttaagacggccaatgtagatgggtattttaacagtaaccattatttcaaagacgcaccagttaagatatgcttttcgttgcgaaattttgacgccacgcctacactttagctaaccaatacatgctaatctagtcacgaaaagtaaggatggcttatcatgataacgaataaatgccgttacggactggtaggtctaatttcgatagtcctaacgtttggtctttccgcttctaatcggctccgtgcgtccttcaacgctatgccggctatcacctacatgtcaaaatatggcattatcaaccatcgcacgcaatggcaagccatgctacatgcgactgatcatggtcgcaaaatcacgtcactgacccaactcaatcaaattctgcgcgctgcaaatttacattcattcgccgtcgccaatctccgccaagtcgaacatgccacccgtccgaccaagacaatgagtgccggcctcaccatcatcaatgtgccagcattttacagcagtcagcaccaattacaaaaacagtattggacacaactccagcacctgattaaacaaactaagccgacaaccgatttaatcttaaacttcgcagccaatactggtggtagttcggcaccgatgattgctggcctggccgccatcattcccgacggcctcctctacaccggcatcacgaaccatcatcgcaaccggccgcgtgtgatgtaccatggccgcatcactggtggacttggtcaagatgactttaacttttcgcaaccaacagcggcccactttcgtcatatttatgccattattggtaaccagacagcgagtgccgcggaggtgaccatcatggcgctaaaacgtaacccgcacgttactttagttgggcgttcttccgctggatatactagtctcaatggtggcgtctttttaaataccgccgtggccgtcatgacgattggcacgctcaaagcgaccgtcaaaatccatggtcagcaatacttcaataaccagccgttaaagccagacataccaacgttatatcagccattggcaccattacaattaggacaatcgccccatttagatgccgactttctgtccgagttacgaaccatcatgaagcactaccactgacaccccgtcctttcagcttcaactactagattcacaaacttcagcctagtcaatcggcactattgtgattcagttggccgttcagctgcactaaaaaatcagcttacgcagccaccgccatccccaaattacaattgtaatcagaatagctgtgaccagccaagcaactaacacgataccaatactgacggtagctgccagtgcacggttcgccatcttcacagttgccataccaggcacactctcaggccgcagtacaccgtaagcgactaagcgcattgcaatcaaaacggtactataactcgcaccaagttgccaagctggccgagccgcgccatcttcttcactctcgtcttcatagtcgtccgccggatcaaaccgtcgggcccactgttcagttgtcaacggatctgctaaatcccagtgttgccaggcatccgcccagttggctgtcgtctcatcattgagcgtgtcatcgagcgtgcgttgcatcaatttattctgcaaagttgccttggcagtcaaatcaccgtcccactcaagctgatcaaataactcaatcgctaacgacaagccctgcatgcgcgtaattgcggccggatcaatctgacttttcgccacaagctgtgaccattgcgcgtccaaatctcgatcagcacttttttgccattgttcaagctggttaaccaattcaaaaatctcaaaagagtcctcagtatcctggtacttatcgaaaaaggcccacatcacggctggtaattgttcagcagtcaacgtcagcggggcggcaaactccggatgcatgctctggcgatgtgcacgccacacttgccacccggcaccactgacctgagtggccgcccgtttaccaatttcttgcagatattcctgatcttgtgcctgcaaaaacgcgttcatcgctgcataggcttgaacttcttctaattgacgttctggtcgtaccccagctggcagcactaattcatcctctccgtcggtctcatcaacttcatgttcagcatgatcattgggcgtaagcacggccctaactgcccgcttccatgcttgccacattggatcatccgccgttacctcataaattgccccggcttgcatccgatttagtagtgacttgacggcgtcatcgatttcatcgtcgtcaaattcatcctcaagtcccagatagctagtttccaaccaacaatccgcgagccaataaaatgtcgttacatatgcttcttgttcgttcatcccgataatctcccctaatgcgtgcaattttaaatcatttgtctctgtgacggtcccgtcacgtgccacagttgccggattatcgtttaatcaatcagtctggccgctagattacgcgcatcgtgcacgccaatactgctcaacgtgtcctaattcaacacgtatgcaatggtcaacgataacaactaatcactcgtagtaacttatcatgtcaggatattaattgcaattaaaatttttattttatctttaatgacggcccacgctaattaatggtgcaccgtctcacccaccccaatggaattcgtcatcaaaaataaaggtcacaaaaaaactgttaaaatcattgatttcaacagttctttcaaacaccgtatcgatttagttagttttgttcgtctggtaattcgcccttcgtttgatcaccagttggccggtaaaagttacgaccatccatagcaaagatccgctccgtatacgtgcccggctctgcgtgtccaagtgaagtctgcatcatttgaatcgacgcgtccaactcgtccaagtcatgtaagatttcagcttccataatatgaggccgaacgggtgacccatattctaacaaaccatggtgcgcaagaatcgtatgccgcaagactaaaacagattccgactgctcgtcaattttcaactgttgacaagtctccacgatttgttcatcgatcaggacaatgtgaccgaccaagttccctgccaacgtataagtcgtcgagaccggccccgacatttcaatcgtcttacccatgtcgtgcaaaatcgcaccggcgtatagtaaggcccggttaacgtggggatactgatcggcaactgccttagctaagcgcaaaattgataacgtgtgataggctaagccaccggcgaacgcgtgatgatttttcttcgccgcgggatagctaaagaaccggtcatgaaatgtcgttaacatgtggcgaacaattcgattccaattaggttcagtaatttcaaagacaaactgattgatttcatccgccatcgtgtcggtctttagtggtgcgtgttccacaaattgttgcacttcttgcggttcgccactatgagtgagccgcatttgttgaattttgatttgcggattaccctgatagttttcgcgtttacctttcagatgaacgatccgacctgcctgaaagttttcgacatctgtatcgcttgcatcccaaaacttcccggaaatctcgccggaagtatcctgaaaattaatggctaaaaacttcttgccgttcttggcgatgcgaacttccgaatctttcaacaaaaaatagccatccacggtttcatctaattgataatcaaataacttctttgccatgttatcccccctaggttaactgctgtacagtcgctgtcttcagttgggtcagtgccgctgtctcattcgtaaagtagagcacttgatgatgctgagcaactgctgctaagacttgccaagcagcttgcttacgttgctcatcaaaattcaccaagccatcatcaatcattagtggtagctgagctgcttggcccaaatgattgatcaacgctagccgtaaagccaagtacaactgttccttagtcgccgttgaaagttccgcgaccatgaactgcgttgttgccgtcttcacaaccatttcatcaccgtctaagtcaatcttattataccgctgtgccgttaattgcgcgaaaatcgtggttgctgcggccaaaacagttggtaattgctgttgtgtcaatgcctgtagcgccatatcgatccagttcgcacccaactgccgcgttagccattgacgtgccatgactgtgatttccgtttgtagatccgcctgttgctgacgtagcgtagcgtactggccatctgccgtcaactcttggagttgtgcttgcgccgtggcaatgtccgtagctaactgtgtcagttgctgcgccgtttgggtacgttgttgctgtctttcagccagtaccgcttgcaacgcttcaagcgacgtatactgctttaacgccgatagctcagcagaactgagttgttgctgtaattggtgacgactcgtggcgttggccgtttgcttttcggcatcactaaccgcttgcgtcaacgcgtctacatccgctaaaccgttagtcgttgctaacgcctgtagctgctcggtcagatcacggacctgctgcgtcaactgctggacctgccgctggacaaaggcaaagtcggggccggacatggtctgctgttgcatcacttgatggacttgatcatagaattgggcaattcgagtaacacttgtcgttaaatgatcctgatcaacaggaatccatcctgccgcaaattgataaggctgaatcaattgccagagtttggcagcctgtgttgctaatgcttgatcagcagtcgtgaccgcagcttgtgcgcgttgcagtgccgcgactagttccaattgctgtaaggcttcactggcagtcagattcggtgccagaccagcagccactaattggtctgataagtggtcggttgcttgcaccggtttaccctgactacgggtcatcccaaaccaaccaagtagggccacacctgctaacatcaagatccatttaaagccgcctaatggtagcaataatcccgcgacaatcccgattgcaccaccaatcaagcgccaatcaagcgatggactattcggggccggatgttggcgacgcgtgttcgccgtcgctgccaacgtcgccttcaaggtctcgattgcggcctgtttgtgcggagagaggcaacctaacagctcaggatgtgcattactttgcgcttgaaaatcagccttggcagcacttccctgctgggtcaacgtttggtattggcctaaggtttgttgcagggttggtaactgagcttctaattggtcaaactggtcttgatgttggacgtagaagccaactagtccttgagattgtgtatcaactggttgctgacttaattgctgacgtgcactcgccaaggcgtgttgcaattccgttcgctgttggcttaattgttgatagcgtgtcctagtcgccgtagttagtgtcgtcgtcatattagtggcttgcagttgctgcaattgttgatagaccggccactgatttcgtaaattggcgagctgttgttgttcatgatccaacttggttaaatcacgttgggtacttgtccgttgtgcctgcaaatccagcaatcgattttgtaatgtttcgtattctgggtaccgttgcttggccgccttgacctgttctgtcaacatgcgatagtgctgcaatgcttgattcaacctgggtttgcggccgcggggcttatataacgcctccgcatctgtccgtaacgtagtcgccgtttctcgccatggtgcactgcccaccaatccgacttgttgtaattgcacgttcaaatcgctggcgtgcatagttttgagcgccgtcaattcagcctggttaaacgtaaacaatcgcaaatactggtcacgatcataaggcgctaaccacttgtcaagtaaggccagcggttgagcggcctgcgtctgcacgttcaccaaggtagcgggttgatcacctaaccgggtcaaccggtatgtcgtctcgtcaaccactagctctatcgaaccaccgtactgattcgtaccttgtggttcatggcgttcaagtgggtgacggcgggagggaaaaccaaataacatgccgagaataaaggcccgcattgttgatttaccactttcattgaggccgtaaatcacttgaagcccatcaccaaactcgaactgctgctgttgaaatttgccaaagcccgcaatttcaagacgcttaatctgcatcatcattcacccccgtcgttaaatggtactgatcatttaagagtcgcaccacttgttgttgccaagcagtgggtgacatatcttccagcaacgcggtgttcagaaagtcttcatccaagagtttgcctgcaagttcagcgactgcttgatcggttacgacctgctcaccaacttgttgccaggtcgtcgcgttaataccaaacaagggggtcatcgtatccgtcgttgcttgctcaatcgcaaccggccaccaatgttcatttgcctgttcctgcaactgggctagaatggccccctgatttaaggctaattccgccatcgcactcagttgaagactagctggtaacgtaatcgttactaattttaagccggtaaccatcttcaatgataattgatcagctaactgatggacgatatgtgaacgggacatgggttctggactagtgagcgttggcgtccaatccgcccattcaatatcagtcaaggcgtgaaatactggttgcaaggtctgatcggcctggctattcacaatgaggcaccccttcgccccagtttcaccgcgatggcgcccctgcgtgttgccggcatatacgattggtggttgcgaattgagcgtttgccgctgatgaatatgaccaagtgcccaataatcataatgtttcgttaataattcattaacgttgaacggggcgtagtggtcacccgccacaccaatctgaccgtgcaaggtaccaatctgataatcaacgcccgtggctttaacaggataatcatcaactgggtccgtcgtcacccaccgctgcgcatagctaaacccactaatcgcgacccgttcttgtgccacagtcgttaaggtagccgttgttacctgcgggccaaacacgtgcacattggccggaaagtgccagcgacttaaatccgcttgaaaatcatggttaccgaacgatagcagcaccggaatcgaagccgtattcaaccgcgctagcgccgtcatcagtgccgcctgggcctgaacactttggccctgttggtcaaacaagtcaccaacgagcaggacgaaatcgacttgctcagccaccgccaaatcgactagtcggctgagtgccctcagtggtgccgtcactaaccgttcctgcaaagctggtgttaagccactcagtccttgaaacggtgtatctaaatgtaaatctgccgcgtgtagaaatttcatgataacccccactaaaaaaggggcaatcacggaacagattccgtcattgcccctcgatccttaatttacttagttctggtataattcttgaactggtttagtgataatttgatttaaatcattcatcaattggttcaagttacgttctttacccattaaggacttaatttcgtcaacgttgccaaccttatcagctaaatcatgggccttttgaacttcgtcatccgtcaattcttccccattcatctgcttttgtgacaattgcatctgaacttcttgaaagtccttaaacagtgaaaaggcactgtcattggtcttcatcgtgtcataagcgacctttaattccttgaattctttagtctgacgtaattcttgttccaattggttcgcagtatcgtaaatatttacggccatcgtgagttcctcctcgaagtatgtgtcgtcattattttagcatttttaacggaacttgaatagcattagtacgttcagaagctagctttactagttgccaaggaaacttttggctttggagaaccagtctttagccttgttcttaactgcattagcgcccttctcaacgttttcccatacggatgatccactatcagaactatccgaatcactactattagattcggttgccagcgtcgcagcatccttcgtaccaaaactagtattattcgtattcggcaaaatattttgtaattcattcttgaataacgaggaaagttgattttcagataaactcttcaaataatgagtactgttcgtcgtatcaaatccgatccaggtcgtgaccacaatgtccggggtataagcaatcatccactgatccttcgttcccgaacccgtactgtaatcagcctgcgtactcccagtcttaccagcaaccgagtatccatacggcttggccgcagccccggtcccactattgtacgtgccaagcatcatactggtcatttctttagcaacgctggcggacataattttcttcgtcttagtcttcgtattatcgacaacgacattgccactagcatcgacaattttcgtaataaagtgggccgtcgttttcttaccaccattcgcaaacgctgtataggcactggtcatttgagcgggtgatacccccgtcgtcaaaccacctaaggcaagtgccaggttatcatccgacttggtaacgggtaagccaaactttttcaccgattgataccctttattcacaccaatcttattcaataaccaaaccgccggaatattcatactttgcgataacgcggtatacattgggaccgatttactataaacattatcatagtttttgggcgcatatttattggccccaaaagtttgcttcttattagaaaggttcgaatcatacgtataaccattttgtagtgctggtgtatacactgccaacggtttgatcgtcgaacccggctgccgcttaatctgagtcgcacggttaaagccccggaagacgtgtttgccccgaccaccgactacggctaacacaccacccgtcgacggatcaaccgcaattgaggccccttggaccttcgtaccatcgtccgcgttggccgggaacaacgtactatccttaaaagaatcttgcatctgtgtctgatcatcttgatcaagcgacgtataaatcttatagccccgattcataatgtcagattccgttagcccgtacttattaattgcttcatcaatcaccgcatcgaaataatatggataattataaccactttcataatggtagttattcgtcagcgtcatcgccttttgcgaataaagcttatactcacttttggaaagcttattattagcgaccatgttattcaagacgacgtttcgacgagccgtagacgctttcggatgattgattggatcataaccactgggcgagctcagcattccggccaaggtcgccgcctggtcaacagacaactctgacgcgtgtacgccaaaatatcgttcagacgcatcctcagctccccagacaccgtggccgaaataagcgttattcaaatacatcgctaaaatttggcccttagaatagacattttcagtttcaatcgccaaaaagatttcccgaaacttacgtgagaaggtctgttgttgtgttaggtaggcgtttttgaccaattgttgcgtcaacgtactcccaccaccactaatgtagtcacggccaagtatcttattgataacgagcaggacaaatgcccgcccgattcctttgactgagaaaccatgttctttatagaaattacggtcttcagtcgaaattaccgcgttctgtaagttttttgaaatactactcaaatggacataggttcccttttgtgaatagagtgaaccggcctttttattgtccttatcatagatttcagttgtcttttctaactccgcctgtaaattaccaactttagccgtcttggcttcataagttaaataggcactcccaattaagatgacggtcaagacgagtacaattagccaccgtgtgatttgtcgccggtgccattggtagccgacgacggcagcgaatcgctgccaatagggtgctaaccaattgccaatgactcgtaagccgtctttgatcgtggcccaaaaaccatttttttgcataatcttccccttgttcagccgacgcacctgtcacaacgtccgcgttacttgttagcttttacaattgtatcataaattttccgatgctcagtaattgaccacaaccttgaaaaaatcttcaacaatcaaacgcaactcattttgtagataacccgatgtttgccagttgttgccgaaatcactgatttaggcaacgtgttgtaaccagattaaaggtcactacgataaaacggccataaacaaaaaaagcttccgagccgtccatatgacatacttgaaagctagctcagccattacttgcgccggacaccccggcggttagcgttgagctcattttgttgttgtttaaatttatcgaaggtcgcatcgcgttgtttttgattctttcgaggcgcccgtttcttcgtatatttcatatctcacacctcttttaatgacaataatcataccgtgaacgacggcctagtgcaaccaattagactgctcaccacagtcagtcttcattactaatgtgactagcaaaggattcgtatagctgctttgccaccgtcgtattcggactcacgacaaagatcgtgtcgtgaccagccaaggtcccactcacttctggcaagttcaaatcatcaatgatcgccgccaatagattcccattactcggtaacgtatgaataatattcatgaattcaacacggtcaatgctcgtcaccacatcgtgtagcgtttcaaatagccggtcctgttcatttttgttagttgttttaaaaatcgcgtaccgcgtctgaccgtgctcatccggcgtcttaacgatctgcatctctcggatatcgcgcgaaatcgtcgcttgcgtcgcagcaatgccctctgctttaagcttagccatcaattcttcctgggtagcgatcggatattcactaattaattgttcgataactgcttggcgctctgactttttcatgtcgcgaaacctccccaaatcttgtaatgaatacattatagcaaatattcacttggcaaactacgcacagaacttcaaaaagcacattttccgccactattaggaaaatgtgcttaaacaaatttgtataattatttaaaagtaatgagtcaaccacggttaccagtccactagtaactaatcaaagcggcgtaaatattgccctaataaatccagaccccgttgtaacgtcggcgtatccgtacagtaacctaaacgggcgtgccccggaatatcgaaacgtgaaccaggcactaataaaacaccggtatcccgcagtaattgttgacagaacgtctcatcatcgatcggtactattagtttaatacacgacactgaaatgccatgtggcgtaatcaattcgacccgcggttcctgtgcgacccactctgtcagaattttgaggttgcgactgactagctcccgatttcgcgccagaacgcgttggcggtgcgctaaaattctaacggccagttggtcattcaaaacgcccccgcagatcatcgtataatcacgatacttccgaaaaatatcagcaatggcttgactaggtgtcgccgtccacccgatccggataccaggcgctgaataggtcttggataaactgttgaccgcaattccacgctcgtataaatcggcaattgagacgaacggggtttcatccagtggctcgtagacctcatcggccaaaacgtacgctccaactgagcgagctaatgtgacgacctgttctaacagtgttcgatctagtaaactcccagtcggattgatggcattattgagtaaaatcatctttgtttccggccggatcaagcgttgcagttccataatatccggcaaccagcccgctgactcatgaatatgccaataatcaaccgtagcgcccaatgacttgggaatatcatacagctgctgataactcgggtacagtgcaatcacgtgatcgccgggttccaccaaactatagattgctaaatgattagccccggtcgccccatttgtttggagaacattggctgctggcacttgctcgtataactgactaacgagttctttaaatcgtggtgagccctcgatccagccataatccatccgggccgcccctagttcttcgtaaaaatcctgtggtgcttgttggtcgtctaaagccgcaatttctgccatcgttaaggctgcgattgagctttgactaatatcagtggttgcttcacgctcatgtgcgtttaaccaggcctccactccgaaaccagcaatcttcatgcgtatcgtccctctcataaaaagtccaatacgactagcataccgattgtcagaggtaaccgcaactatattttcgtgatgaaggttgctagcaacttcacgccgtatagaataatgatgccaccacagattcgattgatccagagtaggactcgtggttgcatgagatgtttaaacttactgatcaagctggtcagaccgatgaaccaaataatggatgctaggatgacccccaacataaagaaatgggtcagtgccgccgggattgacacccgaaacgccgccaacaacacggaaccatcaatcagtgcttgcggattcagccatgctaccgaaaaagcggtcagaatcgctgctttatatgaaaagtccgcgtcgagggtccccattgccgtggccttttgccgcaacagattccagccaatgtaaaagaccaataaactcccaatcaacaacacccctaattcgagccagggagtggtctgcaacaatcggcccaccccataaaagcaagctagggagagcgacgtatcgaacgcaattacaattaaagccacccgcaatgcccgttgcaatggttgttcaatagctgtcgaaaccacaaataagttttgcatcccgattggtgcaatgtaaacaattccaaataataatccttgtaaaaacacttgcatgttttgacctccttaagaccagccaattcgattcttttaccaaccaattatcgttcaatcaattggtcatatccgactagcttttaattcagagatgattataatagagataatttcatttgtagccaaccaatttaacaattttcacccaaccacctgaatcaatcatcaaatttctggctagtagaatgacagcttaattcgcccgcatgggcactcaggaggcgtttgccatggcaattttaacgatcaactggcaaccaaataaacaggtcagcacaccaatttaccaacaaattactaactattttcaagaacaaatcgcgaaaggcaattgggccgttggggctaagcttcctgcgcagcgtaaactggccgaacaattcggcgtgaatcgtagcaccctaattacggcacttgatgaactaatggcagtcggcttaattacgagcaatccaggctctgggatggttatttcaggtaaccattggtccagcttattggcggaacacgtcaactggtcgcaatatgttaaagcaggccaattcaagcccaattcccacgcgctccaaaaaatcaaccaatttgaaaccgatgcggttattcgtttaagtacgggtgaacccgcaccagaacaatttccccgtccactttttcaacgggcctttgcacatctaggcgaacagttaacgagtttgaactataccgagcctgcgggcattttggctttgcgacaacaaattgcacgtcacttggaaaaagttgggattcatacccatccggaaaacattctgattacttccggatcattacaagcgctccaactggtctcaatgtcactatttcccaaagatgccaccatctacacggaagcacctacttatgtcaaatctttacacgtctttcaatcggcccacacccatctcgctggcatcccgatggacagtcagggcttggcgtactggcagatgaacgcccccattcagggacaccatgccattctttacacgattccgacattcaataacccgactggaatcgtcatgagtgccgagcgacgtcaacaggtcttacaaaccgcacaagaacgccgcttatcaagatgtctggttcgatcagcagccgccacagccactgaaggcactcgataagactggcaacgttatttattttggtagcatctcaaagtcccttgcaccgggattacgcatcggctggacggtggccgccaaaccggtcatcgatcgcttgactgacgtgcgcatgcaaaccgattacggcgctagctcactgtcacaacttgtactggcagaaatcttagctgatcctgaatatgaaacgtatcaagctgatttccggtccgtacttgtcaagaaggccgcggcggcagaacaaattctgcatcattactgggacgattttgcgacttggcagacgcccacgggtggcttttatctgtgggtccgcttagccgacaacattaatattcccaaattattcgaccttgccactgcgcacaacgctctcttcaaccctggtagtatctacgatttccagccgaatcagtacattcgtctgagcttttcttatgaatccagcgaccgctttgaacaggggattaaaattctaactgatttaattcacgccaattttaacgtttaatcaagtaaagatttcgttaatacacctgattaaccatcatcgatgataaaactatgctagaatgaagactgaataattcacaataatgataaggggcgtattttgatcatggatgatgttaaagcaacggtactatcgatcttgcaagatttaactggggaagatgtttcaaacaatatggatgccaatttatttgatgaaggtatcttagattccatgggttccgtacaactgttactagaacttcaaaatcagcttggtattgaagtgcccgtttccgaatttgaacgttctgaatgggaaacgcctgctaaaatcgtagctaaggtcgctagtttacaataaataaaaattcaaatcgccgttaagcacgctgcttaatggcgattttttaattagctggaaaaattgtctaattaacaactgatttactgcaaataactttaatttgccgatttccgaattatccgtggcaccagcaataatggctatcacaactcattttggaaaattttacgaaaatgatatgcaaagtttacacaattttgataaacaaacgttcgctaactgagtaaactaaaatcactaaaatcatttttgtaagggatggtattttgaaaatcagtgttcatcagctcatctgggtcacgattggcgcaattagcttaactatttttaccggattcggacacctatttgcccggcaccaccaggctattgccagtaatcggccaatcactaaagttagtcattcagcaactaaggtaaccacgccagtcccggagaccgttgactggcacaagccctccctgtcacggctgtatcccaaactggctaaatacgatgacatcaacattcaggtttcaatcaaaaaatagcgagtctacttaaaaaaccacgatcagaccctttataccatgcttgcttctacgggcaaacatggctctgatacccccaaaggacactttgaaatccaagccgaacgaggacaacacttttttaacacgcaatcgggtgaaggcgccaattactgggtctcattcaaggatcatgggatttacctatttcactcagtcccagtcgatgctaacgatcaatacatcgttaaagaagcccagcaacttggtaaagtcgccaattcacatggttgtattcgcctgacgattgctgatgccaaatggctctatgaaaccatttcaacccatacaccggtggttgtcagttaatgaaaaaagaatttaggccacatcctaacgaccgccataatctactctgctatctcagcagcatgttaattacctttttgggcttctatggctttacttacctagtcacctggttaacgattgaagagaccggtgatccccagttactcggcaacgtcatggcgatgacaatgctgccggcaatcggtctgaacctagtagctggtcgggtacttaaatactactcagccaaacaaatgatgttcattacggatattttgacgggaatactcttcattggtgcctattacgcactaaatacggttagttggcaaatcacttgcttagtcatcgtcgccgttcttaataaatcaattggggtcttttataagctcagtaacaaaacgattttgccagacctttttgcgcccgtaaatattcaaatcgtcaacggctatcaaactcagattcgccagttggccatcgttagcgcgacaatgctcgtcacgatggcattactatgggtaacaccggctaccctaatcttaataatggggatagcgttcttggtttcagccggcctcgattggcaattccgaacacgttccaatctctcctcggattcggttgtcaccgtcaagctagaccgccatcgatcatggccgacatggtcgttactgtacgccgttctcggttatctggtcgacgcgacgattgcagtagccgttccttggctcgtcgtcagcaagttgcatagtcactggccacttagctggttcttaacagctaacgccacaggtatcttattggcaccactattgctaaaacgatggtcaaagcaatccctgctaactttgacggccttcaccggtgggtgcttactacttatgtggccgacctttgccagtcttatgattaccatgttcttaattgttgcattacgcggacagaccaacattagttttttcaccactatccaacaaatccccacaaacaatcgtaatattctaatgacgggggtcttaaccgtcatcgacaccactaccgttattggtagtttgctagcaccccgtttgatcttaatgctcggttcttggaccctccccttgcttggtggtggtatcctcttgttttgtttgacgcggctaattatcttattgaacaaccaaaagcagtcttcatccgatatcgacgaaaactgctgagcaacactcatttaatttgaggccgaggggcccagatcttgaccattggatgcaatcactcgctgataccagtagaaagagtccttcgggattcgggccagagttccactaccatcgtcttgacgatccacataaatcaatccgtatcgtttagacatttgccctgtacctgcagaaactacatcaatacagccccaactggtataaccaatcagtttgacgccatggtgaattgccgttgccattgcttgaatatgtttacgtagatagctaatccggtatacatcatggatttgaccatctactgtcaaataatccttggcacccaatccattttcaacaaccattagtggtaaatgatatcgatcattcatcagctccaaataatattgtagaccagccgggtcatccgcccactcccattcagagtattgtagatatgggttacgcgcgcccatcgaaaaattaccgccaacagttgcactgacctcatgtgttgtaactgccgttgacatgtaatacgagaaggtataccagtcaaccgtaccggctttcaaggcttctaaatcactgtccgtaatgtctaaatcaacttgatgctcattccataaacgtcgtgcataggttggatactgtccctggcactgcacatcaccacagtaatagatgttttgttcccagacgtaccgattctgcaagacatccgccggatcacaggttaacggataagacgtgataccgcaaatcatgcaaccaactttattttcgccatcaatcgcatgtgcttgctgtacggctaaagcactagcaacaaattgataatgtaattgttgataagcgcgttggtaatctgcatcaccggctttggcacgcaatgccagaaacatgattgtattattaatttcattgaaggtaatccagtgctttaccagcccacgatacgccgtaaatagcgtttccgcataatgctggtaaaaaccaatcattcgacggtcattccagccaccatacgtttcctccagatacagtggcatatcgaagtgtgaaatcgtcaacaatggttcaatttcatattttttcaaagtttcgaacacccggcgataaaaatccaaccctgcttgattaggttcattttcatctccgcgtgggaaaatccgtgaccaggaaatcgacattcgatacattttgaaacccatctctgcaaacagcgcaatatcttcttgatatcgatgatagaagtcaatactagtctgattaggataatagtcatctggcagtaccgctccgtgtgctccagcaggaattgaatccccttttccaggagtaccatccgcttgcaaataagtgacttgccgtcgctgattaaggcctcccattgtcgtaatatccttcatagtcaggccccgaccatcaacatcataagcaccttcgcattgattagcggcagtagccccaccccagtaaaaatcagccggaaattgcatgttcacacctctttctcaggcttcacaggttgcatgggcgcattaccttgattcgaaactgccgcctctttggcaatcagttgcttttcataaactttaaagaagggataccagataagcgctgacggaatcagcatcaaatagtcagtcaatgcgttgcgccaactgagcgtactgagataacttccaaaacccatgggtaaaatcgcggtaattacaatccaccccggtgttaaaaatccaatcttgtatagtacgagtgcacacaacataactaccggaatattcaggacaaacgggatactcataatcggattatacataattggaataccaaaagtcatgggttcattaattttgaaccagccggggataattgacagcttaccaacggcactcagctgtttagatttagaacgcatcgccattagcgctaacggcagggtattcccagttccacctgctacggtcataaatgagaacaacatcacaggtgcaaacaccaccggcttcccagctgcctgcaatgcggcattttcagaaaccgcttgaatcactaacggcatcacaattgggactaaaatcatcgtaccatgaatgccaaaggtccataataaagcacccaagatacacaggacaaaaatacctatggttgaagtcagtgcactcagtggaattgccagtaattccataaaacccgaacaaatattatacttaccggctgttccaaccgtgactaataacgatgcgcccaagaaaatcacggcgttaaacaataatggcacaatggatgcaaaaccgtcttggagaaattgggggactgcatctggcatgttgattcgaatattcttgtctgtacataatttctcaacgcggacggaaatccaaactacgacgaagccaataaacattccctgagcacctaaataggttgtatcaatgctaactgttccagtcttactgacaatcaacccaccggccacaatccaaaaaccaaataatgcgtcaatcgcattcatgattggggccgtcatttttaaattcttggcgtaatggaatcccaagaataaaacaacccaaattgataaagaattcattgagaattggaatggaatcttcaagtaggctaacagaatactctttgctgataacacgccaaacatcgtcggtccaagtactgacatcgtgatttgaaagatcgcgccaaccattagaatacccatcaaagacatcatagctgcctgtaatgcggtaataaacttattattgccaagtccctggccggcgcgttgtaagccgaccatcagtttactattaaaaaagcgttccatcgtccttcacccccgaatactaatccctcgtcatcacaccaagttctcggccagtttgaaaatatgggcactgtcacccaccgcatagtccaatggtggaatagcagcgacgggcaacccagttgccgcctcaacttcaccctgccgataagccacttgcggccccattaaaataacgtcatagtcctgatagacatcttcatacgcggacaagcctactgcctggatttgccctgcaacaccttgttcgtcacgatattgctgtaactttttcattaaaatgctggttgacataccgcccgcacaaactaataacacgttgattgccttcataaatcgaccatcctttcaaatttttgagacatctttaacatctcagcgattaactcgttagctaacagactcgtcataaaatgatcttgagcatgaattagtaaaatatcaatggaaacctgttgaccattcgcctcagccaccagtagttgggtttgaacatcatgtgctttccccagtgcttcactagattgcttcaataacatcttagattcggagaaagcatcgcgatgcatcgcatctaacgcattaaaagccagcgtacgaccttcaccagaatacgcgataagtgtcattgcaatatcttgagtttcagtattattggctaatgtcattatccggttacctactttctgtatttgtcgacaaacatatcgtaacaagttttgtcattaaccacaaaagcgcttacatatgcttgtgtatagatttaaggtccatgaattagcagtatcaacacacacgtggcgtcataatagctgaattagactaaatatccaacttcatcactattagtgtataggtttaatgaccaatttatgtattgtgtatagctgattcatcgggtgtatagcttactcattttaacacgtttttttcagccttgaactgtctaaaatgtctcgctataatcgaatcatgaaaatcattcgcacacttgccgtcacgaacacggaattttatgactggttagaaaaacaactactcatagagattcaagccgctactggtgaaatactcacagcaacgtcaatcaagaaaggactgacatatacaaaaacgaccgccaaaacggccgctcagattaaaattacgattgacgattatcagcgtgggattaagtaccaaatgacagctatttcaccactggataccgtaaccgtgacctattcgaccattgctgaaggcaccaaaacaaccgtgacatttctagaagatgttgacagttatcggccacaacaacaccattggctactcagaaattttagtcaagcactgctactcggacggatgtctgacaagttattgcaactcgaacaacaaatcattgctcaccgaacgacaacttgcaaaccgagccaaccatagatactttgtcaacggttaggcctttaaattcatacgaatcgctgaccatctaaatagtcgcttcaagcaatcgccactgcttgaagcgacttatttaagtctcatttaaaaactgctccgtcaatgctagaaccaaccatcatctccccatcaaaatcaaagctgacaccttcctgatatcaatctcaaacgattatccgtggcacttaagattagtgtaattgctttaagatgaccagtaacgtcccaatcatctcatcattcacaatcagtttaaatgtctgctcgaccggccgtagacaccgtcgtaattgctgataatcttgcgaatactgggtcactaatttccgcgtttgcgccgttgtcgtcacaatcttgccagccaaaatacggtcaatcatgctacccaagtgaacaaacaggccaatttgttgatcctcagttagttggtataaggttgtcaaatcatccatgagtggtggtaacacacgctgcaacttagcaacttctgcgtattcgaactgcgtcttaaaatactgatagatctgattataagtatcccagcgaccagcttccggccgaaacatcatcacttgatctaactgctgatgtgaatgttcaaaaattgctgccatcgaaataaacggaatgccgaataattgaggatcaaaggtgccgacaaatgcatgaatctgataaacctgttgtagtctaagtacggttgccaccaactcatcacgatgcccaattgccaacgctttgacgcgcatctgtaaccgtgaatattggtcaatataatcttttaattgcgcagcacccccctcacccgtatgacacagcgtaataatcaattcatcttttgttgtcttttcggcgttcagttggtttagatcgacttgcactagatgataaacatcgtccacgtccattacgcgcgcactctttcgagcagcatcgactccgactaaagtcactgggacttgaatcatccgaattttggtcgcgagttcgccttgaatggtcgtcaacatccatttgattgcccccatatcataaatgactagcacacctgcaccgcaatcaatctcgctgattttatgcttcagtgccttcatcaccatcgtgctatcggctgataagtcaacatcataagcataagtattgctgacagcgctgagcgtgttcgttgttcgcatcagggcctgggcagtccccattccttgcatgacgtaaagcacaaccgggtgatgacgcgtcactggtgattgtgcaactaaaaacgttgctaataaagcagcttcagccggtgaaatggtcaaatctagttttgtcgctaagacctgtgctaatttaacagcagcctcatattcggccacatgttgtgactgtaattgcgtgatcattgtcgctgatgcaggtttggtcgttggcatttggcgatacatcccattaatgtgtaaacataatccattaaacacactctcggtcaacggccgtgccaataaccgttcacaatctggttgccagtctttgacaatcttaataattagtggcgcaacgatttgtgctaaattttgcgtattggacgcacgctgttggacgatactcggttttatcactgacggtgattgttcaactgaccttggcacttggacactgcgaggacgtgttcccggctcaacttgttgccgactcgcttgcaatgaatctgagctcaaacccgaagacgacttggccgcaaacgataaatcagctgctgccaacacggccgccaattcttgttgatagtcccgttcgtgcgctaacgcttgttgaacggcgggcgatagatccgcaaggtacacgcgaacttcacggtcagcatcagccataaatcggacataagcctgcgcacaggccatcgtgatggtcgctttcatcgttttcaaattctgatcataatttgacagcatgagcgcctgggcaacggctagttccaatcgaatcgtccgcttggattgttgagcttcaatcgtcaaaaaacgacgaatcaacgcccatctttctgaccacggtcgttgcttaaaatcaggtaattcaattttcattatcaattgctgcgtcctaagaatttcctgatcaatcccgctcactaaaatgattaacggtggttgcttatgggacgccacggcttccatgacactcgtcaattgtgcgcgttgcgggccatctaaatagtcgtaatggtcgatcacaacaataccgccctcggagtgtgcccaaagactgtgcgctagctggccatgctcaccaaataattgactatcaagttggtgaatatcgtctgcataatcacgacacttaacaatgatggggctgctagctgccgttaatataccccgttgctcaacaaaattctgaatttcgtgtacaaacgtggtactgcccgccccaccgtttgccacaatgtgaatattcaaaggaccactcggatacaaaacagccgcttttgctagtttgatcgcatgttgcaagctatttaaacgaccaattagtcccgtaaatggctcttggaggtgggacgcagctaataaaaattgaactggccgcgtcttagtcttgaccaatttttgtttgcgcactaaggcattcaaagccgcgctaacatttgtgcgttgcattttcaattgtgtagcaatgaccattgctgtcacaccatcgtgataccgcgtatccgttaaaaccaatttgcgtaccgtatcataaataagctctcgtgtcgtttccattagatttcccccacaaaattcgcatcactacatttataccagatttgtacatatttcgctgtgattggcatccgcaaaaaagcacccgttgctcatcacagcgcgtgtcgttttgatcaataattagccataattacgccacaagtttggttaaaatttgcgtggcatccgccaaaactttttctgggtgctggcgggcgtcggtcaacatacccaatggctctaaattcattgcagcaaattctgcgtgccgagtttgaaattgacgatggaatgggagtaagtcactggccgtcatcgctgacctaacagctactggtgctggataacgattcaaaacggtgtagattttagtattggtcagtgtgtattccatgctaaactgtaaggcccctaaatcttgatacaacaacgtgttgacatccgtttcagtcgaataggttaaaataatttgttgcgctaatggcaaccagcactcgttgagtaaccaagtatagttatcgtgtttcggacccgtagaatcaagatctatcaataaataatccgtctggacaccctgcaacgctatccaaaagttgttgagctcgttagccgttcgaatatctgactgccactcatggcagtgatgcttttgaatggtccgccacgtaacggtttgataattgcaactaacgatggtgaccgtcattttccaattagtcaatacgttcgctaacgccagtgtcaacaagctcttgccactagcaacctgcgttccaccaatgactagtgtctgtggttgtttcctcaaaacaaaaccctccttagcttaatttacaccaacagcatacccggacagtcgctgaattactagtgttttgcatgtataacaggggggactttgggctttttatgagaagtcactgataagtttgttggcgaattaattcactcgttgaataagtcaagtgggcgatggattaattctgcatagggttgacaagacacggttttggccataaaaagtaagcgccaacatgtatggtaatcaatttaaacggtagattgcaaatttaat

SEQ ID NO: 35 - DNA, 49090 bp, Lactobacillus plantarum
ctgagaagtataacaatcctggcgaagtgatcgcctatcaaacactggcaagattatgcgagaagattgatgctccagagttttcgattagacaggccagtatgtctaacgggatcgttaatggctactacattatccgggtgccgaaagtatgagcaaagtcgtgatcaaaggcgagctgcctagcctaaatgagtacatcaaggctgaacgggccaacagatacgccgcagctaaactaaagaagcggtacacggccttatgtagtgtgtatgccagggctagtcggaattctggaatcgaatttaattggccttgcaagcttaaatttacgtggtacacgaagaacaaccggaaagatgcagataatatcgcgtttgctaaaaagtttgtgctggacggatttatgaaggctgggattttaggcaacgataatcgaaagcacatcacaggattccaggacgaatttgccgttgataaacgaaatcctagagtagaaatagatgaaatcacggaggacgagaatgcctaaacacacaaagaaacgttcaacgattaaacggaagcaccggcaaattaatagtggaatgaaagagttgcgtaggagattggcgagggaccgcaaccagtgtttgatgtttgagcttaaaagtgaggctgctggtgttcaacaggccattaatgaactagatgatttgataggagatggcgacgatgattaaatttagagcgtgggataaagcgacaagtagctatcgtaaggtgctagaaattgagttttaccctgacggcgagttaaaaaaagtcaaagtaacaggccttcaacgtaaaggcacaataacacctgataatctggtgctagaacagtttaccggcctgacagacgtgaacggcaaggatatctatgagggcgatattattgaagttacatctcaatattgggggatgttagggaatagatatgaggtcaagtttgagcaaggcgcattctacgttaaatatggattattatcagaaatttcaccaagtatatcagttattggcaacgtacacgagaaaccggaactattggagaaaaagaaatgacaattaagtatgagtgccaagatatgttttcacacgagatcatcgcgacgttcgacacctatgatgaagccgacaacttcatggacgcagcgtatgacatgcccaactggtggacgacaccagcaatgactattgtggaggtgactaatgatcgcgagagtaaacaaaaagccgcctactagggcgactagtcattaggaccactcgtatgaccgttgtaagtataacatataaaaggcactgccaatgctgacgccgctacaattgattcccacaaaattaattatagcatacgaaagcggaggggcgcatgatgggcgaacagcaagttatttcagatgaaatttttccaccaattgaccaggagaaaacaattaaacaggtgcggcggttcctggataagaagttaccgaaagcagttcgggcgtccggccattcggttgctgatttaaaatcgcctagcatggatggcatgcctaagtcgtccccagctggtaactcggccgagaatcggattacacgccgcatgtatgcagagcagattgtccgacagactattcaggcaatggctcgctgtgatcatgagtgccaggagatattagatcggctatatttgcaaggttacagcgacacgatgtgctacatggatattggctacagcaagacgcagtattttgaccgctggaagccattggcaatgctacagttcgcacagagctattacctagaagacctgaatatttaccaaaaccgaactcaaaccggactttaaccgaacttcatagcaataaattggtggtaaattagtattatcgataattggttagggcgacaaataaacgtttttctgatagctctaattgattattattgtggccttagctcagttggtagagcgcctgactgttaatcaggttgccgctggttcgagtccagcaggctacgttagacggggacaaatttacggctacatcacctccttggttaaatcgatacggttgcccgtctattaagcagatatgatctaattggcaagatggcggtctccaaaaccgtctatgttggttcaaatccagctatctgtgtagccggcggatttataaggggtgatgcgcttctctctgccgccggcattagtcttcgtatttaacgtcggccgttaaatgtgagtatcgctgtgggctaattggcaagccacaatgggatgtaggttcgagtcctaccggcgatataattagcggggaaagttgcgaatctgaaataagttcgcgacttggcccacaccaatcatattgacccaagcaagtcactaaactgctgaatagggctggagtcgtgtttggaattaacttcataacatgaactcccatcgtcttgtttacattggctgtgcttgtggcggaataggtagacgcgaaccggtatcgaagagatacatgctttagtggctgggcaatggcccatgtcgggtgcaaatccctaccaagcacattaaacgggcaatctccaaactggctctcgcttattggcgggagtttttgtataatctatagtagtaacttagattatttaatttggaggatgatgattaatgactgaagaaagtatttctgctcaaattgttttttctgagaatattgatcgtgtaaataatcaaaacggtttaggcagtacagttagattagtaaatcccactctaacgcttggaatgcctatcgttcccacagcactttctttttctgcgactgttttaactgatggattgagttttgatactgatcatcatattaagtttacgattacagatgaaaataataatgtgttgagcaaagttgaaggtgacattaaatcattcgctgagcctactaagggcggctttaattttaatcttgattttagaaatgtagttttccaacaagctggcgaatataatggaatatttagcttggatggtcaaaatattcaaagccaaaagtttagaactttcgcaactagcgctgccccaacagatggtatgaattaagctcatggaatcttccaacaatatttttttcaattcagatagtgattcttatgaggactctgcatcttttaacaaaggcaaaaagcttttgacggctatttttggtgcatttgtggtagcatcttctataaacaatggtcccattaatctgtcggcagttaatccagatgttacaagttcaaatataaaaattgaagatcatgaggctcgagacactgtaaattaccaattgaacggaggaatttctatgtctgagaataatggctttttaactgatcgtgactatacttcattaaataagcttatagatacacataataaacgacttgatgaacagattgcattgacccaaaagcttattgataatcaaaataaatatcaaaaagaaagcctagatagagtcgaagctagtttaaaagaattgaatgataagattgacgggttgccaagccaggaagaaacaatccaaaaaattgaagatacaataaaagcagaccaccgacagttgaagacttgggcgatagcaattgtagctattgtagttccaactattgtacaaattgtattacattttctaggctagaaagcttcgtataatagctatgcggagcttttttgatacatacgattaggaggaaccacaatgaatatggaagacaacgaggctattgagaatgattggaaaaaagttaatctagaactatttggggtacaatatccattctgttcaagcaacgaggcaactcatggtaaagatgattaacacaaaatatggctacgtcacgccacaagaagcggagatagatgcccacttagataaatggatgaagcgtcgtgctaaacagcatggcgcttttagtttggataaaaataaaaaggatggtaattattatgaacaaagtattgttgaaaaagttaaacactgaatacaatgaactgacggacaagattgctaaagcttggccggctgccagtaacttagatattcctgatgaacaacggcaactcattggtattcaagcaagagctatggaaacctatgcacaggtactggcaattcggattcgtttactcgaaaaataataggattatcaatctaattccaattaacggaggtgtggtgatatgtaatgaaacgaaagttaacgccaaaacagcgtaaatttgccgatgagtatattaagtctggcaatgcttatcaagctgctattgaagctggttattcgcgcaactatgcaaaggcacaatctagcaaattgttggaaaatgttggaattaaatcttacatcgatgagcaaatggctgagatagcttccaagcgcattatggacgccacagaagccgttgagctacttactagtatcgctagaggggaaactaaagaaacggtttatattagcactgctgacgtcgtttatgaggaacacaaagaagctgacttgaaaacacggataagcgctactaaggaaatactgaagcgttatccggataacgataagcttgttgaacaacagattcgcaagcttaaagctgatgcagatattgcggaggctaaggctaaacgatctagtaaagacaatcaacaagttgtcatcaactttactgacgatttgcccgatgacggccaacaaaatacttgattgtatatgagatggctaatagtatgacaaacgccacgataaaccaccaagctatgtatattaaaccgatgactgctgcaatcaaaatgaaatctacaaaccaatttaaaccccgccatgccatatgaaagaaaattggtagtcctaaaaataaaataattattgctattatcatgttaacgtcccccctggagatgatgtcatatgtcaaccacccaacaatttaatttaagtttacgacaattaattggttctggctatactgatttctggcgtgatcatcacttttaccgagtgattaaaggcagtcgtggatcgaagaagtcggtaaccaccgctcacaatttaatttaccggttagttaagtatcattggtcaaatatcttggtcgtaaggcgtaatgccaataccaacaagactagtaccttcgtggaatgcaagaaggctattaatgacttccacttagcacgttactttaagtataacgagtcattgccagaaatcacttacttgccaactggccagaaaattatctttcgtggccttgatgatccattgaaactaacttcagttaatgtccttactggtgaattgtgctggctgtgggtagaagaagcctatgaaattgaatcgtttagcaagttacaaacggtgattgaatcgttacgtgggaatgatccacaagtcttttatcaagtaacgctcacgtttaacccatggaatgagcaccattggctaaagcgtgagttttttgaccagaaacgtgatgatgcctttgttcgcacgactaccgttagatgcaatgagttcgtctctgacgaatataaacagcggctttatagtttataccaaaccaaccctagacgcgctaaaacggtcgttgatggcgactggggcgtagctgaagggctagtatttgaagataacgttgaacaagttgactttaatgctatggataagatacaagagtgtgggcagactggctttggcctggactatggcttcggtaatgatcctaacgctttcgttgccgttgctgttgatgttcgcaataagcagttgtgggtctacgatgagatgtatacctatcatcaaacaacaccacatattgctaaatggttaaaagctaacggctatgaacgagccaggatatatgcagatagcgcaagccctgaaagaactgctcaattaaatgatttaggaattttaaatgctgatagcgtttcaaaaacgccaattgaggctggtattgaccaactatggcaatatcaaattcacgttcaccctaaatgcaagaatttgtggcgtgaattaaacagctacgtctttgacagtgatcgcatgggtaacacgctaagcaagcctaaagaccaagacaaccatgcgattgacgccttacgttatgcagttcgccaatatatgggggattatgatggatcgttaggtgttaaatgggatgaacaatacgcgattggtcgtcagatgggagtgaatgattattaatagtatttatggaaaacaacgttttgaccgtgaagccaaccgagactacacgatgccagttggaacatacacggcagtttcagaacagccgttagaattaatgaagattgtctatcagtttattaaccatcatcaaaatcatcaagtctcaagacttcaaactttgtatgattactacgaggctaataacgcaatcaaaaagcaagaagatagtaataatccttaccatgctaacaatcgagtagcggcagcgttcgctcgttatatgacaagcattcgagttggctatttaataggtaatccaattcagttaaaactacaagatgatactgaagtagatgatagccaggcacaaaagttccaaaatgtattagatacttttatcgttaatacgaacgcagactatgtcaaccagcaactagcgaaggacttatcaatcactggtcgagcatatgatttagtatacgttaaaaatggagtgactgatttaggactagttcgagttgatccaacacaagcatttgtgatctatgatgatactgtcgatcacaagccacttgttggtgttcgttattatcagactggtatcttagataatcaattggtggaacattatgaggtttacactgatagtcagctttttacctttcatagtcagggtggtttgcctcaaactaattcacccgttgccaatgcagtattggatgatacattgccacactttttcgatactgttccattaaccgagtatcgcaataatgatgagcggttaggcgattgggagcctgaactagaccaactagatgcactggacaaaagtgtatcgatgatggctgacttccaggaagacttcaacaacgccaatatcgtcttaactggtaagttttctaatatgacagaacctaagtatttgctggacgagaatggtaataaaaaaataggccaagacggtcagccgattatcattgaaccagctcatccaaacgttgaccctaaaaatcacatgtggtatttagaaccgttcgcagcaagtggcggtgttggttcaaccgccaagcatattattcaacccgacgctaagtatctaactaagcagtatgacgctgctggctggtcaacatacactaatttcctaatcaacgaaattcacaagtacactaatacgcctaatgtcaacgatccaaactttgcttccaatgcttctggcgtggctatgtcttataaactgtggggcagtgatcaagaacgcaaactacaggaaacgttgtttaaacgtggtttacatgatcgcttgaatgcttgtgttagctattggcaaacactcaaccaaattagttctgacaaatggaacaagatgattaaagctaacttcatgccaaacttgcctaagaatgatgatgcgaccgcacaacttatccagttactaaatggtactggtaaattcagtgacgaaaccattcgtgacatggctgaaccaattacaggaatcaatgctgatgccgaagcggaacgcgttaaagaggatacccaaactgctaaggaagatgacgataattacgctcaaggtgacggtggactgggcaacatatttgcaaccggtgaaaaagcatcgttacccgataataacaacaaagaaggctgattatggacattaataaattggctcatgctttagcaaagattttagatgttaaggatccagtattccaacagctgattagcattatcgaacgttcacatcatgcccaggttaagaatttagcctactttctacacaaaaatgtaacctggcaagatgatgccgatgatgcagacattaaagagctaaccgatgcagtgcttgagttaaaacagagtgctactcgtgaggaagaacaagtattagccacgttattaaataatctgccttacaaaactaatctagatgtagcccaggctcaagcacgcgttaacgtcgctaacatgggactaaaggttaacaagttagttcaagctaagcaggcagagatcgttcaacaggtaactaagctaactggtagtgggttaggtgggtacaataaacagcttagacatcgtgcattgtatcgagtggctgctcaaaatgagcctgagaatacctcattgaatttaatcttcaaacatgccaataatttagcaattgatttagataacattatcaagttccaaatgcaaaatcatgtcaaccctaattctattagtaaaattgttgcaaaagaattaggcgttgctggcaagcctaatccaaatgagaatttatgggaaacaacaatgcaaaagcgctacatgtcaaccaaagctgatatggagcgtattttagtgactgagagtaaagcaactcagacgcgggaatgtgccaagcaatacagcaatttaggctttaccaagctaaaggttgttaccagagataatcctcatgtttgcagatattgtgagggccacgatggtacaatcgttgaaattaaagacgctgtggtcggcatgaacgtacccccgtttcacccacgctgccattgcaatgtaattccagtacaaatggattataaagatgtcttaagtgaacttgactaattttttattgccctagatatggcattaaaaggtctattttttatgcacttttagccgacgggcgttaaacgaattaagtcgacagacgttaaatggaggttatctaatgagtgaagaatcaaagaatcaggaaaccaacactgaaggtggtaagcagtctgaagaacaggtaacatttaccgatgaacaacaagctaaaattgatgaattgattggtcaacagcacgctaaatggtctaagaaacttgatcaacagcaagctgactttaaacagcagctggttgatgcgcaaaagcaggccgaagaacgagctaaaatgaccgctgaacaaaaggctgaagctgatcgtaaacaacgtgaagctgaaattgctaaacaaaatcaagaattagcaactcagattcaggaatacaagaccaagtcaatgttactcgacaaggggattagcccggacatgttgccactggttatgggtgctgacgaagattccacaagcgataatctaggattattgcagaaatacgttgatagccaagtacaagcggctactgaaaagttattgactggtaagcaatccgtcactactgggagcaacaatacttcatcacaagaagcagggactgataatccatggtctaaagatggttggaatttaacaaaacaaactgaaatttacaataccgacaaagaacaggctcaaaaattaattgctagtgcccaacccattagccagtcgttttatgttggaaaataacaaggagagataaattatggcaaacattacccaattaagtgatatgaaaatccctgaaaaatgggggaactatttagctgaaaaatcaacacaaaacaacgcttttttcacgagtggtgtcgttcaaaacgtaccacaaattgcagcattattaggcgctggcaaagtagccaacatgccattgttcaagccattagctgacagtgatcctcaagttcccgatgacacaacggacttgttagtcaacaagattactactgatttagcgcaagctcgtaaattaggctttgaccaagcttggagtgcaactgacttatcggctgaactatcaggtgcggatcctttaagcgctattggcgatcaagtcagcgattattggtcacacgtctatgaaaagcttctgctaaaaactctcactggagtatttagttcagtcagcatgaagggtgtcaatcaattagacgctactgctgataagactgataccacgttcagcttgaagaacttcaacaaggcccgcttcttactaggtgatcgctataaagacttggccattgtggcagttcattctgatgttctccgtcaattacaagatgccaacttagttgatgctaagaatggctcaaccttcgtcttaaatgggaatggcaacgtaccaacgtcaatccaagctcctgatgctggcgataagattaaaggcgttcaaattgtggttgacgatagcttaccagtaagtggtgccaagtacacgagttatttgttcgctcgcggtgcagttggttattctgaattgccggttactaatgcaattgaaactaatcgtgatccgttaaagaaccatggtgttgactatcttgttaaccgccgccggtttgtctttgcaccacaagggttatcttggaacgaaagtaacttcacttcaaagcattcgggtaaagcttatcctacgatggacgacttagctgatggcactaactggacaaaagtctacgatcacaaattgattccgatggcacagtttgtaactagcgctgatcctatcacaagcctcggccactagtcaggaggcattctatgagtgacacacaggacagtagtaagacattagaaaacgtcattactctactaggtattactcctaacgatagtgaaaaaaaacgactaacgctatatattgatcatgcagagcaagccattgttttatatctgggacgttcggttagaatttcaggcttgccatcaggattagactacattgtagagaatttggccgttactaagttcaataaatttcataacgaaggcgaaaagtctcacagtgaagaagggctgtctttccagttcaacgttaatgacctgacaccatactatccagatcttcaagcctgggttgatggtcaagctaaaacaacgcgcggtgctactgcgattggctggtgatggcatgcgttatccagataaggtttatttattgactaagtttcttgataaagaccccgatggccttaatcatcaagcgagctatcgaagccaagtagtgcaagctaatattcaacaggtcaatttaacatttgccccgaatggcacggtgtacaacgcaacgattattcgtgtttatggacgttatcaggccgatgcgattggccttgatggtgaatatgttgaaggtgataacgatacggtgcatgagattcaaaaagttagtcagcatgataagcaaacggcgttctatatcattcataatgaggtgatactacatggcgaataactatgacaaaatacctgtcgttacattctcaattgatgttgattattttaaccaattatttgagactgctagagggcttgcacgcaatggtatgccagaggccatggaagaagccaataaggaatatcgacgagccgttgcgcttagcaaagcatttatcaagaatgctggtgcacgtgagcaagaggctgcacaaggcttagaacgcactcaagttggacatggtaagtctggttacgagccaacggggactttgcagggatcgctagaaatcaagattagtgatgatggtaagtcagtatctattatgccaatggcaacagttgcagatcagaagcgagcattggcagctattgctgggagcgacaataaaaagccaatcaccagtcaagatggtgtcacttattatggtgtttacgtggaattcggtactgaccacaatacagaattcggcacttatagaatggcaccagaaccgtttatgaagcctaccggcgagaaagtcgcaatgaggcttaataatgaatttgaacacatcatgcgtttggcagtattggggagtgattgatatgtcaccggaggaagacttactattgaacgttaaaaaatgtctgcgagcatttaacgttccggtatatgatttcggccagcaacgaccaactaagtttccacaggtagttgtcagcttgcagaatgagcaagagcaaactgatattaaagttttggattatttcttagctaccgttgctgttgatgtctatgctgatgtagctaatgttggtcaagcatacgcattaggccgtaaagttgctaatgccatgcaacgattggaactaactgaatggccatctaagtatgacagctcgtcaatgcataaattaattgataacagtttagaaggccggccgttaactcggttggcttatttatttgatatttttgtctatggaaagtgaggaaacactatatggctggattaaagctacaaacaaagagtgctgacaaaattttatacggggtcaaattcccgtgggatgataaatcagttttgattcaaatgttgggattacaagctgcatctagtgcaactaatacacgtgctagttcggcagtcaacctaaagcagggcgttttgcatacgtctggttcacgatcagaaacatttgtcgtcgattcatattggacagtcggtgacaagattcatgatggacttaaaaaagcaattcaaaaagatgtggcgattggcatttggcgcatggatttcaatgaagcaactttagatgttggcggaaaagttaagtctgtgcctgctgaatttggtatggctaaacctaatggattgccagaaaccgaagcagttaacaacttgttacatgctaatatcacttacaatatcgacggtaatacgcaagatggtgtattagaggtggctgaacttgacccgcaactattagctgacgggttaaagatgtttgattttgcccacaacactgatattggcggcaccggcaccactagctcacttggacattaatggaggaaatttaaattatggaaaatttaatgattgatggtactacttgtacacctaaacttaactatgcttttgctaaccaagtaaagaaagaactcagtgaaaacggccgtgacggctttgacgtacttgttgatggcttgttagacgaagacccggatcaaattgtgaatgcatactattacgcattagcttacttcaagcgttcacaacctagtcgtgacaaagtagtagaagcgctagaagacactatctttgctgacgatgacaagactaacgtcgcttattctgatatcattcagtctttacacgctgataattttttagcgcggaagcttaccagctttgtcaaaggatacaacaagatcatggatattatgcagaagaagctggaatcggaaaaagagggcagcgaccaatacaatcaggatcagttgggcatggaacaacttcaaacacaactggacaagctgaaaaaagttctgcaacctggtacaccgcaataagttacggccgaagcgcaggcttaactccggaacaattagagcagttaacgccggctgagtttaaagctgtttggcatggctatcaggttaacatgcttaatcagcagcgcgagcaaatgcacgctcgtttaatgccacaggcaacttatggtgtcgaactcagtcaaccgttaggcgaagttgtagaacggtccgatgaacaaattgcaaacgaaattagcaaattaactgattatcgaactaccgaagaacgacaacctgatacgcctcaaatggctatgtatcgaagactgatggaggcaaaagctggcagagaggaggccgattaatgagtgcagttgttgaaaagacatttgtgtggaaatttatggatcagattagccaaggggttgctaatgcacgtcaagcgatggacgaagcagttcatgctgctgctgacatgggatctaaagttagtgagagtggtgaaaagtggcacaattatgcttccaaacagaaagaagcgatggacgaagccaaagctaactttaatgagtataaagaccaagtagctaattcaagcaattcaatccgtgaaaagatcagcagcctaattaaccatctcaaagaaattccacatgatgttgtgacgacattaaagtctaaaatcaacgatgaaaacattggcatcttctcacgcaaagtacgggacgttcctaaggagcgctccgtgtttttgcgtgtgaaggataagttcaccgatacgttcaaacattttagtgaacgaattaagcaaactcctaagaaacattcattgctgctaagaataaaagatggcttcagtaatgggtttaaaaagtttaacgatagcgccaagaaaacacgtgagaacggccaccgcttacgtgacattatccaaggtacatttgttggtaatgcactgtacagcgcttatgacaaagttaaagatggcattgttgaagcaattaaagccggctatgattttgacaaagaacagcaggttatgctgcaaacatggacaaccttaactgggtcagcttatcaagcaaaaggtatggtcagcacaatcaatgatttaagcaagcagactggtcaagctagcagcctagttaacgagctagaacaagggttctaccatttacactccagtaagcctgaagcagatgagttgtcaaaagccatgttgaatatgggtgatgccgtcggattaactggcgatcaaatgaagtcagtaactcaggacatggttcatggactagctactggtaaagtgtctgctggcgaattaaatcaaataggcgcttatttcccaatgattgatgaagcactagccaagcatgaacatacaaccgttgcaggaatgcgtcatatggctagtcaaggaaaaatcactggtaaagaccttgagagcgtttttactgaattaggtaatcacaagtatggtaaagcggctgaaaatatgctaaagaccatgactggtatgcaacggacggttaaagcacaaatgcctaagcttctaggtgacattgaaaaaccgcttctaaaagcgcaaaacccaatctttggtaccatttctaaatgggtttctgaaactcataccgagagtttatttaaaaatttaggtaacaaggtaagcaaagggttcgctacggttactaaagcttttgctggcggcaatttcactagcaagggctttacaagttccctagatcagatggttaaaaacgctggtaagtcagtcgacaagctttcagcttggcttgccaaaaatgctgataatattaaagcatttggcagcattgttaagagcagtctaactattgcttttaaagttgtgggcgcagctattaatggcgtggtttcagtgctcggatttttagttaatccacttggtaaagcatcaaataacagtaaagatgcttcaaggtctataggcggactagctggtattctaaaatcattagcaagcaatggaccagctattcaaactttcggtaaaatactagccggagtttttgttttgaaaaatgttagcaaattcgttggtggcatcaggtctgttaacgataacttaaaaataactagtggccttaaaaatcttggtaagccagtaaccgcgtttatgtcttcattaaagggcggttctggtgttctaaaatcatttggagcagcattaaaagcagtaccgttcacaatttggatcgcagctattgcggcaatcatatttgctttagttgagttatataagcacaataaaaagttccgtgcgttcgtaaatgggcttattaacacaatcaaaggttggtataagaatgttgttaggtggcttggtgatgctgtaaagtggatcaaaaagacgtttggcccgttctttaagtcagcaattaaatccattcaggcattctggaaagagattaagccagtggtttcggctggaattaagatggtcaagcaagttcttaaacttggcatggctgtggtaaaggcagtctggaaggttgcttggggttatatatcgcttgaagtaaaagcaacttgggcgattattaagccaattattgatattggtatggctgtaattaaagggattatatcagcaggaatggctattatcaaagccatttggaaagctgcttggaaaattattagtgcggtagtcaaatccgtttggaatgtgattaagccactgattattggagcaatgcacgtcatttctgatgtaattcaaactgttcttgatattattcatggtaactggagcaaagtttggaaagatattaaaaacgtcttttcagatatttggaaagccttgtcgcaagcgattaaagcttacatgcacggaatgcacgatataatttcatcagtattagatgcgatcagcaccgtttggcatggtatgtggcaaggattaggagacttcttcagtaatgtctggaaaggtatcaagcaggccgcacaagatggtattaacggcgttttgagcgttattaacgctggcgttgatgcaatcgattcagtttggaaattctttactggtcataaaactagtattcaccatttagagccagttaaatttgctcaaggtggtgtcgtgcatactcgtctatcaatggttaacgatggtgccggtcagaactggaaggaattgctacaactaccttctggtgaactaaagatgactcaccaacgtaatgcagtgctacctttgccagctggtacacgagtatacaatggcgatgaaacagctgctatcatggcgtctgccggtgtcgatcattatgcaaacggtggtattgttggcaatgcaatcaattggactaaaggtaagttatctgatattggctcatggattggcgacaaagccaaggctgttgggaagttcctcaaagatccgcttggaaatatttccaaactacttcataaagctactgatggcctatttaaaggggaagctagttttggcgaattagctagtggcacaattagcaagctgtcgagcatagcagttaataagttcaaggaaatgctgaatagcaccaaaaaaacactggaagtatctgacggcaaggctggtcactacaatccaggcttaattgagaaagctgccaagatgatgcacattgatagtcttccatcaggtttcagtgatcttttgcaagcaactatcatgagtgaatctggcggtaaatctgttattcaaactgttcatgatatgaatagtgggggtaatgaagccggtggtattttgcaatatacgccaggaacatttgctgcttttgcaatgccgggacataccaatcgaatgaatccgctagacgaattgttggctttcttcaataactccgattggcgaaacagtattggtcatacttctatttggggtgttccaaaggttgattggctgcatagcggcccacaaggtagtcgtcggtttgctaacggtggcgaagtttttgacgagcaaactgcaatcattggcgacaacagccaacaccatgagtttgtaattaatccttatgacgtcacggcttatccactattagctaaggcgatggaaacaactatgcgtgctcagccaattgccgatgttaatactaatgttgatcaccgagacaacagtgaaactaattcattgttacgagaattgttaaaagttgtaactgatgatcaacagaatactgaagctgactcgttaacaagtatgcttagtcgtattttagttgcattggaacaaaatcgcccagtatatctaaatgccaacggcaagttgatcgatgtaactaacgagcaattaggcgaacgcatggaagatgaacggaggtatcggtggtaatggtaatggataatgatatttattttgggtatcaacaaccacaacctgaagaatatgtacaattcgctaattttgatagtcgccaattaaatttatacttagctggtcggactgccaataacccaccaactaaagaagttaccgagagtataggttatatggatgggacaattgatttttcagatatacttggacggcgtatcttcgataaccgtacgattgaatatcaatttaaagcactaaatattaattatcacgatcgtaagttactagaacgaaagtgtaaaagactgctgctaataccaatgcgtcagccgatttacgatagtcatgacctcccgttttattggtttggtaaggctagtagtgtcacagcaaatgatgatcatgttaacaatgtattagaaataacggtgcaattcaacgtctcgccctatgcgttacgcaaaggacagtttgacgatatttgggacaattttaatctggaagcagggtatgcacaatttaccaagtattcagtcaatggcaccaaaagaattagcttgtataatgacagcgatttgaaatcaaggctcaaggttatctgtcaaaatgatatgaagattaatggtaaatataaatacaccaaaaattatcaagatgaccctaactttagattaaaacccggaatcaataattttacagttagtggtaacggtgatgttgagtttcaatgggaaagcgaagtgatgttgtagtgtacaaaatattagttcgtgaaacctatcttggaaatgaagaatctattaacgaaccggatgtgtatggcaatcggattgtatcgggaaatctaagcttagtgtctggtggaatagacactggaacgttaaccattagcctagaaaatacgttgttcaatcggattttgccttatcgctggtttatcagaattgaagacctccagacaaaaaaaactattttccgaggccgcttcatcaaagttagtaaagtgtattcaaccacgcatacacaaacattgagttttgaaagcgaactagcttatctacatgacagcgcccaagtttaccgtgagattcataacaccagtgtcaatgactttttaaaaatcatagtcgatgaacataatagacaagtcgatgatttcaaaaaaataaccttgggaactgtcaatgtaactaatagcactgataatgtttaccgttatttagacgaaactaaagacacgttagacaacattacggacaatttagtcaatcgactaggaggctttttacgtattggacgcaattctcatggtcagttgattttggactatgtcaatcgtctgggaacggacaccaagcaaacgatcgagttaggcgtgaatttaaagagctttacgcgcaatcttaacgtcaacaatcttattactcgtttgattcccttaggcgctgaaaaagcacaaaaagacgataagcgagatagcaataagccgattcctaagattgatatttctagcgttaataatggtagacgttatttagatgatccaaaactaattgataaatttggcattatcgaaaatgttaatgtttgggacgatgtgcacgatgctgggatcctcaaaacaaagggtgaacaatatcttgaaaaacaagtatcagccgagattgcttggagtgttgacattgttaatctagctttaattgacaaacggtttcaatcgtttacggtcggtaatagctatcgtattattgataagtttatggatattgatgaaacgattagtgttagcgaaaaagaagttgatctagttaacccgcaaaccgtcacgattaagattggaaatcagaataaaaacctgaccagtcaacaaattaatcaagccagggtaatcaatcagcttaagagctttagtgagtatattacgtcatttaatatgcaaaataacgtacaaatttctccaaatgaatctcatccagctaatccgagtggatctaatccaaatccaccacacgatcaaccaagctattacaacggtgcgattgttgacgtatcagagttccaaagtgatattaattggtcgcaagtcggcaacgctggtttagccttagggattattagaatccaagacggtagtaatcatatcgatgccaaatatgttaaaaatattcagggtgtcttagccaataaactcaattacgccgtatatgcgttctttagaggggttgatgaatctgatagtcgagccgaagcacgtgctttttatcgacgtgttcaaagcgtgacccaagggcaacaacaaccgcggttctatgcccttgatgttgaaaccatcgagaataacgatatgcgtggcaccgttaacgcgtacattagccagcttaatgactggggcgttccaaatagccaaattgtgctatatattgcgaaccatttgtatcaacaactcaatcttgataccactaaggttgggagtatttggattccaagttatggtactaagccgctatatccttatgacttatggcaatataccgacaaaggcactttggatggtattaataccaaggtggatatgaaccaagaaccatcagaacggttcaagaaccagtatttaactaggaggtaaaattttgagcaaccaagataaatattatcgtgatcgttctcgcattacgggaaaactagatttggaggaacttccaaatgcgattcgcgaaaagcagtatggaattgatgtccgcgaagccatggcacaaactgctgaagcgattgctgaagtacaaaataccgctaaagagttcagccaagacacgaaaaatcagttcaacaaattagatgaaaagtacacgcgtgaaattcgtgccattgttttaggcgatacaactaatgtagctgcaccgacaattcaagaaccaaatggtgaggctattaatcagttgcctaacctatatgagactgcacgtggacaagttttgtatgactttgtaaagcaatcatcactgactaaagccaacaaaatcggtgtcatcggagacagcgtatcgtcacgtgctgggggatttccggatattttaactcatcaatatgacatctatgttgaaaaccttagtgttagtggtgctaaaatgagtgattatgataataacgcaattgtcaatcaagccagccgtctacaaaaatgtaatgtggtgatcattcagggtaccgatgatgattgggtgcatgatattaagttaggatatattggtgacacggacattaaaacatatctgggcggtttgcaggaaacaattaaacgggttaaaaataataacccgaatgctaagttaattgtggtcaattgtacccgtcagtgcgtcgatgtgaacagtagttaccggacagaacattctaaaaatgccttcggcttaacgctgattgactatatggaagcccaaaagaaatatcttaatcaacaagatattccttatgttgacctaatgaaacccacgagtatttttgagccggataatccggcctttaagaaaacaatgatgcacgatggcgtacatccaactccggaagctcatcagtatatcgtgcaggaaattgctaaagattattcgtattattacgataattaaaaaaggagataacaatggctaatcaagagttagtatacgacattacaaaacagccaaatttacaaacgacgcaacaagccatttatgcccgtgtgggcgatggtggcttgaaaaccgttacagtacaattgaactccaataattccccctatgatttaactggtaaacatgtcaattttgaaggggtcaaatcagatggtaccaagattattgataccagtggtggcattgtgttagatccgcaagatggcatctttagatatactttcccacctcaaactttcacagcacggggaccattccgacaagctttctttaaaatattacttggcgataatgtagacacgacaattgatgtggtagtagacgtatcacctaatttagttgaatttggaattaattctgaaagttatttgagcgagtatgaacaattaatctcggatttaaaaggcgaacaacgaaccttcataaccgaaatacaaaatattagtgaccggttaaatagcatcaagattcagctggcagataaggatgtcgtgtcaaaggctgaatttaacagcaagataaataatgcggtttttattaaggagggctagtaaagatgtctattaaagagttacaagatgttaatggaaccgtgattcatccaataaccgaaatggctgctattgcggatgctgacaaattagtgaacaccaccagtacacaaaacaatattgctggcattaaaaactttgtggacggtattaatattaagggagtaccgctatcagccattgattctatgaaagtaaaatcaattccaaataatgatattcaccagattaaccaaagtggcctgtactattactactcaaagacggctaatcgacctttaatggatattagctatctcaatggctaccttttagccagttttggagatgcagacaacggtattttgctattcattggcggcttgaccacgatggaaaagttccaaggcaagtggcgcaaagctgaaactaatactgcgatggatttatggagtggaggtgctaaagttggtgataccttgaaattagctgctgatgtcaataattttgatcgtttgcgttttaagttgacgaccccgctaggaaatgattatgtcgaacgatcaactaataaatccacattttggttgacacaggttgggcttagcggtgatggtggagccatccgggctgcagagctaactctagatcgaatggatgatcaaaaggcgatgaaactatcaaaggcattgattaacaatggtagtagcaaagccgaccctcttagtgacgtcgtcttaacgaaagtcgagggattaaaataatggataatcaaattagcttacaattagtgctggatgcgaccggacacgtgacaagctatgctaccgtcggtggactaacaggggcgacaacttatgagggtgaaattccagatgatttcttggcaagcacgcaaccgcaagcattccaattgatagataatgttttaaccaaagaccctaactatgttgcaacaattccagatgtcgttaaatatcagccaagcgatgaacaacggttccaagcaaaattagcattgcaaatggcaacgatgcagaaaaagcaagatgagtttaatgcaaaaatgctgttacaattggcagacacaaaaaaaacaccagtatcaacatcaacaccaatagctgaaaccaaataggaggtacgaattatgtttgaatttatcaaatactactttgaaattggattatacactaaagatgatttagcaacatttaagtcagcagcaatgattactgctgatcagtataatcaattagttagtaccgttgctgcgtaattaatgccaagttggctaaaaaggaggaacctaaaacggaaaaaacacttagttttactgatacttcatcacagacggtcaaaattggtgataccaccactagctttacgttagtttgtggcaatgataatacggcagtggatttaactcatgccacttcaattaccgttaaattgggaaatgatagtggctatcttaaatcgatcaaaattgatccaaataagttagctgattcatggactggtaaaattaccgttaaatttagcgctgagttgataaatagtctaccagctggtagctacgccattgaagtatgggtggctgatagtattggaacgtcaatttaccctagtgatgggtcaactgggttcactattaccaataacattcaaagtgccaatggcgccacgattacaaccattacttttgatgactttgttgaagcaatgaataaggctgcaagcacaatcgctaagggtgacaagggtgacaaaggtgacactccagatttaagtaactacactactgttactgatttaaacaatggattgagcacaaaagttactgataacaagaatggaactgaacagcttaatggagttcaggtacagccattcaataagttatcagatactattggtggacgaaacctggtaagaagcctaggtgatgtcttagtcacaccagtaggtgctgcaggatggtctaatacgacaatcggaacagttactcccgagttttttaagattactaaccaaggaactactcatcctatcacaatttcttttgaaataagtactcaggatgacccgacaaaaaccaatatttttgacagaataaagctagatggagtcacctggggtaatgataatgttgttggaactgactactttagcgttctcggttttaagtggcttgaaatgggtaataatgtttggaaaggaacatatgctttacagtttggcaaaagttcagacgctgtagatagtaacagacttggcataaaccttatgcagacaaaatcaaatacaacacctcataattttacagtcttaggaaactcattatgtttgtactggggaacacaagctattgattggactccagctccggaagataaagttaatgtttcagatatgcgtaaaccagctagtgacgtcgcagggattgaggaggttaacgccaaacaagataaaattggttacacacctgctgatgattcagcagttttacatttgtcaacaggtaatacagctgctagaccaactggcattagcacaggctaccagtattttgacactagcttaaacaagccaatatggtacacaggaaaaaactgggtagatgctacaggaacaacagtttagaaaggacgattatatgtttatttacatcacttatgacacagatggtttcattacagcttaccagaacaccgaggcagacgggtttactagggtgttcattcttgattcatggattacccagtttgcccagcattccgacaaatttcggtacgatacggataaaaatgttttactcaatccgggcaacttgccaaatgtttcgcttgaagagttgaatactaagtattccagcgtgttagaaacaagtcagcaagctgtacagtcggcaacggctttagcacagcaacagacggtatccgcaacaagtatcagtcagttacagaagtcgatcacagaactcgcacttagtcaatcagcaaaggggacagcataatatggttcaaatttatacgtgggcatatcaagattggaaaacaattaccaaggaaacactagcaacagtcgttggattaccggatggcattactgctgacgattacaaggttattaccggtgaagcatatgtagcaccaacaacgtcaacaacatcaggaacaccggtaacaccagcaacatcagaagcacagtcatcagctaccgtagataataacagcgtacaatagggggtagacaattgaataagtgcaagttgaaggcactcatcttaacggtgggggctatttttatggcctttttaatggtcaatgttactagtcaggcttcaactagccgggaccaaggggttgattggtctaagtataacggtaatagtggtgtgttcggctatagcaccgataagtttgtattctcacaggcgggtggcttctatggtggcactaatatccctcaaaccacgtataacagccaagttgccagtgctcaacaggctggtaaacgggtacacacgtatttgtgggatggtgtcggtggcaatatgaccaatgccaaggctatgatggcctactacttgccacgtgttaggactcccaagggtagtattgtcgcactagactatgaggacggtgcttctaatagcgtgacagctaacactaatgtcattctagctcaaatggccctcattaaagacgctggctatactcctatgctgtactccggcaaggcctatctcaatgcatatgttaatactagcgccattgtacgtgcctacggtagctgtctatggctagctgaatatccggactatctggttagaactaagccggattataactggttcccaagtatggacggcgtggctatcttccaattcaccagcacttacaaagcaggcggattagatggcaacgttgatttaacggggatcactaaatcaggctatacaactgctagtaagaagcaagctcaagccaacgttaagcaggcacaggcagctaaggtcgttaaatatagtcaacgtggggtgttctaccctaatcgtactctggccgtacgatacacggatagcgacaaagttagccaagtagctacctattacaagggtgagagtgtaatttataacgcggttattatcgaacacgactatgtctgggcacgttacacccgttcaaatggcctatacggattcattaagctaggcgtcaccaatgggccagcctacgggaagcgagttactggtcagccggttagtcatacgtattacacagtcaagtctggcgacagctggtgggcgatcgcacaacgcaacggcctgagcatgactacactagctagccagaatggcaagtcaatttacaccactatctatcccggccagcgattggtggtgcggtaatgacacaatatgatgatgcaactaagctattaatggatattcaaaaggatgtggccgccaccaaaacgaaagttgagaacatcgaagaaaagctgaatcaagttgacgatattggagacaaagctgacaaggcactggccaagtccattgaagctagccatcaaattgaccgcgtgacaaccattcaaaatgggctaattggtatcttggttagtggcgtgctcgtcacgttagttatttacatcgcagaaaagttcctttaggagggaaaatatgattaaaaaaattagcttcaagaatgctgacggtagcttgaatggtaaattgatcgctgggatcatttccttactgatcgttttggttcaacaagtctttgccatgtttggcattaagtttactggtgattggtcagccattgttgccgttgttaacaccgtgttaaccatccttggtatgctgggcgttgttactgacgttcaaacagtgacagcaccaacagttaaaagtgacgaggaaagccaagttgaagcgaccgctaataaggttgctgatgaagtgcaagggccagagtccgcagtcgctgcagtgaatagttctgcatcatctgacactgaaacgacgtcagaatccgcctcacaatcaggagaaaaagtagtataataatcgtgaactgttctagtcccccatgcttcggcgtgggggattttttgttaacaaaatatataaaaaagagccagtcaagactggcccaatgtttaaataaataaaatgggtgttctgtttctcctaagataataaagaacacagttattatacattaaacctgattaatataacaaggacttattaatatttttctatagattactttcggtattgtgatataaaccgacaagtgttattatgtcccttgtcctgttattagtatcacagctttcaaatccccccaagattgtcggttagtggtgccggaagtgatgaggataatcttctgcttgatgagtggaagatttttttgtgttgcttgcctgtatattttgttagtgagagtttagatttagcattattagctgtcaatatagctaattagataactacaatactttacagaatagcaagtaataagtataatactaattgtctctagtgtagtttctagatgatagttataacttgattaattcccctgcgcttcggcgtggggaattttttgcgtaaaaagccgcctgctgtaaaggtagatggctaatacataagagaaagtatctcagcgaaagaggaaaccagattattactaggttccgtattatcataggaatacatgagaaatcgtgcaactttaatacataaaaaaataaacacaacatatggcgattttgcaaaccatttgatcattcaattactaaatataggaaaatattcgtctttctacatttaagtgataatcaaattcttgacaaaaatgtcgtcaatctatatcattacacacataagaccttgtccattccgtccgcggggtggatttttttttaggagtagaccatatgacatacagtacagataaaccttttaccagtttagatgctcaattaaagatgttgaagaatcgtggtatgaaaattgataacacagattatgcaagacaggttttacttaataataattattacagtgtaattaatggctataaagatccatttttaagaaaagatggtgcaggtgaggctcttaagcctgagatgtttatccataaaactactttttcagatgtgtatacactatatggatttgacagagatttgagaaatatagtattaaattatttgttgatatttgaatcccgcttaaagtcgattataagttatgagtttgcacaaaaatttccagacccgtacagttatttaaatattgtgaattattccaacgatattggtgatctgtccaacgttctaaaaaacttaaaaaacctttcactaaaactcaacaggggaagaaatgaaaggtatggtaagcctagtattattcattatgttcagcaacatacccatgtaccgttgtgggtgctagttaatacgttgacttttggtgaaatacaatatctttatgactcattggatcaaaacctaaaggagaaagttgcgagagacttcagtgaatattataaattgcattggaaatccagtgaaaagattgatacaggagaattgaaatccttaattattgttgcaaatctgtttagaaatgtttgtgcacatgatgaacgtttttacaattacagcttaaggacaaagattccgaagtcgttgttcagcaagtactatatgaataacccaatgttcgatgacttagaaaagccagtagatttatttgcactcatatcgttacttgctttggttttgacacgtaagcagtttaaagcaatgacgtatagtatcaatagtcttatagaaaaaagcaattataagttaaagtcaattgggataggaaaagtgttagatttaatgggatttccagaaatacagtggagagaaaagatccaagttaaatctgactaggtaaagtcgatactagccacactttaattgcattgctgtgattaacaactttggaaaaaatgacaacaaatcccacactaaccttaattggctggtgtgggacttttttatgtttaagataataagttggtatataatagtggaaaaagcaaaacatcaaaaaagggccaatattaaattaatttgtgctcttccacgatttgtaaattaaaaatctctctttttcagaaatggcttataaatggcatttatagcgtgctacccttaatggtataactaccgtgcgggtgataagtcgacgtcggtagataaaaagagaagcgtcataatgctggtatatcagcattatgacgcttctcttttgctaattggtatcaaattaaaaccccaattttgcgttttggctgttgtgatcacaacagcactgttaagcgctcataaaaaagggttttgggatcgtgtcacaagtaagggtcctatgaattaattattactcgttaatagtgtctgaaaggccgttagcgacattccaggtacgacccgttgtcgagtgagattgtacgggttctgtgtgctggtggcaatgccaggtgccgttgataaggcatactgatagccagcctgtttgtcagctttaatggtctgctgattagcacggccggctgggtaacaaataacttgtgtgttctgttgtaaattatgatcgagccattttttggaacttgataattccgtaagttgaacctggtaagttaaattgtttaaatccagatggcgaacggtgtgactttgaaaatcaatattaccggatgcttgcatccgcttagcatcagctaaggttaagtggttcttcttataggtaaagccggtaataaaattaatggtggcgtgttggtgcgtctgtttcaaaattggccaagctgctgtcatgttatctttatagctatcgtcgagtgtgatccagacaatcttcttttgtggaattcgccgatgtttgagcgcgtatacggcttcattggcagtcagcgttcggtagccgtgtgcctttagataagtcatttcagtttgaaattctttggcggggacacgtaactggttcccgctagaaatactgtgatacatcaaaataggcaagtgaacatctttgacggtatgccaatgttgataaggccgtgcttggtgtttagccgagctgtgaacgcttttagcgctagtcttagatgattgactgctggcttgtttagttgccggtgaagccgcctgacagcctgttaacaggccgagcgcgacgccgagacctaatacaaagttgataccccgcatgtgcatgataaatccccccatgatttaaaaactacttcctattctaatagaatagcatgcaaagcgcgataattattgaattattgttaaaataatttccttaatgtttaaggaaaatcgaatttgattagtaatcgtttaaactgattaagaaagcctagttagggtagccagaggagctttactccgatacgattaataaaataattaattcgggggatagtatttatgaataaaaaaagggctatttggttggcggcgattattatgatgattagtgtaggtacattgttaattgtaccgacgatgacgaagaatcaggggagtgagctggcaatggcggtggataacttaaacccatttgttaaggtacaaacggtctatggtcggactaatcaggcaatcggccactcgactggtcagatgggcgaagatatctatacctatcgaatgctgaccagcgatgcgcaaggtaagcaacgctggttgacatttaccgcagatcaccggctaaagcaacgacactatttaaagattgagacgaagggacaaaacgtgaattcatgggaggccgttgcgacaaatcaggtacctcaaaatatacaagaagtattggcttaaatttaggcatagtgccgtgtcagcgattagtgacgcagcactttttttgtgttattacgaaggcgagcttaataaattcttaaatccttttgagtgctaaactgcgatgagtgcgttacaatattttacgtgagacttgtaaagatggttgacaaaaggaccgtttttagttagattaagatactgcattattatgtaataatgaatgaaggggagcgtgcaaatgcttaaaatagcaaagggtcggatttcgtattccgcggtaatcggtgcggtcttatttatgatcgtgcaagtgattgcgaccttaaatctgcctagtttgacatctaatattgtgaataacggggtggctactggtgacattagttatatctggaaaatcggatttgaaatgattggtttttcattgttatcagtcgtcgcagcgtttggcaacgtctttttggcggcgcggtcatcacaacaattagggaagaatttacggtcggatatttataagaaggtcatcaacttttcaaatgatgaatttgataaagttgagacgtcttcactaatcactcgaacgaccaatgacgtcgtccagattcaaaacgtggccatgatggcgttacgaatgatgattatggcaccaatcatgctgattggtgcaagctttttagcgtataccaagagtcatgaattaacttggatcttcgtggtttctattccggtactattgatttttattggtttgatcatggcgtttgcaataccgttgtttcgggcgatgcaaactaagactgaccgcatcaaccttgtttttcgtgaaggcttaacgggagtacgcgttattcgggcattccgtcaagataaatttgaacaggaccgttttgaagacgctaaccaagattacacgcacaatgcgattaaggttaatacgattgtggccttggcttacccggtaatgactctgattatgagtgggactaatgtggcaattgtctggtttggtggccaattgattagtagccaaacaatgcaagttgggaatatgattgcgtttatgacttatgccatgcaagtattgatgagtttcatgatgcttgccatggtatttgcgttcatcccacgggcggccgcttccgcttcccggattcaagaagtcttgagtattgaacctaaaattactgaccctgacaaggcagcaacgttaccagtgacgactgaacacagcttagaatttgatcatgtcaactatcgatatcaaagtgcggagcaattagcgctggcagatattgactttaaagcccattctggacagaccgttgccattattggtgggaccggttctgggaagaccacgctcgttaatttaatcccccgattctatgatattgagagtggggcggtcaaattagatgggaaagatgttcggcagttgaagttagctgatttacatcaagccgtttcgtttgttccgcaaactgctactttattcacggggacgattcgtgaaaatatgcaattcggtaacgaacacgcgaccgatgatgaaatctggcatgcgttagaaattgctcgttcaactgacttcgttaaagaagaaggcggcctggatgcacacgttgaacaaggtgggggtaacttctctggtggtcaacggcaacgattagcaattgctcgtgcacttgtcaaacaggcttccgcttatgtatttgatgattctttctccgcattggacttcaagactgatgctcaattacgggctgaattacgccaggataaacagattcaacagagtgtcgtagtcatcgtggcgcaacggattgcgacggtggcggatgctgatctgatcttggtcctagataacggtaagttagtcggcaaggggacccacgctgaattgaaagctaataatgaagtttatcaagaaattatgaagtcacaattacgagaggaggatcagctgtaatgagcgaaaagaatacgagttctactaagcctgcacgtcctgctggcggtcatggccccggtggtcatgctggactagttgaaaagcctaagagtttttggaaaacggcgattcgattgatgcgctacatgtcagaccggtgggtcggtttggcagtggtcatgatttttgccattgcttccgtgattttccagattcgaacacctaagattttaggtaaagcaacgaccgaactttataagggaattatgaagggggccgcgcaacagaaggctggtatcagtcaatccggttacccaatcaactttgaaaaaatcggtcagattattatgatcgttttgatcatgtacttagcctcagcactgttcaactttattcaacagtacattatgacgcggatttcccaacggaccgtgtataagttgcggcgttcatttaagggtaagatgcaaaaggtgccgatttcatattatgatacccattcgaatggggacattatgagtcgggccgtcaatgatatggataatattgccaacacgttgcagcaaaacctaacccaagcggtgacaagtaccgtcacctttgttgggaccttatggatgatgctgacgattagttggaagctgaccttgattgcactcgttaccattccactgagtgtcgtggtggttggtgtgattgcgccgaaatcacagaaattcttcggaacacagcaaaagagcttggggttgttgaataaccaagttgaagaaaactatgctggacacgtggtcatcaagagctttaacaaggaacaagatgccatcgatgattttgaaatccaaaacaataattattatcaatcagcctggaaagcgcaatttatttcaggtattatcatgccactgatgatgttcttaaataatattggctacgtctttgttgccatcattggtgggattgatgtggctaacgggaacgtttcgttaggtaacattcaagcgttcttacaatacacgcaacaattttcacaaccgatttcacaaatggcgaacttgttgaacacgattcaatcgaccgtggcttccgctgaacgggtctttgaagtgcttgatgaagaagaaatgaaacagacgaaatccaacttaccagccgaaccagatagtgataacttgattagtctgcaacacgttcaatttggttatgcggataacgacctgttaatgaaggattataatctggacgttaaacgtgggcaacaagtggccatcgttgggccaactggtgctggtaagacgaccatcattaatttgttggaacgtttttatgacatcaaaggtggttctattaaattgaaagggaccgatacacgggacctggatcgtgaagacttgcggtcacactttgcgatggtgcttcaagatacctggctctttactgggacgattttcgacaacttgaagtacggccgtgaagatgcgtcagatgaagagatttatgctgcggctaaagcggcccatgttgatagctttgttcgcaaattgccagatggttatcagacggttctgaacgaagaagcttcaaatatttcacagggacaacgccaattattgacgattgcccgggcgtttgtggctaatccagaaattctgattttggatgaagcaacgagttcggttgatacgcggactgaagtgcatattcagcatgccatggaacgactcctgaagaaccggaccagttttgtggttgcgcaccggttatcaacgattcagggtgcggacaacattattgtgatgaaccatgggtcagtggttgaaactgggacgcatgaacagttgatggctcaaaatgggttctatgcggatctatataacagtcaatttactggcaatattagtctcgactaaaggaggggtgtcaattgttccggaaaacagcaatggttgccgttactgcgggtgcgctaatgttcttattagcgggctgtggtaagacaaccttatcaacgactaaaaccacatacaagccgaacgggttagtagcggccgtcaaaggaaaatccaacgttaaaaaggttcattatcagcttgacggtggtcagacgaagacggcgacggtgcgtaatcatacgtttgttattcaagttccgaccaagacgacccgccaaacggtgaagattaaggccggttcggataccacgacggtgcacgtaaagggcgccaagaagctagttggctatcaaaagatggcgacgacttacaatcaggctttgattgcttctaaactcagcaagtctgatcaacaggcggctaagaagttgcaaactgagggtgcagcccttaaaaagcaacaagcaacgatccgagccaaagtcaagcaagcccaggcccaaatcaaggctggcggtacggcggctgccacgggtgctaagacactccaagcccaacaaactgctgcggtgcagctcaagaccaaagcagctagtttgcaaacgactcagaagcaggtcgaagcggcaatggcaacggcgaaaaagcaggtcaagtcgcaattgttaccgacgaagacgccaagtgatggcatcaagaacgtgttaacaactaaggattataagatccggctaaatgttcagaagggtgacgtattaggggcagcgatgattgttccaaccaaggcctttaagaacaagacccgccagaagaactttgggacggcgtttgctttgatgacgacaacaacgggcgccaatgccaagaaggttatgaaacagttccagaaggaaaccaaggataatagtggtagtacgacgacaatcgatccgattacctctaagggcgttcgcttcacgattggtgtctccacgtctgacttgtatatctttatgactaagtaatgttttatgagcgcgactggactttgattagtcaagtaaagctcactattcgaggttatgacgggacgaacccgtagttctaagtcggctgcattttacgcttgtaaagtaatcaaaaaatcaccacctggatgaacataatccaggtggtgattttttgattgatccattttaaatttgattccaaatagaccgtaaaggttacgtgcgttaaattactcaaatgataactctaagaagtataagtgtttggctggtaaatgggccgaagaaacccacacttcatggtagttagggacttttttctctgtgtaatcgaagaagaaatcaagtaagttgccgtttttagcgacaaagtcatcctgaaatcggttgactaatagcttgttgtcaggaaaataaatttcggggttagcgaccttaatatgatcggggacacccatccgaacgacattcgtgtattccggttgggtaaactgaatttcagtcgggtgatgggtgatatagaacatgacgttataaattgaatctgaattactagccacgacaaaccagtcctttgctaaatttacactcattataccaaaaaaatcttaaagcgttggaaatgtttgacgggcccttgacaaacttctaattaaccattaatcttttaattaaattcaaattaattaatttggaaaattacatataaaggaagtcgaagcatatggcagacgtacaattagactggaacaacttggggtttgaatatcggaatcttccgtaccgttatcgtgcgtattggaaagatggtgcttggtacaaaaaagaattaacgggagatgcaactttacatattagtgaaggctcaacagcattacactatggtcaacaagactttgaaggcttaaaagcttaccgcactaaagatggtagtgttcaattattccggccagatcgtaatgcagcccgaatgcagaccagttgtgaacggttattaatgccacaagtgccgacagacatgtttgtggacgctgttaaacaggttgttaaggctaatcaagattacgtgccaccgtatggaactggtgcgactttatacttacggccattgatgatcggggttgggggtaacattggtgttcatccagctcaggaatacatcttcacggtctttgccatgccagttggtagttatttcaaaggcgggatgacgccaaccaactttacgacgtccgaatatgatcgtgcggcccataaaggaaccggggcttataaagttggtgggaattatgcggctagcttattcccaggtcaagaagctcatgccaacggtttctccgactgtgtttatcttgacccggttgaacatcgtaagattgaagaagtaggttcagcgaacttcttcgggattactaaggatggcacttttgtgacacccaagtcaccatcaattctaccttccgttacgaaatattcattactctacttggcagaacataaatttgggatgaagactgaacaaggcgacgtctacattgatgatttagaccggtttgctgaagctggggcttgtgggacagctgcggttatttcaccaatcggtggcttggaacatcaaggcaagttacacgtgttctacagtgaaacggaagttggtccggtaacgaaaaaattatatgatgaattaactggaattcaatttggcgatcgggaagcgcctgaaggttgggtccagaaagttgaattagactaagtacagtgttgtttgtgtgaataaaaagacggctttagtaagacccgtgatacgggtggaactaaagtcgtttttatgtgcgtgcgcatgatgcacgtggtattgtgaatagtaagaaatgctgtctaatcagtagacgcatgatcggaacgacagttattcggctaaggggacgttacggttaggttaagattgctgattgtgatgtaaagttgctgaagaaacgctaaaattaaagggagttgggcaagatgataaagtggagtaatcgacattggcagacagttgaatgggtcagcacgggaattttggtgggctgtacgttactgtataatcatcaggttgtctcgaatcaatggcttctcgtcattggcggggccgctttaatcagttattggttggtcacattaccgcggttattcggaagtcagcactagcttcgggcaggtcgttgatgcagtcaggtcagttcgtatccgcagaaattgtcagggtaaaacgtggacagtttgccaggttacttggttgatactgaccttgaaggtggtttagccacagtcaatcccaacttgaatcatgatcctaataagagagaatgaataaattaatgttaactttcagtagaaccgcagcactaattaaccaaatggtccaagatcaagtgatcccaggggcgagttatgccttgattgatggggctgagtggcacacgaatcaagtgggcgtcgctcaaataaaaccaacgatcaaaccattatggccggatgcgatgtatgatttagcctcggttactaaggtcgtgggaacaacaaccgtggcgatgcagttgatgcaaaatgggcaacttgaaattgaccgccccgtgcatgactacctaccggctttacagtccacaacgattacggttcgtaatttgatgacccatacaagtgggctgagtggttatattccaaatcggaatgcgttgtctgcagatgcgttattagccgcgattcaacagctaccaatcagtgagcgtaaccgcaatcatcgggtggtttatacggatttaggcttgatcatcatggggcaagtcattgaacgaattcttggagcggccattcagccaattatcactgagcgcgttttgcagccattagggttagtacacacgagtttccaacctcaactagcgcaaaccgttccgacgacgtattccatgaaaactgggttgttacgggggatcgttcatgatcctaaggccagagtcttaggtgaacactgtggttccgccggtttatttgccagtgtgacagaccttgttcggttttcacaattgatgctcggccaaatcgacgtaccagctgtgctatcacaggctacgattgcaagcttgtatcaagattggacgcccaatcaacacttacgccggagctttggttggaacctctggcaccgttctgatgagacactgccggtgatttttcatactggttatactggtacgctcctgatgcttgaccgtcaacggcaacggggccttgttttcttatccaaccgggtgcatccagttgcaaataattcggtattccttccagcacgtcgccggttaattgcggcttggttggcagatacggttacaaattagctacttcggtttcacaaccgctttcatttatgctaaaatttagatattaaattcaacaatggagtgagtagatcttatgagtgagccatactttttaaagccggtgttccatgaaaaaatttggggcggtaccaaattacatgatgattttaattatgatattcccagtgatcatactggtgaatgttgggctatttcagctcatccgcatggtccggcgaccgttgaaaatgggccgtacgctggcatgacactggatcgggtatgggcagaacatcgtgatgtgttcggtgatgctaagggagatgtcttcccactattaacgaaaatcttggatgctagtgaagatttgtcggtgcaagtgcatcctgatgatgcgtacgcggctgaacacgagcacgaacttggcaagactgaatgctggtacgtgattgcggctgaaccgggtgcaacgatgatttatggtcatcatgcgaagacccgtgaacagctcgctgaatggatcaacaacggtgaatgggataagctattacggcgagtgcccgttaagcctggtgatttcctttatgttccatctggaacgattcacgccgttggtaagggaattatggtgttagaaacgcagcagagttctgatacgacttaccggctatatgattgggaccgggtcgacaagaccactggtcagaagcgcgaactgcatttgcaacaatccattgatacaactaacgttccgcatcatgaccctgaccttgacatcacgactacccaggttggggatgcaacggtgaccaaatacgtccaatcaccattctttggtgtttggcaatggcggctaacaaatgggcaagcaacttttaaccggggaacagcaccttatacgttagtctctgtactggatggtgaaggtagcattgtcgttgacggtcaagactatccattgagtaagggcgtccactttatcttgccatttgacgtaaaacaatggacattgaaaggcgatttacaaattattgcttcagaacctggggctaaggcgtaattagttaaccccttgatgggataaaaaagattgatactggttggaagccactatcaatctttttttgtgtatctactgatagcatcagtttattaataatcactatctgaaagtatataaatatttattatagcttgaaggggtttactaatgagaaggcttccaaaaactgttatcattgtaaccaattaatacggatcaaactaaaaaaatcgtcactggctggtaactaagtcagtggcgattttgagtgatacgttttaaggtttcacgataacgtttttagtgaggtcttcgttgagttgatccagtgcatcgaagttgccttcagggtacttacgttgtaaggccagtttcaagattcgtttggcgagggcttcattgcgtgcaaggattggaccatggaagtaagacccaaaggtgttcttgtagataacgccctcagattgatctttgccattattgccgttaccttggagcacttgaccaaggggccgttcaccttcgcccaggaaggtcatcccgttgtggttttcaaaaccatagtaggtctggtgggtttcggcgttctcaatggttatattaccaataaagcgattgttatcctgactgagcgtgtaatgatctaaggcaccgatacccgcgatcttttcaccatgggccccaatgtagtaatggcccagcatttgaaagccaccacagattgctaataatgggccaccggcttcgatatatgcggtcaaggcgtcttttttcgtttgtaaatccttggaaacaatcgtttgctcgtaatcttgaccaccgccgaagagggcgaagtcatatttttctccgtcaaaccgatcatccaagctaactaagtcaacagtgatgtcggcctccactgctttagcatagtaacgcattgctaaaatgttaccgatatcaccatacgtgttcattagatcgccgtagaggtgtgcggcgtgtagtgtataagtcatggttaagccatccccccatcgataatgccttggctagcaagttgttttcgtaattgtaacatcgcggtgtaagttgcgacgacgtagacttgcttggtcggtagtttttgaattgcggtcgtcatgttggtcaggtcaggaataatggttaactgatcttccggtacgccagcaacttttagccggaacgtgatatcacgataacgttcaccgccactaatataggcgggaatattcaatgccggtaatttttcaaaattaccatcccagatccaactagtatcaataccatctgcatagtttgcgttgagcagggcggcaaatgagaatggccggtcatcggtgctgattgtttgcaagacttggttaaggcccactggattcttgacgagaatcagtgtgacgtccttttcgccaacgtgaaaggtctcttgacgaccaaagacttgttcatcgttgtcgctaagggcgtgcgcgattttggccggcgtgacgtccatgaagcgcccaaccgcgtaggcagctagcgcattataaatattgtattgaccaccgatattaagatgcatggcctgaccgttgatttcaaagtctgagctagtcggtgtcatagcggttagggcgtttaatttgtatgccaactgtggacgctcaaaaccgcagtggggacagtaatacttgcccatattgctataagttcgactatggtaacgtaaaatatgctgacaacgcggacaaagcaggccatccgtatttgctggcgcttgttggtcatggtcgggctggtagtcaaatccgtaatacagtatcggattaggcaattgtttggcattgaagagtggcaaatcaccgttggcaataattgtcgcttcaggtgctaaagcaaccccgtctaagattttttgatatgtcgtgtagatttcaccatatcgatccatctggtcacggaaaatgttcgtgaagacaaaggcttttggcgtgatgtacttggtgaccatgattacgttagcttcgtcgacttctagaactgcgagtggcttttggtgcgctttaggtgcccgtaaaaaggtcgtgacgataccttgcttcatgttggatccacttggattggttaaaatgtcagggtactgttcacgtaaaaccttgaccgtcaaggcggtcgttaacgttttaccgttggtcccagtgatgacgatgacgtcgtagtttttagcgagatgctttaaaatcgttggatcgagcttcagcgctaacttgccggggagtgagctcccaccgccacggaaggtgtgtaaaaaccaatatgcggatttacccgtccaggtggctaatgtactattaattgacataagttatcggtacccctaattcttgatttacctgggaaatgatcagtgtgaccaactaccgggtattaaaatcataattaccggacaaaatgtcctactctcaagtattttatactgaacgtccctaaaagaaaagtgatactcccgccatttaaccgcatattatcaattcgttaattagttttaatgacagaatgctgaaattcacggccaaatccgctataattgactagaaatgtgtaaaaaaggggaatgagtcgcttggcacagttattttttcgatatggcgcgatgaacagtggtaaaaccattgaaattttgaaagttgcccataactatgaggaacaagataagtcggtcattatcttaacgagtggcttagataatcgtgatggtgtgggctatgttgcgagtcgcattggccttaaacgtgaagcaacgccagtatttgatgataccaatatttttgagatcgttaaacaaacgaatccggatgctgcgtgcgttttaatcgacgaagcccaatttttgaaaaagcatcacgtcctagaattggctgacattgttgatgagctaaagattccagtaatgacgtttggtttaaagaatgattttcgtaacgaattgtttgaaggtagcaagtacctactgctatatgcggacaagatcgaagaaatgaagacgatctgctggttctgtcgtaaaaaagcaattatgaatttacggttccacgatggtcagcccgtttatgaaggcgaacaagttcaaatcgggggtaatgaggcgtactacccagtttgtcgtcatcattatttttacccgccgaaattaacaaagtgagggttaactgagaatggataagttttttgataagttacaagccgttgccgatcggtatgaggaactcggtgaactattaagtgatccggaagttatttcggattctcaacgtttcatgaagttatctaaggaaatgggtaatattcgtgaaacggttgaaaaatataatcactacaaggaagtcacgagtcagatcgaagaaaatgacgaattgcttcatgaaaagctcgacgatgagatgaacgcgatggtcaaagatgatttaaagaaccttaacgcggaaaaggatcaattggaacatgaaatcacgttattgatgttgcctaaagaccctaacgatgacaagaacatcatcatggaaattcacggtgctgctggtggtgacgaagctagtttgtttgctgcggacctgttcaacatgtactcgaagtacgcagaacgtcaaggctggcaagtagaagtggctgatcgtaatgaaactgaagttggtggctttaaagaaatcgttctgatcatttctggtgacaaggtctactctaagctgaagtatgagagtggcgcgcaccgggtacagcgggtgccagtgactgaatcagctgggcgggttcatacctcaactgcaacagtcggcgttatgccggaagcgcaggatgttgacattgatattgatcaaaaagatattcggaccgatgtctttcgttcatctggtgctggtggtcagcatatcaacaagacgtcttcagcggtgcggatgacccacttaccaaccggtatcgtggtctcgatgcaagaccaacgttcgcaacagcaaaaccgggccaaagcgatggaaatcttgcgggcacgggtctacgactactatcagtcacgggaacaaaacgaatatgatgctgaacgtaaatcagccgttgggacgggtgaccgttctgaacgtattcggacttacaattttccacaaaatcgggtgacggatcatcgaattgggttaacgctcaacaaacttgaccgggtgatgaacggcgagttagacgaagttattgatgccctcgttttagctgatcaagctgaaaaaatggagcgcttaactaatgaataagcccactcaacccacttattttgaagcccagcagtgggcttctttttgtctaaaaacggcccagttgccgactgatagtgctcgcttcctgttattgggcttgagtcggctagaccagacacaattactcattcgttaccgcgagccgctacccagtgctgtttggcatgcttatcagcaggggattgaccgggttgttgctggtgagccagtgcagtacgtactcggagacgcaccgttttatggactcacgttacaagttgatccagcagtgcttattcctagagtcgaaacagaagaattggtagactggattttgacggatgtcccagcgacagcgccagttcgactcttagacgttggtaccggctcgggcgccattgcattggcaatcaaacacgaacggccggcatgggagattacggccagcgacatttcaaccgctgcgctgcaagttgccaaagccaatgcggaccgcctacatttagatgttaagctggttcacagtgatctattgaccagcgtatctgcgcagccgtttgatattattgtcagtaatccgccatacatcgctgcgagcgaaaaagacgtcatggacgccagcgtcctcgcccacgagccacaaacggccttatttgctgaccacgatgggttggcactttacgagcagttagcgacgacggttgccgatcatctgacttcgaccggtcgcttatacttggaattcggctaccatcagggaccggccttgcagacgcttttcgcgcagtcgatgcccgacgcgaccgtgacgctgcgacaagacatggcgggtcacgatcggatgctgcgagttgcaatgactctgactcggcaatagttgcgcgttatcctggagaatgctgataaaagcgggccgattaggtagattgctgtttgtaatccgcgtcccattccggccttcgggggtgggtgaacgcagtcgtcgatttgagctcgcgcataacccgcgttatctcaaatgtgagtcttatcctaagcgggctgtttttaacctgggaggtacggcgtgaatttatgagcaattgattaagtccgtgatgtaaataataaataatattatatgaaagtaacgatgaattaataataaagtagaggtttgaatatattatggaaacgaaagtatatacgccggcggagattccggccgctgcggcgttgttaactgcggggcagttagtggcattcccaacggagacggtctatgggctaggtgccgatgcgacaaatgtggatgctgttaagcaagtgtacttagctaaaggccgcccgagtgataatcctttgatcgtgcatgttgctgatgtggaaaccgttgagcggtttgctcaaccgttatcggaagcagccaagaagctgattaaggcgttttggccaggccccctgacgatgatttttaaattgaaaccagatgcgttggcaccagaagttactggtgggctgcagacggcggctttccgtaatcctgataatgaggcaaccctggctttgattcgtgctgccggaacgcctatcgtgggaccatccgctaatacatctggtaagccgagtccgacgacggcgcagcacgtattgcatgatctacgtggtaaaattgctggtattctggatgatggtccgacgaaggttggcgttgaatctacagttctggatctttcaaccgaccaaccagcaattctacggcccggtgccgtaacgcctgaagcaatcgaacgggtcattggcatgccagttcaaaccgaattgcaccatgtcggagctaaggaagttcctaaggcgccggggatgaaatataagcactatgcgccaaacgcacaagtttatatcgttgatcgttcggaagattggccagaagcgctggcgtgggcagcccagcaagatgtgccaatgggcgttatggcaacagatgatattttaactaacaatcaaattccggctaattgcgaacaattttcgcttggagaagatattcaatcggcaagtcgggagctgttcgcgggcttgcggcactttgatactgagacggaaattaaagatattctgtgccaagcctttgaaaataaaggacttgggcttgcctacatgaaccgattaaataaatctgccggtcagactcattttagtgtataatgattgcaagtcgggaaaacccgaaagttgtcacttgcgaaatggaggagatttattcatgaattaccaggaacaagatccagaagtatgggctgcgattagtaaggaacaggcacggcaacaacataatattgagttgattgcttctgagaacatcgtttcaaagggtgtccgggcagcgcaggggagtgtgctgaccaataaatactctgaaggctatccgggtcaccgcttttacggtggtaacgaatacattgaccaagtggaaaccttagccattgaacgggctaagaaattatttggtgcggaatatgctaatgtgcaaccacactctggttcccaagccaatgcggctgcatatatggcactgattcaacctggtgaccgggtgatggggatgtcactagatgctgggggacacttaacacatggatctagtgtgaacttctctggtaaactttacgattttcaaggttatgggctcgatcctgaaaccgaagaattaaactatgatgcaattcttgcacaagcacaagattttcaaccaaagttaatcgttgcgggggcttctgcttatagtcgattgattgatttcaagaagtttcgcgagattgcagatcaagttggggccttattgatggttgatatggctcatattgccggcttagttgcggccgggctacatcctaatccagtgccatatgctgatgtggttacgacaacgacgcacaaaacgttacgggggccccgtggcggtatgattttagcgaaagaaaagtatggcaagaagatcaactcagccgttttccctggcaatcagggtgggccgttggatcacgtaattgcgggtaaagcgattgctttgggcgaagacttacagcctgagtttaaggtttatgcccaacatatcattgataatgccaaggcaatggcgaaggtcttcaatgactctgacttggttcgggttatttctggtggcacggacaatcatttaatgacgattgatgtcactaagtctggtttgaacggtcgccaagtacaagatctgttagatacggtttatattacggtcaacaaagaagcgattccgaatgagacgttaggggctttcaagacctctggtattcggttgggaacacctgcgattacgacccgtggttttgacgaagctgatgcaactaaggtcgctgaattgattttgcaagcgttacaagcaccgacagatcaagcaaatctagatgacgttaaacagcaagcaatggctttaacagcgaagcacccgatcgatgttgattaagtaatttatatcaggtctggttttttctctctaaattagctacaatagaaagaaatcactaaggagtgtgcgtagcaacatgggtaagtttgaggttttggatcatccgctcattcaacataaattgacgatcattcgggaaaagaactgtggtactaaggtcttccgggaaatggttaacgaaatttcaacgttgatggcgtacgaagtatcacgcgatatgccgttgaaggacattgagattgaaacaccgattgccaagtcaacgcaaaaaacgttggcaggtaagaaagtcgccattgtaccaatcttacgggctggcttagggatggttgacggtttcttaaacatgattccggcagctaaagttgggcacgttgggatgtatcgggatgaaaagaccttgaagccggtcgaatatttcgttaaattaccaagtgatatttcacaacggcaattatttgtcgttgatccaatgttagccactggtggttcagccatcatggcgatggatatgttgaaaaagcgcggcgcaagtaatattaagtttatgtgtttagttgcggcgcctgagggtgttaaggcacttcgggacgcacatccagacatcgacgtttacacggcagcacttgatgaccatttaaatgaagatggctacatcgttcctggtttgggcgatgcgggcgaccggttatttggtacgaagtaagttgcattgacaaaaggtagcaccgccaggcaatgtctggggggctacctttttgttttccaaaattattaacaactttagctataatcatccgcattctgtgagttcattagtcatgaatcgtgactaaaacgtgctaatttctaagattaaaagcagccagctatggaccactggaaacgggtgtaagtgggcgtaaacatgctttgctggttcgtcctaagccgacttccagtcgtgacagtgttcgaatggctgacgaagatgtacctaacttttgatgaatttgtcgttgctttttacaaccagtaattttgtcaatcaactggcagactgaaaatgatattgagatagctcactaatcctgaattggtgtagtaagatttaatctcttgacaaagtgctaatgcacctaacgctttgtttaaagttccagtatcaaaatagtcagcgacaaattgtaccaagttaagtggccgttcatcagccattcgagcggcttaccgaccggaggggcttgggtgacaatgctcagtagccaaattattcttagctggaagtggtctgcttccggct

SEQ ID NO: 36 - DNA, 32563 bp, Lactobacillus plantarum
gttgattacctcaacgcaactattaaagtttatcatcatcagaacaagctgtcaacatctttttataaattattttgaataactattcaatgtaaatgctcacatcaatttgaatattcataataatgagtaatgttgcatatcgctcttaacgacaagaaatataataccaagaataacgacccgggtcaaccctttttatgaattaatttcagaaaagttttaaacaccgattaatgtcgcaatagactttattttacggggtttttattaagatagcaagcaaaagttcaataaatctccctttaattttcaacgactgtttttcaaagtaaaccaacgctagcataatgaatattatttcgctgacaatctaccaaatcaagacaaccaatcagtcagcattccccacctcatcaccgtactttatcggttcacaacatccgcgacgcgcctaccattccaactttgcatttacttgggactccaaaattggtaatacttcatcgttcaccatcagtgtcaattcacactgcgcaacaatcggcttaataatagtgtaccgcgctgtggtcaaaacaagtggcagcttatttccgcaaccaaaaagggataacgccgtcagcgttatcccttagttgatacgagttcgattaatcagaactactgcttgaactactactactgtcacttgagctagacagttctggtgcatccgtcttatacagactctccgttgatttgcccttatgcttcgagagaacactcgtcttcttctcagcttggatctctttcaatgatttgagggtcttagtcagcttataactatagtccgacttattgaccttcttaaagcccttaggcgtgtagaaccgtagtaagtcaccctggatgacccgatcagagagtgagagttccgtcgtcacatgattttgcatctgtttgacagtatccttctgcttcgtcgtcatatccgttagcttcttaccggtcttcgaatcatagactgtcccactgatcttcgtatatgtcggtgagacaaaatccccgttccggaaagccactgtctggttatgctgtttcgacagtaagtccgttccgaactggatgtaacccttgttcttgatccctaacaggtcaaaaatcgttggcaacgcatcaatttcaccaccatacgtgtggttaataccacccttgattccttcagaatgaatcataaatggtactttctggaattgagccaagtcgaaactcgttaccgactttttacccaataactgtgcaatggcagccttatggttgtttgaaatcccataatgatctccataaagcacaatcatactattcttatataagccggccttcttcaagtaactaatgaattcggcaaaggcttgatcaagataatgggccgtttgaacgtagccatcaacggttgaatccccggtcgtcgtcttatcgatcgactggttcttcttatccaattcgtatggatagtggttcgtcaacgtaatcagctttgcgtagaatggttgtggtaattgctccaaatacttaacagagtctttgaagaagattttatccttcaagccataaccaatattgtagtctgacttctctttatagtaagaagagtagaagaagtagttatacccccacgacttatacgcgttatcccgattccagaaactagccacatcaccgtggaaagccgcagtcgtatagcccttttgtgacaggattgctggcgctgcctggaacgtattcgacgtcccatactgcgtcatcgctgacccggttggtaaaccaaacaaggagttttccatcatcatttcagcatcagaggtcttcccttgcgccacttgatggtagaaattatcaaaactcaaagtactcttatcatgatagaacttgttcaggttcggggtaacttccttaccatcgaccttataatcaattaaaaattgctggaaactttccaaatgaatcacgaagacgttcttgcccttcgctttaccaaagtatttgacgttctcgccagcctggtttttcttgaggtaggctagcacactcttcatatcactactacttgcttgggcgcgcgtcgcactttccttttcggtctgatagaagctataccctgcatatgtgttgagtcccaagtacttaacgatgtagttgttatcaaaagtccgcgtcaataaatctgaacggtcatgttcagacatgccgaggtcaacagcaaacaacgccaccccaatcatggtcagtgttgcagcataccgaattttgaaaggccgtggatcgatccgaatgaccttgaaggctaataacagaatcagcaacacgacatctgcataaactaggaagtcggttccatgaatgatctgtcccaaactctttccgaggttattactagcagcaccggaactcttaattacccccgccgacatgaaatcagagaattcccggtaatacaagatattggcaaataaccacgtcgtctgtagggcgtcaatgatcatcataatccaatactttaagcgaccacggaaatatagggcaataccgagcagcacgatcgctgtcggaaatggattcaagaacaagataaattcctgaacgggtcccttaacccctaaagtaaactcgctcttataagcgatatatgtctttagccaaaataagaccacggttaggaggtaaaagcccaacgttgtgttgacctttccaaccgtgttttttataaatttaggcatggtaatttcttcctccgttattgctattaacaaatccatattataacggttgcgtactagttagcaatatcttgaagatttcttcaaaaattcttcaacattacaacgcgtcataatatggatctatcgaaaatctatctggattttgggggaatctagttatccgttagcaaatcgtataattcaattgccacgaggtcaatgttatcaaattcaaacgtttggtctggattgaattcttgtaacgtgtacgtcgaggtagcgggatcatacgctacttgcccacgttgaacgccttccttttcgaaccgccgtgattgcacttcggttgcttcagttgtgcgcatggcttctagtcgtttgagaattgctgatagttcagatttatccattatactaatctcgctccttcaagttttgtttacattctagcaaaaaataggactaataacacgtttttttagtagaaagcccatttttaccacaaattttcacacttataattataccctaacttcctgctaagacggtgagaagttgtgctaaaattagaacaacttataaattaaaggagttcggatatatgacactatttagagacgatctcaatgaaaccatcagtcacattcaagtttcaaccatccgccagtttgacgaagaagttagtgcgatacctgatatggtcaagttaacgctcggtgaacccgatttcaacacgcctgagcacgttaaagcggctgctaaaaaggcgattgatgacaactactcccactatactggcatggcaggtctgttggagctacgccaagcggccgcccactttcaagagacaaagtacggcgtccactatgatgctgaagaccaagtcttagtgaccgtgggagcgactgaagctatcgcaactgcattaacgacgatctgtaatcctggtgacgccattatcattccgtccccaatctttccagcgtacatccccatcattcaagaagcacatgccaagcccctcttcatggatacaggtgttaacgattttgtcattacgcctaagatggtcgacgattttattgctgctcatcctgacgagaacttcaagggaatcgtgttaaactacccgaataaccccactggtgtcacctatgttgaagatgaaatcaaagggctcgccgactgtttccgtcgccataacttgtgggtcgtatccgatgaaatttacagtgaactgacttacggtagcgaccacgtctcaattgctaaattcattcctgacgaagtgatcctgatcaatggcttatcgaagtctcatgctatgactggctggcgaatcggcttcctgtttgcctctaaggaaatgacggcccaacttaaaaaagtccaccaatactacgtcactgcagcaaccacgattgctcagaaggccggtgttgaagccctcaccaacggaatcgatgatgcgcaaccaatgcggcaagaatatcaagctcggcgtgatttcgtttatcaaacgatgtcgaagctcggtttcaaaatcgcacgtcctaccggagccttttatatcttcgcgaaaattccagctggctttgaacaagactcgatggcattctgtaaagacttagcccgcaagaatcagctcgcgattattccagggactggttttggtgccgagggggaaggctacgtgcgtctaagttacgctgctagcatggaaaagctccaccaggccatggatcgcctcactgcatatatgcaggaacctgctaaccgtatcaactaagcaacgacagtccaccagctaactgtcctagttcatcactgttagtcatttcaatgactgaattggattcaactcaaaaaggtgcgccaactactcgtaaattacgatagttggcgcacctttatttgtcttcagcatcacacgatctattaagcgagcatcactttgcgaacgcatacgtgcccgtggtggtccgttttgcgggcgctgttgcccattgaagtggtccaagcatcgtcagcgcttcaggcgtccgataaatgacttccttcgtcgttcctgacaatggatccgtcaatcgcaatttaagaacggccgtattagcagccagataatttggcgctgtccgatgtaatggccacaaagcaattttggtctgcgtcattggctgcttactattcacccacagttttgaattgtacttcgtcaccagacgcactttggtctgcgtccccggaatctgataattgatgctcttaggtacaacctgtttatactgctcggtcgttttgagcatcagccgcaagttgttgttcgccgtaaactgccacgcaccgccaagtgttgttgcaatcatccggtggccgttctgccggtatgtagcgactaagcaagcaccggcctgattcgtataaccggtcttcagtccatcgactggcacgcggggatcatagtactcggcgcccttcaggatctccaccgaagttgggaccgtatacttatgaattttgactgaacgttgattagcaacttgaataacatcggggtaagcatcaatcaaatgttgtgcaatggtcgtcacagcccttgctgacaccagattttggtcctgatcgctggttcccttgatttttaaatcgtaattttttaaatcagtattatcaagtcccgaagcgctaataaaactcgcatccaaatgccatttggccgcttgttgattcattaatttaatgaacttatcattactgccagcaacatactcccccagcgcaatggcaccactattcgaagaccctaccaaggtagctgcgaataactccctaaccgtaaacgtctccttggcaggcatcggcattacggataaagttgcactggttgccatcttgcggacatttttgcgaattgggactgcatccgtccacttgatttgaccatgctcgatggcccgttcaactaaatacagcgtcatgagcttactcaaggacgcaattggtaatttctgatcggcattctgcgcataaacgacctgaccagacttggcatccatcacgtaggcggctttgacctcatccgccttactactggtcgcgtgtgccgctacattgcagctcaacaccccgctgactgtcgctgtcaacactagtccccataccaaccgttgtttgattaactttaacatagtaccttcctttaattcgtaaccgcgaaaaatgggtcgaacaatgatgtcggcccattaaaattactgttcttgtgaatccgaccggctaggtgccgcaatcggaatttcttctgctttttcaggccgcatcgccatggcgatcatccctaagaatagtcctaaataatacgttaagatccgccagatcagcatcgctaaaatcagcttactgtggctgggaatgaacttagcaaacaacgccgtgaaaccaaattcagcaccaccggccccacctggaatcgggaatagtgatgtcactaagaagatcaacacgttcaaactagtcaccataatcaaattaacatcatcgattcccattgcccgcataataaaatacggaatcaggtagtaaaacagtagctgtaagaaggtgacgatacaaacttcgaccagcatccgccagtccttggtcattcgaacgctttcttcgtagaacgaatcgattttttcactaatattgttttcaaacttggcaaatcgctcagctttcataaaccagctgaccgggatcaagacgatcttcaccgctcgttttgtaaagttataccagtacatcaccagcaacagaccaacaatcaccgcaaagtgaatcagaaaacctaacaaaacgtatagtgacaggtaacttaacttttcagctaagtaatgaaaaccaattaacatggcgaataagaaattcaataccaccatggcctgaaaaacaacaaacttcatcaatgcaactgaacttgcccgcccagcgtcaatccctgattgtgccatcacgaagatttgggcaggttggccacccgaagaaaacggggtgataccgttgaatagttgctcggctaaaggaacgcgcagggcactcttaaagcgatagttccgataacggtgcctgacaaacttttgcaccaccacggcttccagaccgaagtatagtccgacacaccctaacgcaactaataaccaccaccaattcaaagtgagaatatcgtccattagattgcttagtttgacattgcgcagtgagtaccacgaaatgccgacgcctaacgcaaccattacgagtaatgaccagatattttttcttgtcattgactacccctcttttgcctgttgcaaataaaaatcatgccaaactttggcaaggcgctcttccgaataatcctgagcagccaaaaccgccttgtcatgcaagaattgcaacccggctggattatggcgtaactggtcgatctgtcgttgcatatcatcaacatcactggctgcttgatagtagccatcaatgattgcccggtacaaatctaaatcccggagcaatactggtgtcccacaactgaaggcttccaacacggacatcggaaataactcattataagaaggcagtaagaaaagatccgccatattataatagtccaccaatttctcacgaggaacgatgcctggaaacgacagattagctggcgggttatccaccacctgcttcaactcctgataaccatccataattcggccaaacgagaacccgccggcccatacaaactggatatctggattctgctttgcaagcgtaataaaatcaggaacacctttccgatcctgaatctgaccggtcccgataatcatgaatttattttgatcatagccgtattgttggcgcaagcgcaactgtttagccttagtcatttcgtaaaattcacgtttgctgacaaaattcggaatatacgttacatctgctcttttgatatggtatgcttccaattttggaatgaaagtcgggttcaccaccacaatgtggtccatccgcttataaaatgagattaaataacgattgaaaatcatttggaatggtcgtggcaacttcaagctaccctcgagcgtctctggtaagaaatgcacgtaaccgattttacggcctcgattaggcataaacgtagacaggtaaaacattggattaaccgtatggtaatgtgaaacggcggagcgcccatatcgattgactttaatattaaattcatcctgccaatgggtccgcaacaaccgcatcaattctagataggcgctgccgactccctgacccttgacggagtcagcttttgaaaacatggtaatgtctaacataattcgtccccttacgcgtcatacgtcgaataagcatccccggtttggcggtgctcattgacgatttgacacacgttaattactaatattcgccgatttatccgctgattcagaatacgccagctgtacgtcttgatagtagttgatcacttgcttgccgaaatactctgcggaaatttggtaaagcttcttctgccgtggcttgggatcgttaaaagtattgggatgttgtaaataacgcacaacatccttgatcagatcggtctcacttgtaaaggtcgtccccagtgacggatcatcaagtaattgatccgtgtacggactagcagccactaccgttttaaggcccgcagccattgcttcaatgtacgtcagcccctgtgattctgagttcgaagccgaaacgaacaggtcagccatctggtaatagttataaacttcatcattatcaatttcaccggtaaattgtacgtgcgccgttaagccggcgtcttgaacctgattttccagtgtttcacgtgccggaccatcacctacaatcaggagttgggcattcggcacctgttctaagatcgccggtagggctgcaatgacttcgtgaatgtttttctcgtaggccaaacgactcaaggaaagtaatactggcgtatcagactgatagccgagtctttgccgataatccaccgtcgactgctgctcgtactgattaatgtcgattccagtcggaataatgcgaattggcgctttaacgccgtagcccgtcagtgtatttgcaacccgctcactcggtgctacaatcccgttcagatgataacaatacgcccgtgtggcctccttaacgtggtatggctttaacaacttaccattcgcaatataatgtagataatcctcatacatcgtgtggtacgtatggatacatgggacttttaactgtttggcaacaaacttaccaatcatccccatggagaattctgtctgcgtatgaacaatatccaggccaagatccttagcaacctggtaagccttaaaaagcccgcgaacggcgatgcgccgatccgtgaacgaaacaaatggaatactcgtaaaccgaaaaatattgcgttcataaatattcttatcaacatggggatccgtggtcgtaaagatatagacttgatgaccagcccgttcgagttgattgcgtaacaccttaattgacgttgcgaccccactcacttgtggatagtatgtgtctgtaaatatcccgatattcacgtagattctccccttatttccatcaattaaccgtgctgctaatcgatgttgcttaaccgcgcttagatcattatttcatgatcatcacgaattcgacttaatgcctatattataaacattatattggttaaatatccgagttgcaaataatcttaatataaattaagagttcatgacaaaatctatctgaccagctacacctatagaaaatgaattcgaaatgatgaattgtaatcgctaggcatcactcaacaccgccattacatcgtttccactacaccaactcttcaccgtcaacagcgagtagcaatgtgccccgtgtccatcattgactagcgcgcggtcgcaactatggacaattgtcacaatgcctaaatgtccagtcaattcgcgtcatgtactgtgccagctctcatcataccggtgcgggtagtccactcccccgtcgtgctaaacccggggctagtaccaactggttaatgacccgcatttacccacaaaaaaagagcaaatccgcagatttgctcttagtttgattgtttatttaccgaagacgttcttttcaactaattctttgacttcttcgttagtaacacactcgttaagtgccttatcagctaatttagccatttccttagtatcaagtttcttcattaatgaacgtgtcttaagcacggaagttgaactcattgagaattcatccaaacctaagcccatcaataatggcaccgcaatctgatccccagcaacttcaccacacatacccgtgaagcggccgttcgcgtgagcagcgtcaataacatgcttgatcaaacgcaataacgatgggttgtatggttgatacaagtatgacacttgttcgttaccacgatcagcagcaaatgagtattgaatcaagtcgttagtcccaatactaaagaagtcgacttccttagcaaactggtcagctaaaatagctgccgctgggatttcaatcatgataccaagcttgatgtcgtcagcaacaggcgtaccagctgcaaccaacttggctttttcttcctcaaagatagctttggctttacggaattcgtcaagcgttgcaatcattgggaacataatccgtaattgaccgtaatgtgacgcacgtaataacgcacgtaactgggtccggaagatgtcatcacgatcgagggaaatccgaatagcccgataacccaagaatgggttcatttcatcaggtaatggcaagtaaggtaattccttgtcaccaccgatatccatggtccgaacaataacgggtttgccgttcatcccttcgacaaccttcttgtaagcttcaaattgggtatcttcgtcaggtaattctgaactgttcatgtacaagaattctgaacggaataatccaatggcttcagagccagcatccaaaaccccatccatatcgtcaggtgtcccgatgttagaagctaattcaaagtgcttgccgtccttagaaacggtggcctcgttcttcaacttagcccattcagccttttgcgcaacaaagtctttagccttttgttggtaatcagcaacttcagcatccgttggggctactaaagcgtcaccgttgataccatctaagacgaccgtatcgccttctttgatatcagtcgtggcagattcagatccaacgaccgctggaatttcaagcgtccgtgacatgatggctgaatgactagtccgaccaccaatgtcagtaatgaagcccttaacatacttacgatcaagttgagctgtatcactaggtgttaaatcgtgggcaaccacgattacttcggagtcaattaaagctggacttggtaaggttacccctaacaagtggcttaagacccgcttcgttacgtcgcgaatatcaccggctcgttcttgcatatatgcattatccgtcatcgcttcaaacattgaaatgaaagtatcagtaacttccttcaaagcttcttcagcattgactttatcatccttgatcttaccttcaatttgtccgagcatttctgggtcagacaaaatggtgatatgagcttcaaaaacttctgcttcttcttcacccaagttttcaaccgctttgtctttaatgacctttagttcagccttggaagcatcgaaagcgtcatgtaaccgtgcaacttcagcatccgtatcggaaactgttgtcttttcgaatgataaatctggatcaactagcatataggccttagcaattgcaacaccatcactggccgcaattccttttagtaccttttcagccattattcagataatccttctttcttcatcgtttcagttaaagctgcgatagcgtcggcttcgtcggcaccttcagcagaaatggtaacgtcagcgtctttaccaacaccgagtgacataacacccatgatggactttaagttaacggacttgtcttggtattgcaacgtaatttctgagttgaacttacttgctgattgtaccaataaagttgcgggacgtgcgtggataccagtgtctgcgataacgtgaaattctttcttttccataactattcgatctccttcaagataaataaatttaaaattggttccgagtcaattcgagttgccgccaacacgtatactcaagagcccttaataatgatgatagcaattatccaattaaaatacaagccctttcattcaagctaggcctattaattggttgtcttaccatccttctcgaaatggtaaacaatgcggccatctaagtctgccgtaccaatgactcgtttacgatactcatacttcatataggcatcgtgaaaagccataaattcatccggcgttacggtaaaactgtcgcgttcgccatgacgcaacgcttccattaactgggtataatccgttgccaaacaattaccgcctcctcaaagttaggttgacacattactgcatcattattttgatatttacgaacaaagttctccgccgctcactggctgttgacggtcaccaatgaaaaacgatgcgctgcaagcatcaaaactggtcaggctcgatacatgcaaaaaaaccgctttgtactataatatagacagacagttacatcatcacttatcctaaccaggtaattaatatacaacgaatccggttacatgacaagctatgagttgcgactatccagactattcagaaataattgaatcaatcagccattgcgaattatcccggccgcacgtccagttttgaccctgaggcttttcacttgcaacagtccgtaaattcgctatactaatagtcaaaggtcaacaaaggtcaaagagccgatgaacctttaactatgatcctaatcgatttagttatatttctgatgcgaaaggtgtgtgacagcataatgctttgtgacaattgccataagaacgaagcgacgatccatttatatacgagcgtcaacggtcagcggcgacaaatcaacctttgtcaaaattgctatcaactgctaaagaatcaggaacagcaaccaaataacggagttggaggtgctgatatggcacaagatccattcggttttggtggtcttgacgacattttccgtgcaatgcagggtggcgttgatcctaataacgcttaccggcaacaacagaccccaccgacccagccagctggtcctaatggcggcaatcgtcgtggcaataacaacggcggtggcctccttggccaatacggcttcaacttaacagcgcaagctaaacagggcaaaatcgatccagtgattggtcgcgataccgaaattaatcgggttatcgagattttgaatcgccggaccaagaataaccccgttttaattggtgaagctggggttggtaaaacggcggtcgtggaaggactagcacagaaaatcgtttctggtcaagttccacaaaaactgttagataaagaaattattcgtttggacgtggcttcccttgttcaaggtaccggtattcgaggtcaatttgaacaacgaatgcaacaattaatgaaggaagttcaaagcaatccgaatatcatcctcttcattgacgaaatccatgaaatcatgggtgccggtaatgctgaaggtggtatggatgctgggaacgtcctgaaacccgcccttgcccgtggtgatttccaattagttggggccacgacattaaacgaataccgcgacatcgaaaaggatgccgccctcgcccgccggttccaaccggtcacggtcaacgaaccgagcgtggaagaatctatcaagattctcgaaggtattcagaagaagtacgaagactatcatcacgttaagtacgatcaagatgccattgtggcagccgtcaagttgtcaaatcgttacattcaagatcgtttcttacctgataaggccatcgatttactcgatgaagctggttcacgtaagaacttgacgttgaagacggtcgatccaaagacgattcaagaaaagatcgacgaggcagaaaagcagaaacaggacgccttgaagaaggaagactacgaaaaagccgcctactatcgcgatcaagttgctaagttagaaaaagctaagcccgatgaaagttcagaccagcctaataacgatactgccactgtaacagtcaaggacatggaacaaattgtcgaagaaaagacaagtattccagttggtgacttgcaggctaaggaacaggctcaaatgaagaccttagcacccgaccttaagagtacggttattggtcaagaccaagcggttgaagcagttgcccgggccatccggcgtaatcgaatcggtctgaacggaactggccggccaattggttccttcatgtttgttggcccaaccggggttggtaaaactgaattagctaaacaacttgctaaggaactgtttggttcccaagacgccatgattcggtttgacatgagtgaatacatggaaccacattcagtggctaagttgatcggttcaccgcctggctatgttggctatgaagaagccggtcagttaactgaacaggttcgtcgtcatccatatagcctagtcttactagacgaagttgaaaaggctcatccggatgtcatgcacatgtttttgcaaatcctcgatgatggccggctgaccgactcacaaggtcggactgtcagcttcaaggatacgatcatcatcatgacttccaacgctgggactggcgacagtgaagctaatgtcggttttggtgccgctgctgaaggcaagacgcacgatatcactagccggttgacggactacttcaagccagaattcttaaaccggttcgatgacatcattcaattcaacgctttatctaaggaaaacttgatgaaaattgttgttttgatgatcgaagatgtcaacggcatgttagctaaccaaggcttacacgtccacgtcacagaacctgtcgaggaaaaactcgttgaactaggttacaaccctcagatgggggctcgcccactccggcgtgttatccaggaacaaatcgaagatcgcatcgccgatttctatttggaccacggcgacgttaagaacatggttgcaaaagttgaagacggcaagattgttttggcggctgagacgaagtccgaataagataattaaatttagagccagaagcgtaaacaatcgtttacacttctggctcttttttgtgcctacctcaaatcctcattgagtcgctatgaatagcccgcgtctctgccataattaaacgcctaatttaaagtcccataattgtcgttccaaattatcacgctcaatgccaatatagcgttttgtcacctgctcgctcgaatgattgaaaatcatcatcaatccggcaatgtcacgagtcttttgataataatgataggccaaatgtcttgcgcaacgtgtgcgtaccaatatcatcccgctccaggtactcaccggccgtctgaaagactcgatagacaccattaacggttaaagctccgccccgaccactacagaataacggttcatttgccccccgataccgcgtaaagtgggctaattccgttttgaggtttttcaaaaacaaccagcgcttcttgcccgttttttgttccatgatcataacacgatctttgccacgtacttgcccaaccttcagtcgtaaaatatcactcattcgtaatcccgtgttaattccaaccaaaacaatcatgcgattacgctccccataacgcgcttgtgaaacagcccataaaaaatcatcgatttcttggtccgttcttagcggttcaacattataatgcatacgctccattacacctcaatcaatcttattaagtttaaattacttaacctagagtaaactaaacaaagtaattgttaacctataatgctccccactattaagtgctaaaacaaaagcgcgggacaaagagtctcccctttatcccgcgttaaggatattacttcacttaatatccgtgaacgtgtacatctgcctataattgcaaagctgataattgatccgctaactgtgttgctggcgtcgtgtcaagtgatttagtcaattgtgcatcaacatctttcattcgatcctgaccagccttcgtaagcgttaagacccgtaaacgccggtcttgtttaattggttgacttttcaaccatccttgggttattaaggtgccaatgttttgtgccaacgaggctttcgccacattcaacgcatttgccacatcaccaatctggataccaggatgttgttcgacataaactaagatccgtaactcgttcaaactaagccctgtggcggacgaccagttcgacgtaagtcgttttaagtcccgttcaaggtgcatgatattcataatataattaattggttgttgcatactaacagcatccttcctgaaatttgtacttttttcattaaccgttcaaaacaagccattgtcccttcgcatgatttttaaaaaaatagtgcgaattgattcctgttaaatcaatatttttgatacgattcgtcattgccgctcgataaccgtatccttgacgacctcaattaagtcaacgtttcactcgcaatatttttttaaaaatggtgcgaatcaattattaagacgaatagttatatttgttaacaaactttattaacaatattattattgcataattacaaaatttacacaaataactttgactaccggtcacagtttagctggtcaaaaatagccgtctatccccgatttaatcggctttttgacaattgattccatcaatattttttacatattaaatttatatgtcaagttaacatgagttaattataatggttattaattaataaacttatctaaacagttaattaaatattctactgaataataaaacagacgtcgagtattcgcactcgccgtctgttttattagccgttactcagaaaattccgtaattaaccccgcgtcaacagcccgcttggtgtatatcgggatttcgtcttcagttgcccggacaaagtgccctggtgcaatttcgaccattcgccgcttcttaccgtcatgttcggtcgtttcgtcataaggaacctgcttacggttacgttcaaactctggatcaggtaccggcaccgccgagatcaaactctcggtgtacttgtgtaacggatgattatacacttcatccgcaggcccaatttccagaatcttaccgtaatgcataacgccgatccggtcactgatatacttaaccattgacaaatcatgcgcaataaataaataagtcaagttctgcttaacttgtaattccttcatcaagttaaccacttgggcttgaatcgaaacgtccagcgcagaaattggttcatcagcaatgatgaatttaggctctaccgctaacgcccgggcaatcccgatccgttgacgttgaccacctgaaaattcatgtggataacgactagagtggtccttgttaagaccaaccgtctccaataagtcttcaacttgcttggttcggtctgcatcatccttggctaaaccgtgaatatcaatcccttccgccacgatatccttgactttcattcgtggattcaatgaggcgtatgggtcctggaaaatcatttggatctcccggcgaaattcatggcgttccttcttagtgtgtaatttggaaacgtccttaccgtcaaaaatgatttcaccatcagttggttcatataagtgaatgatggaacgtccggtcgtggtctttcctgaaccagattcaccaactaacccaaatgtttcaccttcataaatgtcaaaggagacgtcatcaacggcccggacttcatcttttttgccgacattaaaatactgctttaaatggcgaacttctagaatttttttacgttcatcaggcatgtctacttactcctttgctacgggatttgaaattggtgcttgcggtttttgcatggccgcaaacttttgctgacgccgaacgatttcagcaggtggcgttacctttggggcatctggatgaagcaaccaggttgccgcgtaatgggtatcagaaaccttaaagaatgggggttccttctccgtatcaatcttcatcgcgtaatcgctccgcgctgcaaaggcgtcaccaactggtggttccaacaaatctggtggggtccctggaatcgctgataatgagccactttcagtatccaaggttggcatcgaattgagtaacccccaggtataaggatgttgtggattgaagaagatctcatcgactgtcccgtattccacgattttaccggcatacatcactgcgacccgatcagccattccggccacgacacctaagtcatgggtgataaagataatcgacgtatcaattcgattttgtaaatccttcatcaagtccagaatctgggcttgaatcgtcacgtccaaggcagtcgttggttcatcagcaatcaggacttcaggatagcagaccaatgcaatcgcaatcacaatccgttgccgcatcccgcctgagaattggtatggataatcattgattcggccttcaggattagtaatcccaaccaatttcaacatctctagcgcttgggcaatcgcttcttttttcttcaaacccttatgtttcatcaaaggttccgcaatctgcatcccaatccgcattgttggatccaatgatgtcattggatcttggaagatcatggcaatatccttaccacgaatgtgttgcatgtctttttcggactttttaataatatcttcaccgtggaacataatgctcccacgtttaatttcagcattaggtgctaacaggcccatcagtgaacgtgtcgtcactgacttaccagaccctgattcaccaacaattgccaaggtttcacccttacgtaaatcaaagctaacgtcacggatggctttaacttcgcccgcataagtatggaaattgatttccaagttgcggacctcaatcacattttctggtttttccatagtgctgccgtcctcctaacgttttgactttggatcaaacgcatcgcgcatcccgtcacctaacaagttaaaggcgagcatcaagataatcagcacgatggctgggtaccacatctgatatggcaagaattggaagttcttctgcccatcagagatcaacgtccccaatgaagcttgtggtgaactgatcccaatcccgatataactcaagaacgcttcgaagaagatcgcacttggaatcgtgaacatcgtttgaataataatgacacttgaaaggtttggtaacaagtgtttccaagcaatcttgacgggtgattcacccagtgtccgtgcagccaaaataaagtcttgattcttcaattgcaaggtctgtgctcgagtcagccgggccatcgtggtccaaccagtgatcgcgatagccgcaatgattgaggccatcccagtcttcgtgaaggccgtggccatcaacaccatgataaccaattgtgggatggacgagaggatttcaatcacacgttgcatgaataaatcgacgcgcccacctttccaaccggagagtatcccgaatccgaccccaatcgtcaggtcaatcaaagtagcaatcaacgcaatttcaagtgagatccgggtcccatacataatccgcgccagtaagtcccggcccagataatcagtcccgagaagataatgcacgtccgactttgcaccagccgccgcatacgcatcaacgtccttaccagattgagtcaagtgaccattcaaaccatggatactaacacccggaatcttcggagggaggttcgcataccgtggcgactgtgcattaggatcaacatggtagactgcccgtccaccaaatgccactaagaataagaatactaacacgataaagctgataaaagcggtcttgttagacttcaatcgccgccatacatcttggccgaacgttaaggaaggtgctgcgatccgttcattatcaggacccgcttgtttatctaacggctcgaagtcgccgggcttaatatcgatactacttggattttctgccattaactagtccccatttccatttaaacgaatccgcggatcaataattccgtagacaatatcggtcaacaataatagtaagcaaaggagtgctgaatagaaaatcgtcacacccatgatggttgggtagtcgttaaccagaattgatttaacaaattgttccccaatcccaggtactgagaagatattttcaacaaccattgaacccgtcatcaaggcggcggccaatggtccaatcagcgtaaccattggaatcaaactgttccgcaacgcatggtgatacacgataccaaacttcgacaaccctttggctttagctagctcaatataatccgaactcagcacgtccaccatgtcggttcggataaaccgagccgtttcggccagcggactggcggccaaagctaacgttggtaagatcgtgtaagcgaagccttcccagccagcaactgggaaccaaccagcctttaagccgaggtagtattgtaacaggatggctaacacgaaacttggaactgcaatccctaagatcgataagatggttgctaaacggtcggcccaagtatccttcttgatggcaccaacggcccctaggataatcccaaagacgattccgacgaccatcgcttggccacctaactgcattgatggtcccatccggctaccaatcaggtaactgacggcttgatcagagaactggaaggatagccctaagctccccttgaagatcccgccaatgtaaatgaagtattgcaaccaaacgggtttgtccaacccatattgggccaagatagacgccttttcactaggggtcaatttagcttcattttgcagcggtgttccgggcattaacttcattaagaagaacgtggcggtcgccacaatgaataatgtcaggaacaagtaaaatatccgctttaaaagatactttctcatgagaattcctcgcattctattaaaatcaacttaaaaaataatgacatccctcattataaaacaaaatggtaaggattaacaatgtgtcaatccttacccctttgcttcacattcattcagttaaagcacacacacttttttctgtggatttacatcattattttacggacatgtacttgaagttgtagtttgagcccgcagtgttgtagatgatgcccttcagattactccgagtcaacgttgccgaggcttgttgatagattgggatgaccccttgatcattcatcaattgcttttcagcagcaaccatgtcagcccaacgtgcagtcttgttattggcatcggcaccttccgccttcttcacagcatcgtcgtatgcggcactgtcatacttcccattgttgtatgagttgtcggacgtgaagagtgacaagaaggaaattgggtcggtaaagtcagcattccaggcagagataaccgtatcgaagttcccgttttgtgaccgttgaagacgggtcttgaatgggacgttctggttagtaacggtcagaccaggtaatttctcccaagcaccttgaataaattcagtagacttcttaccaccatcagtatcgtcagaaagaagcttgatgttcagcttagtttcaccaatttctttcatcccttctttccacaacttcttagctttcgttaagttgtagtcaactgcagaaggaacggcagcgtcagtcgtaaagtccttaccagttgtcgggtttttagctaagtcttcagaaacgtaacctttagaaacggtcgaaccgttacctaacgtattattaacgtaggacttccggttaattgctaatgacaaggcctgacgaatcttcttgttctggaaagctttggctaaagtcttatcgctatccttacgattaaattcaacgtagaaagttgaagccgtcttccgaactaagtagttcttatcattcttataattcttaacttgttcgttggaaagtgtcgtaaagtcgagcttattggaattaaataagttcaagccagttgaaggatccttaacgacttggtacttgatgctgtccatcttaacagctttcttatcccaataatcgttattcttcttcaaggtccatgacaagtttgtcccagtccaaccagtcatcttgtaagggccgttataaaccatggccttactgctcgtcccatacttagaaccgtacttcttaaccactttttcattttgtgggaagaagttgacaaagcccatcagcttgtcaaagtaagcaattggcttatccaaagtgaccgtcaacttgtaatcgccatcagccttgatccctaaactagaaacgggcttcttgccattgacgatagcgtcagcgttcttaatccctgaatataagtatgcgtattgtgacgcagtctttggattaacggtccgttgccaaccataaacaaagtctttggcagtaactttatccccgttactccattttgcgttcttccgtaaagtgaacgtatatgtcttcccaccattagtaaccttagtggatttcgcaattccgggtgtgaccttcccgttcttaccgagacggtataacccttcattggtgttattcaacgcgttagaactaaccacatcggtggacttagaaatgtccatcgttggtaattcggctgattcggtccaattggccgtttgcttagaacttgaagaactcttgcttgagccacaagcagctaagaatagtacggatgcgccggcaacgacggttacttttgcagctgttttgaaattcatataacccaacccctaactttaaaatagtttgtgtgtgcttttccctcgaaaagttaaagtaattgtatattataaataaattaaaatcaatcccaaactctaatttttatcattatttcgtcataatcttcttaattatttcattttgcgattattatccatactgataaacatgcctgaaattactgatatataagcaattatattctcacatcagtgttcaattatcaagtgaacacaatcggcaatttttcttaataaataattcaaataacgataaaaatgacgatattaggtcttttttacgttagtcaaaacagctaaaagtgcacaaataaaaaagaatgctgattttttatcagcattctcttattattaaacaatattggctagttaagtactcgtacatcggcataaaacacactagcccgtgaatttacaccaacttagattctttccacattaacctcgaaacaagctggtagccattttagatgtgcgcccattttaatcacgactcaacctgattaatcagctccgtctagcctagttaccgagatacccaatcaccgaagcaacaatcaagatgatgagaacaatcgtcgtaatccaaacatataagtggtctttttccactgcaaaggcgtagatagagaccgcaacccgcaaagttggcgttaaaatcaatagaaataaacctaacataatcacggcatatggtttaagtgccacaatgccggctagaatatcagcgaccgtatggggttccataccatttgcataaccaccattgccctgaatcaacatcagaagcatcccaataataatcacgattgcagaaacaatgacgccaattcgtagaatatacccaatcatcatttcaacggcgtgcatctcttgcgctttagttgttttttgcttatccattagatggtcaccccgaatcctttagcaatcatttgaattcccagatagagcatcacgggcacaaagatcatgcgaatcaagcgtggcttgagccgcgtcatgattcgtgagccgattaaggcaccgacgataatcccgatagctaatggggccgcgattccgggtttgattgacccattaaagaagtagaccatcgcactcgctgccgccgtcacccccatcatcaggttagaagttgctgatgacggtttaagcggcatatgcataatcgtatccatggctagcactttgaacgcgccactcccgatccccaacaagccactggcgaaaccagcaccgaacatcatggaaaaaccacccggtacgttttcaacctgataatcaacttgcttattcaatgctttatcataataagtaccatttaagttcaactgtgtcgccagcttgtcatctttgactgacggtaattcaccgttcttactcattaatttacgaatcatattatacgtcgtgaaaactaacagcgccccaaataggaagtacaggaatgttgcattaagcacccccgtcaacactgccccgaggacggccccgaccgtcgtcgcaatttcaagaaacatcgcgacgcgtaagttcaacatctcatcacgtaaatatgcaatggtagagcccgaactcgtggcaatcacggcgataatactggccccaatcgcatacttaatatctaatcccaaaccaagtgtcaggattggtgtgacgatcatgccaccaccgatacctaaaatagcaccgaaaattccggcaattaccccaacgccgagcattagccctaacgaataaatcatttccttcaccttcaccctttaaatttcaattgttagtgtaccatttaaaccgattgatatctaattattaaatgaaggttagcgtatccccagtacgacagtcattaggattattttgcgtctgaaaataccactgcaatttctagctagtgtaatcggtaacaacccgattaaatcagcaatccacccttaaccgcgattaaatttttagatatcaaactgattaaactagtctagcgactgcgcttgctggaattgtgccatcaaaccggcaactaatggggtcgctaaggcttccggggtcgttgctagggccagttgagtctgaaaacgatgatccgccaatgatcgaatcagcacgtcaccaccgtcataggtttcagccaatgaccgtggcaccagggccactcccaattggtgattagcccagtgcatcgccgtgcgggcatcatcacaagtcatgatgtaagtcggcgtaaccgacgcttccagaaaggcaacgtggaataattcattaaaacgacggtacttgatcaatggtaacgtagcgaggtcacttagttgtaactggcgccgcttttcaaaccgtgaatatcgcttcggaatgactgctgccatccgttctgcgggaaagtaacgacagactagatgttgcgcgttgaacggtgttcgtaacaccgccacgtctagcaaccgtttatgcagatcgtctaacaactcatacgtattgccttccgtaatcgcaagctgaacatcgggatgttgccctaaccactttagtaatgccgtattcggcatgacccctgccgaggatgaaactgtccccagattaatggtccccgtcacgccgtgtgccagggcccggaccttgttctccgcagtcgccgacaactgcgtgagctgttgggcataccccaccagtagcttgccagcttcagtaacagtcacaccctgaggcaagcgattgaagagggtgacgcctagttcaagttctaattgcttaatctgatagctcagtggtggctgcgccacgtgcaagcgtttggcggccgctgtcatctgaccttcctctgccacggccaaaaaatattgtaattgttttagattcatccgttaacgccccctgttattaaatattagtatacacgactgacaaagcgggaattttacaatttatttaagacgtgccagaacccttgtgaatgcgttatactagtgataattaatttattaatgaaaggagtggtcacgtgtcgtttcttgaccgacttaaaggaatacttcaggcactaaacagcacggaagccgccacaagcgctactgaggcaccacgttccattgccgcacaaactgccgcagcacctacagttaaccaaacagaagcattagttctcgttcaccacctagatcaggatggcaatgaactgcaggctgctgatatgattgctggcaccattggcgaagagattcacttgccagccgtcagcatcaccggctaccacctcgtccatatcgaaggcttgactcgctggtttacgaccccacaggctagcatcacgttgacttacgaacgccaagctggccaaccagtctggatgtacgcctatgacattgaccgccgcgaactaattggccggccgaccatgtaccgggggaaattaggaaccccttacgaagtcagtgcgccgaccgtcgccggttttaagctcctccgttccgtaggcgacgtgactggggaatacacgaccacttccaagacggtcctttttttctaccgcaatcaaaattggcagcaaactgacctcagtactggttttgtccaagtcaacaagttgaccgccgtttatccgtatcctggggcaactacgaccaactatttaactaagctccagcccggtagcacttataaaacgtacatgcgcgttcgcttagtcactcacgagacctggtatgcgattggcgatgatcagtggattccggagacgcacctccaattaactaccagtgacacactgttactcaagttgccagccggctaccgcgtccaaaataaacggcctgttcgccaaaccggcgttgtcagttttgtccctggcaaacaggtccacacatacatcgaaccatatggccgctatttaaccaccgtcactcatggtgacacggtcaatttgattgagcgaacggccgacgacaacggggtcgtctggtatcgcctgcaagatcaaggttacttgccgggccgttatttaacgaaattagacccaccgtttgcttaaacaagacttttgttcgattaacgcgaaccatgctaaaatgcgccactcgctagcttcaatctaatctagcgagtggcgcattttaatatctacttatcaacaattatgcgcatcaactcgatgccccgattcgtcagcaagaaaccttcctggctgtggtgcatgaagactaacccttcaaactcgcgatcaccagcaaagttcgcctcaccgacctgactagtcgtcaagtgtcccagtttagccgctggaagtgacgtaatactctcatcggagaccaggtagagccgaccagtaatctcgttatatccaatcgattgggcgaagaaacccggattattagctaacccctgcgcgagttgttcaaaatgtacaccagtcgtcgaactgattgtgccacgataaagcgtgacattgccatttctgagctgactcgcatgcgtccaataataggcctgcccagcgcgatcaaaagtcagttcatcacctagacgcccgctaccagtagtaaaggcaattttaagatccggcgtcagggattgcggatttagtcgcgcaacacttgcaagctgatcacgtgccgtcgatgaaataaaccacagctcgttcgtcttaggatttaaagctagtgactgaacgtgtcccgccgtaaactccggccccacttcaatggcggccagcacccgacggtcaaaagccgtcatcttcccgtcgaattggtgagctgctgctactcggaccatcgccatcttccctgattgcccagcccctaaagccatcaggcgttgccaatcatagcgaacgacccagccagtctggtcggcgccacccaactgttgatcattgacgtacatgacgtacaagtaccgattgtcagctgaaaacgtcgcactctgtgggtcattcaacaagcggctccctaactgttgcggtaaatacagtgctgttttgaaatgataatggtcgcgatagccactactctggcgcaacgtgtctggctgattttgtagcccttgagtcgctagatacgcggcggtaggacgaaacaaaatatgctcagtggtgtaccgtcccgccccttttaagggcaaataactcagcttattggccgcgcgcgtcaccccatgttcctgttgatccgttgtcaccacgcgcatcggttgccgcgtgggtgtcttaatatcagtgaccctggttccgacaactcgtacggtgtccgccaacgcccagctcagtcgcccagcagtcccgtgacgcacctgccaataagtcactaaccgcttgttttgtgtcaccatcacctgaccaacccgttgccagtgactagtcgtccgggccgtcccacgtggcgttaattgcatcgttgcacgatttaattaatataagcgcgtttgtttcgattcaagttcacaattccggggcgctaagctttgcaccactggccaccgtaccaagttcgtcgccgcatgcaccgtcaccggcccccacaaccccattcctaacatcaatcccagcatccagcgtccctttattttcaatctcatcgccccctacaatctaaattgcaggttgattgtatcgtaattctctcaccttagcagtgctacaacgttggtttacatggtgaatttacatggaccgataagcatgttagaagaaccgctcatatcgcttctatccggtaccacccaccaaaaaatgatgacaccgccaaatcaacttggcagccccatcattttatgaattattcacatatttgttcgtgcttttgcttgagacacgttgtaacttttctatccgttaaatcaagagcagccagcttaggcccgctgggaaaagttcgagttagcgtaaacttttttggtaggtgcgtcctacaccgacttccaggcatttctgccaattgctggaacgcggtggacacagatttaagccgaagaccacgtcttaaatactggtcttccactaaccaagccaaggacgcttgctaagtggaatttcaccgctgagcattggccgaaacgccttccagtcgggatagtattcgaatagcagacggtgaggggcccaatttttgatgaattggtcgttgtttttcataaacggtaatttcgctaagcaactatcagactgaaaatgatattggaatagctcactatcttaagccgctgtagtcaaaattgaatgtgcgacaaagtcgtttatgcaccctgatgttttattcaaagttccagtatcaaaatagttagcgcccaattgcaccaagttaagtggccgttcatcagccattcgagcgggttcccgaaacgtgatcggtgccactgaagcctgtgcttgctacgccaacggactaatgccaaaaccgcattaatccgttggctaggcaatgctcagtagccaaattattcttagctggagtgattttcttccggcttagaataagactcgtatttgagctaacgcgggttgtgcgttaactcaaattgatgtcggcttacgttccagcaatagtcacccagccccggaggtcgaaataggacgcacatcgactgacgaacagtaatctaactagattggtcagctaagtgtaaaccacaatataaatcctagagcttcgaggtcagcttgacatccggatacttatccgcaaaccagcgttcggcaaaagcattttcgaataagaagagcggtgccccgtagcggtccttgaccaatagattccgcgaactagacatcttttcatccaattgttcgggatcgatccagcgggcagtcttgctacccattggttccatgacaacttccgaattatattcattttgcatccggaatttgaagacttcaaattgaagttgaccgactgcaccgagaatatagtcacccgttgaatatgaagtgtacaactgaacggcaccttcttgaaccagttgttcaatacctttatggaaagacttctgtttcatgacgttcttggctgtaacgcgcatgaagagctccggcgtaaattgcggtaacttttcgaattgaaccgcatttttgccagcataaatcgtatctccaatttggaagttacctgtgtcgtagaggccgacgatatcgccagcaacggcagtttccaccgtttcacgggtatcggccatgaattgcgtagagttgtttaagcgcatcttcttaccagtccgctgcaagaccacgtccatcccccggtcaaattcaccagaacaaatgcggacaaaagcgatccggtcacgatggttcgggttcatgttggcttggatcttgaacacaaaaccggcaaattcatcgtcggttggctgaacgacttggtcatcacgagtcttatgagcagcgggtttaggcgcatactgcagatacgtcttcaagaacgtttcgaccccgaaattggtgagggcggacccaaaaaatactggcgtcatgtctcccgccattactttagcttcgtcaaaatcattaccagcttcgttgatcaattcgacttcatccaacgtgtcacgataaatactgtccttggtcaattcattactaggatcaagctcaccgttctcgtctagtggtaagaacgtttcgccatgagcttcattatgataaagttccacacggtgattgtaacgatcgtataagccctttaagcccttacccatacccattggccagttcattggataagtttcgattccgaggacttcttcgacttcgttcaacaagtccaatggttcgcgaccatcacggtccaacttgttcatgaacgtaaagatcggaatgccccgcatcttacaaatttggaataacttcttcgtttgtggttcgatccccttagccgagtcaatgaccatgacagcggaatcgaccgccatcaaagtccgataagtgtcttccgagaaatcctcatgtccgggcgtgtccaagatgttgatccgtttgccatcgtaatcgaattgcatcacggaactcgttactgatattccccgcttcttttcaatttccatccagtcagacttggcaaagttcccacttttacgggctttaaccgttccggcctgacgaacaacgccaccaaacaataacatttgttccgtaatggtggttttcccggcatccgggtgagaaataatcgcaaaggtacgccgggtattgaccgcggcggttaattctgtcttattcattaaaaattcctttcatcataacctgtatattcaacgtgcacggtggtaccgtcccaccgtaaaaaaacatagccttacatattttactgatatttgaccaaaaaatccagtaccaccgactatcttgcaccgattcggtgggaattcacttaacaaagtcatgacagaccagttgcaatcgatttcagggccatacttttaaattaaggccgcgttttatttggcatgttaaattaagttgtgtacaatgtatttgtttttaaataactgtgatttgggaacgaggaggattttaatatgtcagaaaaatttgacgttgtatatctaggtagcggtcacggaacgtttgacggggccattccgttagcggctcgtggcaaaaaagtagccgtcattgaagctgatttgattggtggtacctgtcctaatcggggttgcaacgctaaaatcaccttagaccagccggtagcattaaaaaatcaagttgctaacttccaaggatacggtctgcgtggtgaaccgacgattgattggcaagccaacttcgaccacgaacgcgacgtcatcgccggcttaccagatatgattgctggcttaatgactagtgccggcgtgaccctcatcaatggccgcgggacgttcgtcgacgaccatacgattcaggtggcggacaagacgtataccgccgataagattgtcatcgcaacaggtcagcatccacatcgtttggacattcccggcaccgaactcgcccatgacagtaacgactttttgaatctaaccactttgccacaccacatcaccgtgattggtgccggctacatcggactcgaattcgccaacatggcactaacagccggcagtcaggtcaccctactcatgcgtggtgatcaagcgcttcgtcaattccaccaaccattcgttgaacgattattggccattctcgtggaacaaggtttagtcctaaaacgtgaatgggtgccaactgcgatcaagtcgactggtgaccacttcgaagtcctcagtgcggatgacaagattacaacggactggatcttagatgcgacgggccgccagcccaacaccgcaaacttaggacttgaaagaatcggtgtggactacacagcagctggaatcaccgtcgacgaccacttgcaaacgagtgtcgctggcatctacgcatccggtgacgttctcgccaaggatcaaccaaaattaacacccactgctatctttgagtcgcaatacctgacccacctattcacgggtgacaccaatgcccccatcaagtatccggccattccatcggtcgtcttcacgtccccacgattggcccaagttggtacacttccaaccagtgacactcatgatgtcaaagttaccgtcaatgatttaaaggatgactggttccggcagacaacgcgcgatgtcaccggccataacttactcgtgacggatgaccagcaccggttgattggtgccgctgaactcggtgaacaggccgaaaataccattaacacgttgctaccagcgatccagtatcaattgacaccggcgcaacgtgaacaactcgtgaccctcttcccaagtatcggcgcagccgtttggtcagcaatttaacaaattttttcttggcaatcaggcctgtaaaaccgggcttggttgccattattttcagtctaatgaaaataatttacaaatatatggttgatttatgtaaatagtttcattacaatgtaagcgaatacaaaaagtacttaatatttttcatataaggtagattgtaaaatt

SEQ ID NO: 37 - DNA, 27431 bp, Lactobacillus plantarum
gcaattggcagaaatgcctggaagtcggtgtaggacgaaccagcaaaggaagtttacactaactcgaactttttccagcgggcctaagctggctgtttttgaacttacacaacttggcacgttttaatcctaattaggcctaataactattggcacaattagcaatcattgtttgattttatgatgacatagttgattcggtgtgacaagggcgtgcgcttggttctaagtgaagcttatttgggcaagcgggcgttttcaagagctaatagggcgcgtttcattggcaaaccaccacgatagccgccaagttgaccgtctttgcggcggatacgatggcaggggatcacaataaggagtggatttttaccaacggcgctggcgacagctcggactgcggtagggtgattgatcattgtggcgagttgtgaataagttgcagtttgaccgtatggaatacgggttaaagcttgccaaacttggtgttgtaaaggggtgcccgtcgtttggtcgaggggtatgtcaaaatgctggcgttgaccagttaggtaatcatgtaattcttgacaggcttgttgattagcttgttgatcataatgaatattagcggatttgaagaaggcttgccattcgtcgcgtggaccgttggcacggccgacaaaggctaagccggcgggcgttgtgcccagccagtaagtttgctggttaatggttgtttgggtcaatgttaagtgcatgtgtgagccctccgtctcaattaggatagcgttagtataacagaattggtggtgtgacgacctgattaaatcagaacagcactgctatattttaatgaaaaaagccagtgcgaacgatgagtcgtccgcgctggctttgatgtcaatgataaagcttgaatttgataattgcagatgctgattagtaccagccatttgcttgccagaacgctttagcagcagtccatgagccgtaacggccagcgacgtatgcgtcggcggtcgcttcttggttggcggcagaataatcgccatttaagagggattgaccaagttgatatttaccatagtaaatcccgttggttacggtgtaggagccaccagattctcgagcagcaatccaggccttggcagcagcctcagatgtactagtcgaactggttgtcgtgcttgttgttgaactggccgtgcttgagctagcttgactggcagttgtgctgctagtacttgcactactagttgcggctgagctagcagtagtcgtgctttgactggttaccgttgtactttgactagccgcactttttactgaactagcactggcttgactagtactgttttggctagcggccgacgttgcactctggctcgtcgtactagtgactgaactagcgctagcttgactagtacgactttgactcgtcgttgacgtactttggctggctgcactagtgactgaactagcactagcttgactagtactgctttggctaacggccgacgtcgtgctttggttcgttgcactggtaactgagctggcactggtttgactcgtgctgctctggctaacggccgatgtgctgctttgactggctgcactggtaactgagctggcactggcttgactcgccgtgctttgactaactgttgacgtggcggtaacagtgctagtaggactctgaacggcggcactagttgttgtagtcgtcgtacttggcgtggctactgaaatggtggcccgtgtcattttaactgtctggtgtttgttaacttgtagtttgtccccgacgtagattaagttgacgttcttcaaatgattcaacttttgaacggcggcaacagttgttttgtgggtgtctgcgatttcactgacagtgtcaccagccttgaccgtcaccgtatcggccttagcagcagttgcaccaagggcaatggcaccagttgttgctaatgaggataataataggtgtttaattttcatataattgattcactcccaaactagattagacttcctttaaagtttaccatcatgtaagcggttcgttaagcgcaatttgcttactgacggactttttagtaaataaaacatgcccaattaagacatagtgtaacagattagcgcttacattaccgctaatttgcaatgcaatcttagtggcgagtgtgtcaatgtagtgacctgggtaacgtgattacgttgcatggtagaattgagcttttaaaaagccccccaaaattgaccgcggcttgcacgtgttcgacgttaccagcagaccatttgcatagtggttgatgaaggactgcaataagggccgatcatggggggccagtttgcagtcaggcaagtccggtgcacctatatggcaacagaaaaacgcggccccatataggatcacgctgattgtatgttcagttgtgcatgaatgtgtttagtaataaccgttggcttcccagaaggccttggccgctacccatgaaccgtagcgtgaagccacgtattcgtcagcgacggtttcctgattagaagctgagtagtcaccgtttagaagtgacttgctgagttgatacttaccataatagttcccgttagatgcggtataggagccaccggattccttgttggcaatccaagcttttgcggcagcttcagcactacttgatgtgctagttgttgatgaactgctgctggctgccgtacttgtgctggcggcactggaagcagtggtgttactcaacttcgtcatagatgcggaagtagcggttgaacttgacgccgtgctagcttggctcgtcgcagaacttgaagtggcactgctagttgacgaactggcggcactgcttgaagcagcactgctggttgatgaactggtggcactgcttgaggccgcgctggcggttgacgtgctggtcacgctacttgaagcagcacttgtgcttgatgagctggcagcactacttgaggcgacacttgtcgttgacgaactggtagccgtgctagctgctgccgtacttgtactgctgctaacggatgcgctgctggcactttgggtgctagtactgttggtcgttgaactggcagtactggtcgaactagccgtacttgaagcagcactagttggtacttgggcagtagccgtggttgcgtggtgtttgccgttgacttccagtttgtcaccgatatagatcaagttaacgttctttaaatggttggctttttgaatcgctttgatggtcgtcttatgcgttaaagcaatttcactgacagtatcgccagctttaacgacaacggtatcggcattagcaacggtagtacctaaagctaacagaccggtagctgccaatgaagttaatagggcatttttaattttcataagttaatcagtcactcctataaaagttgtgttgttatttcgattgaatggtgattagtatactgatcacagattgcaaagcaataaacaacagattacggtttgagccaattttgtaataaagtaacatggtgtaacaagttaacactttcatcatgttttcgccacattatcatcacactcgcggtaaaattcagaaagtaacttaaaaaatactttaaagcggtgagcgatattcttattaattcagtaaaatttgttataatcgagaccgttaagcagaacgtcgtgtaagggagcgagtaataatgtattattttgtgaataccagcattaacccgaaaaaatcgggaattgaacatgctgagatgaaacggctggcactttttaaccagcatcacgttcctgctaagatggtcacgcgatttttttcattatcgttacaccagacactgacagcagcggggattgcggctgaaaatcaaattaatctgtttgatttcattcagcattccagtgaacggccaacgactaagatgacgattgaagatctgcatctagcaccggacttgcgggtgcaacccgttgggcgtcattatgaagtttatcaaaatgaccagttattaatgaaggtcaatacatttctgaacactcaaaaacaactgaacaatgtccaatattatgatcaaaatggtaagttagtgaagactgattggtacgatacccggggatttaaagggcttgaacagttttatgccgctgatggacaagtggcaagtgaacaagtctttaatccggacggggaggtcgtctatcagacatttcatatggcagatcgacaaaatcaggtccaaaattcactttatcgattcattaattatgaggggcaagactggtcatttgctggtgaaacggcaatgacaacctttttcctcgatgaacttaatcggaggacgccgcatgcggtctttgtcattgatcggacgtatgagttggcttacgccgcacttcacatgcgaactaaagcgtttaaagtcatgcacttacacagtaatcacgttaatgatccagcacatccgaagacggctagtctcaactttaattatgcttacgcgctcaataacctagaccaatggaacggcgtcattgcgtcgactaagcaacaaactgctgactttcaagcccgctttggcaatcaacccgccgtttatacgattccagttgggattgtcgatgacgcgactttgaatgcgcccaagccatcttttgatcagcgcaccgcaggcaagattatttttgtggcgcgtttagccgaagaaaagcaacaagatcaggtgatccgggcattcaaaaaggtattggcccaagtgccgaatgcgacccttgatttctggggctatgcaaatggagataccggcaaacaactgcatcaacttgtggaacagctgggactgaaagcggcagttacgtttaatgattatacgaccgatttaacagctgtctataatgatgcgcagttggcgatgttaacgtcgcgggcagaaggttttgcacttgccttgcttgaaggtcaggcccacggggtgccccagattgcctatgatgtcaaatatgggccacgtgatattattcgggacggtcacgatggtcaattggtgccggtcaatgatgaaaatgcgttggctacggcgatgatcgacttgttaacgcagccgaaaaagttagccatgtatagtcaacaggcttatcaagatgcccaacgctttagcacaacggctgtttggcaacagtggcaaccactcatgaaagccgcagccgatttttatcaagttgagggggcaacacagcgatgaatttttttgtgaaccaatatttaatggcgttaaattctggtgtggaacatgccgaatttaaacggctccagttgtttaaagatcatcaggcaccggctaaactagtaacgcgtcaattcgatggtttgttacatcagaatatgcggcgcttcaatattgccgatgatcagatggccaacttgtttgacttttttcgtgaaacgaccagcttttccagtcgggtcatcaagatggctgatttgaactggccaactgcctatgacattaagccggaccccaatgtcagtgaggtacgagctggtgatcggctggttgctaaggtccactttgttcccagcacggtggggcacgtgtacttcattgaaatttttgatcacttcaataatcttgttcagcgtactgattatgatgaacggggctttaaggcccgtgatgaattcttctcgtcagccggggaaccaatcacggatattttctatcgaccagatggtagtcggatggccgaacagtattatgcgcatgataataatgggactaattatgtttcgttgtgccatcttatcaattatcatggccgtgactactactttaatggtgaacaagaatggtaccggttcttcttagatgaactgaacaagcaatatgatgaaaacaacgtctttattgcggatcggccgttagctgctcagtggccggtggtgaacatgcagacggcggctaaaaaatatttgtggttacccacgccacatgcagtcgatccgcgtgatcaagtctattctaatttgaataacgcgtatgtttatggcctgcacgagtttctgagtgcttgggacggtgtgattacgagtaccgaacaacagaagcaagatttgacgcagtggctcggtggtcaaccgagtgtcccaatcctgacgatttcagcagccattgtttccaaaaagcacgctcaacacgcaccaatttcgatcagtgaacgtcatgcgcatgaaattatttataccggccgtttggatgcggaacggcgcgtcgatcagctagtgacagcttttgaccaagtgcaccataagattacggatgcgaccttagtgatttacgggtatggtggtgagcttgaccgtctaaaacagcaagtgtcccagttgcacctagagaccgccgtgacttttgctgggtatcaaccgaacttaacaatggcttatgatcaggccggtgcttacgtttatactggtgaaagtgatgcacagccattatcgttaattgaagcccttagtcatggtgtgccagcaattgcttatgatattaactatggccctaaggatgttttgaaggatggcaagaatggttatctggtcacggatggtgccgtcaaccaactagtcagagcgctgacccgaacacttgaaagtccgcaacgtcagcaacgacttagcaagggggcctatcggagtagtgaacaatatagtgatgaacaagtttggcaacagtggcagccggttgttcagtgaatatcaaaaatggtctgactttagtggtcagaccattttttaaacgctaatgtcaaaaagacctaataacaacggcggggatcgctaatctgaccacgttgttaggtactgggtaattgcagtctgtacggggcgcagtgccgctgccggttgcgtgttagtcagtaaaaagaattggcgttggtaatgagcacttagctgttcgatgggaatctcgttgcttaaaacgtgacgtgaaataattgtttggccgataccatgagcgaggaggtccgcgatgatttggttactgtggatgatcatgacttgtgctggctgaatgttgcgggcttttaaaaaggcgttggtataatgacgcacaccggaattaggttcacgtagcagccagaggggactggcaaagtcgcccgcatggacgagctcatcgtgaccaaatggcaagcgattgagctggtcagtaacgagtggcttttcaactaaaccaaagtccagtttgtgttgggacatagcggtcaaaatttcggccgaattggcaagcgtcacttgaaagtcaaagcgatcactgacggcactcaaattggctaataaagtgggtagaatcagacgcccggttgtgtgtgaggcaccaatccggcaaggaactttcactaagtggcgtggtgattgcaccgctgttttggtagcggcccaagttgttaacagcttttgagcctgttgatagaggagctgaccactggcagtaggaacgatttcttggcgcccgttacgtgttaagagcgtggtttgtaaatcggcttcaagttgtttgatttgtgttgagacggtcggctgggaaataaaaagttgctcggcggcatgggagaagttgcgagtttcgtataccgcacagaacgtttccaattgtttaaacattgtgttcacccctaactattatgtttattaataataactatcataataatttatttctcaaatgtaaataactttcgtatacttaaaagcatcgagatagagatgggagaaagtgaatgaaggtcaaagggattttaccggggttagtgaccagtctggtcattgcaattattagtcaaggattggcgcaatttgtgccagcgttaggtgcggctactatcgcgattctattaggaatcattggtggcaatacgtttctgaaacaaccgcaacttggtcgggggactaagttcgcagaaagtaagctgttggaatattccgtgatgttgctcggtgcgacgatgacggtacagacaatcggcaaaattggtgggttcggcgtgctctttattctttgccaaatgacgattacgatcgttggggctttgtggttagggcgtaagctgggtttcagccagtcggtacgtatgctgatggccggcggtaacgccgtgtgtgggtcgtcggcgattgcatcaatcgcccccgttattgacgcggatgaagatgataaggggactgtcattaccttagttaacttgatggggacagtgctgatgttaacgttaccggtcttaggaatggccgtgtttggtggcagtgtcattcttaaaggggcgttgattgggggaactttacaatcagttgggcaggtagtggccgcagctagtatgattaatcaaacaacggttcaatttgcaacgattttcaaaattatgcggattatgatgctagtcgtcgttgttttgatttttggccggttacaccaacgcacgattgaaaatgaattggctgaggatgctgtcgtcagtggtaatgggaacggtcattggttaccatggtacgtggccgggttcttaatcttatgtgcattgaatagcttgatttcgttaccagcaattattggcgcaacggctcatacaatcagtagttggtttgaaatcattgcgttagcagctatcgggttacgtttgaatcttgttaactttatgaaagctggcaagcgcttagcactgtatggcttaggcgtggggacgattcaggtcgtcagcgccttgattttaattacgttattactgcaacattaattgggttttgatacacttaaatcgcaatcatggttaatcattcaattaatcatgattgcgatttttcatctaagagagtaggaatgttcatgctaacttatcgagtcacaccagcgattgaattgcgagaaccgctaccccaaagcgatgcgccggcattactagcattattaaccgctaatcgtgcgcagtatcagtattatttgccatgggtggctaaaattcaaacggtggcggatgaacaacgctttttaacttttgcacaagctcagttacaacaagcgcaagcgctcaacctagtcattgtcgttgaacaacgggttgcgggaatggttagctgtgaccacttcgatgataacgaccacagtgccaacatcggctattggttgggacgaccatttcagggacgcggcgtcatgacggcagccgtccgtggcgtttgtgacttgggttttaatcagtatcatcggcaatgtttgcggattcgtgcggcggtggacaatcaggcaagcaatgcggtggcgcaacggacgggctttgactttttgattcagcatccaggtggtcagcacttattggatggcgatcatgatgagaatgtgtatcaggtttcagcggttgattggctggcgaagcgccacaagtgatgacgattaaacaaaataaaactgactagccaagatggttagtcagttttattaacgtctaatttttaactgtcaccacttgccacgtcttaggaattgtaaacaaatattggcgttgaacaatttttgtcttggtatttcctaggctgaataacacgtgtgtcaggtgatttttgaactgccaagtcgtggtctttagttgaacctgcgcgggtgaaccgctagtcagtttagttgttgtggtggttgcggtcaccgtgtgactgactttagtggcggctgcaacccggtaactgatgacgcgttcagaccctgttccgagttgctggacccgcaacgctacttgtttggattttagcggggctaagtcttgaatctgcgtgcgggtgacctcgtgcatgccccaatggtaattgtcgtttaggacgagggcgatgaggctagtggcaataatgaggccactaatgataatggcaatgagacggttacggcctgccggtgaaaaaatcatcgtgccagcaaagacaaaggttgccagaattagtaagacaatgatcatgcggcatcatcctcctgactaatggtttttgaatgattggcttttaagaagaaggtaatcccaaagccaatcgcacaaaaaatgagtgagacaacgaacgccatgtgataaccagttaaggttgcggtgattccgtcctgacggtatttcaaaggtgcctgtgtcagtaattgatgtcccggcatttgccacttagcgacgctggagtagacactgattaaaacggccgtccccattgaagctgcgacttgacgtagggtgttgttggcggcggtcccatgggaaatcagccggaaaggtaacgcattgatcccggtcgttgtgacgggcatggtaaccatggtcaggccaaacatccgaatggcgtaaacaacgatgatccataagattggggtcgtggcgctaattgataggaagaaagcagttccaagcgttaggagtaacatccccgtcattgctagtctgcgggcaccgatatggtcaaagatgcgaccagtaatggggctcataatccccatcatgattgcgccaggtaataaaatcaatccagagtccattgctgaacgaccgaggaccgtttgaatatacattggcaaaatcatttcgacgcccatcatagccatgtaagcgaggacggtcaggattgcggatagggtgaaagccggaatcttaaagacacgtaattccaataatggctgatccatgtgaagttgccgccagacgaatagaccaatgaaaatcagaccaatgactaaagttgtgagaacgactgggtcgccccaaccagcattaccaacggatgaaaaaccgtataacatactgccaaaaccaattgttgagatcaagactgaccaccaatcaattggttgtttggaagttggtaagactttccgcaaagtgaagaatgaaacgatgatgactaggatattgattggcaggatgaataagaagagtgcccgccaggaatagttatcaataatccagccagagagtgtcggtccgatggcgggtgctaagccaataacaattccggctgtccccattgcggaaccccgtttttcgggtggataaactgaagacatgattgtttgaaacactggggcggaaattccgacgcccattgcttgaatcattcgggcaatcagcaacatctgaaagttgacggcaaagtacgccagcgtagttcccagaccaaaaataagcatggctgttaagtacaaatacttggaattgattcgggtcagcaaccaggcactgacgggaatcataattcccatgattaacatgaaaccagtggtcaaccactgaacggcggttgctgaaatatgaaaatcggccattaacgttggaaaagctgtcgttaatagtgtttgggtaatgaaggtggtgaacgtcccgacaagtaaagtcaatacaagccaagtccggtgatagggctggccgttggcatcaagcggcaacgttgaattttgagttggcataataccgtcctttcttttataaattctgtaatgatgcacaatcaataagtatatcacgatgcaagtcctagtcctattaattggtaccggggcggtctgctgagtgttcggtgtcgtggtaaaataaaatagataatattagttaatttgtggtgagtcgtgctaatgatagtcagcacaattcatcgacattcagtaaggaagctaaaaaatatgaccaaaaaatatttaacatttgattgttacgggacgttaattaatactgagccgctgtatcaatgggtggctaatttaggattggcggttggtttagacccactaacggttcgcaaagcctacgcgacttatgaggacgatcctgccagtgtcaatccttatctagattattcaacattagtccgggctgatcttaagcatttagatcgattgtttgaacagagacacttctttgaaagtcattacgttgaatgcttggaagtgcaacgacacttattaccatacgccgatgttataccgaccttaacagcgtggcagcaattgggctatcaattgattattatgtcgaattcttcctgggatattatgccggccaacattgctgctttaaaggtgccgttcacagcggttgttacggctgaagacgttcaagcttacaaaccagcgttagctttctttgaaacggttcaagagcgttttaagttaacggcagataatcattggcatattgcacgtggctatgaatccgatgttgttccagccagtgctatgcagtggccgatgatttggattaatcgtgatcagcgacaaccgactagttctgaacggccgacccatatggttactgatttggccgctgctaagcagtgggttaactaggcgtgcgcggtagtgtccccgttgatcaacagttaaaacactggttgatcatcagggctgaacaagctttctaattttgactaagctgttaaatctcaaaattggaaaggaaattaacgtgaattcaaaatctttaaataaaagtacggtcctattaatggcgatctccgcggccattgtagtggctaatattaattatattcaaccgattgaggcggacattgcgcaacagtttaatctcccaaacgccgttattggcgcggtggcaatgctgacgcagttaggctatgccttcgggttgctcttaattgtacccatgggtgatatcatgaatcgccgaatgttgattatgcgcttactggtactcgcaatcatttcagcgttactagccttcgtggctcccaatatttgggtgtacgccttggcaagcttactgattgggataacctcggtggcaccacaagttattattccgtacgccggctttctcgcacctcgtaatcagcgtggtcaagtcttgggcaacgtcctgagtggcttgctcgtgggggttctcttgtcacgaactgtcagtggggtacttgcgagctatttgccttggcagatggtctatctgattgccgctatcttgattgcaggattgtggctcgtcttgtggcgaaaattaccgcatgatcccgtgacgacacataccacgaattataaagccatgattcagacagtacctcagttagtaaaacgctatccggttttgcgagcgtcggctgttaacggatttgtcttgtttggtgtttctaatattttctgggcaacactcgtcttttacttgcaacatcaatacgggtggggaagtcgtgaagctggtctgcttgcgttgctaggtgttaccggtgtgttagcagcccctttaattggccgtctagctgatcgttttcggccccgaacgattatcggcttgggtctagtgttatcaacattatcctacgtagtgttttggctgagtggtacgcatttggtggggttaattattggtattgtcattcttgatttaggtactcaattcgggcaggtcgcgaatcagacacggattcaaagcatcgatgtccatgccagtagccgtttcaattcggtattcatgtttggctacttcatgggtggcgccctaggttcattttgtggcaacgtcttatgggatttagctggttggaacggcgtctgcgggttagcggtcgtcgtgttaatgattggtataggcgctggcagtaggggacagttaattaatatgaagtatgctgatgatgagcttaatgaatattaaccataatcggcgttgaacttaatattagtcgtaaatcaattaaaaggattgtatttcagagaaaatggtctaaactctaattattcatgttagaagatgtaacatgaaatctaaataagagggttttgctatgcgaattgaagctgattgtattggtaagttagctgttccggatgatgctttgtatggaattcatacgttacgtgccgttcataattttccgattacgacggaattgatgcatccactgatcatgcaaagccttgttcaaatcaagaaagcggcggccagtgtgaatgcggctgccggaactttgtctaatgataaggcacacgccattattgcggcatgtaatcagttactactggggcgttacgcggataacttcattgtgccagcgattcaggggggtgctgggacctcggctaacatgaacgtcaatgaagtggtggctaatttggctcaccgattgatgccggcagttgccgttcatcccaacgatgatgttaatcaatcacaatcaaccaatgatacttttccaacggccggtaaaatggcgctttgcatgcaactcccaggactattaacggcactcagccggttggtacaaacgttactggttaaatcgcagcgttatcaagatgccatcaaagttggccgaactcagcttgaagatgcggtaccgacgacgtacgggcggacctttcatgcttattaccaattattcaagcgtgatttgacccgtgtacggcaggcgggcgaacatctccgaatcgtaaatttgggtgggactgcaatcggtaccggcatcaacgcgactcacacgtatcaacaacagattttagtgaaattaaatcaaaatactgatttagatttagtagccgcaccagacttgatcgatgcaacgcaaaactgcgatttgttcgtggaattctctgcggccatgaagacgttagccgttgacctttccaagtttagcaatgacttaagattgctggcgagcggcccacaagctggctttggtgaattgaatttgcccgcgcagcaagcaggttcttctattatgccaggtaaaatcaatccggttattccggaggttgttaaccaagttgcgtttgaagtgattggtcacgacacgacggtaacaatggcagcggaagcaggccaattggaattaaacgctttcgagccgattatgttacgggcattgctaaccagtgagcagcatttacagcaggccttgactacattagtcgatcactgtgtgcggcaattgacggtcaatcgccaacgctgtgcagatcaagtggcacattcggccattacggcaactgttttggcgccataccttggttacgagacgactaccgcgctgattaaagaagcgctcaccactaaccaagcaattcctgaattattacatcgacgtcgcttgcttagcgatgctttggtcgagcagctgttttcgccggccggactaactcagccacgcccagaggttattgaacaactacgagcggttgcaaagtagccactgttttgcagtgcaatttatggctgagataggctagtgctgaaggttgacaccagccagtttaaagccaatggacgtcgcacgacttagcacaaactaaagttagcgcgctttctgccaattactaaaacgcagtggatccaagtttaagccgtatctcaaatgctagtcattaaaaatgagtcaccagaatgaaaaattctgatggctcatttttagttgtcgtttacttagtcttagctaaaagcagtgagacacattagtgtaagttgaccaaagcaaaaacgattggaatggtgacgacacttaaaatcgttgagatgctcattagggcaacggctggcccgggatcaccgtggactttgagcgagaacaagacgacgattccggcgactgggcaagcagccattaacactgtggtgaataatgggatgccagtgatacccattagctggaggacaacaatcgccaagtatggaaacaataaattgcgcaataagatgactaaccaaagacgtttatcgagtgttgcacggttaagtttaacgtctgccaaactattcccaataacgatcatggacaggggtgtgttgaccgaactgacatatttaatagcgctattggcaatcgttggcagttgcagcgaggttacgaagatcagtagcccaacaacaatggcgatgatattcggattaaagacgatctgtttaagattatcccgccgattgccctgttgtccggtgaagagggtgataccgtgagtccagctaaaaatattgaaggccgctaacgaggcaacagcatagaatacgccagttgcaccgaatagggagctggttaatggaatccccataaaaccggcattagaatatacggcaccgtaacgcataatgcgccgcaaattctggtcagagacgcgtttgaatagtaattgtgtcacaatgatcatgagcacataaatgatcacaattccagcaatgacccgggctaacatttgcaagcggtcggctgaaaatgtcttttcaaaggcttgaataatcaagcaaggtgacacaatgtataacaggatattggttaaatcagttgaagtctgggcatgcatgaagccgagcttgttaacgagcaggccgacgagcatgagaatgaacatcaaaatgatttgactagttagttgcgttaaattcatttacttcagtccaataaattagaatactctcattattgaggcttggcctgaactttgtcaagattcatttaggccggatgatgcgcctggacaatatccacgtgatgtttgagatggggaaaaacatgatgatcagaccaccccatgatggcaccttgagcaattaaggcaaagaccgtcccgaagccaatggcgcgcaaatgacctgtggcgaagaatgaaacgacgataatcgtcagaggtggcaaataactggtccactgagcaataatagcggagccatgtaaaaaccgaaagcgtaagatatatgataaatcatcgttcggatgctgaattaaattacaacactggtaaatcgagacggcggccgcaacgcctaatagcccaagcacgtttagaattaagcgtggtaacagggacagggcgggaatctgtagccaatcccaaaagtagccgataaattggaccaggtaactaaagggcacgatatagagcaagttggagataaaccgccgccgatcaaagtgacctaacagaagttggttgagaatcgtgacaaccacaccgtacagtaataaggtggttcctaatgaaatatgggtccagtcagctagattaacgctggagccagtccagacggcgctgcctaggctggtggcgatggtgagcgcgttggcagcagaattcagaataatggaaaagactaaaaaaccaaaacgttgacgaaaatcaggaatgttcaacacgactaagcgacctttcagttaacagtatatgagttattataaccgctttcataagtagatgtcacggctagactcataaaaatatgctatactaattgcacaatggattttacggttgaaggacacttcaagaattcggactacttttgggttgggtagtcagagcttgcagtgcccttttttaggaggtttttaatggattacgttggtagtttagcgttgattttaattgttacggcggttgcgggtcacctgagtgtccgaatgggcctacccgcggtgattggccaattgttaagtggaattatacttggtccagccgtattaggttgggtctcagcaacaagttttatcaaagacttcgcggagcttggcgtgattattttaatgttcatggccggcttagagagcgatttgaaattgctgaagaagtattggcgtcctagtttgttagttgcggtcctgggggtcattctacccgttgcggtgattgactggtgtagccaactatttcaccttaacgccactgaaagtttgttcttgggcgtaaccttcgcggccacatcggtttcgatttcagtcgcggttctcaaagagttaggcgccctcgatggtaaagaagggacgacgattttaggtgcagcggtcgttgatgacgtcctggctgttttgattctgagtttgatgatcagcttatttggcagtgaagtcagtggtggcggtagtcatgcctcaaccaacttgggactctcgctggcgattcagttggcgttctttgtggcgctgtactttgtggtcaagtgggtagtgccacatttaatggccgtggggcatgccctactggttccaacatccatcacgctgatgtcactagtgatttgttttggactctcatacttagcggacgcaatcggtttaagtgccgtgattggcgcgttttttgccggtatcgccgttggtcagacggactatcatgaagttatcgatgagcatattcaacccattggtaatgctgtatttatcccagtctttttcgttagtattgggctgaatatgtcattcaatggtttcttgaacgatttttggttcatcgttgtgattaccgttgcggcaattgccactaagctcattggtgccgggggcggcgcacggttagcgggttttaattggttaagcggctatgagattggcgccggcatggtgtcacgtggggagatggccctgatcattgcacagattggttatcaaggcaaattactatcagctgatcgttattcggcagtcatcacggcaatcattttaacgacgctgattgcaccactattacttcgtcaggcggttaaacgccaacgtgaagcttaaagcaattgaaaatcccaacttgtttgcgtattgcaaacgggctgggattttttaatcacgacattattcagttgttaaacgttgatagtggacttcggcgagctgaccatatcgattggtgtcaactaattcaaagcgctgttgctggtcaattgctttaaataagggaataccatcacccaaaatgactggtgcaatctggatgtagagctcatcaactaaatccgcagctaacagcggcattaagacgccagcaccgccaacaatccaaatatttttgccagcggtacggcgcaagtcttcgacgatcttcgtgacgggggtattggtgaactgggtgcgttcatcgccggtgtgggggtgggaagtcatgacaatattgtgggtcgccggattatatggattaatgagttgatcagtggtttgttccatcgtgtattcgtaagtatggcggcccatgatggcggtatcaacttgctgcataaatgcttcggtgggggcatcgttggcaccagctgttttgaacagccagtccagccgattatccttagtggctaaacaaccgtcaattgaaatggccccataaaactgaactttacgcatgattcgacacctactttatctttagtagtcatattgtaccatgttttccggtcattcacttgctgaactccggtaaaagttcagtaacacaattaaataattggttcgaaatgggaggtgggaaactacttaaggtgtcgctgggagcgtatgaatgctgcaaataatgatgttgtggggctaatgagaatgagtatccacagcgggttgagcaggtcgtggtgatcattgtcggagaagtagcatacgggcaatcaagatgtgagttgaagtaacgattggtggttttcaagggccccaccgtccgctataattggattagcatttcatcacatacagtttgacctaattaggcgagctggcctggttcgtaaacttcccaggataaaaaaccaagaacttcagttatcggaggtaagagaatgaatgcgacgcgtaacgttattattgactgtgatcccgggatcgatgatagtttagcactattattggctcttaaatcaccggcacttaatgtgattgggattacaattgtttgtgggaacgtgccaacccatatcggtgcggaaaatgcactgaaaattttagatttggctgaccgattggatattccagtctatttgggcgctaatcgcccattggaagtcgcctacacgagtgcgcaagacacccacggcgatgatggtttagggaatagtcagattccagcggtaacggcggtacgaccgattcaagatgccgctggttttattgaagagacgctgattgaagcacctgatacttcgattttagcgttgggaccgttgacgaacattgcaacggtactgcaacgtgatccacgcttatttgaacaagtcgatcaatttacactgatgggtggaagttatcggagtcacggtaattgttcgccagtggctgaatacaacttctggtgtgacccggatgcggccaaggtcgtctttgacttgatgcctgttcccattcagatggttggtttagacgtcacgcgtaacatcgtgttgacacccagtttattaacgtatattaaagacgtcaatccagcaatgggggcttttgttgagaaaattacaaccttttattttgactttcattgggaatatgaacgggttattggttgtgtgatcaatgatccgttggccgtggccggaatgcttgacccaacgattctgagtggctttgaaagctacacgacggttgtgacggatggtgtcgcgcgtgggcagtcaatcgtggatgatcatgatttctggcacaacacacccaatagtcaaatcatgacgaaggttgacgtcgtagctttttggcggttgttcttaacgactgtggtcggtgcggctgatcctgatttaacgcaagtcttgcaccaattggtgagtgcatgaagagaataaaaacgcgggcaattacgttattggcgctctgcattgccctgaatattgttggcagtaacattgccttgatgttaaaattaccgatttatttagattcaattggtaccgttttggctgctgctgtgtttggaccactgggtggaatgttggccgggggtgccaccggagttatcgtgggtgcgacgacagacctgtactcgctgttcttcatgcccgttcaactgctgactgggttagttgctggtctgctatatcggcgaatcaagccgggcacgtggcggtcaaattggtggctagctggtgttatttcacttcccggaacacttttatccacggcgattacggtcatcttatttcatggcatcacgtcgtctggttcgagcatgctagtccaattattattaggtaccggtatgggcaaaacgatggccgtcttcttgatacaagtgggaacggattatttagatcggtttatcacagtgtacgtggtcgcacttgtttaccgcgcattgcgatataaattgccgcaagctaattagttgaacggatgacttggtgtcggatgactaaatctaagcatgtttacgctaactcgcactttttccagcgggccgaagcaggctgtctttgagcttggcaaattctagttttcgattcgtagtgtctgatgagtcgtgtaaatatgaacagtaaaaatgacctcacaggaacattcctggcgaggtcatttttactgttatgaggttaaagtgcagtggtcagtggcactacgagtcgcggcgactcatcttaccatcttcaatttgatagaccacgtcacagtcatcaatcagccgttggtcatgggtcaccattacgatggccttttggtgctgatgagcttcgttggcgaggcgcttgacgacgtcgatggagcggggcgtgtccaggctggcggtcggttcatctgcgagaatgacgcttggatcattgtaaagagcacgggcgatggcaacacgttggcgttcaccaccggagaggtcacttgggtaggcatcccgaacttcagtaagggctaactctgctagtaatccatcggtgcctgcttgatcaaatttgcgccgggccattttatcgacgagcttgaactgttcacgaaccgtcaggaatggaattagattggaactctgcaagataaagccaatttcattgaaacggtaggctaagcgctgtttttccgtttgattcgatagtggttgtccgttcagaataacttgaccacttgttggcgtttgtaaaccggcagcaatcgtcaaaaaggtggatttacctgagccagaggggccgataatcgcgacgaattggccagcactgacttcgaaattggcatcagtcaaagcgttaacagcggtatgaccgtgaccaaattgtttattaatattttgtaaggctaaaactggttgactcattgatatcatcctccttatccaatggcaacgacggggtcaatcttggcgacagtccgccatgagagtaaggcaccgacgactgcagctaacaagagagccacactataaataccaaattgtggccagtcaatggcgaatggtaatccggcgggcatgatttgcgcgaggcctaacgtaattagaaggccgatgccgataccaatgattgccatgacgacactttgggtgagtagggcagccaagatgtgtttggtaccaataccttgtacttttaagaccccgaacaaggcttgtttttgaagggtcagaacgaacatgaaaattccaatcacggctagggcaattgcgaacaagaagtaaatcatcgtgttgagtgtcaactgctcagcgctgtatcctggtaatttttcaataaacgtggcaattgataaacgttgcatgttgccatgatgttgagtcttgaaatgactctttttagtcacaaaggcgttgaccggttgttgatcgccactggtgatgggattacctttgagacgattgagcgtggcaacgtccgtgtagaccgttggcgcaatactataggtactagctttgaaagtaccgacgatcgttaccttttgatcagtggtcccaatgcgaactttctgaccaatccgatagcctttgtcttttaatcccgcggaaatcaataattgattcttgccgttgattcggtgtcctgagatgacttttggcatcagaaaactatcgcgagtggtcccaaaagcgctagcgttagtcttttgaccattactggcagttcgtaaagtaccggacagactagctaagggtgcgacgtcctgacctttgattcgatcttggtctgctagttttaattgggatgctgacagtgtctgattcgcatcttcgttcaaataaactgtttgagcatgccactggtcaacagcctgacgattaccattggataacccgttagcaaggcccgctaacataaagacgacgagggcaattagtagcaaaaccccgctaagtagcccatatctgagtttttcgtgggccatttcttttaagcctaaatacatgtcaattcctcccttttaatttcatttatcaagtgataaataaatgtggtaatcgtatcacgttcatttttgtaaatcaaattttttatttaattaccaggctaaattatttcgaaatgggtaccaaggctggtatgattaatttattgaatagagaggcaggtaattattaatggtgaacaagcagttcaatcatcgggccgcagttattgctggtgtgactggtggtgtgatttctggtttagttaagttagggtgggagaatatcctaccgccacgaacgccacagcgggatcaaacgaatcccccacaacaattattgcaacaaattgggattcccgccagcgttacgcatgcaacgtattcatattctggtcatgatttaccaggtgtcagctatgtcatgcatttcggattctcaacgacctttgctgtggcctatagtttatgggctcgcaagcacccccgggcaaaaggtggcagcagcgcgttgtatgggttaggtatctggacagcctttcaccatggtatcttgccagcactgggaaccgttcccgctgcgaaggatcaaccaatgaccgaacacgtgtcagaagccattgggcatgttttatggatgtggaccgctgattgggttagtgccgctgtctatgaccggatgacccgttccaaatagcggtttaaatcggttagtgagtgacgacatgatgaagtgtcgtaatcgcaaccgttgaataaagtttttgcttaaaaaactagcttggttaggaatgattacaactgctaaccaagctagttttaattgtcgctattttggttaatgttcggattctgatggtaacggaaatagtgattcaccgcgacaatcacgtgattatgaggaaagcaactgagattaacgtctattacaatgggaccatttgattttaatgattgattttttaatttaattctcatattgactgaaaatgtgctaaaatattaatattgtgtgcaatatttcataaaaacatccataaatgagaatggggcggaagtagcttggaaaagcagggaaagatgaagcggtatcgccagttccgattgagcttgggctggcagatcttaattgggctagtgcttggaattgtattaggggtcgtcttttatggcaataaaacggcaattactgcgatgcaaaacatcgggacgatgttcatcagtctgattcaaatgatcgttttaccaatcgtggtggcatgtctgattaccgggattgctaatatgggcgacctcaaaaagttaggtcggattggtggtaaaaccattatctatttcgaaatcatgacgacgattgcgatcgccttagggttgttaatgggtaacatttttcaccctggtgactatatcgatattcatcaactacatgcgtcgaatattagtcagtatgtgcaaaccgctaagacggtctcacacaatggtatttggtcgacggtcatgggcattatcccgactaacgtctttaaatcattgtcagctggtgacatgattccagtcatcttttttgccgttttctttggtttagggacggcggctattggcgaacaaggcaaaattattctggactttatgaacgctgtcgccgaagctatgttcaaagtgacgaactgggtcatgcacacggctccgattggcgtctgtgccttaattggggtcacggtcgctgaaatgggcttgaaggcgctggccccgttaggctatttcattattcttgcttatattaccatggcaatctttattgtggttgtgatgggcattgttggtaagttattcggtttaaatatttggcacttactacgggtcattcgtgatgaaatggtgcttggcttttcaacggcgagttctgaagcagccctgccccgcattatcgataagatggggaaatacggtgttagtgaaggaattgtctcatttgtgatcccaactgggtatacgtttaacttggatggctccgcaatttatcaatcgttagcggcgcttttcttagctcaggcttatgggattcacctgtcactcagccagcagatcactttattgattgtacttatgattacgtcaaaggggattgctggtgtgccgggggcttcgtttgttgtcttattggcgacgatttcaacgattggcgtgccagtacaaggactcgcttttattgcgggaatcgaccggctagttgacatgggacgaaccgtggttaacgtggtcggcaattcattagctgcggtaattatcggtaagtcagaacatgaatttgatacggccaaaagtgatcagtatttagctgagattcgggcggggcatgcgcgcgcaattacgaaataattgaaaacagctctgtcagttagttctgcattaataatgcgatggcgatgatcactgatgattgatagacccaaaagttgtatttcagaaattaatttctgaaatgcaacttttttatgatatcttattctggttacagcaattacttcagcgattaagttatgataagacctataggggaggatggcgatcggatgacaactgatttttcgattgggcaactcgcacagttatttgatatcccagtggcgactttacgctattatgacgagattgggttattgacgccggcacgagtcaatccgcatagtcactaccgatattatgggacgcctcagttcgaacggttgagtaccattaaatatttgcgagcactcggcttaccattggctacgattgccgatttttttgcggcccgtgaactgtccaagctgacgagtatgttaacgacccaacagcagcaggttgaggcgcaattgcgattattaacggcggtacaacaacggatcaatacacgcttggcccagattaaaacggcccaaagtgccaattttgatgtgactgaatgcgtgacgttacctgaaagagcgatggtggctttacgtcagccttatcgccctcaagatgatattgaacttgttattgctaagctacgcgcacagaccggcgcgacgaacgaaatctttctcggcaaggttgcgctgatgctcgaccagcaagccatccaagccggacattttgaccgctatgcgggaatttgtttattatttgaaccgggtgatacggtgccaccccatcaagaacacttggcggctggtagctatgcgcagcggatttttcacggcactcatttggatgccccgatgcagtatcgacaattgttagcggattgtcgtgctcgcggctggcacgtggcgggaacagctattgagacagcactgattgattatgggattacagatcaggttgcacagtcggtgacgcagatacaattaccaatcaagacttgaccctcaagtaactttagactttatactaaatgataattaattattttaaattgaaataagcgctagagattaagctattgattaggagtggcgatatgattggaacgatttttaatacgagcatgattttagctggttgcttggtcggcagtatctttaaaaaaggaatcaagccagcttaccatgcgatattattacaagcgttagggctagcggcttgtgtcatcggcattaatgcggtcgtgcaacggatgccgcagagtaagtacccggtgctttttattgtgagcttggcgattggtggattaattggtcaagctttggatattcaagggcattttgaccgctgggtgggccgtttggcgggtggcaacttagcggaaggcctagcgactgcggtgttactgtactgtattggatcgttatcgattttggggccgattgaggcagccttaaagcatgattacacctttttgtttacgaatggcatgttagatggcatcacgtcgatcgtattagcatccactttcggatttggcatcgcgattgcggcgggcgtcttgttttgttggcaggggagcctgtatgttttagcattaattttgaaaggtgcgttgagtgcagcgttactgaatgaaattaccattgttggtggtatcttgattctagcatccggcttaggtatgttgaaaatcaagcaattcagtacgttgaacctattaccagccttgctagtgccaccaatcgtaattagcgtgatgcaattattttaactagtgggccaatggtgaagtcaattaagtcttttgattgataaagtaaaagccaccaacttaggacaatcagtgaaagctgatcattttaagttggtggctttgtgtataatgcatcgatttgagagattggcattaaatatggttaaaacggactgttttttaaatcaaaagcaaccagcttaggcccgctggaaaaaagtcgagtaagcgtaaaattgcttagttggcgcgtcctacaccgacttccaggcatttctgccaattgc

SEQ ID NO: 38 - DNA, 24747 bp, Lactobacillus plantarum
aattttacaatctaccatattatttcccaaagactgtagagaacccgctactcctagctgattttgtgggacgactgacattagtaatgtgttatttggtgcaatgaaaaatccagtgccgataccgttggaaattaacaaagaaataatgagggttaatgaagtatgtgaatctaggaataagaagccaatttgcgtaattataattaggactaggccggttagtagaacaagctgttgagagaaaagatcactcaaccagccaccaagtggggcagcaatagccataataagtggaaaaatcagcattaatattccagtagtaccaactgaccagtttaaataatcttggagatagagtgggaatataaagctgaacagtgcattaataagtggtatcagcattccgactagcaatgctaagctgaaggtacgattcttaaaaatggatagtggtaatagcgcattttttcgatgcttttccaaataaataaagtatagtgtaagtgctaatgtgataatgaagccaatgataattagcggctgcctgaaaccaatagtctgccctgcttctaatacaacaaagaatagtgtgatgataatgaatagaatccctgcgccccaaccatcaagtttagtggcttgttgccggccatgatttttgggaagaaataggtggcctaaaataatggcaatgattccaagtggaatgttaatcataaaaatagcattccaagcaaactgctgtagtaaaaagccacctaaggcaggtccggcaacaaaaccagcggaaataaacattgtattgatacccatggcagatccccgggtgtgattatcaaacagttccgaaattaaaccatagctgtttgaaagcgttgcggcagcgccaactgcttgcacaaaacgagccaatagtagaaactcaaagccgaagttgacactggccattagtgagccgatagtaaagctatacatacctaaattaaagattctacctttaccccaaatatcaccaagtttaccgaatgttaccagtaagcctgatagaatgaccatataacccatcacggtatatgtgatctgactaattggaaccgcaagtgattttgacatgataggtagcgcgatattaatgattgatgcatcgagattagccataattgtaaaaataccgatgacaatcattgctaaccaagaacgagttgttgttttcatgataaaaattcaacctcctattttttgaacatttgaaagtataacaagttcgtgttacactaacgcaagcaaaatttaggaggatacgagtatgtttacaattacggcgaccgctcagaaatatggtgtgtcgaataatgcactacgttactatgaaagtgttggtctaattggcccgattaagcgtgatcaaaatggtatccgacaattttcggctagtgatcaagagatggttaaccgaattgtacatctccggcaattaggcgcgtcaattaaagagattcagcaatacagtttccgtcctgaagaagtaacactagaacgtacagttgcactaaaaaaatttctgttacgtctaaacggagatctagaagcacaagaggcgcaaattaaaatagaaaaacaatatttaaaagcaaaaatagaacatttggatggtgatattttgagtatgaaatctcataaaaccacgcagatgggttagtagtaactagtttctgaatatcaattcagaatagtcttggaggtatctttgtgattgggtggcccaagaccaaaagcgagtcctagatttttctagtgactcgcttttttatgagagtaattatttaggaaataaaataatagtacttgttactatagttgccagctgaccgtaaagacactcccggatggctggttgtcggtaattttaatggtggcctgattcaatgtgactaactgttgaacgattgctaagcctaggccactgccttcgattgcttgtgaccgagattgatcaacgcggtaaaaacgctgaaagacagcctgtttttggtcgtctggaattccctcaccatggtcggctacagctagttcgactgcttgatcagtctggtgcaaactcaaggtaatcggttgatcatgtggcgagtatttatgggcattatcgagtaaggccacaacgatttgttgtaacatttccgcattaccttgaacgtggatgttcggatcaattgcgagcgtcaatggttgatcaattgacggctggtaatgttcagccagtgacaacattaatagtgataggtcttggtcggttaagactagcttagcgcgatcagctcgtgaaaggtgaagtaggttctcaatcagatgttgcattcttagtgattcttcatcaataaactgtaatgattctggaatcacttcggggtgggcgtcaccccgccgcttgattagactgagattaccgcgaatcgcagcaatcggggttcgcagttcgtgtgaagcatcagaaataaattgacgctcatgctgcaatcgttgattttgcgtgaccaatagttcattaaaggcccgaccgaggtcgttgatctcgcgggggctagcaggcacgtctaaggtgggctggtcgctatctggattgttcgatgtgtacttggttgcgtgtaacagtttaatggttgggtcactcagtcgcagtgctaaacgatgggcccaccaagtccccaatgccagggcggcacaagtgacagccagcatgagcagaatcaaaataagcagactgttgaacaatcgccttaagctgacccatagttggtaagtgttatgcccatctttttcactataagataagaagaaaccaaatccgcgaacgtagactaacggccctactagcttagtctgttgcttggtgaaaaacgatttggacgatggggtagtgatgatcgtccgcttcgttttagtggcggtcgtcaaggttgctttcttggtggttacccagataaatgccggttgtttcgtattgcgtgtcgtcgtattgttccattgaataaaactggggacgtctttgatattcgcctggttaagactgctcatcaagtcacgggcttccctagtcgtattgattgtttgctgagtgccgaccatcagaagggtgatcaagctaaccaacaacgtaattgtcagcattagtcggcggatggccttattgatcagctgttcataggtcggagtggtgttatttttgggcatcagacatcggctcccttagtttatacccgacgccgcgcactgtttgaatgagtggggaggcgccggttgtcgtgattttattacgtaaataaccgacataaacgtcaacgacattttgctgaccgagaaagtcggcgccccagacttggtcaagcaagtcatcacgggtaaagacttcgtcgggatgagcgaggaagaattgcagcaaatcatattcacggtgagttaaggtaacttcttcctgcccgttagtaacgcggtgggctttggtatctagctggatatcatccagttggtagacttgattgggttcaacttgattttcaatgcgtcgttggataacccggattcgggccaataattcttcgatttcaaatggtttggtgatatagtcgtcggcaccattatctaacccggcgactttatcaccgacataatctctagcggtcataataatgactggtacttgatcgtgtttgcgaatgcggcgaagaacttccataccgtcaagttttggcaacatccagtctagcaggatgaggagcaactcgttttgatgcgcttggtaggtttccatagctgtcaaaccgtcagtcgctaccaaaacgttgaaatcctcaaattgtagttctttagtcaagtaaccagataggctaccttcatcctcaacaattaaaatcgtttttttcaatgttatgctcctctcaataaccctggtttatgtctaattatagcgaataattatgacgcttttccgatattttgacttatttttatggatttgtgtgaactaaatgaaagcgtcaccggacttatgctaaaattggactatgaaaatggaaggtaagtgagtgacatgggactttttcgtgacgccatgcaggcactgtatcacagtggtcattatggttacaacatcaatgtaaagaagtcggctcctgccgttgatccgaaggaagtaccagcgattgcggcgttaggacgtattaatcgaacgcccaactttaagacgtggtccgttgattcgccatataaaacggccgaatttacggctaaattaactgacgcagtagcaacttgtgatttggaaatgcgggatcttgagatcaaaccgcagatcgatggtcggtggggcgatcaataagcggaatttgttcccataaattctaatggtcatattaatttaatgatagaccaattaatcaatagtgacggggtgagtcaatgttttcgtacgatcaggtccagcagttaaaccgcttggaaattgaaatttataagtatattgtgggtcatcccgctgaagtaagtactatgacgattcgacaattggccgaccatagtcacgtctcagcaacgactattttgcgttttctaaagcacatgggctatgatggctacgcagaatttaagttcacattaaaagaacagttacggcaagatgccacacaaccgttagctcagacagttataccgatgcggacgttttttgaccgcatgaacttacccgatatcacggctaaacttcatcgggtcgcagaactggttcatcaagctcgaatggtcgtactgattgggtcagggacgagtgctggcctggccgcgtatggcagccatttattcgctaactttggtttatatagcttgatgattagtgatacgagtcagccccatccggttcagcaacaggatttatcggataccgtctttttcgcactttcagtatctggagagtctgaagatattattgaacaaagcgtttattatcggcagagtggcgcgaaggtggtcgctattaccgctagcagtcattcgacgttagctgggattgcggacgtggtgttaacttacgataccccggaagttcaagcaatcagtggtggtagcaccttgtcccagttgcccgtcgtttattatctggaacaattagctatgattattcagccattaacgtaaaggtaattcaaaccaatctttggaacatgttctaaaaatagaacaaattccgatggatggaacaacacccattttagagtgaaagggtatacattttgagaatgacaggtataatgaattttgtaggaagcgtattcatgggtacaaatgtcagatgacaggactactttgtaacggacgaactcaattttatgtaaacggttaactattgattgaccgttagcttacttaaattattctgattgtttgagaatgttcgttaaatgaatatgcacaacaaattattttagggggtcacgacatgagcgaaaacaataacaagtcgagctttgttaatgaccgagttgtccctttctttggcaagattgctggttctcgtcacttaattgccttacgtgatgggatgacattggcagtgccaatgattattatcgggtcggtcttcatgatcattgcgcaattccctatcaagggttatcagacctttatggccaatacctttggttcgaattgggcaacgatcgtccaatatccaactaacgcctcgttccatatcatgggcttgattgcggttattgggatttcttataacttggcaaagagttataaagtcgatccaatctctgcctcaattgtttcgttaggcgcttggttcttaacgattccattaaacaccgataaggcaggagcactgtgggtaccattaacccaacttgattcggcggggttattcacggcgctactgattgggttgtttattactgatttttacgttttcatggtgcatcgcaattggacgattaagatgcctgatagcgtgccaccggcagttagcaactcgtttgcagccttagtacccggttttgtcatcttattcttgatgtggttactgcggttggctgttgaagcatcaccaatgcagagtattcctaacgtgatttcattcgtcttagctaaaccattaggcttgttgagtaacacgttaccaggggccttggttgctgaattcgttgtatgtattctttggattttcgggattcacggtgccaacgtggtttctggggtcatgcaaccaatctggttagctgcgatgtctcaaaatgcggaagcgcttaaggctggtaaggctttaccaaacgttgtgacacaacaattcttcgacaactttgtccacatgggtggttccggtgcgaccttgggactggctttcatgattgcctttgttgccaagagtgccgaattcaagacattaggtaagctggttatcggacccgcattgttcaatatcaatgaaccaattgtcttcgggttgccaatcgttatgaactatcggattgccgttccgtttatcttggcaccgttagttaatgttacgacgacttacattgcaatgtcgacgggcttagttgcaaagacggttggggtcatggttccttggacgacgccgccaattatctctggttacttagcaacgatgcacatctcaggtgcggtattacaaattgttaatattgtgcttgatggtgccatctactacttcttcttcaaggccttagatcgtgataaggttaaggaagaaaagacctttgctgctaaagaagctgctggcgaaacggtcgaagcttaagttaaatcattaatgtagtaatcgtataaataccaccattagcgacttgctgaaagtctgttgatggtggtattttaatgtcgatttttgagaagcgcgtgcagattaaagcgaaccgagtgacttggaattgtcaccgggttcgccttttattaacgggtatgaaattgtgggtgcaacattcgggggtgaccatggtcagtacccttgtactgcaatagccaataagcgttttgcggcaaagcgctacgggcaatgacgtgtgcaacggtgtagcgaatcgtgtcggcattagcgtcagtccataaacgccaagttggtaacttagctgcttgaaccggttcccaatcgcccaattcttgttcactagtagttagtgcggtgagtaaatcaggccgttcggaaccagtcagttcgatgtagtagcaatacgcttgcggatgcagggtgttgggctggctcatgatgagattgctcctttggatggttttaacgagttatcgttgacttaaataaccttatcatcaatcatagtacaaccgtttgactaaattgactagctttttcgcttactgttattaaaatgtaatattcaaacttgcaattaaaaataattgagtgttgcgccttgacctggaacgcgtttcatcacgtatattaagtggtgaaaataacgagggggtgcagcacgaatggaaacgggaattttaaaacagattgatttaacaacgacaacggaacggtatttcttcgtgcaagtacaacgactggccgactatgtctggattcgctcagttcaaaactttaagcctttagaattaacggttcgggtgagtgatttacaggtgaacaagcaccaggccgttgctgaccgggggaatatcaaatatgagtttaacgacgataccgggggactggtgacgcaacttgctggctgggtgcactaagacggtgacagacaagcagtaactgtgatactttaggcaatcaacaaccaataatactaatggcagcaatcaattttaactaggctaggactaaatcaggcgcgccactgaaggctataatgcttcagtggcacgcctgattatcattaaaagatcacttggtattatcactgtaagtgattttatctaaaccttgggtgtcataattgagattggttttgccgtcatacacggtattcttggcatttagcttggtttccatgttggtaagggtctcagtactgagccccagttgggtccgaaggcggtccgacgtttgttgcaaggcctttgtacttaaaatctgataggaactcgtattgatccaagcgggtgagccaatgacttgagtcgactggatgtgtttcatattggcacgatcatgcgtcgctaacccaacaaggtcgttaaagctaaggtcagtttgtaaattacccttcagtgaagtgagtaattgattgtagcgactataggtcttagtctcggcgagtttggcgagaaccgctcgcatgacttgttgttgccgtaattgacggccgtagtcgccccgggggtcctgataacgcatccgtgtataagatagcgcctgtttaccattgagatggtgtttgcccttggttactgtgatgtggtcgaatgaaacgttgagtggactagtgatcgtcacacctccaacggcatccacgatttgtttgagaccgcccatattgatagttgcatagtaatcgataggcacgttgaatagcttgctaacactagccttggccatcttggagccaccaatattgtaagcggcgttgagtttttgaacatttgtgtcctgatcaccgaccatttctgctaatgaatcgcgtggaatgctggtaatgagcgttttcttggtctgcggattgatcgtaacgaccataatggtgtcagaatttcccttatcaatacgaccgtctgccccggtgtcaacacctagtagtaagatgctgagtggcttagtcgtatcgattttagtactgctgtttcccgtatagatcgtcgattggtagcgcgcctgtgcctggcgaataattaagccaatcgctacgaatgcgataacgataatgatgccgaccgcaattaacactggccgtaattttgaagatgctgaatgccgcatgttcaaatcctcccttaattaaaggcgttaagatggttccccggataacgtctttgtcttgaaatcactgtttctagcatacccggtcagtacgatcccggaaaatacttattttgagtgtacttaatttaaaaaatagataccacctaaaagaattagattggaaactgagcaaattaggagcggtcacttacggacagtattacggcagaaaacggattcttggcttatactgacagtgaacttaaatatatgaagtgaggtttggtaatttgacagtctttcgcgcattttctaaccaagaagttttagattatttagcaacgcaagtcactgacgggcaggtcttcactgacgaggagacgctgaaaaaatactctttcagtccgcggttgaccgatgacgatagtggccttgccttagcctatgttgaagcacatacgaccaaggacattcaaggaacgttgaaaacggcccgtaaataccacatcgcagtgattccccaagaccaaacaacgagcactgttatcggtgcggacgggttaacagacagtctgattctttcaaccgccaagatgaaccgaatcatcgaaattagcaaggctgattccatcgccgtggttgaacccggcgtcgttaacggtgatctggataaagaagcacgcaagcagggtatgttctacgcgccggaccctggttctaagcccatctctgggattggcggtaatgtggcgacgaacgctggcggaatgagtacggtcaagtatggggctactaaggacaatgtcttaggcgttaaggtcgttttagccgatggtcgcgaagttaagttaggcggtcggacgctaaagcaggactttggttatgatttaacgcaattgatgattggttcggaaggcacgttaggaatcattaccgaagtaatcgttaaactgttgccgattccgctagggacccccgtgatgggcgtcgcctttttcgataatatgacagccttggctaaagcagtcacggcgattcgaatctccggtgtttatccaacgatgttagaggcattggatggcaatacggttgcggcactcgatcgctacgagaagacacactatgctaagaatagtgcggcgatgttgatctttaagcttgataatggtggtcaggatagtatggcagtcgttaagaagatactggccgaacagcaagccaacgatgttaagattacgactgagcctaaggaacaggcagcgttagaacaattacggcgcgacatgctgccggcagtttttgctggtcagaaccatattatggaagatatggccgtaccattatcgcaactagccccattgatggactatattcaagacctatccaagcggttggacgttgacatttacacggctggacatgctggtgatggcaatgtgcacccgaccttggtgtggccaacctcagcaaccgaagtgccagaaaagattattattgcactacaagaaatgtttaagaagacgctggcacttggtgggacgatttcgggtgagcacgcagtcggaatgttgaaaaatcaatggaacaatgccgaattaggcgaagatgttgatatgttgcaacatcagatcaaggcactctttgacccgatgaatattttgaacccgaaacgtaaaatcaattaacccaacgattacaaagcgcttaagttttgatagcagttgttggtcagatattgcgtaacttggtcatcgtgtcttattattgagatagtcccaaaaatgagttgttggttaatgagtcactaagaatgtgcagtgtggattaaccgatgcgaaggaggccccaagtgatacctaagagtgcacgaatccgaattgaatttgatgccgaagtactccgcaacgagatttttgatgtgcatgatttcgccagttttcaaagcttctggcagcgatttgagaatttcttggccgatcgcatggtcgttggtcacctgaacgtgttagagggccgcggcctgattcctagtgattttgcagatgttgacggacacttagcttaccaagttggtgaagatgcgcaccaaattgcgtatgaccaaattgcgcgtgagtggaccatcacgatccgttaaggtagattgagagagaatagagtcttatattggagcgatattgattgagcacaacaaattcccaagcaagtgcagataatgatcagcttttgccagcacccccggaacttttgcaagctgttgatcagttgaaagcttattcgttacgttatgaagttgcgatgaagctcgttttagataagttagattatattagtcgagagtatgagcttcgttacggctacgcgttaattgatagcaagcagtcccggatcaagtcgcctgagagcattgttggtaagatgcaacgtaagcatttaccgttaacgttaaatgcggtgtttaataatttgcatgatattgcgggtatccggttgattgttcgtttcctaagcgatgtcaagacagtcgagaatttattggcgactcaggctgacattaaagtattacgagtgaaggattatattcatcatcctaaagctaatggctatcagagtttgcatttaatcctcggggtgccggtctacactgttgatgggccgagcatcattgaggtcgaactacaagtacggacgattgccatgaacttttgggcgtcgttggagcatgaattaaattataagaagaacgttccgcatcaggacgcattgcgagcgtcattgactaagaaggcgcagttaattacggagctggatcaggaaatggacgatatcaagcaacggatgtatgaacctaagacgcccccaaaagaagtctaaaaaatgcccgattattagcaggtaattgctaataatcgggcattttggggttttcttgatgcgaatcaagtccacccatgcacatgactggtatcttattatagaagaaagtaattaagaagttagattgcttttgcaattaaagggttcatgttacttttaataggcaagataatttccaaggcatattgataataattaatttaatgggaatagctagattaattaaactaacaatcgaatagtggggttaaattcagtgttcagccaaatttttgactggttttcctcggtaccaccagtcgttgataaaactggccagttcttccggtgattcatgtagtcctgtttttaaccaataacggacaacaccaacgataccattgagataatactcaaacatgtactctttttcgcgattgccaataccagtgatctcagcttggttatgtgctaagatctcacgcttagttgttgcgataaagctcatcagaaaatcctggtcggttgttaagatgaaggaagtaacggcgtggcgtttcttaaccacctcaaaaattcccgtcagaatggcttgtaaagagtcgggattaagatgtttatcaataacagctagcagttcttccgtggcatcttgttccatcttctgcatgcaatctttgacgtcttcataatgggcgtaaaaggtgccccggttgatatctgcggccttgcagacagcagtgaccgtaatctcatctagcgactgatgttggagtaagttgattagactatcttgaattaggcgttcggtcatttgcgaacgacggttgtttttagtacctaccactgaagttcacctcattatttgaacaatatactattgtttgtttatttaatgacgattttatgaaaattgttggttgaaattacaccggttttcatttaacatgttgttattatttaaacacattgttgattaaatgtcacgatgtcgttttgagaatctgaattagggaagggatataacgtgaaagggagccgtagacgttttacaatccaagcgattgtttggctagttgtgatggtagcggccatcatcttcctgccaaatatcagcagtctggtacgtgataagggccagaccaagttgccaagtagtgctaaaagtcaagtcgcacaagtcattcagaatcattgggggcgtaatcaaaataatacgcgccaagtggtggtggtcttcaataatggtgattcaccgttaacgagtgaccagaagcaagcaatcgatgggacgattcaacgcttcaaagtgcaaaaatcaaaatatcacgtgaaatcaatgacggctgccagtgataatgctgctgccaaaaagcaattgatttcaaaagacaaatccacccaattactacaattaatggttggtaagaaccagaccgtcgcgaacatgaccaagaatattacggctggtgccaaaacggctggggttaagacgtacgtgacggggagtgacatcttaaatgatgacttcactcaggaaacggaagcggggattcagaagactgaaattattaccgttattttcattttcatcgtgttaacgttagtcttccgctcgccgattacgccgttagtttcactgttgtcagttggggtgtcgttcattatctcgctgagcgttgtgatgaacctcgttaataaatttaactttccattgtcgaactttacccaagtctttatggtcgtggtcttgttcgggattgggaccgactacaatattctactgttcgatcaattcaaagaagaactcagtcatggcgatagtccggtcgccgcgactgggcgcgcgttaaagattgccggacgaacgatcctatacagtggatcgtcactattgattgggtttagtgccctcgggttagcgaacttctcaatttacaagtcagcggttggggttgccattgcggttgctatcctgttgctcgtcttgttaacgttgaatccattcttcatggcgttattaggaccacggttattctggccaacgaagaagtttgctggcggtagtacgagcaagatgtggcacggcattgcagcgtcatcagttcgttacccaatcatcgccctagtcgttgttttgggtgtctcattaccgtttatcctaacgtacaataatgaattaaactacgatacgttagctgaattaaacgacacgattcctgcgaagaaagggttccaagttgttcaggatcacttctccaaggggacggctgaaccgtcaacgttatatatcaagacggatcatgccttaaacaatgaaaaagatctaaaagtcattgacagcttaacgaagcagttacaaaaagttaagggtgttaaaaccgtggcgtctgtcacccaacccggtggctcacaaatcgatcaattatacgttggcaaccaattaggcaccgtcactagtgggatgaagtctgctagcaaagggctaactaagattggtagtgggttagatagcgccaatagtaaattgaagagtgccgatatgtcggatagcgcgaagtcggccaagaagttggcagatggggcggatgaagttgctagcggtgttgtttcatataccgatggcgtctacactgttaacaatggtttgaaccaattgaatagtaagaccgggactttgtctagtggtgttaatcagttggtcagtggttcagggcaagttactagtggattgaacacgttgaacagtaagactggtacattagcaagtggtaccagtaaattagcaagtggtgcaagtagccttcaatcaggtttaacaacttatgcgaatggcgtttatgctgtaaataaaggggctaatcagctcaataattcaactagttctttgcagtccaaggtaggccaattgctaacagggactaactcactatatagtggacttgataagttgaatagtaagagtagccagttggcaacgggtgctactactgtagataatggtgtatctcagttgcaaacaggtgctcagacactagctcaaagcttgtcgaagatgcagacaaccctaaatacaagtaattctcaagctaataaagctaatattaataagttgacaacagggcttagttctttaaatacgaatatggctgcattagaaaagttggctggtggtatgtcaggaacaatcagtggtgtgcaaaatgctggaacagtttttaaaactgtgtcgcctaagattaatactgagatggggacgattcatagtgctttgcaggattattcaaaactagaaagtgcgtataagcaggatcatcagtcttcaagttcttctgttgatgctaacgcaattgcctcagcagcggttgccgcagctggttcttcagtaacggctgatcagaaatcagcgattagttctgcagtgtcatcacaagtcaatgcgcaaactagcagtactagcacgtctactgcaacaacagtagttacttcaactgatgcggcaacaggtttggcagcatgggagacattaagctcacaattgagtgaattgcaagcggctattgaaaaattagacaattccactggagatttatctaagttaagtggtctgtcagaactggcttctcaatcacaagatgctaatagtaaagccattaagacaatcaatcaattggaatctggtattactcaaattcaggaagcacttgctggaagtactactagtctgggccttgttagtggttccaatagtttgacagagagtttggcaacattaaaggctgggactagcgaattggcctctggcttgaatgaatatacaaatggcgtttcaactgctactacaggcgcaagcactatcaataatggtgttggaaccttaaacagttcaataccaaccttgacaagtgctatcagtgctattagcagtggtactagtcaattggcaactaacacgccaacactaactagtggtgctactcaattagcatctggtactaatgaactcaatagtcaagtaccgacactagttaatggtgttcagaaattggcttccggttcatctcaagtaacaactggcttaactaccttgaaaggccaagtaccaacgttagttagtgcaattagcgcgttagatgctgggacgaacaagttagttgctaattctgcaacccttaacagtggtgcctcgcaagtggcctctggtaatgaacaaatgtacaccagtatccaaagcttagtaggtcagatgcagacgctccaagatggtttgaagactgccagcgacggaactaagacaatcaacactggtgttggctcagctaacagttacttgactggcttaaaggattccgcggctgcgaagacgtattacgtgccaaagagcactttgaagggtaagacttacaagtctgctttgaaggcttatatgtctggtaacaaccacgcaacgaagttaacaatcgtcttgaatgaaaatccaagttcgaagtcagcgatggataaagtaacggcaattcaaaagcaagcgacgaatagcttgaagggaactgcgttagatggtgccaccattgcgattggtggtcaaacgtctgaaacgaacgatacccaagcaattgcttctagtgacttcgttcggaccgctgcaattatgttagtcggaatcctgattgccttgatggttatcacacgttctgtcttacaaccgttctacatcttagggactttgttattggcttacattatgtccttgagtattacacggatcttgagcaactggttcttgggtcaaagcatgttaacttggaacacaccgttcttcgggttcatcatgttgattgcgcttggggtcgactacagtatcttcttgatgatgaagtatcgtgaatttgataattcggctgcgacaccaagtactcgaattgtcagagcttccgctgtcattggggccgtggtcttatccgctgccttgatcttgagtgggacgttcgcagccttgatgccatccggtgtcttgacgttgattcaagtggcgatggttgtgattatcgggttgattattctggtattcgccatcccaacgattattccaagtttgattcgcttaacttatccgttgacggatcgtatggaagacgaaaccactgctgaaaagcagacgaaacgaaatcgtcaataaaataagtcagttatgcgataataagtgtaaccaactggcgccgtctaacgattcaagttggacggcgctttttttaggggctgcacttagattttaaaaacagtgttagttttagtctaagagtatgcggcgagtatgagatagccggattggatagtggcgataaggagatgtttttaatgcaacgatgtgcatgggcggattcatcaccagcaatgcaagcgtatcatgataacgaatgggggcggccgcaacataatcagcaacgactttttgaactgttgtgcttggagacttatcaagcaggactgagctggcagaccgtcctgaataagcgggcggcttttaatgaagattttgcggattacgatgttgaccaggtggccgctatgacgaccgccgatgttgagcgactactaaccgatgctcgaattattcggcatcgccagaagttaatggcaacgatcaacaatgctcgtgtgatccgagattggccggccggggaagattttgccacttggttatgggcgtttgttgataaccagcctatacgccaggcgtggacgtcaatcgatgaggttccggcaacaaacgacttggcgcaacaagtgtctaaagagatgaaacgccgcggcttcaagtttgtcgggccgacaaccatttattcttatcttcaagcgactggtctcattaatgatcatgtggcggactgcccatttgctccagaaaatttaccggcctaacgcgcttaattcctggcgcggtgagtaagtgagccgtcaatttaaaaccagcgcgatgacaactgtcaggcgctggtttttattaaaatcaatatgttttgatataagtgcgattgcttaaattttatgtataaataaatacttattataaccataaaaacaattgacatgatgtcgcttaatttgctaagatacggcgtaagaatagctgcggaaggcaagtgatgggagcgacgttaggtgaaagaagtaaggttttggggactcttgttaggactgtttgtctgtttaggggcagtgataccgttagttagtaaggctgacgtacttgatacggcacccgctggactgaatctggaaggcttatttgaaccgggaaaatttgaccgtaattcggccacaatgcagactgtttcaaagaatggccattcgcagcatgttatcgaattaacaaatgacgataatcaagttggggcaatgtggtcgacccctgttaatcgctttaacatgcgggtcgataaccaagtctcaatgtgggtgaactttggggacaaagccgtgagtgaaggactggccgttgttttacagaatgatccccgcaaaatgagtgcgattagtcggtatggaaagaaaagcattattggtgagaacttgggtgtttatgggacggatacctatacacggcgaacggcgccggccacgattgctaagacggcgattcaaaaaagttgggcgttggagctggataccaaagtgaatgacggtggtttttggggattgtatccccgggggaattctttcgatgaaaagcctaaaaaaatgcatatggccgcgagctaccctgcaagtccggatacttatacgcaacggggtggtttaacgtcctcttatcgttttgaacagaaccatgggagtatcgctgataaattaccactcgcggacggtaactggcaccatcttgtattgaagtgggtcgccagtaaacaaatcatgagttataccctggatcagggaccaacacgaatgaccacaattgatacaacagtctttggaaaggatatccggaatgttacttgggggttaactagtacggcgacaaccgctaatgccagaacactggtcgtctttgaccggttgccacaaccgattgaaatcgagtcagatttaaacgtaaccaatctgactcaagagcgaactgtccatgaaggagactgggttcatggtggggatgagttggaatatgagtacgttctgagctatctcaatggtgacaatgaatggcaacaggttaaggccagcctaccattacccgaacaagttcactttagtcacgcgaagatccgctatgcggatggtaccgaggaagagatcaatttaccagcggacgataacgaatcgtcggtggcccgcttacaacacgatttgcagcggacactatcaatgaaaaatccgcacgcttatattacgctgattggtgaggctgccaaggtcgatcgggatacttttgttgatgatgacatgagttactttgagggtcacgagatgaagaccgcaacggccacaccgcacttcaccattacgaccaataagaccgttaacctgacaattgaaccgttgacacaagtgaagaaaggcgatcccgtcatcattaagggccaaattaagctaaatgatgggttagactttgacaatgatggcatgcgtatcgagtaccgggtcaatggtgaagcgggagaagactatcagttgagcatggacgatccggttggttatgtcgaatttgaagtggatgccgaagaactacaaatcggtgaaaatcagattacgttacgggctcatagcaaagataacgcctactcagaaccagtgacagtaacggtcacggtcattggtggggagttacagctgaaaaaagtcagtactgaaagtgtgtttgcaccaatcaagctgacgggaacggctcaagtcagtcggcccgagggacttgaagtagttgtcaatgatgatacgggctcgaaagctgcttggcgcttagaggcgaccgcgacccctctcgtgactaatcagggccgcacactagcgggaaacttgtattatcaggatggtgccaagctgacaatgttgggaaaggatgccgtggaaatcgcgcgccaaaagacggccccggggatcgactatgacgtgaccgcccactggtcatcgcaacaaggtttggtgctcaaaacaacgcccgccgctgttcctggaagttatcagggtacgatcacgtggcacttaagtaccgtaccggaagagtgagtttacgattgtgtaagtaattcgtttaatcaataagttcaatagtcgcgacaagaattaattgctaattcttgtcgcgactatttggcgttcagcgaaagtgctgactaacgcatttaaacgggcctccgatacggtgcaatgctagtagtagcaagcacaaccagcctttcaggggcttagctagcaaattgaaaaatcttcggtttcagacccataaataaacccagcaagttcacaaattagtcagatttcccgtgtaggttaaaagcagtgcaaagcaattgtcataccaatactttatctgaaggagggtttaagcgtgaatttttttaaacgcgcatggctcaatctaacggcaaaaaaaggccgttcaattctattagtacttgttacatcagcaatcatgctgtttgtattggccgggttattgattaggaatgctgccgatacggcaactagtaatgccaagaaaagtgtcggggcgaccgtcactttatctgctaaccgggaggcggcttttaagaagatgcgcagcgccacgtcgacgagtaaaagtagtcggcctaagttgacgacatcgcccgttaaactgagtgttgcgaagaaaatcgccaagcttagcaacgtttcaagttacaatgcgaccgtctcaacttccgctaatgcgaagggctttgatacgatttcaacatcaggtagtagtactggtggtgggatgaaaggtatgggtggctcaagtagcagtggtactggtgatatctcgattactggggtcactaatacgagcagcgtctcaacctttgaaagtagctcaagtaaaattacgaagggccgcggtattacagctagtgatgaaggcactaacaacgttgtcatcgaaagtgaattggctaaggaagatagcctgagcgtcggtgatacgattaagttaaaagcaacgaccggtgataagaagacttacacgatgaagatcgttgggatctataaagcgtcgtctagtgcaagtacgcaacaaggtcctggtagtaccgatgtcagcaacagtgtttacacgtcatacacgttcgctaacacggtcaagggttctaagtacaagaacacagctgattctgtgacttttgcaatctcagaccccgctaaagttagcagcgtcaaaacgtctggcaaacagttgatcaatacgtcgaagtattcgttgtcaacggatgatagcagttaccaaacggttaagagttcgatgaataacgttaaatcatttgcggataagattgtctggctcgttgcgattgctggaacgattatcttagctttaatcgttatcttgatgattcgtgaacgccgctatgaaattggtgtcttgttatcattaggtgagagccgttggaagattgtcgctcaattctttgctgaaatggtgatggtcttgatcgtctcagttgtcttagccggattcggtggtaagtttgttggtaataagctgggtgaccagttagtttcacaacaaacgacgactgcaacgactacgacgagttcaactagtcagcagggtcagcctggtggcggtggcggcgcccctagtggtaacactggtggtagcaagccaagcggcaatatgcctagtggtggcggtcagactggtaatgccagtgccacgaccgacacgaacttagatattaatgtcacggtaatggatttagttgaactcggcggctttggcttagccatcatgttcctgtcgattatgctggcttctggtggcatactacgactacagccgaagaaagttttaattgattaggaggggcggcaatgttaaaagtaaatgatcttggttactggtatgaccgccaagaaaatagtctatttgagaatgtaaaccttgaatttaagtcggggacttcgtatgccattgttggtcaaagtggttccggtaagacgaccttcctctcactgctggcgggtctagataaaccgcgggctgggcaaattgaactcaatggtgaaccaatcaataagattggtctgacgaactatcggaagtccaaagtggcaatcgtttttcaatcatataatttgttgacgtatatgtcaccattgaataatctgatgactgccatggcaattacgaactcggaacaccgtggtgacaaggattatgcgatgaagatgttacgacggttaggtattacagatgatcagatgaagaagaatgttcaacgcttatctggtggtcagcagcaacgggtggcgattgcacggaccatggtgtgcgatgctaaactagtggttgcggatgaaccaaccggtaatttggatgaagaaaatacgaaatatgtgattgaccaatttcaaaaaattgcgcatgaacaaaagaagtgcgtcattattgtcacgcatgaaccggatgttgcggacgtttgtgaccactcctaccgattagaaaagcacaaatttgtggcggaaacctagggtgctcttacgattgaatcagacgtgagttgacgcgtacaatcgcatttttgtcaagataagtcactaaaaatgagttctcagaatgatttgattctggggactcattttttgattactgtgaattgctaacgagacaacaatcgtttttgagggcgaacttgccagcgaacgataaaggcgatgatgataaacaagacgagatagagcaccgagatgccaatcgcgtaagcaaccggaatactcaacttggccgcggtgtgggtatgcgtggccaaactaacgacgacggatacgtccgataaggcgtgcaagaaaatcggccagactaagttattggttcgtagataaaggccgcaaaaaatcaggccacccgctgcagcataaaagacttgtgggatgacgtagctgagggtcagctggctgctgttaatgagtaggtgggtaagaccaaatagtaaactgtcgatacaaatggctagcatgagtcggtgagggaagcattgtcgtagtagtggcaggagcatgccccgatagatatattcctcagtgatcccgataactagggcgtagccaatatagagaattaacgttggggtccaagcaagatgacatagcttgatgaagttgctcgtcattggtagtaataaaataatgattcccgggatgagctgcaagcattgtcgtacgagtgattgcgattgccaccactgaatcgatattttaaaccaaaaatgatttaatagcaggaaaataagtaatacaagcaagtcttggaccagcccactgtataaagttggtactggtagccaggcaattaatttaaaaagaattggtactaaaatgaaaatactaatagcggctccccagccgcgtttggttgatgacatcgaaatcccctccagaagttaatgctaactttagtataggtcacattgaaggtgttggttatattaattacggatcgattagttgccggtggtcattatgacagccactggtgattttggcgtagaatcggcagtattaataggataatgaccgcgatttcgatgatttgaaaactagtcgtcgttataccgggcaaattgattggaggttccatcatgctaaagaagtcattgacggtgtgaatcaacaatggccatagtagcgatgttgtctgtgccgtgattaaacataatagtagccccagtacgaacgtaaagcccaattgcaatagggttaaactaagtgtttggtgaccaagattgattagatgggtcaaactgaagaggatactagtgaagactgcagctctacctacacccaatgttgactggctggcctgaaacaacattccgcgaaaaaaggtctcttcgaacaggctgatcaatatggcaacgaataacagggtcagggtgtttgtcagttgttgggcggttgctaacgtatataatccaattagtgcggctacgattaaggttggaatgatgggccggatttgccgacgccaagttgccgataccccaaattttaaggtttgccgtagccagtcacgatttaatatgagtgcaattgctaaaaagaacagctcttcgaccccagttgttaatgaggatgggagttgggttaagcgtggtagctggaaaatcaggccaatcaacaacatactgcctaacatgccaccccatagtgtgatgactaatttggtttcgtggcgcatctcctcagatccttcctcgtattctcgctactaagcatacgccttttaaatgaatctgagcataaaaaaacagcgtaacgacaattaatgtcattacgctgttcgttagtaatcagttattttataaagcccaagcagccatgccttgtgcgttgtataagctaacggcagcgttaacttggtcttcaacagagccactgctgatgtgcatgttttggaataaaccataggcaccagaagtactgttcttgaccgttgagttccagtttgattcacgcgtgatgatcgtgttccaagttgaagctgaaacgccagtccgtgattgcatttggcttaatacgtagctctttaagttactaccagtgtagcttgaagtcgttgaggttgttgaagctgttgatgatgcagctgagctagtagcacttgataaagcttgactagtggttgcagcagaacttgaagcttggctagcagctgattgcgttgagcctgctgaagaagcagcactcgttgcaacgcttgaagtagcttggctagcagctgaagaagtagcagcagaactagtagc

SEQ ID NO: 39 - DNA, 39367 bp, Lactobacillus plantarum
agattctaaacacgttcttagctttttcctgcgaacgtgagcaaacggcgtagatttctccgtcaggttgatcaaaatatttaacgaaactgtgcgcgatgttaccaaggccaacaatggcccagcgataagttttcgacattataggttcctcctaggattaatcgaatgtgaccacttacattttagcaaaaaaataaggaattggcgcccaataatcatgtaaaattaattcaaaagtcggtaaaatagagtgtaatatgaccgatgctcattgcgatttaggcttacttagaattaaaacatgttggttagttggattcttattcgtcagcacgtgcgcgtcttatgccgactttcggggccgggtgacaattactggaacgcagccgacgtcgatttgagctaacgcccaacccgcgtcatctcaaatacgagtcttattctaagcccgtttacactaactcgcactttttacagttggcctaagctggcagcttttgaactaagaaaccagcatgttttaatcctaattcatgataaatgaacaggtgtaatctgtaaggcaattaccagaaaggaggcggctatgatggcgggtaagcggcgaaaatcgcgccggaagcaacggacaaagacacaattatttgtgaagaagggccgccttcagtgggtcaatatcttattagtgttggcggcgatggtggggatggtttggtatattcagcataattgggcggttaagtcgcgggttacggcgacagcacctacaacaacgcatgcggcatttattaaaaagctagtaccagctgcgcaacagcttgatcagcaataccacgtgctggctagtatcacgctaagtcaggcgattttggaatcggattggggacaaagtaccaatgcgacagagaataataatttatttggggttaagtccacgtcgggacggctcatgacgacgcaggagtattatgacggggcctatcatacggtcaaacggcgcttcgccgtttatgatagctggcacgcttcgctggtcgatcatgccaagaaattggcgtacggaacgacttgggattctcagcactacgctgcggtgattaaggcaactgattatcagacagctgcgcaagcattgcagacggctggatatgcgactgatccaagttatgcacaaaaattaattaatattattcaaaaatatgacttacaacggtatgatagaaagtaatgaaattaatagcagtatttcaatgtcgcttataattctaggagggtactatgcgagaacttgaagaacgcattttgaaagatggccgggtacttcccggtgaagtattgaaagtggacggctttttgaatcaccaagttgatcccgacctgatgtttgccatgggaacggaatttgcccacttgtttcaagatgcgggtgtaacgaaaatcttgacggttgaatcatcaggaattgcgccggcagtcatggcggggttagcaatgcacgtgcccgttgtgttcgcacgtaagcacaaatcagtcacgttaattgatgatttatatacagccgaagtttattcttacacgaagaagacgtctaaccacatctcgattgccaagaagttcttacaggcggatgaccaagtcttgttaattgacgactttttggccaatggtcaggcggttcaagggatgtttgaaatctgtgataaagcgcacgtaaaaattgcgggtgtcggtattgtgattgaaaaagtcttccaaacgggtcatcaactgattgctgatcggggtgtccgtttagaatcactagcacagattacgtcatttgatggtgaccgggtgcactttgcatcggaggacacccaggcttaagttaagaaagcgggggattgtgatgcacattgacatggggatgctagtccttattttcatcatcaactttgcttacattacgttaaacaccgtacgttttttgcttgtaatgcggggttatcggtattttgcagcttttgcaagtgtcattgagattacgatttatgtgctaggattatcattggtcttaaatcgtctcaataatccgatcaatttagtcgtatacgcgttaggttacggtgtcggggtgtatgttgggatggtaattgaagatcgattagcgttagggtatacaatgatttcagtcattttacctgatcccaagtcgtcgttaccgggagtgctccgtgaaaatggctttggagtcacacaacacgctgcttatggtctagaaggtgagcggctagaactagaaattttggccccacggaagaacgaacggcggctgtatggcctgattaaagacgcggcgcccaatgcgtttgtgatcgcgtatgaaccacgctacatctccggtggcttttggctcaagcgagttaagcgacgcaatgctcgccgaaaaaagcagtgataaacttgcaactgtgcgtgtcagcaagtatgattgttacaggataatgagcgttaaaataattcaataatcagattataattatttaaagcataggaaagtagggactgaagtggacaactcgattttaaacccaggtggtacgcttggcattattggaagtagtactaatggtgttggattagtaattgccgcgcgtaatgctggcatcaatgtcggggtatacggcgataacgaaaatactgagaccatggaactggcagattttcgcgttgtcggggccctcaatgatcaacaacagttacagaacttcgcagaacgttgtgatatggtgacttacgagtcggaaaccattgatgcgtcggtcattaattttttggcggcccatacccgggttccacaaggcgccgatgcgcttgagattacacaggaccgctctttggaacgggcgtttttcagccaacttaacttgaatgtagcaccgtcagcgacaattgtcagtttggatgatgtctatcaatcgatcgggtcaattggatatcctagtattttgaagccgattcaaaagggcttgggtcaaaatcggcaactggtcattaagacgcagacggatattgtcaaggcggctgatctgttggattggggcacatacttgttagagtcattgattccatatgataaggaactctccgtttttggcgctaagagtggtgatacgacagctttcttcccaaccgttgaaaaccggtatcgtaatcatgagctagttgcctcgattgtgccagctcaaattgattcagctgtgaatgacgaaatgctgcggatcacaaaggaaattagtgataacttgagttatacgggtgtctttgaagttgccttcttcttaacgaagagtggtaatttgtacgtgaagcggattgtccctgcgatgcatcaggcgggttatgtcttcgaacgtgctacgaatattagtatggcagaacaacacttgcgagcaattgcgggactgccgttaatgccagtcaagcagttgatgcccgtggttgctgcttactttacaccggctcaggagagtggcattcgcacgcagtggcagattaagacgaactggttctttaatttctatcaccgaacgttgttacaagcgcaccgggcaccagtcgctggccacgtgctagtcgaagcaccaagtgttaaagaagcactcgaacagatcgaagacacaagtatttggcagtttgggcaaacgacgccggctgataatgaacctgaagctgagtagtgtatgatcagaacctagttttacggattattacggttaaactaatcgtactgttcgcaccgggtgaccagctattatgggtaaccgtcgtgaataaataaagttcgaaatccaattcattttgtgaattggatttttttagcggttggggagaagccagccaaatggcgagatacggttatctgagggggaatcgttgagattggcgtggcgggtattttggttagaaattgagggagtctcaaaattacttaaagttacgcaatattgccgtcaattcgtttcccgtgaatagtagaagttgtaaaattaacataggtgtcactgacaatggaaaaaccgcgatttttgtatgagatgctgaccttaaagtacagcaatcacggccaaaatttgctataatgtttggtgactgatttttagaaagggtggcgaacagcgtgtcgaaagaaagcctattggcaggaatgaatgacaagcagcaagaagccgttttagacacagaaggaccgctactaattatggccggtgcgggctcggggaagacccgtgtattgacgcaccgggtagcttatttaattgaagagcaaggggtcaacccctggaatgttttagcgattacgtttacgaacaaggccgcacgcgaaatgcgtgaacgggttggtaagctgttaggtgaatcggcgcaggaggtctgggtctcaacgttccatgccctgtgtgtccgaattttacgacgtgacattgaacaaatcgggtataaccgagcgttcacaatcgccggcactagcgagcaacggaccttagtcaaacgaatcttgacggaacaaaatatcgattcgaaaaaatttgatccgcggtcaatcttatccgcaatttcaaatgcgaaaaatgacttacaaacgccggagatgtataaagaatcggctgccagtccctttgagagtgtcgtggcagacgtttatttgcaataccaacgtgaattagcggttgatcaagccgttgactttgatgatctgattatgctgacgattcaattattcaagcagaatcctgaaacgctggcgtggtaccaaaacaaattccattatattcacgtggatgaatatcaagatactaataatgcacagtatacgttagtcaacttgttagctgacaaatataaaaatttatgtgtagttggggatgcggatcaatctatctatggttggcggggggccaacatggaaaatattctcgatttcgaaaaggattatccgcaagctgacacggtgatgttggagcaaaactatcgttcgaccaagacaattttgtcggcggctaatgcagttattaacaataattcaacgcggcggccgaagaaattatggactgtgaatgaaccgggtgacaagatttcttattatcgtggtcagagtgaaagtgatgaaactcactttgtcattgccaagattcaagaaagcatgcagcaggacaaaatggactacggcgattttgcgatcctttatcggacgaacgcacaatcccgggtaatggaagagtcactcgttaaggcgaacatcccttatacaatggtcggtggtaataagttctatgaccgtaaagaaattcgggacgtcttatcctacttgactttggcagtgaacgatcaagattcaatgaactttgaacgggtcgttaatgaacctaagcgcggcattggtcaaacgagtgttgaaaaattgcggttgttcgcggatgaagcgggttattccatgttggaagcagctagcaatgttgacatggctaatggcatttcagcacgagcgaagggtgctttagcgaagtttgcagcgacgatgaatgaattgcgcgctatgcgggaatacttatccgtgacggatttaacacaagagattcttgaccgaacgggttacatgaaggcgttgaaagatgctaaggcaacgaaatcgttagaggcacaagcccgtatcgaaaacattgaagaattcttgtctgtcaccaaacaattcgatgatagttatcaacctgaagatgaagatagtgacaaattcgtggacttcttagcggatttagcactggtttcggatgtggataacgttgaggaagaaccccaagccgtgacgctgatgacgttacatgcagcgaaggggctagaatttccggttgttttcttgattgggatggaagaaggtatcttcccactgtcccgggcaatgatggatgaagacgagctggaagaagaacggcggttagcatacgttgggattacgcgggctgagaagaagctgtacttgaccaatgcatactcacggatgctttacggtcggcggcagaataatccggcttcccgtttcgttgaagaaatcgaaccagaattactcaaaaatgaaaatacgttggatggtgcaagtagcactggtcctaaagtcccatttggtgcggatcgtgaacggcgtgcttttacaccttcatataaaaagaatccagtggggacgcgggccacggtcaagaaggctagtggcacgggtgctgacaagaatagttggtcgatcggtgataaagtcaagcatcgtaagtggggaaccggaacggtcgtgaaggtctccggtgctggtgaagatgctgaactagacattgctttcaaatctgaaggaatcaagcggttattagccgcatttgcaccgatccaaaaagtacaggactagttaggaggactggctgatggcggacaaacccaacacaatgacggttgagcaggcggctgatgaagcggctgctttacggcaaacgttaaatgaatggcgtcggcagtactatgacgaagatgcgccgaacgttgaagatagtgtgtatgatcaaaagtatgaacggttggtcgaactcgaacaaacttttccacagctcgttacaccggattcaccgacgcaattagttggtggaacggttaaagcaggctttgataaagtgacccatgagattccgatgttgtcattgggcgatgtcttttcacaagctgagttacaagagtttgttgatcgcttggaacaaaacgttggtcatccagtcgattataattgtgagttgaaaattgatggtttagcgctgtcgttacgttacgaagatggggtgctcgttcaagggtccacgcggggtaacggtacggttggcgaagatattacggctaatattaagacaatcaagtcgattccacaacggttgacccgaccactgacgatcgatgtacgtggggaatgttatatgcctaaggcagcgtttgctgccttgaatgaacgccgagaagcagcgggagaaccagtctttgcgaatccacgcaatgctgcggccggtacgttacggcagctagattcacgagtcgtggcggaacgacagctcagcacgtttatgtataacattgccgactatgaaccgttaaccgcccgtacgcagagtgacatgttaacggagttcgcagatcttggttttgccatcaatcctgactttaaggtggcccattcgatggccgatgtctttagttacattgaccattatcaaaatgaacggccagaattagcatatggcattgatggcatcgtgatcaaagctaacccgttaccgctgcaacgctcactaggagcgacagtcaaggtgccacgatgggcgattgcctttaagtttccacctgatgagcagccgacccttttaaaggatgttgaatggaccgttggccgtacaggagtcgttacgccaactgcggttatggaacccgttcaactagctgggacgacggttacgcgggcttcgttacacaatcccgattacgtggcggccaaagatgtccgcatcggtgatacggtcttgctacacaaggctggcgatattattccggaaatttcatcggttgatttagccaaacgacccaaggatgcgcaaccattagttattccaaccacgtgtccgtcttgtggggcgccgctggttcatttggaagacgaagtggctttacggtgtattaacccgaaatgtccagcacaagtccaagaagggctggttcattttgcctctcgcaatgccatgaatatcgatggcttgggaccacgaatcattgcgcaactctatgcaaatcggctggttagtgacgttgctggtttgtaccgattaactaaggcacaactgttaacattagataaaataaaagataaatctgctgaaaagctcttgacagcaattgaccgtagccgtgataattcacttgaacggttattgttcggtcttggtattcggcacgttggtgctaaagtggcgcggttaatcgcgcagcattttgggacgattgaggcgttgatggcagctagccaagaagagattgcggcgatcgattcgatgggcgatgtgattgcgaacgcagtggttcaatattttgagagcgacaaagttcatacactcatccgcgaattgcaagcagtcaacgtgaataccacttatcaaggccctagtgccaccgtggcagaagatagtaacagttggtttgcaggcaagcgggtcgtgttaactggtaagctggaaagctttacaaggccagatgcgactcaatggctacaagctcacggcgccacggttacgggaagcgtctctaaaaagacggatctcgtgattgcaggtagcgatgccggaagcaagttgcaaaaagcacagcagctggacattactgtatgggatgaagcccggttcagcgaaacaatgagggaggatgcacaagcgtgaatgttaaacgcatacgcacgattggcttagtggcagtagctgccattgttctagccgcctgcggtaatttaaagaattcgtcctttgggtcgactagtagtagcaccacaacgaccggaacgaaaacaacgaccaccactggaactgctgatagtgagttctatcaaggcgtcatcaaaaatggccgttatcggacgagtaagtcgcgaggcgtggtcgtttcgcaaaatgataacgtcatgaatttgaagagcttcgaaagtggcttattggacgtgtctaaaaaggtctttccaacgagtaagtatgtctttcaagaagggcagtatttgagctcatcgacagttgaaaattggctcggacggaaatcaagcagcaattcggagggcttgaacccagagaataacggtaagaaggatccgaatactcggaatccgatttacttacaacagcttgaagaacaagattatatggttcaaaatggtagtaagttatcgcttggcggggtcacgattggcttgggaatgaactcggtcgattattatactaaggtcgaatatggggcaacatacgaaacggacatctcaacgactgagttaacggcgcaaggtaagaagatggcgaatactgtcttacagcggttgcggcaacgctcagctttgaagaatgtgccgattgtcttggcactctataagcagtcttcgaatgatagtttagttgggggcgacatgattgcctacgcggtttctaagaacggctccacttcgatctcaaactggacgtcgttgaattggaagaattatgtcttcccagcgacctctgagtcaaagaactcaggtgcgaatagtaatgatgagtcggactttagtcagtttaagtcccacgtgcagaatttcttcccgaacttgtctggcgtaacggcgaatgctcattacaaggacaaatcgttgagtaaattaagtgtcaacatcacgactaagttctacagcgaaacggaaattatcagtttcacgcagtacttagcaacggctgctaaacggtacttgccatctggtgtaccggttgaaattacggttaagagtgccaatggtgacattcaaagcttcttagccagaacggcgaagggtagttcgtattacacccatgtctttagtgaccagggcgacgattaaacaataatattgagtaagatttgagaaagaaggaaatctgatggctgaagaacgaattaatgccgaacaagtgcaacacgtggcgagcttagccaaattggagtttacaccagaccaattagcgatgttcacaccgcaactagaaaaaattatcggcatgttcgaagaattaagcacagttgataccacgggtgtacccgttacgtcacggatgagtgatcatacgaatacgctacgtgaagacgtggcagttaagagtgatgaagcactccgggaagcattgctgaagaatgctccagaaacggccaatggcttgatcaaagtgccagcaattattgatgaaagtggggacggtgaataatgacttatttcgaccaagatctaactagtctgcacgctgacttggtagccaagaagatcagtgctacggaactagcgaaggccacttttgcgaatatgaatcaggttgaccctaagctaggggcgttcttgaatttaaatgaagaacaggccttacaacaggcggctgctttggatcaggatggcatcgacgcgaacaacgtttttgctgggattccgatggcagtcaaggataatattgtgacgaagggcctaacgacgacggcggcttccaaaatgttggaaaacttcgtgccggtctataatgccacggtggttgacaaactattagcaagcaacgctttgatcgttggtaagaccaacatggatgaatttgccatgggagggtcaactgaaacgtcggcgttccatgtcactcgtaatccttgggacatcagtcgagtgcccggtgggtcttcaggtggctcagctgtcgcagtggcttctggacaagtgccagtggcactcggttctgatacgggtggttcgattcggcaaccatcatcatttaacggaattgtcggcatgaaaccaacgtacggtcgggtctcgcgctgggggctgattgcctttggatcttcattagatcaaattggcccaatgacacggacggtcaaggataacgcggccgctttgaatatgattgcaggtaacgatgtgcatgatactacgtcatccaaacaaactgtaccagactttacggccggtttgacgggtgatatcaagggtatgaagatcgggttaccaaaagaatacatgggcgaggggatcgaccctaaagttcgtgaagtcattcaacaagcagtcaagcagtttgaagacttaggtgctacggttgaagaagtctccttaccaaacagtcgctatggtgtggctgcttactacatcattgcatcttcagaagcttcttcaaacttacaacggtttgacgggattcgttacggtttccgggctgacgatgttaagaatttggaagatgtctatgtccgtagtcgttccgagggctttggtgatgaagttaagcgccggattatgttagggaccttctccttgtcagctggttattacgatgcgtacttccacaaagctggtcaagttcggacgatgattatcaatgactttaataaggtctttgaagactacgatttgattatgggaccagttgcaccaacgccagcctttaagttgggtgacgaattatctgatccaattacgatgtatatgaacgatgtcttgacgattccagtcaacttggctgggttaccaggaatgtcagtaccagctgggtttgcagacgggttaccagttggcttgcaattaattggtaaggcgtttgatgaaagcacaatgtatcgagcgggctgtgcctttgaacaagcaacgcaagtttacaagcaaaccccgaaagtcggaggtgctaactaatgaattttgtaaccacgattggtttggaagtccacgttgaattaaaaacgaactcaaaaatctttagtccttcacccgtgcaatttggttccgaaccaaatgccaacacgaacgtgatcgactgggggtatccgggggtattgccaacgcctaacaagggcgtggtcgaagctgggattaaagcagcaacggctttacatgctgaaatcgaacatcacacgtactttgaccggaagaactatttttacccggataacccgaaggcctaccaaattacgcaacatgaaaaaccaattgcgcatgatggttggattgaaatcgaagttgatggtaaaaagaaaaaaatcggtatcgaagagatgcatattgaagaagatgccgggaaaaacacccatgaaaacgactattcctatgtcgatttgaaccggcaagggacgccgctaattgaaattgtttctaagcctgacattgcctccccagaagaagcttatgcttactgtgaagcgttgcggcaacggatccaatttacgggcgtttcggacgttaagatggaagaaggttcaatgcgggtcgatgttaacatttcaattcggccggccggttccgacaagtatggtgtgaagaccgaaatgaagaacttgaactccttcaactacgtgcgcaagtcgttagaatatgaagagcaacgccaacaacaagttctcatggcgggtggcaagatccaacaagaaacgcggcgttttgatgaaacaacgggccaaacgatcttgatgcgggtcaaggaaggtagcgatgattaccgttacttcccagaacctgatattccagcagtcgatatcgatgatgactggattgcatccgttaagaagaccattccagaaatgcctggttcgcggcgtgaacgttacatcaatgaatttggtttaactgcttatgatgcgggtgtgttgacccaaactaaggaaatgtctgacttctttgatgcaaccgttgctgaaggtgcggatcctaaattagcttcaaactacttgcaaggggacgttaacgcgtacttgaacgagcataaagttgatttgttagcgactgacttaacgccaactaacttagctgggatgatcaagatgatttcagatgaaaccatctcaagtaagattgctaagaaggtctttaaggccattatggcgggctcagaacctgtccaatgggtcaacgacaagggcttagtccaattgtctgatccggcgaagttacaaccaatcgttgacgacgtattggataataatcaacaatcaattgatgactttaagaacgggaaagaccgggccgttgggttcctcgtgggtcaaatcatgaagaagacacgtggtcaagctaacccgaaagtcgtcaaccaactattaatgacatcattaaaagcacggtagaagcgttggtcgataaggtgttgagcctcgattgatgcatgtccagcgttggagtagggatgagacgctgaacgcttgaccgtgtgagcggaggaataggaaacatgcgtaaacgggcacgacttatttataacccgacttctggacgtgaggcattggcccacgatttagttgaaattcttggtatctttgaacaagctggttatgagaccagtgcgttcgcaacgacgcccgcccctaattcggcggctgatgaagcgcgacgttgtgccaaggacgggtttgaactgattgtagcagctggtggtgatgggaccatcaatcaagtagtaaacgggttagccgggttaaagcggcgacctaagatggctattattccggcgggtacgaccaacgattatgcccgggcattgcggattccgcgcaatgatccggttgcggcggccaaggtagtcctaaagaaccagacggttaagatggatatcggccaggctggtgaacagtatttcattaacattgcggctgggggcatgttaacggagctgacctatgacgtgccatcacaattgaaatcgatttttgggtacgcggcatacttagccaagggtgctgagttattaccacgagtaaaaccagttgagatggatttgaaatatgatggtggtcattatcagggcaaggcttcgatgtttttcttagcgctgactaattcagttggtggctttgagcagttagtgccggacgcgtcattagatgatggtaaatttaccatgattattgtgaagacgagcaaccttgccaaaatgcttcacttaatgacattagtgctcaatggtggcaagcatatcaatgatccaagcattatttatgtgaagacgagcaaggttgtcgccaaaccagctgacaaggatcgcttaatgatcaacttggatggggagtacggtggtgatgcaccgatgacgttccggaatttgaagcaacatatcgaaatgtttgccgatacggatcggatccccgatgaggcaatcacggatacggatccagagttggaagacgctgagcgacactttgtctcagccgttgatcagttgccagctgcaactgaggacgacgaaaaaacagaataacttgcttaaattaccgtttaccgatacaatggtggacggtaattttttttaaagtgttgccgtcacagggacctgattgagcattgcctaacgatttaatcgtttgtcggtttagcaatgatttgtcagtggtgcaaagcatgagacagctcaaattcgcgcgttttgacactcacagtaagcaatttgaatagcatgtttaatcagtaaatgttaacgacactgccaagtgtggcagtattaatggccatatcactcgctgcccggagcagtggctaccaggcagtaactaaaaaataataagtcactaacaaagaaagcaagaggaaacaaatgaaagttaatttaccagtgcacaagggtgaagttttagacgtcactatcatggatttaacctatcagggtatgggtgttgctaaagtcgataattacccaatctttatcgaaaatgcattgccagaagaaaaaattacggtcaaggtcacgaagacgacgaagaactttgcgtttggtgatgtggaaaagattaaccaagtgagtcctcaccgggttaatcctaaagggcgcgtttatcgtcaaaccgggattgcaccactacaacacttggaatacagtgaacaattgaagtttaaacagcaccaggtggccgaattatttgcaaaggtccacatggatgatgtcgaagttttaccaacgattggtatggccaacccgacgcagtatcggaacaaggcccaagtacccgtacgacaagttcaaggacaactaacgactggtttttacaagaagaacagtcatcaattgatgccaattgaagattattatattcaagatcccgcaattgataaggctatcgtggtagttcgcgatattttacggaaatatcacgaggcagcctacgatgaattccatcatagtgggacgattcggacgatcatggtacggcgtgggtattacagccatgagatgatggttgttattgtgacgcgaacgaaacacttaccaatggctgacgtggtcacacaagagattcaagcagcgttacctgaagttgtcagtgtgattcaaaacgttaattctaagaagactaacgtgatcttagggccagttaacaacgtgttagctggtaaggccactatcgatgatcagttactgggcttgacattcgccatttcagcccaatccttctatcaagtgaacccacaacagaccgaaaagctttatcagttagccattgatcaagctggtttgacgggtaatgagacggtgatcgatgcttattccggtatcggaacgatttcgttaacgatggcccagcatgccaagcaagtgtatggtgttgaaatcgtaccagcagccatcgataacgcacggcagaatgcggataagaatggtattacgaacgcgacctttgttttggatagcgctgaaaaagccatggctaaatggcaagcagatggcgttaagccggacgtgatcgtcgttgatccgccacgtaagggcttggacgccgactttatcaagagtgccggtgaaatggcgcctaaacgggtggtttacattagttgtaatccatcaaccttagttcgagacgcccaacggtttgcagaatacggctaccatattagtgccccggtccaacccgtggaccagttcccacaaacaccacatattgaatcggtaacggtgttagaacgcgaacaataagcattttaaaactagattattaatgaaattataaaagtgtgttggttgcctgattatttgtcgggtaaccaacacacttttttactcagcttgagggctaactttgaattagaagcacaaaataaccgtttttaagcgctgatattgatttgaattcgtccgattttaatagacagatcatttagaatcggctaataaaacagtttattgataattataattattgctttaaataatttaataaataatgcgctgtaattgctgtaaactagttcactggagctgtttgagtcaaatttagcgtattaaattaaataattgtatttattggtcaaaaaacacccacaaaaaccatcaattgtattacttttgataaaagtatgtatttcatctcggtttttgaccagtttgggttataatgataaacgaaataaaccgataaatgggggagcatgatggtaaagagaagaacactgacacaggcaaaagtattagcaacagctaatcagttaattgaaagcaagggaattaacggattaacaattcgggatttagcgttagttttggatgtgcggccgcaatcgatttataattatgttgatagcttgagtgatttattagatcaggttggcctccaatttgttcaaaatgttgcggatcgtttaactgaaacaatctcagacgttgacggtgatgaggctttgatggcatttgctcaagaattccgggcggcctgcaaccagcatcgggggttggcaccgttattacttgacttaaatgataacctaagaatcccacggtctcgtaaagcaattgtgcagctataccaggatatgtttaaaccattacaactggatgattcggcgcgggtggagaataccttgtaccgttccacgttgttcggattcattatccaagagattggcggcttctttaaggtgcaggggactgaacttgatgaacggttcacgaaggttatgcagttagcgattgaccagacacacttacctgctgataaaacgaaaaaataatttaagattcagtgcggctatcttagcagatagccgttttttttataggttaaattcgccaatatttagcagtaaatggggcgtaatacaataatctttgttaaggctgaaatcaaaatcaataatgatttattgaagtagttttatgatcaatcgtaatgaaaatcttaattctgcatggtaaacgctaaattagggcgttattttagccccaggcttaaaaaatcgtttacaataaggttaaagttaattttaagggggcccaccatgtcggaacgttatttatcagcaattgaacacgggttaacgactaagcaagttgaccagcgcctgacagcgggtctaaagaatgagccgttaccgcccttaacgcggtctgttaaacagatttttcgtgataatttgctaacactttttaactgtatcaatgttttgttagccggattagtctttttgacgggaagttataagaacatgctgttcttattcgtggtcatcgtcaacacggctatcggtatttttcaggagattcgtgccaagcgccaggtcgataagctggcattattatcggccactaaggttcaagtccgccgtgacggtcaaacggtggcgattggtcaggacgaaatcgttcaggatgatttactattagtgaccagtggcgagcagattcctgtggacgggctcgtgcgggcgaccgctggattagaggtcgatgagtcccagattactggtgaggctgatccggttattaaggggccgggtgatgagctggtttctgggagtgtcatccttggtggtcacggaatcgtgcaggcaacgcaggttggtcacggcagttttatcaagcagatggcgcgagcagctaagcaaaaacggcggacgccaagtcaactgttaacgattatcaaccgaattatcaaaattttgacttttacgattattccactaggtgctggactgttcatttccactatgatgcggggtgaaagtcagaaccgggcaatcctcgggacggtggccgcgatggtcgggatgattccggaaggactggtgctgttaacgtcagtcgctttagctgctggggcgttcactttaggccggcaccaggtattggtgcgggagttacccgccattgaggcactggcccgggtcgatacgttgtgcctcgacaagactggaacgattactagtggcaagttagtttttgaacgcgttgagccgtggaaccagcatgatttaacagctgtggagcaccggttagctgcgttagtcactgctattgatgatgataatgaaacggcccgggccatcaagactgcttttggtcagccaccagtgcaagcgacagaagttcttcccttttcttcaagtcgtaagtggagtggggctgcgtttgatggtcacgcttacgttatgggcgcaccggaatttatttttaccacggtacccggcgagttacagtctcgcatcaaaacgctcgcgcaacaaggttatcgggtattagtgttagccgaagtggctgccttaacgacgcccaaaccgactcgaccgatgactttgggattaattctgatcacggatgagttgcggccacacgctaagacgacgtttggtttttttgctaatcaagacgtcgccctaaaagttatttctggtgataatccggtgacggtcgccagtattgcacaacgggctgagatcaaggacgctgatcggctggttgatatgagtcaagtggggactacccccgactatgatcagctagtgacaaattatacggtgttcggtcgagtgacgccgcaacaaaaagagcaactaattaaagcctatcagcgcaacggccataccgtagcgatgactggtgacggcgttaatgatttgttggcgctgaaacaggcggattgtagtatcgcgatggcgagtgggagtgaagccacgaagagtttggctgattttgtcctaatcgattcgaactttgatgcgatggtgcaagtgctgaacgagggtcgccgcgttatcaataatattgaacgggtcgccgcgctctacttgatcaagacgatgtattcggtcgctctgacgttgatttttattttcatgagccacagctatccgtttgagcccatccaattaacaccgatttcatcgttgatggttggtattccaacctttttcttggcgttacagcctgattatacgcgaattaccgggcgctttatgaaacaagtgatggagattgccgttcccgcggcgatctgcgtggtcggctatatcatggtcatcatggtgttaggcaataagttccagctgaatttcgaaacgaccgcgactttgagtgtgttgatgaccgggatctttagtttaaatgcgttattgattgcagcccggccgttgaaccggttcaaaattgggttagtcgtgttaatggcaacactgttcgtcctagtctttctgtttgccggccgaattttttcattggttaatctattagattggtcgttagctgtgatttacctaccactgatgatcagtgcgtatccggtgttcattgttctgcaaaatggcttaggaaaacgcgttctcagcaagatcaattggcgataatcgatcaaatttaggtgacggggccacgctgcaattacggcgtggccttttttggtgtaatcagattgctgtctcagcgtaagccacaccgttgttgaccagtcagattaaattaacagttcgatataagtatggttgataccagcatagcatgtaaatttataacagattttaataggcagcagcgtctaaaacggcttataatgaagttcagtagattaccggaatgggggcggtattgtgtggcttgatgaacaacggttaattcaacggttagtgccgcgcttgttgcgttttcggcaaactaacttctatcggattattcaacggaccttgatgttgacgttcccattcattttgattgggacgttcagtcaaatcattcaactgaccgtgttgacgaaaacggggtttattgccagtatctttcacctgtcaaaatgggtcccatactatcgttacttacactatccgtttgatagtttaacaaccttgacgctcaacggtgtggccgtagtagcagcatttggtgcggcaaaataccatgccaaactcaatcagcgcgatgaccaactagcgggattgaccgccgcgattgcgctattgatcgtggcttatcagtatacgaatcaaaatcaaattggtgtttttaacactttattgatcgggactaacggtctaacgggcgcattgattgtgggtggtttgaccggcctgctcttcaaatggttcagcaagccggttccggcacaaagtagtccgcatacggccgatatcttgacacggactttcagttcactacttccaatggccttaatactagtattggccgtgctagtgagcctcgctttgaactggctgatgattattacgtactctgctgaaagttggtcggcatttcaaaagtacgcaacgactagtcacagtctgtggctgacctttggcatggcagttgtgacgctgttgttagaaattcttggactagctggtccgtaccaagaacgcttggtgaccaacagtgcgacaatgacggccaatttgaattatgcactcacacatcactcggcgtatcacgtgccgtatccgtatacggccaacacgttgtatcacgcatttgggacgtttggcggaacggggatgttgctggccttagtgattgccatttatatcggtagcaacaatcataactaccacgtagtcgcgcggtggagtctattacctgcgctctttaatagtaatggaccgctactgacaggcttaccagttctatataatccaatctatctaataccatttgtgcttgcgcctgtcgtaaatatgggactggcggcgctggcaattgggtttcattggattccacccgtggtttatccggttcccgtgggtacgccgggaccgttgattgcctttatcggcactaacggtaacgtggtggcacttttacttggtatcgttgatttggcactatcagtggtgatctatttgccgttcatgcggttggcggaaaccattgtgcaggcggcgcaagcacaggtggggggtgctaagcatgtataatcgacctaattggcagcgacggcggcgaagtctgttagtgcttgtattaggcttactatttctgggctttttgattcagccctcataccagtggacgaaaaccaacgtggctgcgatggcaggacgccatgattcgcagatgtcaccaattattatgattcccggcagtagtgcgacccagaatcggtttgacaccttagtcaagcaacttaataaggctgatcatcgtcggcatagtttaattaagctgaccgtgatgacggatgatacgattaaaatgacggggtcgttgcgtgcccgtgataacgagccaatcatcgtcgttggctttcaaaataatcgtgacggctatgataatattaagcatcaggcccgttggttctcactggcctttaagaagttggctgccaagtatcaattcaataatttcaaagcaattggtcactcgaatggtggtttgatttatacgtactactttgaacactattttaatcgcgacgatattaaggtcaaacgaattatgaccattggctcaccttacaatttctcagaagctaatttgaatcataagacacaaatgttagctgactttattaagtaccgcgatcgattgcctaagtcagcgacaatgtattcggtcgcaggtaccgaaaactatgattcggacggtcttgttccagcgcggagtgtcgaggctggcaagtatatctatcaagggcaagtcaagcattttacagagattacggttactggtacgaatgcccagcactccgatttacctcaaaatgcgcaaattgtcacgttgattagaacttacatgttggataagccgaaacagactcgtaagggcttagtatcgacggggactgtcgaatgagcggcaacgaggttcagttgttgtggactggacagtgttcaagagtttgtgacggtggcacctgtgaggaagtttagggtgttattaagaattgtggtaaaatttggtcatggaggtggccgaaatgtccacacaatcaccagtacatcgcaatcgggtcctgactttaattcggtcttattatccgaatttaagtgtgacggaccgcaagattgctgactatattattgccgacccaattaaaacggcggctcagtcgatttcagacttggctgccgcggttggcgtttcaacggccacggtttcacggtttgtcaaacggattagttttagtagcttccgtgacttttcacgtgaactaacggcggccgaaccgattgaacaaactaatgcggaagcttttcaagatgtcgaaaaacaaacgactttcaaaggaattgcggaatcaacattcaatagtattcgtagttcgctagatcagacaagtcaggtaatgacggaagcagatctcaagcgggcggtggaattattgctgaatgctcgctcgattggcttttatggtctcgggggctccgcagtcgctgccttagatgggtatcataagtttgtgcgcaccggtattccgtgtgcccataatagtgactatgatatgcaactgatgcaagcggctcagatgaatgccagcgacgtggcagtggttatctcacataccgggcgtaatcagcaaacactacaagtgctagccaccctgacttcacaaagtgtgccagtgatcgcgttaactagcttcggtaactcgcccctggctaaggacagtaccgttgcctttatttcagttgcagaagaaattaattatcgttcggaagggctgacttcgttgattgcccagatgagtattatcgatagtctcttcttgatgactgctgttcatggcaatatcgaaatggcagaaagtcttggccgggttcgcgaggccattagtcaaacacgaacggagctttaaagctgtaggcaaaggattgatgagatgacaaagcggcaacattatcgaccagtatacgcaaaaacgcggtgggcgcggtggcgttatcgactgggctggttattagttctattagtaatcattggcagcgtttggggcggcttggcttggttacgttggcgtagtgacgctgtcgtgagtgggtttgatgtccgtggggttgctgtgtcacaaaatgacggttatttagattttgcggccttgcaaaatgatgggctcaagtttgtctatttacacgctactcaaggagctagttatacggatgatacctttgcaagcaattatgaacgaatcgttggcacaagtttaggtgttggcgtaatccatacgtttagtttttcatcgactgctgcggcccaagcggcctatttcgagaaaacggtcggggatagcatcggcaatttaccaattgcgattcaagtgcaatactacggtgactacacggaccagacgattgcggtccgaaaaagtcgtgctaagcttaaggcattagtgaccacgttgacccaggattataatcgctcctgcgtcgtatggtcaacgcccgcagttgccaagcagatcgttaagcccgcactaaaagacactgacctatggctggacacggcgaagacccaccaacagggacgacaagtgatgtttatgcattattccgatcgcgccgtttaccgccagaacgggactcgtcaagagttcgctggaattctattcaacggtagtgtgacagcgtacaataaagttgtggcgcagggcttaaattaaggcctaatccttgaataacttatttcgcaaattaaattaacagcttattagctgctaggctgactaaaaataagtcgcaagttcaagactcttcttgaacttgcgacttattttgatggcgacctattaaaatccttaggacgtcactagcgtcattaggtatttggcgataagatgacataactgcgatcatcggcttcgtcaaagagggttacaggtcgttgctcattagcccgcacctcaaggtgaaatccatattgatcaagtaagacgagcgcactcgatgagatggattcgacggtggctggtaccgagcgcccgtcgatgcgaatcatcatgttgggatcaatctccaacgtgtggtcccggtgatgcgcctcatcacgataggtccaagttcccgcgtagaaaaccgctaagtcaccgtcagcgatcgtactagggtgccgtttgtggagtagtgtactagaaagtcctgcaagtaatgataaaccaaataatattgcgccacgccgcttcactggatcaaccttctttctgaataaatctatagttaaaatataccactaaaacggcgttaacgtcacgtaataagtggattcttattaaagcctttatgtcactgttacctgcgggtaatgaacgtaatatttgatcaatttcggaagggcggtaactaattttttgaattaatttgtgttctgattggaaattactgggtgagtgtgttaatctatataatgtgattggcatttatgtgaagttttaaagtatcatttaattgtgttaccgtaaattctttataggtgttaataacatgtgttagttactttttatttttatatcctaggaggatttagttcatgaaaaatggtactgtaaaatggttcaatgctgataagggttatggctttattactggtgaagatggcaacgatgtattcgttcacttctcagctatccaaactgacggtttcaagaccttagaagaaggccaaaaagttacctttgatgaagaatcaagcgatcgtggcccacaagctgctaacgttgttcctcaataagcttagcttttaaaagggctgcccgtgtggcggctctttttttatgcgcaaaatagcgggtgacttttgatccttatggcccaacttaacggcgaaaactggtaaaatagaattataaactaaacgcacgagtaagcgccaccaatcacgactggttgactagcgccgttgagaggagtcaaatcgatgttaaaattaggaattatcggaacgaattggattacgcaacaatttattgatgctgccgctgcctctggtgaatggcaattgacgagtgtttattcccgccatgctgagaccgcgcaggcttttgccgccaagaatcatgccgatgagacttttacggatttagatgcatttttcagtcggggtagttttgatacggtctacattgcatcaccaaacagtctgcattttgcccaggctaaacaagcaatcgcctatggtaagcacgtcatcgtcgagaagccagccgtggcgaaccaacaagaatttgaacagttagatgccgttttaaaggctcaccctgatgtcctattatttgaagcagcacgccagattcacgaagttaatttccaacgcgtcaaggatcagattaaaaagttatccttagttcagggtgcgacgttgacttacatgaagtactcgtcacggtatgacgccgtcttggctggtgaagaaccgaatatcttctcgttgaactttgccggtggggcgcttcaggatttaggcgtgtacctggcctacgatgcggtcggctggttcggcatgccggaagaggtggcttactacccaaccttgattcgaacgggcgttgacggtaagggtgtggctattttacgctacgctgactttacggtgaccttgaacgttggtaagactagtaattcgttcttgccatctgaaatcaacggtctgcgcgacgctattgtgatggacaatcctgctgaacttggacaaatcacttatcaagataaggatggtcaggagcatgcgattggggcgcaacccgataccaatccaatgctggccgaggcgcgcgacttcgcaaccgttatcaatgacccaagtaatcaccagacggaatacttagcttggcagcaacttagtcgaaatgttaataaactattatttaatttgcggcagtcagggcacctatattttacgggtgaagcccctgataccgataaatagaaatgaggcactatgttagacgtatttaaaactaaatttgcggcggcggggttcaccgagttgtcgccgattcaaacggcagtggccgagccacttgcagctggtcaatcggtgttaggactcgcaccaacggggtctggtaagaccctagcgtttacgtggccaatgctcgaagcgttgcgggtcggagaaggcacgcaggcactgatcctagcgccatcacaagaactcgcgatgcaaacaaccaacgtggtgcgcgagtggggccaattgatcgatgccaaagtcctcgcgattaccgggggggctaatgttaagcggcagatggaaaagctcaaaaagcatcctgaagtaattgttgggacgccggggcggattactaacctgattgcggatgggaagatcaagcttgggcatctgaagatgatgatcgtcgacgaagccgatgaattactgacagatgaaaccttggatcagattcgtgaaattctcgacgctacatttgctgaaacgttacaattaggcttcttctcagcaaccgaaactaaaattttagatgagttgccacgctggtttggtcagcatgttgaaaaaattgatgtgcgggccattgatcagacccagggggtggttcggcaccggacgatgcaagtgggtaatcggcaccgggtggacttactgaaacggattagtcgtgttgaccatatgcgggccctcgttttcttcaataagatgcaggaactccaacatgtcgccttagaattacgacaccagcacgtgagttacgttgccttgaccagtaatcaacggcaggttgaacgtgaaaaagcgttgcggttattccggcaaggcaaagttgggctgttgttgactactgatttggcggctcggggtctagacgtgcccgaattgccagctgtgatcaactatcagctacctaaagatgtcacgacttatattcaccggagtggtcggacaggtcgcatgggtgctgatggactagtcttgacgttcggtgacgaccatgatgtccgcgactttaagaagctgatggcgacgaccgactatgaaattaagccgggttacttggttgattatcatattgttgatacgaaaccagataaagttgttccaccgttaacgttcgaccatccagaaacggctggcaacgcggctaacggtcggcaccgggtcgtgagtgctggtcacccagatgaggttaaacgagtggagacgagccggaagcggcccgctgcggcaacacctaaaaagaagaaaggtcacaataagcattctaagaaaaaagggatgcgcaagaaaaatcgtgatcgctttagcaatcagtaattgccaaaatacacaatccgtgagatgatattttacggattgttaatggcctcatagcacaactggatagggcacccgcctcctaagcggttgatcccggttcgagtccgggtggggtcatatttatatcaaactaaccgcttcgtatcagcttaaaacgttggtatgaagcggtttttgtttttggcaaaacgctaaaaaacggtataaaaggatattttggtgcacattttggtgcacattaggcgtttttgtaagatttgtgcaccgacttgtgcaccaaaccgtccatcgaacttagagccacaagggctttgctcgtctcctttttttccatttctcgtaaaaggtgcgagtaaacacggatggttgtagaataattagaatgacccaatcgttcagagatatagtaaattgagacacctttgtaaattaaatatgaagcgtgtgtatggcgcagtccgtgaaaggtaatatctttagacccaatacgttttaaaactctgtgaagcgtctgatttgcgcttgtgttgtccggcacacgtccatactgattaataaatatcaaatcaagtggattatcaattcctagttcttctaactttataatctgcagagcgtgaaaactttttaaaatatcagctaagtgatcagtaatttttattagccgcttggactgctcgtttttggtatcagcgaatccatttcgttgtaatgtatcccaggtcttattgattctcagagttttgaaatcaaaagagaaacaatcccatgttataccggcaacttcactgtaacgagcaccagtttgcaaactaaccaacgccatcagcttagttaaatgagcaaatgttaagtctgattcaagcgcgcgagtcagcttttccgcatctttaccgtctaaatatttcatttctttaggcttttctgggcgcccactaattttagtatgcgctgtaaaattgcgcttaataatgccatcatcgatagcatattggacggctgacttaatttgcacgttaactttttcggagctgctaagcgaacgagggcttcgacctacaggattagcataatcgtttagaaacttctgataatcggtgcgtgttatttcatctaaccgtttgcccgcaaaataattattaacaattccaagtgtatactgataacgtaggcgactggactttgctaaagttggctccttataagtctgataccattttaaaaagtaatccgtaaatagttgcttacctaatcttggatttataccattgctaacatcaatttcattttggttagcccattcttgggcttcacgcttagttcgaaaaccaccttgattgataaatttacgatttcctaaatcatcgtaatatgaaacacgcgcattccattttttaccacgcttattaatacttgccatttatatttcctccttaaatttcacctaggcgggtagaattttaaggacttgcaggcaacaccttctttcagttgctgagtagtaaatgaaatacaatgttagaacaacataaaaaaggcttttaatcattctaaatattagctatactagtagcaatgtgataggttaaataagaggaggaaaatgccaatgaataattctgaatttctaaagttgatggatgagcttggtattcctaaagaaaatatcattgaacagcatgaaccccaatattctcttgaggtattgcaaaacctcgaaaaatgctatggtattgacacaagcgatgtaataaaaaatcaattatcgactgagaatccattaaccattgacaaatgtgtctatgaaaaatggattgatgcgtttgaaacttttactgaatataagggtgatatgtcgctgatcgatacatgtaagaatgagttcattttgccaaatatcgattttcaagaagctgaatttattaattctgcttctttttttgtgcaataatatggttaatattaaggccatattgaggatgaaacatgagccgagaattcgccgaggttatatccactgaaatatcagaaacaattgaaatgacatgttcattgtcagataaaaagccttggtctgttgccattaaaactccttgaacagctaattgcaatcccggtgacactaatgatagtgtttgttttatagtgctatatatgttattagttgttccaggaacaatcacattttcaaatggtagtgttccataaataggttgtatctcagcttgttccagaatatttattttcccttttctcggtgaattaggaataaattcttcaacattaccatcattatctcgtttgaaaaaatgttcgtttgctgggaacaatatagccattattttaatagaagtatttttttcagaaagttgtttctttagtgcgagggcggaatcaccattttttgagaagattaagattttattgattttattttcatatgcataatgcagtgatgactctattatgtctgaaaattcgttaaccatgttagtatatattttcattgttttttcctccattgactagtgaaacataagctttaccgagatctgttgctggatgaataaatgtattttcatagtaacaaaaaacgttaacggctttttgtattgttaatttgtggagatcaagttcagtatctgttgggtaaattaaatgatgttttccatatatatgttcatttacattaatgtgagaatctggaaagcgaattggaattttgaaaggttgaaaatcaaatctgaaatattgctcttctccatctgcagctggtgttaaagcataacgatattcttttataaaagcctttccgtctgtaattacaattttttccgttattagaaaatcatttaaagcatagtcttttccgtgtgaacaaataattaattcggacaatttggaattgtcacctgaactaattggtttcatagtaggctgtgaactcgtaattttttttaaagaagtaatttcatttttgatgtaatctcttaatggaattgaggtagggattggtcctcgtttaggtttaattttaggcttcattttttgtttcatgtttttatcacctcttttatagcattaaatttaacttgatataatgcaaggctggatacgaatcaggaagttaaagataatatatcttatgaactacgctcgcatgttgcccgctaggctgtagtgggcagggtgctattttcgtttgtgattccagtaaactaacatgacgactagcgctatgaagcaaatgatgccaattgcaattactcctaattaattaaatttgacagtgttgcgtctttgatattactcataggaatattgactgtactatgtccgctcaatacatctgatgaattggattctccagttccatcctgtattttaaaaataagtggatttttgttattaactaagttaaatgcttcatatacaacatttactgactttccgggtaaaattgaaggtttttgaaaactgagatcttggtccgtaagtttagcagttgcatcgttgtacagtgcatttggatcgtcaatttcatggtcgtcagataaattttctttagtagaatcgctattttggtaaacagttaagcctaaactagcgtcttcgttatttcctgtctgaatactatcagctgagcgtgtctttttagaagtattggttatttttgctatcacaaccacaacccttttaccagtcgctgtgttatcgtcataggtcggtactttggcaacatgagtaatttcgacagttccacgtttaggaaagatcgctgttttaccgacaaactttgccttagtcttatcaatttcttgtgcttgaactttatcatgcgctgcaagaattagtttttcgtcactggttagttttccttcttgagcgtgttcagcaattttactagtgtattttttgttcagttgcgatgtggtttctttttttaggtcactatttgaacttgaagatttactgctagaattcccacaacctgcaagtaacagtcctcctaataaaacagaactgaccataataacttttttcattacaataattcctccaattttctagcttttaccgacatccgtatctggtctataagttatccgaacataatattgaaactccgtatagattgcctatcagcatatccttcagcgcgtaatacttccactaatcttgcgttcgctaggttgccgctatcattttcatagtgcgaagcctcatgcaatgctgttttaagccaatcaatgtcatcttgaagagtattgatatagacgtcagtgccgacgatacagccatgatagtgtggattgttgacttcgataccccaaaatttaagttgtggatacatatcttcaatcttttccaagtctgtcataccggtcacctacagtctacgacgaaatttcattgcttccttgaccatatttattatggcctgacgttcctcatctgatatatccgggtcaatagagtaggcaattaatttttgattctttgtcaggctatcagatgacacagaaggttccgggtcatttgtgtttccaagaagatagtcagttgatactcctagaacacttgcaactttttgaagattctcagtgcttggattttgagttttccacttataaatagcgtttttgcctaatccagcacgatcattaagttgcagcaagctaattttattcttcttagctattttttgtactcgttcaaacacagtcatatcggcattctcctaaaaatagagaattaatttagataattgtcttgacttattaagacaattatcttatatttaattcatcaagtaattaagcagcaagaaacaatagcttcaaaacgtagctttggcgagaaacggatgatgaagtaaagtttattggcttatttcgtatgcatttattatagacgattgtctagacaaatgtcaataacttgatgaataaattacgaaagggggatgaaaaaagccgtccaactagacgacttgtgcttattagctatttaccagttgctttttctaatcctgctagaacatcttggttacgctttgaaagtactgtggctttatccatgcccttcataaaaccacgccctttcaaattgttgacgattgagtcaggagttactgtcgcaccggatagaatctttgaaatgccggtttgataatttggaacactcagtaatgttgtcactaaagttttttatctctagcttctaactatttttagctagctcagcatatcttttcgacctaataaggccgtcgggcgctcgtggatggattattgatgtcagtcaccatctatgcgttgcaccttcacaactctttgagacacgttgcacttggctcagggttgccttgccaacagtggtttaggttttccttgaattcacccgattcgagttgaatattactattcaattgggcaattctaataagcacaccaattataacagaatggataaacttattcatcaataaattatgtaaaggaggagtaaaaatgccagaacaaacaatcgaagatgtcgcattggaaattgaaattaaatacaaaactgcattgagccgccacaaaatttctcaaaaagaaatggctgaaatgcttaccactaagtccgaaaaggtcacaccgccacaagttaaccgtgcaatcaaaggtggtaacgaacccaagtcaagacggattcggtcacaaatggccaaaattttaggaattcaatgaaaggaatgatccacatgaatcaaattacaccatttaattttgaaggcaatcaagtacgcacggtactaatccgcaatgagccatattttgttggcaaagatgccgcattggctattggttatcaaaatacgcgcaaagcaattcgcgatcatgttaaggccaaatatcagagggaggaacgaatcgttaccccctcaggaattcaaacaatgaccgtcatttctgaaccaggtatttatcaactagctagccaaagcaaacttccaagtgctgatccgtttcaagattggatttacgaagacgtgctcccttccatccgcaagaatggcgtttacatgactgaccagacagcctacgacattacgcacgacaaggacgcgttaggcgacttgctattgaaggcaggcagccagctcaagcaaaaggacttagttatccaggagttgaagcctaaggcggattacaccgatagcatgttagctaacaagggactggaaacaatctcaatgattgctaagaactacggttactcgacacgtgagtttaacaagttgctacatggtttaggcattcaatacaagcaaggcaaaacgtggctattgtacgcgaagtatcaagacgaaggctatacgcacgttgaaccatacgagtatacgaatagcgatggcgtcaagcaggtacgtaacacgatgaagtggacacaagtgggacaaaagttcttatacgactttttaaagtcaaagggaatcatgccattagttgaacagccagcataggaggcgaagcagtatgagtaaatgggacacgcaagcatttttgaaatctgataggttttcaaatactaaatcagaaatagaaaaaatcctgtttagcagtgatctgttgtataaggaggcctttcagataataggcgctatccaatcagatcttgaagccaaacaggaagaagaaaaggttaattaatcgggaaagcgtcccgaataatgttcgagggcatgcttatagttatcttcgaacatttcgattcctaatcgagcatcgtacgtatggtgatgagatttagccttatctttttcttcagcaatatctgaaatggtcatagcttgagcggcatatagtgccatttcatgttcgcgatgagagcttttcatatttatcacctcgattaattgaactaacaaaattatacaccgaaaggagtgaccaggatggacagtttgataagtgctttgtcgaagcttttcacgcaagcatatgaacaaggaatcgcggatgggcgtagtcaacaagctgttgatcataaaatgattggacgtaaagatttctactctgagttcggaatcaaagttgatacattcgacaagcactatcgcgacaaagaaggattcccaaagcccgaagaagacggaaaatggtacgccccagcagtcgaaaaatggttattgaatcatcaaaatttgagtaattaaaacctaggcgggtagatgatgattcaactcataaggaggaattgccatggtagaagtagcggtattaacctgggcgctgacatccgtatggtacaaacgccgtgagattagaaactggtttggaatttaggaggaaatgtaatggtaagagacacagatgcatttgttgggcttggcaataaattagttgccaatgctgacaaggcacaagcaaatgatttactaagtgaaatgaatgttgctagtttgtcaggccatcactcaatcatctggaacaagtctgaaattagtgtcggcgttatcagcacactatcagaagaagatatttcagttagcaagtgtcctggtggcggatatgtcattgattggcaagaagcattagaaatggaggaatgatcatgcaaaaagtattaattttaccactccacgaggggaaacgagcgcaaaaaaagccatcgctagtagcggctaacgatggactaatggaagagatgattagtaccaacatctactatattcaaaagcagtctcgtttgcaagtgctaagaaagcgaggacggtagttatggaagaaatcgtgaacaatcacatcaagtttctaaagcatgttatcaacagtgtttggatcagtgatggcgaatcgctggccaagttgtacgaaatgttagataagagtgaaacagaattgaacgaattacgggggttagcataaatgtttccagaagaagtagcaatggatcgttcacttgaaccagaagacgaagatgataagccaacccgtgaggaactaattgagctaggagtgttatcagatgacgaagattgatgagctagaacaaattgaaacagctattactcatgctgaacgtgatttaggcgatctaaagcaaaaagtgctaagcaaacgatcttatattagcttgcttgaacaaaaacggagcttactgattggtaatttagacgaagttgatacgcctaattatcgtttcactcgtgagaatagacattatgataaaccgtctaattggcgagtaagcgtgattgataagaaacaagccatcaaagatcttgaacggcttgatcaaactttgattgttcccagtgtcgatttaaagaaagtcaaacagtttgtcgctaatggtgttatcgatggacaacagtttaagtcaattgtaatcagtaagattgagccaaaaataaaagtgaaagctaaggaggaataaggatgaatgagaagcttaatctgatgcagaaacttaatgaggctgctaagtcaattggcgcggttcataaagacggtaagaatagctttcagaattatgaatttcaatccgaaggagctatcaaagctgcggttgaacaagccattcaaggtgttggaatccgaataattccgaattaccaagtcattaatcaatatgacaaggagagcaaacgtgggggttctaatcactttgttgatgttatggggacattcttgattaccgacggtgcagaaacagagaccgggtcaatgcctggtagtggccaagatagcggtgaaaaagcggtggctaaagcttgtacgagtgctcagaaatacttctacaaacagttgtttaacatcaccgacaaggaagatgatccagatacaactgacagtaacgcaacagttggtgaatcgcttatcaatagcgagcaaagggaccgactcgacagactgtttgaatctctggcgggtgtaacgaacaaggacaaggaattcgttgctaaagcttacctcaagaaggttggcagcattgataaactcacgcacagtagtgctaacacgctaattgagatggtcaccaataaattaaattcttacgttgacaaggaggaacaatccgcatgagacaaatcacgatttctgggaacttaggtaaggatcccgaagtacgacaaacacaaaacggtatgcaagttgcaaactttaatttagcagttagacagactcgtccggatgatcaaggcaattatggtactgattggtttcgatgcgcggtttgggggaagcgcgctagcacggttgaacgcttctttcataaaggaaatcacgttacggtgacaggcacgtttgaagttgatgaatacaacggacaaacacagctaggggtgaacgtcactgattttgatttaccggatcgcgaaagcaaccagagtaaatcacagtcaaataatcaagcgccacaccagcaaccagagccttcagctggcggccagattgatattacggacaatgacttgccgttttaagttgaggtgatcgtgtggaactgctaccgactaagttaattgaaaaagatggcgagtggtatcaggttcagaagctaacccataagcctaaccttgaccatgttgagacggtaagtggttctgctgacgaatactacacgtactcggaattagctgacacacgtaaagctaggccacaacagcgacgcttgttcttcgcattgcttagtgacatctatacgtggtcaggcatgccgacagacttcttgaaaaacttgttttatttgcagtatgagtcatatacgtttggcaagcagattagcctgtcagacaccacagaatcgtctgtgagcgatgctaaccagttactcgacctagtcatcgacttcatgtttgagtggcatgtgccgttcaaggaaggctataagctattgccgcgtgagcaagaatattatctgtttcaatgttgccgccaccgagtttgcatgacctgcggtaatcgtgctgatatccatcatgtagacgttatcggagccggcttgaacagaacacacgttgaccacaccaaacggcacgttatggcattgtgtcgagtccatcacagcgagattgagcaaattggctccgtggcatttagtgcaaaataccacgtcccggtagatggcataaaactagataaagaaacgttaaaacgaattggcttgaaaggaaaatatgatgttaattaaattacagagtggtgattacatcaatagtgattatatagttcgtatttttggcgacgaaccatttattgaaatggctcacagagttgatgaaactggaaggcgatctttaccaatcactgatgttgacataaagctaatcacttatgcagtcaagaatgctcaggtaaacgatactaagcgatttatgaactggaaatacagcagtgactaatacaccgggtgggtggaatgcctactagtaaataagggaggattaaaagatggcacaaaggagaatgtttagtaatacgatcacggattctgatttgtttatggatatgcctaagtcagctcaactactatattttcatttgaatatgcatgctgatgatgatgggtttgtgggtaatacaaaatctattatgcggatgactggttcaagtgatgatgatttgaaaattttgttagccaagcagtaccttattccgtttgagaatggcgtcactgtgattaaagattggcatattcataattacatccgatcagatcgtaagcaccccacgaaatatactagtgagcttaaacaattagagctaaatgaagacgctagttatagtaaattaccttttggtagtcaagtgtcaaccaatggtcaaccaaatgacggacacttggtaggcaattgtcataccgaggttaggttaggtaaggataggttaggtaaggatagtaaaggtaagtatatagaaccaggtaatcccaagccaggaaaagccaaaccagcacgacacaaatatggacaataccagaatgtcttactgactgatgaacaattggcaaagcttaagtcagagtttccaaaagattggcaagatcgtattgagcgagtctctgggtatgttcaatctagtggtaaacactacaaagattacttggctaccattcgtaattgggctaagagagatcagcaaagtaaccaaagtaacaaagtagcgccacaaacacgagaggactggtttggctaatggaaaatgtaacgaagttattcaatcaagccacgattaagaaagtagtagcggctagaggaattgatacaactaagttgccaaccaaagaagaattggatcatcaaacaattgatcgggcaaatgcgggcgtaattgctaaccgaaaacggtattactatcgcatgtcagtctggtctggaggcgtgccgctacgatttagctttaatgattggcgaattgataagcagcctaatcaagctaaagctagagagcttggcaatcaagcatttaagttagctaggcaattagagactaaccagttcaacgtagcacttgcaggtggccctggtgttggcaaaacgtcattagcactggcaattatgtatcagttaatgggtgtaggccaaacagcgatgtttgtttcaacggctgagttgctacggctggtaaatgagaaatacgaagcaccggacgtacgtcaacggttactatacgttttaaaagacatgcaaaacgttgatgttctagttttagacgattttggtactgaaggcggtaagccaaccgaaaaaggattctacaagccagtgcacaaagatttgcagacgctgatgtatcaagtggcgaatgcgcgttgcgattttgatcataacgaagtcaaacatataaccatcattacgactaacaacacacgtaagcaattagaaagtatgtatgatggcaaaacaatcgatcgcttatataccaaggatactagctgccaattgctgtttgacaacatggaaggagtcagaagtgtatgagttgtgaattatgtcatggtagtaaagttgttcagcaaccgcttgaaagttatggcttcacgtttggaccatgcccaaattgtacgaatgagatacacgttcattacgaacaagagcttgaaaggaagttagcctatgacaagtaaaagaggtgagcgcatgactgaaa

SEQ ID NO: 40 - DNA, 22019 bp, Lactobacillus plantarum
gattaattatagaatttgccatatcaataaaaaagggttccaataagccgctcactctctccagttcttcaggttgcatcaatcaagtggcgatttagtgagccaaaaccatatttcctaaggtccttcaataatccccactcacaatcgcaatcacaaggtaagttaaccttcagaaaaacaatccccgccatgttcgctatatcaccctattaataggcgttgaataccatagctaattaatcacgattagtcagacaatcagcaagaagtcgcaggatgtcgcgcgattgcgtccaattatttggcttttagtcactatagcccatcagaatatttattttggtcagattgaccatcgtaactttgtcaaaaccgattaaactaaagctatcacatcgaaatggggcgatgattatggatttatcacacacgcggttactccgcaaaaaagatatcaatgccatgttagccacttatcacagtccgctcaaaaaggaacttaaaacatttgacctaacgatgctgggaattggggccatcatcgggaccgggattttcgttttaactggtacgggggccttgacggctggtcccggcctaatgatctcattcgtcttagctgcaattgcttgcctgtttgcttcactctgctacgctgaattcgctgcgatggtgcctgaaagtgggtcagcgtacacctatgcctacacaaccctcggcgaaattgttgcattcattatcggctgggacttgatgttagaataccttttcgctgtctcaaccgtttcagcgggctggtcaggctactttcaatcattcttggcgggcttcggcctcaaactgcccgctgctttgtcggcagctgcaggttccgtccctggtgtgaccagctattttaatctgccggccttcaccattattatcctgattaccactttattgtctctcggggtcaaagaaactaaacgcgtcaataacgtcatggtagtgattaaattagccgttgttcttttattcatctttaccgcggtgcgcttcatcaaaccggcaaactggagtccgttattaccatttggcttcaaaggggtcttcggcgcagcctctagcgttttcttcgccttcatcggttttgacgccatttcatccagcgttgaagaaacattggaaccatccaaaacactcccacgttccatgttactgtctcttggtatctgtaccattctctacgtggctgtatcagccatcatgactggcgtggtcccatttgaaacgtttgccaagtacattgatcatccgatctcggccgttcttatttactccggtcaaaattggatggccggaatcattgaccttggcgcgattcttggtatgaccactgtaatgttagtctgtctctacggtcaaactcggatttccttctccatgtcgcgggatggattactcccccatgtctttagcgatattagcgccaagaccggtgcaccacttaaatcaaccgtcttgtttgggtcgattgccgcaatcatgggtggctttattccattagctgacttagctgaactggtgaatatcggtactttgactgcctttaccctagtttccttctccatcttacggttacgtaaaacacaaccagatcttcggcgtcccttcaaaacgccatgggtcccgtttgtaccaatcatgtcaatcatctgttgtgtcttcctactaatcaacctgaagcctgtcacttggattcgcttcgtggtatggttagccatcggtatggtcgtttactttggctattccgttaaacactcccagttgaagacgaatacagctactgatgagaaataattgactagactaataaattcaaaactaatgggtcgcttcatttcagcgttatcaactggaatgaaacggcccattttttatcctctaaatacgaacaaccggattacttattgtactcaacttgaagtaaagttcacctaacgaaacgtaagttgaaacttgttaacatgagcaaatttttagtttgtctggttaaccccttttgaaaaaagctagtatagtatgagtcacagttctaattgaagtgggggtcaataattcatgcgtaagcaacggattcaggaacgttcattgattggcatgttaatcacattaggcgtcgtgtacggggacatcggaacgtcaccgctatacgttatgaacgccctgatcaatgacgcggggcaacttaagaatgcaacacctgattatgttatcggcagtgtttcattaatcttttggacgttgatgctcattacaacggtaaagtacgtcctgattgctttacgcgctgataatcatcatgaaggtggcattttcgccctgtatgcgctggttcgtcaccgggccaaatggttaattttcgtcgcgttgattggtggcgccgctttgttagcagatggcaccctaacacctgctgtgacagtcacatcagcagttgaaggcttaaagggattacccaaactgggggctttttcccagtacccgtggctcgtgcctctaaccgttacggttattttactggttctctttatgattcaagggtttggtactgccgtcgttggccggtcattcggtcccatgatgttgctctggttcaccgtcatcggcatcttcggtctgatcaacatcagtcaggcacccgtcattctcaaagctttctcacccgtttacgccgtacaagtcttattcaatccggctaataaaatgggaattttcattcttggtagtgtcttccttgcaacgaccggggctgaagcgctgtattctgatatgggtcacgttggtaaagccaacatcgacgccacttggccgttcgtatacacggctttgattctcaattatcttggtcagggcgcgtggatgttaacccattatcaggatgcggcatggcgcaatgccaccaatgtcaatcccttctatgccatggttcctgcgggcggtcaaattgcaatgattatcttagccacggccgcagccatcattgcgtcacaggccttgatcacgggctcttataccttagttgacgaagcagtcggtttaaagttcttaccacgtatgattatcaagcaccccagtaacgttcggagccagatttatattggtgcgatcaactggctgttatgtctggtcaccttaggaatcgtttggctatttcaaacttcagctcacatggaagcggcgtatggtttagccatcaccttaacaatgttgatgacgaccatcctgcttagccagtggattcacatgaagggccaccgggcgctggcgctagctttattattcggctttggcgcactggagaccgtctttctaacggctagtctgaccaagtttattcacggtggctatttgaccttggggctgaccctcgtcattttcttgattatggtcgtttggttctttggtaatcgccggcgtttgcgttacaaccaggcaaatgaacagattagtctgctagattatcgtaatcaactgatccagctaagccacgatgatcacctgccagtatttgcaacgaacttagtctacttggctaaggtcgaccatcaacaccgggttaaacggtcaattctgtactcgattttagataagcggcctaaacgcgctaaggtttactggtttattaccattaatgaaaccaaccgaccttatgattgtagttacagcattgacatgctaggcactcgaaatatcgtggaagttcaactcaacttaggtttccgtaaatcacagcacattaatttatatttgcgccaaattgtcacgaacttaattgcagatcacagcatcgatccccaatattcccgttacggaatcacacaacctcgtcaagttggcgattttaaatttgtcgttcagaatcagcagatcatggaccttgctagcaacccaactatgggccagttcgatcgactactaattggtggtcgcgttctactacaaaacatcaccccatctcctgctatctggtacggcttagcgtttagcgatgtcttggaagagacgattcctttgttcacgaaaccagcaacagacgccacactaacgaatttgacggtccaccatgcccgcacgccgcaacggaattcgcgccaaccataaataaaagactagtttcaaggaattcaaccttgaaactagtcttttattattaaaatctatcagtcaacacacttatgtttgcggcataaacattaccttagtgtcaataatgccatactgatttcgcatcacttgctcgattctttcactgagctgaaagctggctgccactgtcattcgtggtgacactgctataaccagcgacaaggccactaagctcccagaatactggacatcaattgcattgacctgattcacaccatcaatttgttgaatcgtattaatataatttttttcaacttgtggatcactgtaattaattagctgcaacccactgtcccgaaaaatttgtaacccagcggcaaaaataaagaatccaatcacgatactcgcaacactatctaaccaagcaaatttgaatagtaagaccccacttaatgagattaaagtgccaatgctcgttaacgcatcactaagactatcctttgccgcagccaatagcgtcgaattatctaattgttgcccaccgcgacgattaaagtaccagacgactaacataacgatgctcgcgattgcagctccccaaacagttacaccgctcactgcttgaacggtgtgtgacttaaacaaattactaacaccactcacaataacttgtaccgccataactaacataatgaccccactcattaacgtgaataaatcttgtaaacgaaatcgcatcaatcgattgcgacgttcggcctcccagccgtccaaagcggtcactttactttgatgtgattgatgattatgaatgccaccccagataccaagcgataacaaccccgatgaaacaatacccgcaaaattattaaacgcatccgcgtgcaaagattgcgaatgaccaatcgttgcaagcactagttcgattacaaatagacttaaatatgctatcgcattgcccaacagatgccacaacgcaccttgcattcgcttaatttggtcagcttcaatttcttgccagccatctaacacgggatgttgattatttgattgattaatcgtaatcgccccctcctaaacagattccaaccgctcactctaacacttagtcgtaataagtcaaccttataccacctagaacgctgatagcttaacactaacagtctgacttgtaattgtcactatcagcatctttaagcagtaattaattaaagctggcaccttcgaaagtaatccacttcgaagataccagcttacaattgtctttgataacctttacgcgcagtcacaagctactgttcatataaatcacccgcccccatacaaagcctgctaccggtaaagtacagttacaatcacactaaggttcacgtttcgctatttgagacgtcacgcgtcgcggctcagaattctgcacgcccaaaatgtctaggaagaatgaaacaattggaatcccaatgatcaagccccaggcccctaatagactttccataataatcaacgtaataaaagtgacaaagactggcaaatcagtccggtccgccattagccgtggatgaaggaaataagactcgaaggcgtgaatcaaaataaccaacacgatgatccagacaatccgaatcaagccacccgacgcaaaccccagtaaggttagcggaatcattgaaatcaacacgccagccaccggcactaagcctaagataaagacaatgatcgacaacaccatgatacttggcatcccaataatcatgaacccaatcgtcatcaaaatcgtattgatcgtacaaatcaccagttgcgtttcaataatccgccccagaatcataacgaatttatgcgttaaatagtaaacgttcgtgaagaactttttaaacttcgactgcaagaactggcggccaaagaccatcattcgtccccgcgaaactgcaaagataaaactcaaaaagattgccattaagacgtgcgtaaagccagttccaacctcactcagtcctttaataccggtgacgagtaacgccttcccgttttgaatcaattcactactatgaatggcttggttgacccatttatcaatattcttattcaataccgggtgattggtgattgctttagccagcatatctggaatgaccttcaactgatcgaccagggtaggcgccgcgtacgatagcgcaccgataaacaacgcaatcacgccgacgtagaccacaatgacggcaatccaataaggtaagtgcgttcggaggtttaaccaccgactaagcttaatgcccaaatacgcaaaaatcgtcgttaatagaacaactgtcgcaaacccgcgcattaaataaataatgatgattaataacgccaacgttaagtacaagtcaacgtcatcccgcttaaaaaaccgaatgattctatccataatttgcccccaatcgcatgttacttgcattatagcatgactatggattaatcccgcccaccgattccggccttaaattaaatttgacatttaaaataattaccagtatgataggtgtcaataattaaagaacgattaaaagatgagtaattggtgtcgctgttcagcgagtatcgggttggtgaaacggtatcggcacaaccaatgaagatggtcttcttcctagttcgttttggtgagtgtctggtgagcaacaaagtaaccagcattaactaaagccggtttaacaaccgttacccgcgttagcaattgccaatcatttggcagctgtatcgagtagactagttcactagcctagaactcaggtggtaccacggcccaacgtcgtcctgaataatgattaatattattcaggacgacgttttttcgttcccaataaaatttaaggagtttgatatttaatgacaactacaactttaaccgccccattccgttttgacgtcgtcggcagcctactgcgccccgctagtttgaaaaaggcccatgaacaattagccgccggtaccattacgcgtgatcaagaacttgaaatccaacacactgaaatcaaacgagtggtcgctgaacaagttaagctcgggctcaaagccgtgaccgatggcgaattttcacgcagctggtggcacttagatttcctttggggcttaactggtgttggcaagtacgactaccatcaaagctataagttcaagggggaccatactcgaacggataacgctgaacttattggcaaagtcgcgtataatcccgaccatccgttctttgctgcctttgaatacttacaatcaatcgttcccgctggcatacgcgctaaacaaacgatcccatcaccaactatgttattccgcgataatcggagtgacaattggaccaaattctatgacagctgggatgcctatttaaatgatctcgctcaagcttatcacgataccattcaacatttttatgaccttgggtgtcgctatattcagttagacgatacgacgtgggctttcttaattagcaaactcaatgatcccgaagctgaccacgcggcctacactaagtgggcgaccgatgccgttaaagtgattaacgcagcattagctgacctgccaagcgacttgaccgtcacgacccacatctgccggggtaactttaaatccacgtacctcttctcgggcagttacgacgtggttgcaccctaccttggccagcttaactatgatgggctgttcttggaatatgataacgaacgggcgggtggcttcgaagcgttagaccagatttggaaccatgatgaccacaaacgcatcgtattaggtctggttacctctaagtttccagaattggaaaagaccactgtgatcaaagaacgagttcaagctgcgaccactaaggtgccattgcgtaatctagcactatcgacccaatgtggctttgcttcaactgaagaaggtaaccagttaactgaggctcaacagtgggccaagttggcgttagtcattggtacggctaaggaaatctggctagaagcctaattacaacaactaaaaaagatcgagaatcaaccggcgcatttcaagcgtaatcgcttaaaaaatcagccagattctcgatctttttagttaccggttaaaccgggtccgccaccgtgccaagcgcggcgtcgcagtagccggtttagtcgccttagcaggcatgttcaatagaatcacacccgtaataatcgccatgaatcccaacgttttcaatcccgtcaagatttcgccaaacgcccaaattccaatcaggccggtcgcagctgtgccgactccggcccagattgcataaccaacactcagtgggattttgctcaatgcccgtgagaaactaaaaatcgctaggccgtatagtaacatgcccacaattccaaccaaggggtacttaaatccagccgataacttcaacaagctggtccccgcaatttcaacgccaatcgcaataattaattgaatccatgcacgcatcatcattcccccttgatttaaatgttcagtaaaatcgccccgactacgattgcaattaagccactcagacgtgagagactgagccgttcacggtaaacgacgaccgctaaaataacggttgcaaacgtgcccagtccagcccacatggcatacgtcacccctaacggcaggcgttgcattgcaagcgttacaaggactaacgaactaaaatatccaaccaacaccattatcgttggtattaagttccgaaaaccgtttgcgcgctttaagaaaaagctccctaaaacttccatgaaaatgccaccaaataataacccgtatgccatcttaatcacctcactaaaaatttcgttgtcctactattctacggaagtttatttaaaaaggcaatcaaaagatacgcctggctgattacagtttgatgacaaaaataaatcgtattatagactatgctacagcgatctaaccatttaatttcaaaattattgttagctgagtggcgataactcattcagcttaacgagcgtacacaatggttacgattcgaataccgtccagttgaaaagcctttcgcaataaaatgtcaataatcagcatttaagacgtcatccgcaactcaaatctcccgcatctaaaaaaaaaaaggaccaactcagcagctggtccccacagtcatccttaaatatagaaataaattgagaaaaacatcaacgtggttcccaccatcacgaataggtgccaaataacgtgtaaatatttaatccgtgggaaactatatagtaatgcacctaaggtaaacgcaacgcccccggcaactaataaccagaagccagtgacacctaaatggtcccataactgccgaccaccggcgaggcacatccaccccatcaacacataaatgaccgtttcgacctttttcaaacgtccaggccaaacagcattaaccgtaatcccagcaatcgctaaaatccaaatcgttaataagatcgtccagcccaaccaacccttaatcgccagtagactgtacggcgtgtatgtcccagcaatcagcacgtacacgccactgtgatcgaagatacgaaaaacttcgcgggcgcgcgtaaagtataatccgtgaaataacgtcgaacacgtatatagtacaaacaacgaacaaccatatataataaacgccgcccattcgaggggctgaccatccgcatatgccttgagcatcaaaaaaacaaatgcaacgatacttaaaataatcccaatcccatgagtcactgagttgaggacttcatttgttatttgatactgtcgcgccgactgtgccatgttaatcacctcatatttattattgacaccagcataccatcacatagtgtaaatatcaatacatctagtttacaaaactaggtaattaacaaaaacataactagttcaaaaaatgacactgcgaaattaaccatttcgcggtgtcatgctaagcacaatcttatattcaagctaatcgtgcggtcctctaggccatggatatctataccagtgcccactacgaacccacagcgcttaccactcatcataactgatcagcggtaacacctattcaacctaattatcggcttcttcagcgtgagctgcgacctgctgaaaaatactaatgatatgtttatcggccagctggtagtgcacgttacgcccattgcgcgttcccacaactaattttaattgtttgaggaccgttaactgatgagacacattcgactgtgtcagggctaatcccgtcgccagttcacccacactcagcttagatacggccaacgcgtagataatccgggcacgcgtcggatcaccaagtgccttaaagattgcggtgatccgactcaactcatcagtcggcggcatcagttcagccaaccgtttgacgatcatttcatggtccatttcattttccatcataaactccaatttctaattgagattgtcatgtaagcgtgttacaatacacatgaacagtcattcatatgtttgctcattcatatttaaattatagccataacaaggataaattcaactaagaagtaggtgattcatatggcacacagccatcaaatacaacaacagaccagcgccttcaagattggggtcgccctaaatactgccttcattgtcttggaagctggctacggttttgcgagcggctcactggccctagttgccgatgcaggacacaatctcagcgacgtcctgggcttactgatctcctggctggcaatctggcttggacaaaaaagcgccaacgataagtacacatatgggtacaaaagctcatcaatcttggccgccctcttcaacgccgtctttttactagtcgctatcggggccatttcagtcgaggccatccagcgccttagtaatccgggtcccgtcgccgaatgggatgtcattatcgttgctgctgttggggtcgtcattaatggctttaccgcattactctttatgaagggccaaaagcacgatctcaatattaagggcgcttttctccacatggccgccgacgccggcgtctccatcggcgtggtcattgctggcttcatcatcttgaagactggctggttctggctagaccccgttgtttccctgctaattgccgtcgtgattttgattggtacttggggactcttacgagatgcgatgaattattcactagaagctgtaccaaacaatgttgaccgccaagcaatcgctgattatttaaccagccagcccaccgtcaaccagattcacgatttacacatttggggcatgagtactactgaaacagccatgaccgtccatctctgtcgttcaacattagctgacaataatgcctttttggaacaactgaacaaggacctaagcgcccagtttccactaacccacatcacgattcagattgaacttggcaaggtggattatgaaacaacggatagttcgatttagttcatcttcataaaaaacgataccgcaacctcagcggtatcgttttttcaaatattcagcatttttcgacgttcgtacgttaaattaagacattaacgcacattgcagcacacataacgtcattcattatataatttaagtaatatttattaattcagataatctggttcacttcattcttagctaaccacctaggaggcacttacatgagcatcatcaatcgcgttatcggtatcattatcacgcttatcttgttatgccaatggttgcttggctatcaattaccagctgccatggcgttcttcttagtggcctggctgattggcttggtaacgatgtggctgttgccagacacgacgacgaccgctaaccgctagtcgtgtcagagggatacaaaatcaactcattctaaaacacgtcataagaccattacaacttgctcttgcgacgtgtttttgctaacttcactattacctagaaaacggttagactggttctacacgccagcatcaccgaccattcaaatatgtttttgccgcttaccctcattgtgaacttgcgcttcatattgcgatggaactaataatcacacttcccataaccactccggattaaagcccccaccttgcttacattcacacattgatactcacaaagatacgcaggcataagcaaataaaaaaggccagcatccgccagcctaattctacctaattcaatttaatcaatcccgccgccaacaaaaacatgtgggtgacgactggtccaacgaaggtcaaaccatgtcggtgtaaatccttcgcaacgcgggcgcccaggggtgagcgcgtcggtaattcatcatcgggcgccggcataatgattggtgtcgcatcgacaaacgcccacaggtagttgctaaagctaccatactcggcctgtaattgttgaatagcacgcgcatcttgaatgattgcacgtaacttacgaccattgtgcatcactttgggagtcaacatcagccgttcaaaatccggttcgtccagggcagctacggcgtctacccgcagccccgccatatgttgccgcaatactggtaactgactagccgcgacccgccagcctaaacccacttgtaagattccaaccactaacaattcaaataaaacgtgatcatcgtacgtgggagtaccgaagtaagcatcgtagtccttaaccccattcgccgtaatatcgtcaaaatcatccggactaatcattattcgataaccaatagccattctcaattcgacctaacagcgtaatcaattgcttggtttcagcaacatcgtggacccggatgatccggccacccttaagcatcatcgctgcttcagtgaccaacgtcattggtagccggtcttccttcttcaggccaagcaatagacctaaataacctttccgtgaaatggccaccatcattgggcgtcgcaaataattaaattcatcaatgttacgcatcatcacgtaatcctgttccccatgtgcgacttgtgaatagccgatcccctgatctagagcaattcgttcaatatcgatgccatgactcgtcaatgctgccagattttgttcaaagaaaccacgcatactgctcgtcagatcggtatattcttggtcacgactactgtgcatagtcagtaagccgacgcgactgtcagccatcaatttgagcttgcgaggatcgtccgtaaaggcgttcacatcgttaataatgctgacaccttcttccaggacggcttgcatgacatcatacttataagtatcgaccgctaagactgcttccgggaaacgagccttgatggcgcgaatgtacggcaacgtccggtctaattcaacttgcggcgtgacttccgtgaagcccggccgtgtcgtttgaccattaacttcgattacgtcagctcctgcttgtaacatggcatccacgtgattcagtacgtcatctttagtcttgtactggccaccgtcgaaaaaggaatccggcgtaatattcatgatgccataaatcatcggcttcttggtgagattaaaccggtgctcacccgtttgccaaaaaacatcatattgtttcataatttgggtcaattgaatttgagtcgttgcttgatccgtaaagactcgcgaccattggtgggttaactggcgaccagctgtctggttcaacaagacggtcaactgttcaggactcgccagcacgaccccatctaattgctgacatagttgggttaatcggagctgctgttcccgattataatcactaaaacgcaaaactaattgttgttgtcgttgaacttgggcattcaacgcctgactcgcaaaatccgttgcttgtgctaatgaactggtgatatcttgtactaacatctactccaccgatccttccaatttttaaagttttgtgattaattttaaggcggcccgtccccggtgtgtcagcgggatgcgccacgttgctggtaattcggccaaagttcgaccatagcgcggtagccagaaaattcggtcaaatcccccagaatagcgtccaaattgataggacgcaatgtagccggtgatcgaagcttgtacggccaaggtctgcccatctggccaggcagccgctaacgtagcacgcatcaacgcttgccgctcgttgtcaggaatatcgcgtagggccgttaaaatttcctgattgcgatcaaagccactgactgcaacccctaagtcgcgcgccgtggtcacacctaacaagtctggtaacgcggaaatctctaagccactatcatctgcgataaccggaacccctagctgttgcgccccaaaacgagctttagcaaccgcgttatcgacatagctcgtcgtcgtttccacgggaaattcgagccgcggcgccactgtcaagtactgacgagcagtcaagccatagtaagccaaacacgcgatcaagtcgcggcttttaccagcgttgttggatgcaatcaaccaagtcgtcgtcattggcttaaccccggccaaccagcctgttggagctcacgaatgacataaaatgaccccgttacaataatcgcactattactggttgcttgctgctgagcttgcgttaacgcatccgtgatcgtcgttgcagtcaataagtctggctgtcgttgcatcgcagccgtggtcataaaggtgggcgttaataatgcgttcgccgtgtcggccagcttagtcgcggataacgctcgttctggatttgcgggcgtattcgtaatcaggacgtcagctaccggtaatagttcagccagcattttagggtaggccttatcttgtaagaccccgacgatccaaatcaatttacgaccagcgagtaattgcttcacacttgccactagtgccgccataccatccggattatgcgccccatcggcaataatgacaggttgctcctgtaatacggtcaaccggcctggcaaggaaacttgttgcaagcctcggcgaaccgcactgttcgtcaagttaacttgttgctgttgtagtactgcaaccacagttaaaaccaaccgcagattttgtagctgataggtgccactcagtccgaccgttaattgcgtccaatcaaaaagctgactgtgcgcatcaacgacggtttgcgtgagtgtttgcccagtcaccgtcagttgcgcgtgcttagcggtcactagccgaacaccttgattgagcgcttcagtctgcaaaacagccagggcttctgggtgttggtcagccaatgtcactgctgttgtatggggcttgatgatttttgacttattttgcgcaatcgcggtaatcgtgggcccaagaatggcggtatgatcgagggcaatcttagtaaataccgtgagttggggactggctaaggcgttagtcgcatcatacaagccgcccaaaccggcttcaatgaccgcccattgcacgttttgattccgaaaccaaacgacactaatgagaaagaaccattcaaagatggagacatcgctagctgtcagtcccatattttgcagaaccggtagaatctcacgatacgtatcgataaattccgctggactgatccacgtcccattgcattgcagttgttcacgcgcatcattaatcgcggggctgctgaagcggccaacttgatacccttgcgcccgcaggatactggctaacatagctcccgtagagcctttgccattagtcccagcgatatggatcacatggtaataatggtcagggtggccaagatgtgccatgattcgccgtaataacggaacacgctgatgattattggctaacatggcttgatttagttgggctaataagtcctgataatgttgttcaatcgtccctgtatccactcaatcacctactttgcgattcgctgtaagaattctcgtttcaagtctaaatccgtcttgaattgaccactgtaatagctactttccgtatgcacacccggtttgctaacaccccgcatctccatgcacatgtgccgcgccgtgattgagaccgcgatcccagccgggtcaagaattcgttgtaattctgttgcaatggaaaccgtcaaccgctcctgaacgttcggctgttgactgcaatagtcaatcaagcgaggaatcttactcaagccaatcacttgttcatgctgcggcacataagcaacttgaaccgtgccaaaaaacggcaaaaggtgatgctcacacatcgaatagaatggaatatccttaagtaataccatttcagtcggatgctcaaccttgaacagtttataattatcaaatggtgcggcggtcttagtagcgaaaacttccgcatacattcgtgcaacccgtgctggtgtttctactaatcccggtcggtcaggatcttcaccaactgcacttaaaatttctcgtactgcatgctcaatctttgcttggtttttctcatcaatcatctaactcactcacatttcttacttttttaatccaactctgatcctgattagccgcaatcaattgggccacttgtggtccaactaacacatcagttttggcgatttcagcagttggcagtagcacaaagttgcgcttagctgcctgcgcatgcggaatcgtcagcgtcgctgtgttgatttgccggtcgccccaaaaaataatatccaaatcaatcgtacgtggtccccagtgaaccaagcgttggcggtggcccgcctgctcaattgtatgtaattcatccaatagttcttctggtgtcaaattagtcgttaaggataccgaaacattgtaaaaattggcctgatcacgctttccccacggttgagtctcataccaatgagattcgtcaatcacgtttaccccattgacggctcgtaatcggctaagggcttgctgaatattttggacgcgcggatgaatattggaaccaacactcaaataaacccgttcttccctacttgccattcggcgtcccctccacctcaatttccacatcatcaaagattccaggcattggtacgctatatttacgaattttaatattgattgcatccgccgcgggaaaacttgtcaataacgtctgcaataagtggttagctagtgattcaatcaacttgtatgaatgggtcgttacaaattcatcgaccacgttacggaccgccgcgtaattgatggtctcgtgaacgtcatcgtgttgaaccttggtttcgataggatatttaatggcaatatctagccctagttgttgaccattacgccgttcttctggaagtaccccgttaaacgtgtgaaagcgtaaattattaattcgaatcatgcccataagtatcccagcctctttcttgctcatttttacttataatcatagcatgaaggacgctcaatatgatagtaatcagccaaataaccccataaaaactagcaatcgttcgggaaccgaaaaaagtgcgttgctaacaaaccggttcatcaaaaaagacgttgctggtcaaaaaaccagtaacgcctttgtcttagtttaaagcagtcgtacccccaccatgaactctaggaatccgtagtcgtcccatcattaaaattaatcaaattactgaggtaatggctagttagaccaggtgtctgcttcacaatataggtggcgagcggtgactgcgtcatttgcgtctgaataaagctcgtattgacgatgttcgccaacgacaacgcgacaaaaataaccagatacgtcacgacaaatgacacgattccacccgcaacactgttcacttgcttaataactggtagccacgtaatgctacgtgaaacacggcctaacaaccgaatcactgaccaccctaacgaaattaacacgaagaaagcgaccaggttaatgatcaacgttgccgccactgaagcttcaattaaatgtaaattcgtcaatagattactaatcattgtccctaacggctgatagagtagtcgtgcaaacaataggacgacgaccgtcccaatcagatgcaacatttcaatcacaaatccgcggtgaaacccgcgaaaaattgcgcttgctagtaaaattaaaatcacaatcgtaaatatcatctgcgtgccccgccttccgcttttcaggtacgcctattttaccagctttcgtcagtcagtgcagtgttttcacctagtctaaaccttatcttaaagacttgacgacgaccgtttctttcggtaaagttaacagtaatggttacgatttaaaaagaatggggttacaatacatggtcaaccgacggatatggctttatttggcaataatactgggactcagcggcctattagcaggctgtcaaagttcgagcacccccagtaaaacgactaacgacaaaattaatatcatggctagtctcgacttttatggtcaaacagctaaggcggtggcaggaaagtatggtcaagtgacctcgattattgatcgaccgagcgttgacccccacgactacgagccgaccgtcaacacggctaaacaggctagtagcgcccaattaatcatttacaacggcctcggctacgatgactggatggaaaagcttactgtcaacaaagccaagggcgcccgggtaatcacagtgggaaccgacgtggctcataaaactgacggggccaacgaacacgtctggtacgatcccacaacgatgcccaaattggcaactaaaatcgcaacagaactcagcaaaattcagccgcagcacaagcattattttgaacagcaggcccaaaagtatcagaccaacgctaagactataaccactatgatcaaacaattgaaacagcatgcaaataatcagcgtgtcgctgtcagtgagccggtctttgactactcattgaaggcaatcggctaccgaatcagcaatacgcatttcgcacatgcaattgaagaaggttccgacccatcacctaaggatatccagcaaatgcaacaagacatcaagcaccaccggattgcctttttcgttgaaaacactcagaccgatagtaacttggtcacgaacatggtcaaactcgccaggaaatacgatgtgccggtactgaaggtcaccgaaacgttaccggccaaccagacgtatcaaagctggatgctcagtcaatatcgtcaattggcaaagattcaaaaagcaacagccaagtagaagcgccccggttagttgggccaagtcctgtgattcagtacgatcacagtcgtgccacgaaaaaagggccgccattcttgattacaagaatggcggcccttttggcctaattacgactaaccgaccgattgtgcaggcactaatgtctaattagtggcgttcaaagcatatcccacttaacttcagtcattctcgcctggtagtcagtcaccgtgattattaatgcgactgcttgcgcccatcacgcaaaagtaacgcaagcacgaggccaaccaattcaatgccgagcatcatccagaagaccgtatggtacccttgcaagttcgcacgcaacgttgaggctcccgcttgtttctgagcaagcgtcacgttggataagaccaaggtcgccacggccacaccagctgaaccaagaatttgacgaaccgtcgtaatcacagcggtaccgtgtgaaatcagttcatcgggtaatgaattagcccccaatgtgacggcgggcatcatgacaaaggcattcccgccttcaattaaggcagccagcaaaatcatggtgagcaggttcaactctgaattgatcagtgctaagatcagccaaccaacaacgatcatactcataccaagtaacatgatttgtttgtatccaatcttctctgctagtttcccagtaagtgggttcaaaatacttagaagcaccgcaccaggcaccagtgacatgcctgaaacgaatggcgacaccttcaagacaccctggtaatagagtgggaagatgattgttacgacaatcagcgccacgtacgagattgctgttaggaaaatggctaagtcataattaaatgtttttaagacccgtagttccaataacggcgtctccaagtgaaattggcgataagtaaagtaagccaccgctagtactgaaaccgctaataacagccaaccgaacgtccagttcacattgggtttaccaatctcattcacgacgtataaaatcccagcaaagcccagtaacgtcacgattgagagcaaatccagctttgaaggcttattgaccatcacgtccttgatcgttgtgaaactaattaggatcaacaaagttgccaccgtgatgaagacggcaaacaatccgtgccaatcggtaaacttcaaaaccacaccggaaataatcgggccagatgctaatgctgatcccatgaccaacccggcgacacccatcgtactaccccgtttttcctcgggcgtaatcgtcagtaaaatggattgatacgagggaaacagcacgccaactgccgccgctttaattaggcgaccgaccatcatcacaccaaaactgggtgcgaaataaataatgattgaaccaatatcgaaaagcaccaaaacggctaagaataatttcttaaacccaatattattcaacaaccacggactgattggcatcatgacgaccattgtcaacataaagccggtcgttaaccattgcacggttgaggccgagatgccaaagtcgcgcataaatgttgggtagaccgtcgacaaggaagactgactgatagacatggtccaagtcccaagcaacagcgtaaaaatgaaccagaagcgtcgacgccccgtcaacgttacattttgattagctgtctgcattcaaaactcctccttactttagaacagttatcaactaataatatccattgtaccattgaaaccaatgatgtacaggctaaaagtcagattgccaacaaaaaagtttgctacaccaaataaagagacgtgcacaattagcttgtaacaacacccgcgtgaatgattgttaaatatccaatctgttaaaactctaacggacagattcattaagtcagttgtcctctaatcatcataaaatcagtcccaaccagggcactccatcacaccgaaaagctttgcagccaaactaaaaatgggttgttcaagaatcaaattcttgaacaacccattacctacatgttgcatcgatattcttaatttattcagctaacatggccgcactaactgcctgtagctgcttcgcttcaccagcagtcggtttagcgggtttcatcttctttaaggcgatcactgcccgatattgaagttctgccacattaatatcatcccgcaaatcataatgagtaattgtgacgaaggcggagttctcataaattttttcaactttagcataaaaatcataatcggtattgccgttcttttgacatttaacccgatcccccacagaaatctgagccataactatcactccacttcataaaatatgataataacatagcacgtaactgctagaataacaattattgctcccgaatttacatgatttttacatggttatgacggatactgtccaaattaaatgacattaggcccacgagcccgtattagcggttagtaatggccaagttcgtaaaccaatacctagtaccttagactgagctgaatcactttatcgcttgaaactagcatcgatttttctaaccaaccaaacgtacgccatttacgcctgactctcaaaatccgaacgctactgtctctcgttttgacagctcccccatcactgccagctaccccaaatatgagcattgagcgcaatcgctaacgattcaactcaacggaaacttattcagtacaatgagtgtgattgcaaccaataagtagatcgtgccggtgattaatagtatgggttgaattccaaatgcgctgatgagtaccgggattcctaataatccgacccgccgtttgaatttcaaaatttagtcttagttcgcccagtaggctaatttttggcaacaaaaaaaggaatcgaattaacgattcctta

SEQ ID NO: 41 - DNA, 20606 bp, Lactobacillus plantarum
attaattttacaatctaccttttaattacaattttagtcttagaatttcacattcccgattaccaaccgggacatttactggcggcactattagcgcaatggccgttgatcttgtcgtacgtcttttcgtatttctacgttggcacgctgtggttatttcatcatgattatttcaacatgctacaacgaattgatcgcaacgttaatatgctaaacttattaatgctctttagtatcaccttattggattacccgatgtcattagtggcagatgcgttgacaactggtaatcgacaggatatgcaaacggcatttatcgtttatgatttggttgccctgtttatttcggcgacattttatttcatgtacgcttatctgcatcatcaccaggatctaaagaagccgggaatctcaatggctttttatgccgcaattaagtttgatccggttcgaagtgtcacgatttatggcttagccatcgtggcaacgttttggtcggtatggttaggtgcaatcttactagcaggtggcatcatttttcactttttggcctacttacggatgagtcgccagctagaacaggcgaagggagggacggcataatggattattcaagtttattaggacctgatcgttatgatctagccgtgacgttagccaagcagtatcatcttgatcccagccaggtcttgttcggctatttgcaagtggttagtcaagttacgggtggtccgaatgcagcgcaagctgatttacatgagccccaagtacgagcggcaatcaatcaggaatttgatcattttttgaagcagcgtcattaattaaaaatcacgatgtgagttcagtctcaacatcgtgattttttagtttcaatcggcagggaagaggtacggtgttcgccaggttgctgccatttcaggtgttagtgtcagtcgttgttcgtgaccagtcgtgcgtggaataaagcggtaagtacgagtcgctaacgtgatcaaacaacgatagtgcgtgtagttgtggctgatgagatggcgacggtcggcgtggtatggcaagcttacttcttgtaaccagcggaataaagtggtcggcacttgttgcggtgctaactgcggtgttcccagtcgtcgaagtgccatgtgaatgaaacgatcagtgggaatcggcccgctcggtaatggttgcttagtctgaatcacgtgctgagcagcctgacgagtggcagttgtaatctggttgccagatattgctaaataaagatttagtcggcgctgatggtcgcttaggactggtgtattggtcaggacgccggctggattcggttgcgcagtcagtgggccaccagtgggttcgatgacgacactggtgtgtgcatcactgagataccagtgaaagggatagacttcaccagtgtcatcaccccaggacgcaccgaccaggttaacacttggcagatcggcgatcacggctgcgactgattggtgttcacctaaagcccagttgatgaaggcttgaggtgttaaattaatttggttgacttgtggttgagtggcgtattcaacggcgtggggcaagtacagttcagcacacatcaaaccagcttcgttaatgccgtcagccatcaaacaagccttaaagtggtcaggtagccggccaccaccgagaatggcatactgcgtcatacgcgtcgtcgctaacccagttggccacggataacggcgcggcaaaaaaattggccgccaaggtgtcgttgttggaaagtccatggtgcgggcgaagtagcggtgattgtcagtatcaagataagttaagctggtacacatggcgcggcctcctttgaattaggttcattatacgtcaaaataggcgacagataaatgactgtttaattaacgatggtaacggttacttttttgatgatctgcgtgtgcaaaacagctggcagtgcaatcagtgacagattaatttatggtcggatggaactcattattttctaatctttacaaacgtgctataatgaggtttcaataactatcaaagcgaggtcttcatagtgagtggatataacgtcgcgattgtcggtgcaactggtgcagttggcgcgcggatgatcaaaatggtggaacagacgagtttacctgtcaactcagttaaacttttggcatcaagccgttcagccggtaaacaattacagttcaatggtcaagccttaactgttgaagagaccgttcctgaatcattcgaaggaattgatttagccctcttctcagcgggtggctcagtatctaagaagttcgcccctgaagcagtcaaacggggtgccgtagttgttgataatacaagtgctttccggatggacccaaagattccgttagttgttcctgaagttaaccctgaagcattgaagcttcatcatggaatcgtggctaacccgaactgctcaaccatccaaatggtcgttgctttggaaccagtgcgcaaggcatttggtttgaagcgggtcattgtttcaacctatcaagccgttggtggtgctggtaaccgggccttgaaggaattgcatgatgagacggaagcctacttaaaaggtgaagagatggaagctcatatcttacctgttgcgggcgacaagaagcattatccaattgccttcaatgcgttaccacaaattgacgtgtttgaagaagatggctacacccatgaagaatggaagatgagccatgaaaccaaaaagattatgtgtggcggcgacatggacagtaaggatatcaaagtaacggcaacttgtgtgcggattccggtgccagtgagtcactccgaatcagtttactttgaagttgaagatcctaaggcaaccgtcaagggcattcaagatgctttggcagctgcaccaggcgtggtcttacaagacgaccctgataaccaaatttatccgcaagcgcataatgcggaaggttctaaagacacgttcgttggtcgggttcgtcctgaccaagaaacgccacaagccttccacatgtggaacgtttccgacaacctcttaaagggtgctgcttggaactcagttcagattgcggaaaccatggacaagatgggtttattgcacatgcaataaaactaatttgttaagggtaatgaaaagctgatcgctagaatcaatattctggcgaccagctttttttgatgtcgaattattcgagcgttagagtcagataaaatataataagcgtcatgttgaaattaggttcgttttagaaagcaatattaagaatttgttaagctaaaactgatgagtgtcctttatccttgtcctggagtcagctccagcatataagctaagtttattcaaagttagtgaatggtcaatgagatgtcatgatgttaatttgctagctagaataaaattttaacgcgaatatggaggaattaataatgaaatcaattaattggtcaacggactatttaccagggcatactgataatttcgtgtcaaacgaggtcattacagacggtgtgactttagcggctgtttggaaaaatttagtcgatacatcgaagtggacgacgtattatgacaatgcgactaacattattttggatgatcaaacgaatactgaactaaagtttgcggaacatttccgatttgatacatttggttttcctatcgatgcccaggtcatggaactcgttgaaccgacggatggtgaaacagcacgactagcatggcatggctggcaaaatggtgatgcagatactcaatttgatgtctatcacgctttcttaattgaaaaattgacagatggccggattcgattattaacacaagaatcgcaagttggacagcctgctaaagacttagctaatcaaacacccaatccgatgctaaatggtcaccaaagctggttagatgggttagtcaaggctgctaaaaggactatgactgagtaaagtagtagctcagcaagattaataggagtgattaaaagatgaaaacatggtttattacaggaacttcaagtggttttggaaaggaactcgcgacaattgttgcacgtcagtctgacactcagctgattgcggctgcccgccacaccgatgatttagcctacctagatgtttttgacgcgacgcgtattgagaaagtaagcattgatgtgacaaatgaatcacaaattaaaactggggtcgctcaagcgattcaacgttttggaactattgatgttttagtgaacaatgctggcttaggctatttttcaacaattgaagaaagtgatatggcgaaagttcgctacatgtttgaagttaacgttatgggactcgctaacgtgactaggaccgttttaccgaccatgcgggcacaccatgctgggataattattaatttatcatcggcgttggcattgacgacactaccaactatgggcttttacagtgcgacaaagtatgcagttgaggggtatagtgataccttgcggcaagaagtaaaagacttggggattcaaattatgacggttgaaccaagtggcgctcgaacgcagtggtcagggcggtcatcccaaaagatggtaccgacaattgcagattacgccgcgtttagtgacgcgattacgacggtatcggactcggttactcaggcaccgggcaatccgcaccgaattgctcaggttatgtttgatcaggccaatttggtagaagtaccggcacacttgccattaggtgaatttgcctatcaaggtggactcgctaatttacaaagcattgttagtgaaattaagtcacgtgaggacctttcattatcgacagacgattagctgcgttaagatagtggttaaacgacaatcgaggaggttcagttcagtatgagttattcaatcggacaagtagctgataagttaggagtgacgattgataccattcgttactatgataagtcgggattactgccattcgtgaagcgtaattcaattggccggcgtgaatttactgataatgatctacatttgatgaggaccattgtatgtctcaaaaatgcgggtgtgtcagtagctgacattgctacttttattgcgctcagactcgaaggtgatacgacattaaacgatcgttaccaattactcaaaacgcatgagcaggaattacaacagcggattaccgacttacaggatacgatgagttatttgaagtttaaggagtggtattatgagaccgctacggctgccggacatgaggatattcattttgtaccgggtactaatgaagttcttcccggtcttgaccaggaatatgatgcgtatttgaaggcgaccggtcaactggttgagctgtctcgatttgctaatgtaaaggattatcggttgcgcaagcgatagtccttagcagtttcagtttaatcgatgaaactgtacagaaaaactggttttgatagcttggatattggataagaataaccaaaataaaaggttctgaattgtcagttgtttgacagttcggaaccttttgaaattaaaagcagcgtatatttaagcaattagttgtaagacttgtctaactagcgccactggtacgggttgatccaggccaatgttcagccgcttttgaccggttgcgtaaccagcagttttagcagcagtgagggtcgcatcgtcaaggtcggctgaaatacttagactgacgtgggcctgataagcagcaatgctaacgtattgtttgtcatgttcatagaacggcaaattccacttgattttagcagtaaagtcaagcaattccgatgtaatcagttgggcaagggtgctcaagattggttgtgcagcgattgcagctttattgatgtaatcgttggtgtccgtgactttaactcgactaggcatttttaaaacctcctttatttacgaaatgaattgcgtcgtagcaaccaaatggttagggcacatagtgcaacggcgatgaataccgtaatctcccaaccgaatggattcttcatgaacggtaagtcgacgttttgcccgaaaaaaccgaagacaatgttgggcattgtcaggacgatggagaaaatcgtcagcacccacatcgtgttgttcaaactgttgtctagaatgttcgagtaggcgttcgacacccggccgatgatgtctgaggcaatgttggccatttccaatccttgttgtgcctcgacaataatatcgtcgagccgttctaattgggccgccgagaatttgaccggtacaaaccgtttgagtgactgcaacatgtcgttattacttttaagggacgtgaggaaatagactagcgttgtttctaagtccatcaattgaataatgaccgaacgctgaatttgctttttcatcttcatctgaatgtcttgtcgttgtttattgatcttgttgatggccgaaaaatattgccgtgatagcttgtacaagacgttaaagatatggtcgtatggatgcaggacatcttcccaatcggcatcgatttcgtctgccaacatatcctcaacgaatattgtgttatcggtcgtaaaagtcagtagggtgtggtcaatcaacatgaaactgacttgggcggtataagtaccttcctcaacgtcttctgtgaccacgtcaaaaataatggtcgtgatggcacttttggcgtcatattccaaccggcctcgttcgtgttgatcggttgcgtagcctaacatttcgtcggtaacgtgttcctcacttacgagttgatgataatcattttcagtgtaattattaacagcgacccagcgaaaatcgtcgcttagttcatggacttttatcattgtttttacttccagcgttttgagatatcttcaatttaacatgagttgcgagacaacgcaaaggaagttttaaggccacctaattatttaacagttgttctacttaacttttcacaccataactggtgactgcgactgaaaagcgctaacaataaatcataactgataatcagtaaaatgactgaaacgacgacgaggtagacatccaggcggttaagggtggcactaggaacattgcctagacgattgaataaccataaatccaagaataaaagtggcaggccgattaagtagagcccactgtaatggataagcagttgccagagattggcctggtgaccactgatggttacgatctgactattgagcaggcgaccaccaatggttttaccatgccaacaccaggcgggcccaatgaagaagaggatgatatcggccaggtatagccagcgaaaatcatgtggtaatggccaattaaaatgtttgactaagacgaagtagacggtgtcaaaggcggcaattgcgagccaatcgatgaccaacgccccaatgcggcgccaattgatggggtgttcctgccaattcaaccgggtactgtggtcgcgattgcgccactgattaggaatcagatgtagacacccagcaccgacaatcccaccaagtgtgttcatcattaaatcgtcgacatcgaacatccggtaggctcgtgagtagtagccgtataatccggttaactgcgtggtttcgaagaacaatgaaatcgagaagctcgtcagggtgatcaaccagagcggccagcggtgccgccactttaagtaggcaccgatcggcataaataatagaatattgaagaacggctggaagaacgtgtcagatttgaaggcggctaaccaagtactggggtccccgagttcaaacggcgtgagtgccttcaactgggtgagaaagtagaagggttgtaaattatactcagcagttgttaggctagccacggatgagcgagtcgggagtggcagaataattagtaagtaggctgctgccaagtaccaaataaacgaataggtactgatcaagttacgctcactcaatgtttgacgtgttcggagctggatagtcaggataatcatggcgagtagtaaggtcatgatgggtaaagctaagataacgatgtgcacgggttccagcaacgtactgacaatgtgactggaaagtgcgagttgataaagttttgtaatgagttcgtgcatggctggtccccccttttttgggaatagcgctgttctttaactaatgttgactatatcatggtataaagaaattgtgacaattaatataaataaataagtaaattgttagactttcgccgtgactgctagcggattgtcgcgaatgaccgtttcgaccatacttgcttatctaaaaaaaatatgattgaataagcataaattatgagagggtgatgaggatatgctaatggatgggcatacccacacggaactatgtccgcatgggagtggtgaagcaacggaaaaaatgattcaacgggcgatacagctaggttttcagcggtattgtattacggagcacgcaccgttaccaccggcatttcgtgaccagtatgaagggacgccggccggttatactgaggcgtcgttgcgtgagaaccaagtagccgattatttggcactggctaacggactgaagaccaaatataccgggcaaatcgagatctcagtgggttttgaagttgatttcttaccagagcatgttgcttggacgcgtgattttctgaatacctatggtcctcggacgcaggaaagtattttgtcagtccatttcatgcgggggttacggcagcatttctggtgtgttgacatgtcaacggatgattttgcagccggttttgggcagtggcttaagacgccccaacgtgtttttgaacagtattatcagacggtcttggcatcagtacaagcagatctgggcccttacgcaccacaacggatcggccacatgagtctcgtccgcaaatatcaggattactttggcttgactgaacccttggatgtccataatcttcaattagtagatcagacgttggcgttagtgaagcagcaacggcggcagttagatttgaatttggctggtctctacaaaccgtattgtaatgatttttatcccggtgaacagattctacaacgcgctcaaaagcttgacattccgctggtttatggctctgatgcccatgacatagccagtgtggggcgtggctatcatcttataaaaaaattaattgagggttgacagccgtcagtttagtgattacaattaattataaattaaacgactaatcaaattttaataaatggttgtgattagaacaagtaattaagtcttcctcatccagagagcccgggtagctgagaaccggacagacaggcttaacgaacacacatctatgaactgctaaggtgaaccagtctcattagccttagccgaattggtttcgttatccaagttgacttgatcaacatgaggtctgccgtgcgaacggtagatgaaataaggtggaaccacgcgtaaacgtccttttagcaaattgctaagggggcgttttttagtttcaccgatccatgcggtaagtttgcgtgacggaatcgcaagtcgctccggttagcatgtaagcaattgattaagcacgttgataagtaacaatatgaattaaactgattagttttaaaaataacgacgttttaggaggcgtaaattatgttgaaacacttattaccactaggaacccgggatgaatttggtcggcgggcacgtatcaaacaacacttgatcgcggtgatccaagcccattttaaacaacgcgggctcgcgccaattgcaacgccgttattagaaaacgaagcggtgtttgatccatatcagatgggtaactaccaactataccgcttatttggcaacgatggtcgcaccttggtcttacggccggacatgaccttaccagttgctcgcttcattagcgcgacgaatgtccccttaccgcaaaagtttggttatgtcggcgatatctttcgagtaagccgtcaattatcaggttcatataaccaaatcacacaagcgggagtcgaattagtcggttacgcatcgctgaaagccgaatttgaatgtttaacgattgccaaccagctttcaagtgagctgattgccgatgctgttgaaatcgaattaggagatgcccaatttgcacaacgggtcgtggccagcttgactggtgacgaaggcgaacaacaagccattttaaccgcactgttcgataagcaagtaccacgctacacgaagttgattgccaagtaccgcgcacagcctttatacgattttctcaaagcatggccgcgtttgttcgggcgtccagaatgtatcttcaaagaattagcggcagcaccactacctgaaacagtccaaccaagtctgaaacggcttcaaacggtggtggcctggatgcaacaaacgatgccggagcaagtcatctcggtggatttgagtagccaagcaccacaaaaatactataccggcctgacttttcggggttattcacaagcgggggctggctacctgttcagcggcggccgttacgacaaactgttaacgaactttcaagctgaagcagaaccggctgtgggaatggggttaaacgttgacttgttaacgactttagccaccgaccaacagaccgcttatgctgaacaattgatttactttgagcctgaacagtggtcacaagcggaggcatacttagcgaaacaaccgcacgccattttgagtttggcggatgacttagcaggtgcgcgcatcgaagcacaacgtttgaatgcccaactgattgatttaactggaggtatgaccaatgactgaaccacgtttaaagattgccttgactaagggccgcgtcgaacaacaagtcctgccgttgctggaagaagctggactggattgttcgcaagtccgcaacaagcaacggcggttgatttttgattctgagacgcaaccatatgagtttattttagcgaaagggccggacgtgacgaccttcctcgaacggggtgctgctgatatcggcatcgttggtagcgatattttgactgaacacgagagtacccaatatgaactgttagacttgggggttggtaagtgccaatttgtgctagcatccacggccgactttgatcccgttgcaccacgacgcaaaatcatcggcaccaagtacccattgattacccaacggtattttgatcgcttgggccaagatgttgaaattattaagattgaaggctcggttgaattagcaccactgactggcttagccgacgccatcgtagatatcaccgagacggggaccacgattcgtgagaaccatttacaaatttatgactatttacaaccagtctcgacccgcctagtggtcaaccggttagccttaaaacagcaacaagccgccatctttgatttagttgatcggttggccacagttgttgatacgaataatccaaaggagtttgtctaatgaaaattattaatgaagatttagctagtttaaaacgcttagttcaaacgaagacccaacaattgactgacttaaaggttgaatcagcggttcgcgaaattattgccaatgtgattaaaaacggggatgccgccgtcaaggattacgaaacccaattcgataaggtcaccttgaccgactttaagttgtcacaaactgttattgatgatgcttataacaatctggacccgcaagtgaaggacgccttgttgttagctaaacgcaatatcacgagttttcacgaaaaggaaaaggcgactggctttattgatgctgaacagcctggcgttctacgagggcagaagttaatgccgcttaatcgggttggcttatacgttccaggtggcacggcagcctatccatcgactttactgatgagtgccttgcccgctaagattgccggcgttaatgaagtcattatggtgacgccaccacaagtcgatggcatcaatccagccgttcttgctgcagccaaaatcgttggcgtcgacgccatctatcaagtgggaggcgctcaagcaattgctgcgttagcttatgggactgagtcgattccagcggtcgacaagattattggtcctgggaacatttttgtggcgactgctaagaagcaggtctttggtcaggtggcgatcgacatggtggccggcccgtcagaaattggtattttagcggatgattcagctgatcctcggcaattagcggctgacttattgagtcaagcagaacatgaccgtcgagcccggccaatcctaattacggatagtgccgacttagcgcaggccgtcagtgacaacgtgacgtcacagttgaaagttttgccacgagaagcgatcgctaccgacgctgttaacgaaaaaggcttcattgccgttgtcgcaaaggttgaagaaatgtttgacttgatgaatacggtggcaccagaacacttggaagtgcaattgaagaatccaactcagtacttgaatttaatcaaaaatgccgggtcggtcttcttaggacgctacgcctctgaaccactcggtgactacgttgctggtccgaaccacatcttaccaacgagtggcacggcccgtttctcatcaccacttggcgtctatgatttcgttaagcgaacgtcctttatccaatacactaaggacgctttggctaaggaagctccggcgattaccacgttggcacgggtcgaaggtctggaaggccatgctcgtgcgattgagagtcgttttgacacctattacgattagggcgtaattagtagttgatactgattgtgattacagccggtagtcgttttagcagatgaggaggaaatgaacatgcgacaagcaacgattaaacgtgaaacgaaagaaacccagattgaaatcagtttgaatttagacgaacagagcggtatcgaaatcgataccgggataggctttttgaaccacatgttgaacttatttgcgaagcacgggcgcttcgggttggtcgtgaagtgtcacggcgacctcgacgttgacccgcaccacactactgaagatacgggaatcgtgcttggcgaatgctttaagcaggcgttgggtgataagcagggaattgaacggtacgggacggaatttgtgccaatggatgagactttaggtcaggtcagtgtcgacctaagtggacggtcatacttagtttttgatgccgagctcacgaatccgcggctcggtggcttagatacggagacagtcgaagatttcttccaagccgtggcctttgctgctgaaatgaatttgcacgcacgcatcctgtacggccgtaacactcaccacaaagttgaaagtttgttcaaagcgtttgggcgggcaatgcgcgcagctgtcacgattaatccagatattcagggggtcaactctacgaaaggcgtgatttaaatgtttgcaatcgtcgattatgatacgggtaatacccgtaatttgaagaaagcttttgactacctgcaagtgtcaaccatcttaacggctgacccgcaacaattagcggccgctgacgcagttattttacccggtgtgggagctttcgcagctgcaatggccgctttaaaagagcgccagttagtcggcgtgttacaagcattggcgcggagtggcaaacccgttctcggtatttgcttaggcatgcagctcttgtttgaaagtagttccgagtacggcgagcatgctgggctaggcttgttaagcggccgggttagcgctttgccaacggacttgaatgtcaaagtcccacagatggggtggaatcagaacgagcttcggcgtcctgatagtccctttgccagtattgacgcggcctatacttacttcgttcattcgtactatgcggtatgtccggcaactgaaatcgtggcgacagttcaacacggcgtccaggttccaagtattgttcagcatcaaaatgtgattgggatgcagtttcacccggagaagagtggtcgagtcggattacaacaactagcagcttttaaggaaatggtgagtgcaaatgatttttccagcaattgatttacgagccggtcagagtgtccggctctaccaaggtgattttaaacaggcgacattgattaatcctgatcctgtcgttcaagcccaacaaattaacgcagcgagcttgcagcaattacacatggtcgatttggacggtgccaagtcagggcgcccagaaaacttcgcgacaatcacggcgatccggcaagcatttaccgggacgatcgagctcggtggaggtattcgaacctacgagctggcgactcgttatctcgaattaggaatcgatcgcttaatcttggggtcagttgcgttgactgatccacgactggtcaaacgactgttaagtgagtttggtggtgagcgaattgtgattgggttagacggaaccaatggttatgtggcaattaaaggctggttggagcagtcacagaccaagatgagtacattaatgaagacaatgactacgagtggtgccaagcactttatcgtgaccgatgtcgcccgtgatggcacgatgcaaggccctaaccttgcgttataccaagaactacaagcacaggtgcccacggccaacctgattgccagcggtggcgttcggaatttgaccgatgttcaagtgttacaagccagtgggttcaaggatgttattattggcaaggcgttagctgaaggcggtgtgacactggccgaattagcgggggtgactgaatgttagcaaagcggattattccgtgcttggatgtggcggatggtcgggtcaagaagggcgttaatttcgtcaacttgacggatgtcggagatccggtggcgattgcagctgcctatcagcaacagggcgcggatgaacttgtctttttagatattgcagccaccaatgagcaccgcgagacgatggccgccatggtcgaacaagtctcagctcaggtcttcatgccactgacgattggtggcggaattacaagcgttgctgatatgcaacgaatcttacgtgcgggtgctgataagacggctattaattcggctgcagttgccaaccctgaactgattcgtgccggtgctgaaaaatttggtaaccagtgcattgttgttgcgattgacgcggcgtgggatgcggcagctggtcaatatcgtgtctatacacatgggggtcagcaagcgaccgacctcgatgcagtggcgtgggccaagcaagcggtcgccttaggggctggcgagttattggtcactagcatggatcgcgatggcactaaggcgggctttgataccaagttatatcaggccctgggagcaacggtcaatgtgccaatcattgccagcggcggtgcgggtaacttacaagactttgtggatgtttttagcacaaccccggttgatggtgcattggcggcttccgtctttcactttggcgagttaacgattgcagatgtcaaagcgacattaagaaaacaaggagtggtcgtaagatgaaaccagactttgaaaagggtgacggcttactgacaacggtcgtcaccgacgcggatacgaaggatgtcttaatggtcgcgtggatgaacgcggaaagctatcaacggacattggcgtcgggccagacgtggttttggtcacggtctcggcaagaactttggcacaaaggcgctacgagcggcaatttacaagatgtcgttagtatgacgttggattgcgatcaagatacactattggtcgcagttcatccgcatggtcccgcttgtcatacgggacatacgagttgtttctttaacccggttgaactagaacagggcgcctaaggattgatgacgatagccgaatgagttgggagttagatggctgattggttggaaaatgcggtcccaacggtcgataagcaggattgtttttaacccgtattaaattgatgaatatattatagaagaaagtggtgtcgaatatgcaaaatatggaagaattatacgaactgatcaaacaacggaaggcaacgcctaagaagggctcctacacagattatttatttactaagggactggataagattttaaaaaaggttggtgaggaatcaaccgaagttattgtggcggccaaaaatcccggtgacgacgaattaacctatgagacagccgacttgttgtatcacgttttagtgttattggtcgaacgtggtgttagttttgaccagattaagcaagaattggctaaacgtgaaggtaagatgagtgactataaggatcggcccgaaattaagaacctataggaggtagccgaatgaaagctagtattgaacagttagaaccctatgtgcccgaaaagccgttggcgaccctccaagctgagttaggattgacagaattagtccggttatcagctaacgagaacccgtatggcacctcgccaaaagtggcgatcgctgtgaagaattgggacttcacccagagtaatcgttatcccgatgccgacgcacaggagttacgacaagcagtggcccagcaacagggaatcgacccgaatagcatcgtttttagtgtaggtcttgatgagatgatcgtgatgttatcacggacgttcttagccaccaacgaccaggtgctagtgtccgcaccgacgttttcagaatatggactacatgctgagatcgagggggggcaattaatcagtgtgccaacgttgcctaatgaccatgtgaacttcgaaggcttaatgaaggccattacgccccacgtgaagatggtttggctgtgcaatccgaacaatccgacgggcaccgtggaatcattagcggcaattgaagcgttcgtccagcaagtacccccggagacgatggtcctgattgatgaagcctacattgattttacaccgggcgcggctcaagtaacggccatgcagttaccagccaagtacccgaatgtagtggtcatgcggacattctccaaagcatatgggttagctaactttcgaatcgggtacgccgtttttaataccaaatatgccgcaacgatgcaaactattcggcttccatacaatgtgaattccttggctcaagtggcagccctggcggcaatcgatgatcctaattttgtgaaacaaacggtccaaaaaaatgcgacggaacgtgctaagtggatggcattctttgatgatcagggtgtcacttacgatcaatctggcgcgaacttcattttctttaagtatccgagtgccacgcaactggctgactatttagtgcaccatgggtatctgattcgcactggcttacggccagggtggttacgactaacggtcggaacggctaacgataatcagcaactccaacaattaattcgtgagtttaaggcctagaattggcgcaaagaaacctgagtaatcggtttctttttttgttgccctaactgctgaataaattcgaggcagctggtccgcaaggatagttgtcaataacacctgctaaaccattaactcaagtgttgacttcgacgccactctaagcagtaaaattagggtgataaaatacaggagggacaacaatgtcagaattagataaattagcagctggggaatggtatcaatttaaagatgctgaggtggccgctcaaaaagcgcgggctgccaagttatgtcaagagttcaatcagatcgatgcaacaaatccagatgcgcaaactgccaagattcaagagattcttggtagttacggtcgcaatctttccgttcaagcagactttaattgtgataatggtcgtaatattcatgttggtgataattttcttagtaattataacttaactattttggatatcgcgccagttcatataggggataacgtgatgattggccccaatgttgatatttatacggtcaatcacccgttgacgggctagtggtcgacgtgctagcttggcccagggtcatccagtcacgattggtcatgatgtttggattggggggagagcggtgattacgcccggcgtgacgattggtaataatgttgtgattgcggctggagcagtcgttactcatgacatgcctgataatacgttggtggccggggtaccagccaaagttattcgacaattagaataagaaaggtcgcaattggctagctttttgggcacttattttactcattggcatgatgagtcgtaaatacgacgaaaataaggtttatttttgaaaattagtccacgtaagcggcaccaattatttttacaggtatacttagattaacaaactaatattaagagaaagaggatgccgtttgttatatttaatcgaacagttgtatggacccttcttcagtgcgactaactggggtaacgtcatcacatctgctaatgactggttaatcattttatcgttagcaattattgagtgtttactatcagttgataatgccgttgtcttagctgctcagacccagagtttagataatttacaagagcgggaaaaatcgttattctatggcttgtggggggcctatatctttcggtttttaatcattgggattggcacgtatttgatcagtttttgggagatcaaagtgttaggtgcggcttaccttgggtacttggtgtatcgatactttagtcagccgaaaaatggggccaaggtggcacagaaacccaagcaacaacgacgcttcttcggactaagcaacttctggtcggtcgtcattcagattgaaatgatggatatcattttctcaattgattctgtattggcgtcattggcaatttcggataatccggtgattgttttgattggtgggatgattgggattgcctgcatgcggggcattgccgaggtcattatgcgcttaatgcgcaagattcccgagttggaaaccatggcgtattgcttgattgtcttgattgccatcaaattatttatctcaattcctgccattggttgggatattcccgcaacggcttttggtggtatcgtattagtagcatttattattacgttgctgattcatttttggcgtcggcgccgcaatgaacagtgcgtggaaggaaaggtgcgtaaatgatgaaattaggttggattggtaccggcgtcatggggggcagcgattgtccgtaacctgatgacggccggctatgacgtaacggtttataatcgaacaaaaagtaaggcggatgcgctagttgcggcgggggccacttgggctgatacaccggctgccgtggcagaaacgagtgacgtgattttcaccatggttgggttcccacgggacgtcgaacaagtttattttggtgatcacgggattttcagtggattggccgctggaaaaacggtaattgacatgacgacgagccaacccaagttagccgttaaaattgcgacgtacgcgcgtgaacatgacatgcacgctttggatgcgcccgtgtccggcggtgatattggcgcccaaaacgccactttgacggtgatggtcggtggcgatgccgatacgtacgaggcgatgttaccattatttaatgtgcttggtcacaaggtcaatcattttggggatgctggtactggtcaacatgccaagatggccaatcagatcatgattgcagggacgatgactgggttaactgaaatgttattgtataccaaggcagccggtcttgatccggaaaaagtcttggcaacgttatctagcggtggtgctgacaactggagcatggataattacgtgccccggattctgaaggacgattacacgcctggcttttttgcccgccattttcttaaagatttgcggattgctttgagcgaggcggatgcgatgggacttaatctggttgcgacggcgcaggctaaacgactttatgaagtaatggtcgatgtcaaaggcttgggtgatcaaggaactcagggattgattaatatttattagcgcgtggctgacttgatgaaagtcgctcaaacatcatatatttattgaaataatagttatcaaggcggggattcagcgagtttaatctttctgaatccccgccttttattaacatgatacgcattatgcgagttaatttgtcatgaatcgtgattaaaacgtgccagttatgtcagttcaaaagcagccagcttaggcctgctggaaaaagttcgagttagcgtaaaattacttagttggcgcgtcctacgccgacttccaggtatttctgccaattgctggaacgcggtggacacagatttaagccgaagaccacgtcttaaatactggtcttccacgctttaatggcatattagtgaaacgtgctcgggtcagactgagacttccggttagctacgctatgacgtcaagcggaaattcaccgcttaacgccctagctaggctaatcctcagtctcacccgtctgaacctcacactcttggcagtgctgagcattggccgaaacgctttccagtcgggacagtgttcgaatggcggacatggatgtacccaatcattgatggacttgtcattgctttttataaacgataactttgtcaatcaactgtcagacagaaaatgatattgtgataatttactattcccaaatcaccatagtaataattaaacgtctcgacaaagtggttaacgccaccctaacgttatgtttaaatttccagtaaaaaatatagtcagcgactaattgtaccaagttaagtggctgttcatttgccattcgagcggcttcccgactggaggggctgggtgaca

SEQ ID NO: 42 - DNA, 20436 bp, Lactobacillus plantarum
agccggaagcagaccacttccgactaagaataatttggctactgagtattgtcacccagcccctccagtctcaagcctgtgaggggccacgggttgaagccgagcattgcctagccaacggattaatgcggttttggcattagtccgttggcgtagcaagcacaggctttagtggcaccgaacacctttcggtaagccgctcgaatggctgatgaacggccacttaacttagcacaatttatcgttgactattttgatattaaacaaagacaaagggttagggtgcactaggcactctgtcagaagtttgaatcttactatgccgattcaggattaatgagctacctcaatatcattttcagtttgacagttgattaacaaaattactgtttacaaaaagcaacggcaaattcatcaaaagttaagtacagcttcgtctgccattcgaatactctcccgactggaaggcgtttctgacaatgcccagtggtgaaatttcacttagcaagcgtcctgtgcttggttagtgaaaggccagtatttgagacgtgatttttcggctcaagtctgtgcccaccacgttccggcaattggcagaaatgcctggaagtcggtgtaggaccaaccaactaaacaagtttacgctgattcgaactttttccagcgggcctaagctggctatttttgaactttcaaaataaggatcttttaataatgattcacgccaaatcaaggcttgaaagccaccccatatttccgctaaaataggcttatccaaattttgttatccagaaaggaaatcattatgaataacgtttacctagctgcaccgttttttgacgaggctcagaaggaacgcatccaacaagtgaagtcggcgctgttggctaacccgacgatcaaccccgatggtatcttcatcccagaagaacatcaatttgaagaagaaccttttggtagccgtgcttggcaacaatacgtctacgcatccgatatgcgtcaagttcatcgggccgatgtcgttgttgccattcttgacttcgacatgactagtgcaaccaatgagccagattctggcacaatgtttgaaatcggtgcggccgtggctgaaaagacacccgtcatcgtcgttcagtttgatgcgaataaagaactcaacttaatgattgcccaaggattaacggcctatttcgatgctagtaaagatggtctgaaagaattatctgcctacaattgtgatgacttacgttctaagcccgctcaccggccagtattttaggcacacaacttaatgacacgaaaaaatgctgcttgcaaacgaataacgtttgtaagcagcattttaactaacttgaattgatcatccttattcagcagtattcacgactaatcgtgactgtcgccgcgcctgccagcgcttattcaattccagcacgaatgttggaatcagcgtagctactagcaccgttaaccatcctaacgctggtagtgtcactaagctaaagaaactacggaacggtggtatcactgcaattgccaagaccaccagaattcctaacagcaatcctcggttcagcattggattacgcgtcatgcttgaccagctgagtggtcggcgatccttaattgcatagatgtcgatcattgatcctaatgccaatactagaaagaccatcgtcatcccgactggggcttgaccatttgttaagccaaagcggccaaacgcgtaaattccgagggttagtacggtaaaagtagctgcccggataaacaaccgttgaccaaggccccgagctaaaatactttcgtcattggctactggtggttgttgcatggcttggggttcacctggctcttggctaataaagaatcctggaatcccatcagcaagtacgttaataatcagcaattgttctgctaacagtggcgccccccaaccgaagaggactgcaccaaccatcaagaagatttgtgcaaagttgacacctaccaagaattcaacggctttaatgatattctgataaactgtccgaccttccttaactgctgccatgatcgtcgcaaaattatcatccgttaacaccatgtcagcggcttctttagatacttcggtacccgtaattcccattgcaatgccaacatccgccgctttcaatgccggcgcatcgttgacaccatcaccggtcatcgcaaccgtcttaccaagactttgccaagcctgaacgattctaattttgtcactcggcgacactcgggcgtacactgcaatctgatcgatttgagccgtcaattcttcatcgctcaattggcgtaactcatcaccgctaattgcttgcagctcaggggttaaaatgccaatttcctcagcgatagccttcgcagtaaccaaatgatctcccgtgatcataactggaaaaatacccgcctgtttggctgctcgaatggccggaatcacttctggtcgtggtggatcaatcaaaccaatcaatcctgccaattggaggtcagctgtcaggtcgtcccagtcagtagtttggacatccgcgggaatgatgcgatagccaacagctaaaacgcgaagcgccgcctgcccaaattcatcatgggccacttgtccagcagctaggctagcttggtcaggcttcagtggtaaccgatcccaagcccctttgacgataactaaccgtcgaccatgcgctaattcatgcaccgtcgtcatcatcttcttagttgagtcaaacgggtcttccgcaattcgtggggtctgcgcctccaagctgggccgatctaaatcatactgagccagccaacgaataacggctaattccgttgcgtccccaatagcttgttcttcaccgtcaacgtggttgatctcggcattcgtcgctaatcctaagtaacgcatcaatgtttgtcccgctgatggcaagggctgttcggtcgtcataatgcccgtggtcggcgtccaatactttgtaattgtcattcgattttgcgtcaaggttccggtcttgtcagacgcgattacatcgacactcccaatcgtttcaacggcactaactcggcgcatgatggcatttctgtctgccatccgtcgaacaccgtgtgaaagactaatggtcacgatgatcggcagagtctctggcacggccgcgaccgctaatgaaaccccaatcatcaagctatcggccaaaccttggttttgcacccaaacactcagcgcaaaaatcgtaataccacctaagacggcaaatgtcgttaaccagcttgatagccgattaagccgcccctgtaatggcgtggcccgttgcttcgtcttgttcaacaaacctgcaatttgacctaactctgtggccattccggtcgttaagacctgaatcaatgcagtaccggctgtgacggccgttcccgcatacacttgacagttatcatccaactcaccggtgtcctgataaatacttttttcaacagcttcactttcacctgtcaagactgcctcatcaacggctaagttcgtggcctctaacacgaccgcatcggctggaacctggtcacccgcttttagtagcactaaatcaccgggaacgatttctggtgccgcaatcgtttgtaccttcccatcccgtcgaacattagctgtgggtaaactcattgacttcagtgccgccaacgacttttctgcggaagcttcttggtacaaaccaatacagacattaataactaaaatggcgccaatcacaatggtctttgtccagcccccattctgggcaagagccaagtacgtggctaaaccaactgcaaataataatactagcgatgaaacgtcgctcatatgttgccaaattttacgccataacggtacggggcgcgcagccactaattcatttttgccgaatttagttagctgggtcgtcaccgctgtggtcgttaaaccggactcgggggtaggtttgaatggtgcattctgataattctgcatcgtttattcctccgtaattcgattatcattgtcattcgtcactattaatgatagcggaaacattttgtcgttttacgtacaaattgtgaaaaagtcgtgaagattagaacgtacaattaaagcagccattaaacattaaccacaggtcatcatcaaaaaactgttcaatttatgactaaaatcaagttaccagccatgaatattgttataatagaacacaaatattccttggaggcacgttatgaaaatcaaattaatctcaactagtgatgtgcacggttacctcgcgccaactgactacagtcgtcgtgataacatcgcaccatttagtcttagtcgtgccgctactgttattcatcaactgtcacgtgaagatacggctgatgtctggccaatcgtgattgataatggcgactacgtacagggatcaccgttgacctatttcattgctcgccaccaccaagaagctgcaccgttatactcgcgccttgcaaattgcaaccacgttcaagccggtatttttggtaaccatgaattcaactacgggctcgactacctcgacctgtgtgaatcaagccgccaatatccgatgctggccgccaatattcatgatgacctgcaccgcaccttattctccaaaccatacacaattctggaacgcgccggagttaaagtggcaattttgggactaacgacacaattcgttgcccactgggaacaaccacatcacattgccggcctgcactttgaggacgtggttgcaactgctaaacattgggtgcccaaattgcgccaactggctgacgtcgttgtcatcgcctaccacggtggtcttgaacgcgatccccaaactgatcgtccaaccgaacgcatgaatggtgaaaaccgaggatccgcactattagctgaagtacccggcattgatgccatgattactggccaccagcatcgacaattagccgttacggttcacggtgttcccgtgacacaacctggtatgaaaggtactaatgttgctatgattacccttgagctcgaccgcaatcatcaagtgacgaccagtcatccggaaatctatccggtcgcagatgccacccccaatacccaggtaatgcaactagttggaccaatcaatgaccagatggaagactggttagacacaccacttggccaaattaacggcaatatgctcgtacacgatcatcttcaagcacggctgcataatcatccttacatcgattttattaatcgcgttgaaatggccgcaaccggtaccgatattgccgcaacagcattatttaatgacgacgtaccaggcctcaaacaacacgtgacgatgcgggaagtcatgaacagttacgtctacccaaacaaacttgccgttgaagccattactggtgctgatttacgcgccgctcttgaacgttgtgcgagttactttttcctccaagacggacacgttcgggtcaatcccgagttcatgcaccctaagttgcgccactatgtctatgatatttacagtggcatcgactatactttcgaccttaccaaaccctttggtcaacgtgtcgtccaactcgattatcatggggccccagtcaccgctgaccaaaaattaacggtcactctgaatcattaccgcgctggtggcggtgggaattacccaatgtatcaaacggctaagattatccggcgcttacctactgatatgaccgtattaattgccgactactttgcgcaacaccccgtcgtcaacgcaacgcaaccgactaattttcaagttcactattaagactaacgcgacaaacccgctcaaatatgccctatttgagcgggtttgtctatactgacgttcacaacgtttggtttagcatcgtcgttaaaccgtgccaattaacctttgtcaatcgggaatcataacagcactgaccgcaagtcgtgccctcctttgtgagcacctcacaaacccagcatggtaatcaaaaggtgcccgtcatacgagctgcaatccccacattaagaatcccatggtcagcggcgcaatgaccgtacttaacatttgcgtcgccacatactcatctggtgccaagtggttttggacggccaacatggtcgcgatggttgcagtggggattgcgagtgtcaagacaactaattgttggttacctaatgacacacctagactagccataatcccccaaatgagcaccggtaagcctaaatttttcagtagcacgtttaagacaaccatgcgcgtcagtcgccacggtctggtcgttaacagaagccccagcgcaaataacgccacgcccccagctgcttgtcccaactccgtaaaattcgttagccaagcactgggcaaccgcaatccggccaaattcaagagaaaagcactgattggcgcccacacgactggttgccgactcgcacgacacagtttctgccaaccggctcgccaacgttgctcaggtgtcgaaccgcccgctagcgttaacagcaacacgctcactggcacttgtaccaaattcatgtacaggccgcctaacgcgaccaataaaacactgattttaccaaaaaccaccagtaagacggaaacacccatgaatggaattgaaggactggcgatcactagcgctcgtaacgtccccgtttctagttgctgatggaaacagcattggctcacaatgacgatgaccatgccacctagcatgcctagcgccaaccacagcgcgaccgaggagttttgaataatggtagcgcgctttaatgacaagattcctccgaaaagacttaacggcaaggcgtaatgcatgaccaactgaatcaaaatatcactggtcgttggcgcaaattggtgccgtagccccgcaaacacgcctaatcccaccgtcacaacaattggtaaaattgctaatatcagtaacattcacaggcccccagacttaataattaaaactgagtgtaccatagtccaatcgctgtgatagtcaggttgctagtcaacaatcggacatcttatgacgtttcattagtctaattaggggcctacctcatattattaagcggccgcgccacactttttacgataacaacgaattttctaatttaactagctgactccgacaattaggtgattagccaaataaaaaggatgctgccagtggctgcatccttaataacgatgaaacttagaaattaacttgatcaggatcattagctaacccggcaacaccgtggaaaccatcaatgaccttcatatcatcatcgctgagttcgaaatcaaataattccgtattttgtttaatccgatccgcatgaactgattttggtaatggtaagaaaccgtgttgtaatgaccaacgtagcacaacttgggcaacgctcttatcatacttatcagccaacgtctttaattctgggatactgaagatcttaccagtacctaatggactataagcttctgataaaatgtcatgtttgcggttgtaggccacaacttcatcttccatatcactaggattgaggaagatttggttaacggctggcacaaccttggctgtcttaagcagcgcgtctaaatgcttaggccggaagttagaaaccccgatagcccgtgctttacgtgccgtgtaagcttcttccattgcccgccaagtatcggcgttcaattgttcccaattgtcgcgcattgcggctgggtttggccagtggatcaagtagaggtcaacatagtccaaacctaacttagccaacgaggtatccagcgccttcttggcagcgtcatagccatggtcggcattccataatttggtcgtgacgaataggtcttcacgtgccacaccactatcggcaatagctttaccgacactttcctcgttaccataggccgccgccgtgtcaatgtgccggtaacccgcctttaatgcggctaatacggaatcgtaagcaacctgaccatcaggtgtttgccacgttccaaaaccaacaatcggaatcttagtgccgttatttaacgtgtacgtatcggtgagtttagtcaatgcagtcatcaaaaatgcctccaagaatttatttgttaagataattctacccataaccgaccacttccggcaaacattctgttccaaactaatgacgatacgcaaaattcgtgagaaaatataaacattctgatgtgggaggggttttgatgagcgatacggcagttatgttaaaaaccacgttattggccggcgccattttgctagaaaatggggctgaaatcaaacgagttgaagacacgatgcaacgaattgcaaccaacgcgggctaccctgacgcgcaggtcttcgtactgttaacagggattaccgtctccttgccggaaaatgccactagcgaagtgcgagcaatccataatcggggtatggacctcgaaaaagtggatcaggtcaacagcctgtcacggcagtttgctaatcacgatattgacttaactgaatttgccgcagccctcgaacgggtcaatcaagccgtaccgaccttcccattcagctggttatgtctagcggccgttgtcgttagtgtgccgttgatggtcgcctttactgggcggacaactcctgccgacttgatcacttgtgggctagccgggttggctggttttgctgccttttattggatcaatcggctggggtcaattcggtttctcagcgaatttatgggcgcttttattattggtctaattaccctactcggcttttatctcactaacggtcattatcatcccgacgccatcattattggcgctgtgatgccattagtgccgggtgtcgccattactaatgccgtccgtgacacaatgacgggtaacttgctgagtggtcctgcccgcgctgtagaggccgttttatccgcgtgtgcgattggtgttggtatcgcactgacttcatttttctactaaaggaggcgtgacatgctacattggctcttaacaaccggtttatttcaaattatcttagcttacttagctacggctggttttggggtacttctcaatattccgcgtcgcgccgttaacctcagtggttgggtcggtgctgctggctggtttacgtatgaggtcctctatcacatcctgccattaggaatcgacgccaaacttgcgattggtaatctcgtcgcagctatcgtgattggcgtcgctagcggtatggccgcacgctacaaacgaatgccgatgatcatctttaatatccctagtctggtcccactggttcctggtggccagtcttatcgagtcgttcgtaacttggtcactggtcaaccagacttggcctaccagtactttgtacaagttgtcattattgctggcgtgattgcaattggctttctcgtcgctgaatttatcaatcacattactttacactttgtttaatcagaaaaatcagctagtgcatctttgtcggttagcaaaatgacaccacgttatcttgattttcagctgttagacttcttaaatgattagcaaaaaatagataacgccttttactaagtacttacaataaaagtaagttaataggtctaatatagttcaaattgtgggcttataagcctgcaacatttacaataataattgtatttaacccgagattttctaacttggagggagaaaagctcaatttattatttagatactgacaaaataagcttagagaaaaagaaaaatacccttggtaagattggcataaaattatgaccttcattaatatttttcaaaactgtaaattcaattaaaatactgcctaattacgattctacagctgcaatttcaatgtgattgcgaagccttaaaaagtagtatacgaggagaatattacaatgaatactaagtctaatcatctcatcgaatggctgctcaccttattattaataatctcaattctgataaatgttggttggtttatttttcgatatggcggtcattactactacatgaaaatatcgagtagtaccggaacttcccccattacactaccggtcaatatcccagctactgggtatcaataccaaggactagcaactaattctaagggcgaaaaaaagtatcttcattttaatacagttgctgctgatccagccccattcaaacgcggacaaattgtcagaatcacattcaatcaaaggtacggcgtaaccaactataaattagttcatcggtaacacgattacttcaaaaaagccgtcataacgattggtttatcacttatccaatcgttatgacggtccatccattactagaatgatataatctaaaaagtcagcaactaatttatagtcgctgactttatttattcatgatatttgcggcaacaagcttagccaaaagttacgcttctagtatttaatgaatcaacgtaaagtagccaatcacaagtacccccaggacaattcggtaccaaccgaacgccttgaagtcgtttttcttgatgtaatccaacaagaaacgaatcgacaagtaagcgactacgaaggacacgatcaccccaacggctaagactgctccttgcaaaccagctaaagaaccaccgtgagcaaagaatttcacaagcttcaataatgacgccccaaacattgttggaattgccatgaagaatgaaaactcagttgcgacgtagcgtgaagttccaatcaagatagcccctaaaatggttgcaccggaacgtgaagtccctggaatcaacgagagcaactggaagcacccaatgaacaatgccgtcgtataaggtaacgtttgtagattagcgaagcggggtgttaagcgcttattatgattttcaatcacaatgaataggaccccataaataatcaacgtggcagaaacgaccgcccaattcattaaatgttcgtccatccaatcatttaacggtaaccccacgatcactgatggaatgaccgctaataacaccttactccagagaacccaagtatttcgcttttccgtggtatccttgcgtggtgacaacggatttagtttatggaaatacaggacaacgaccgccatgatcgcccctaattgaatcacaacgttgaacatatccgtaaactgcgtggactgttgcatcttgataaattcgtcaactaggactaaatgccccgttgaactaattggtaagaattcagtaatcccttcaacaatccccaagattaccgctttaaaaatatctaacacaatggattcctttcttgttggcaatgattatcgcttgataatcccaatacataaagatttacgaccatccccgatggccggtatatcaacattatagcaagcagctactcaagatagtagcgtccatgtgtatttttttggtaaagattaatttgtcagcgctgccaacgccgtactaaatacattttgcgtttggtcatcaaaacaaacaatcgtgattgtctgaaccgtgtgggccgttgtctgcgcggttgcttgtaacgtttttaacgctaacggtgccgcaattgatagcggaaagtgatagacgccggtactgatagacggaaaagcaaccgtttgacaatgattctcagcggccaaattcagactgttgcgataactgttcgctaacaattgtaattcattatgctggccaccttgccaaacgggacccggcgtgtgaatcacatacttcgccggtagtcgaaagcccggcgtaattttggcttcaccagttgcacaaccgtgtaatgggcgacaggcagccagcaatgctggcccagctgcccgatgaatggcaccatcgacgccgccaccaccaagcaaactcgtattggccgcattaacaattgcatcaacggtcattttggtaatatcaccgtgaatgactttaatctcaaccatcttaaactgcccccataatcagattaacactcgtttgggcctgttgttttagctgtgccccactaggatcctgttttgccaataactgaatgccgctgcgaacctgcattaaacttgctgcagcctcagcgaccgtggtcggtaaggttttagcctgaggtgaaagtaaaccgacgagtcgggtctgtaaatcagcatagatcgtttgcagttgggccatcaaggacgcatcctgcgacccaatttcggccatcaggttcaccatcaaacatcctgctggccaccgttcactctgaaacggcagtcgcaaacaagccgcaattaaagcgggcaatggtgtttgccgcgcccgctcacgttgaatcaattgatcaagttgttcatctaacgttatttgatagcgttcaagtgaacggcgtaacgcaacccgcttactgtgatactggcgataaaactgcgttcgtgacaactggctaacggtgagcaagtcgtcaactgtcgtttgataataaccacgctgccaaaattgaatcatcattgctgtttcaaccactgatgcgtccttaacaaccatgctaaaccctcctgaacctaacgctactacattaatcagcaattaaatactgaattccgcgaataatcgaccataagtagctagccactgcgactaatccaaataccgctaaaagaaccacggccaaccagccactattaacgatactgtccatataaataccgctaacgcctaaaataacgagcagtgtaattcctaaaattgtcggcaacaaatgtaaccaaaaagcccgtcctgcaacccgatgtgcttctggattagtactcgtcagcaaccaaacaattaatggaaataaaactggtaagaataaaatgcttaaatagctcaacgcgttaatcacccgattttgtgtcattgttataacctccaccgatatttatttcgagtatagcgaaagtctggtacttcggcaaataataaacaaattgttaaaatacttaggactctcccaaggttacgcgccgaatgttaacttacgaccacggtctgctataataatgacataacctaaccttgcaatcgctagttgccactgtacaacccgggagcgaacggttcatgttaggatttaggtgcattagttaagatgcggaggaaaagaaaatgacgaaacgaatgagtttcaaatttaaatgggttgccctcgttgccaccctgatcgttgggattggcagctggcaagtccttgcgcacgctgacagtagcagcgatgaaccaattgtcacattaggcagtagcctgactagcagtcaaaagactgggacgatcaacacgttaacggctagcttgaacggtgccgattatcagacgctaactgttaacggcgatactctagttaaatacctcaacccatccggtgaaagtttcacaagtagctcaggtgtgtggtccagtgcgatgattcaaaaaacaagttctggttctggaattaatgtcaaaattttaaattataatggtagtaataacatcaccactattacggctaaccagtataaaaacgccgcactaacggctgggattaccgatgctaatatttacgtcacatcagctactccaatcgacggttcgggcgcactagccggtgtttacgcagcgtacgcaaaatctggtaacagcttaaacacgaagcaagtaaccgccgcccaagatgagttaagtactctcagtggcatcacccaagcaaataagagcaaggatggttatactgattcccagttgaacaacgctgtggctggtgccaaaaaggaaatggcccaaaaaggaagtaacatcactaaaaacgaaatcacgaccattgtcaatcaacaaattaccaataacaatttaacaaatgtcattactaataatcaaaagactgaaattattaatttgttagtcaagatccgtgattcaggtgcattagattcttcaagctttaagactcaagccaactcgttgatgaagaacattcaatcaaatgccaagggtgtcttcagcaaactcaatactaaagaaaatcaaaacttgctccaaaaaatgtggagcgcgattgttaacttcttcagctctattttcaaatcaatctttggctaattattaatctcggatactcaaaatcggacgacaaaactgcaatcagttttgtcgtccaattctttttaagccttgaagcataccattaaataacgatcactggcttggcaaactattcaattgccaagtgatagttccagaataatttttagccatcacacgaccacccttgacgtgcaacgcaacgttattaacattccaaatttgttgattagtcccgacgccttgttgactagtcgtcccagctattaacgtttgttgggtagcacctggggttaacttaatcacggctggtaaggttgcctgattttggtcagttgccgtaacccatttactagtactagcattcaaatattgcgctgttcctgatgttaacgtcacgtaactacccgtcatggtcgtcccatcagtagctgtcaacgctgataattgggccgtcaattgccaaccacttggggtgtcccgtgtatcagtcacttgtgtatacacactatcctgcccatttttctgaccaccaactgttgcatacttctgtccatcagtagcagtagccaattggtcttcagcggctgatggtgacaacaatgggtacgctgtatccattgttggaatgctgtgctgtccaaagttcaaatgtgtaggtacagcgtccaacgataatgggcccaaattgttcgtcccgccagtcccaggcttgctaggatcatcaggatcaattggattgacgattaaatccttagctactgtaaatatcggtgctggttggaaagtcgcatcatgatactgctgcccatttggataactattaggatcaggattacgatttcctagactatcagccatataaataataatcttgtcaccaatttttaacgataatccggttaagttcagtgaccaagtcccattggcattggcaaccgttttgacattagtttgaatctgcccattcaatgctaatgtgacctgcgcacctggctctccattttgaccactcaccgttcctgttgaaactctaatggggtccggtgataccattgtggccggattaggcggcgtcacatcaaccaccgtcccggtagccgtgaccgtcgttccactggtattgctagtcgatgctgtgaccgtcgttccagcttttaaaaaggtcccgacattagctgttgcgtagccattactatcagtttgggcagtgattgtcttaccattaacgctataactcacggttaattgccctgcactagcatactgtggaatataattaaccgttccgtcatcttgaacaccattagtatcaggaaccatcgccacaatgactcgcgtccgcagcttctgatccgcatctgttagcttggttgtcccatcatacggattattaaatgctaattgtggcttctggttagtggcactaatccgacgcattttagaagataaataattactttgcaaattactatccgtggccgtcactgctgaaccctgttgtaataactgagatacgttactatacgaataatccgcaccgcccgtaaccgatgatgctaatttccacaagctaatattactatcttggatttcaaaagtgcccacattatcttggttaatcgaactagccgctgcagtcgttccagttgagctattacgtaaatccaagttgttcggattaataaatcgaacagtagccaaacgcgcgtaatttcccgaaataagcggtgctcccgtagcagcaattacataaatattggcaccactactactttgaatcgtcgaagttgcattatcagaaaaagagattggcgattgacttctagctagtgacgttagattaacggtgctaccagtatccgcgtaaaaattacgatgatattgtgacccataaaagtacttgttagagtatgcatttcctggcacgctagcattaaacgtggcatttttacccacattaatactttcatacgcatcaaaaataaccggataggtagtataggcggttgacgtagaactagcaggtcgtcgaatacaatttagcgtcgcgccttcttcaacattaacttgccgattaccagttccttgatagtcataaacaaaccagataaatgaattatcatcaccattggctattttcgatccagtgaatgtctgtccagcagctacatcaaggccaccacataagatgttttctcgaaccgttgttactcggcaattgccggtaatattgacttggttcccttgcgcactgacaaatcgccgacttgtattggtataactagtcccacttgggaccgtaatattactaacattaaatgtccaattcaaagcccctccggcaccatcgccaccggtggatgagccaatcaaacccgcatcatttccaaaagatccgattaatgatgcaaaattcataaaagtggccgtgtacatcgtaccgctagttgcagtattatttcgggtatgaaaaccagcccgaccaatattcacgctatgaccatttccattcacaataatattaccggataatcgtgaatccaaagcacctgaagcggcagtcggattactaatatcagccgtaatattaatttcatcaacactcgcatccttccaagcatcgactaattgagaccactgactaacatcaaccacattcgaactcagctgagctaaacgagtgactggtattaatggactagatttggcactcgccgttgcttgcttagttggtgctgatgagaacacttgactagcagtggatgacgatgagatgctggccgaactatcagttgtctcacccgcagattccgtgaccgatgacgattgattagcagcagtttcttgtgaaggctcgctactgctagcactcgtttggtttaccgcctgacttgaaagcgtcgttgccgctgaacgtgaactgtccaaacttgctgctgatgatgtcgcttgtcgacttgacgatgccgtcgaactatttgtatcggttgccgctgaagaactagctgaactcgtactggcctgatcagcctgcgtttgtggttgcttaatctcgacattcaacgccggccctttttgatcatcggctacagcaactaacgccagtttttctgctttaacagctgttaatctaattggtaccttcgtttgcggatattcatctgaccactgaaccgttatcctgcgcttatcaggattgtacgaaactgtcagatgcttagccgtaattgtaaaggcgccattatcccccgttgtgtactgactatcatcgaaaactcgttttatttgcttaaactcctctggcccatctaaattaacctcgttcggtaaatcaatcgtatttattttagaggccgtatcaccaatctgtagttcaacatcaaaatgttgattcgttaaaatattatcgctagccgttgattttgcaaaagttaactgtggtaacgtagctgcttgagcggtcatatcggcgcctaagcttaccgttgcaccagcggctatgacttgtaacaataccatcaatatgacaacaattgctcttagctttttgatagtatcaccccttagcgcttattttgacgccgtttaattacccagaatatgattaaagcaatgagcaataatactaacaacacgataccaatcaaccaaccccaagtagttggagacgtgacgttaacagcatccgtagcgccaactacaaaatcttgctttagcgaccagacatgcggcttagcgaacttttcatccgtagttcgatacttgacgtatagagtgtaagtcccaggtaaaatgatcccccgattagtacgccactttaatggtaagtcaaagttagaattaggagccatcgaactactttttagatcagccaccgcgagctttttggtctgcccagctttgctaacgtaggcagtgacagtccctttgcctagaattgaagcgtggtaattttgaatattaccgataactgtcttgatgccactccgcttttttaattgaacatcagccaagcgtaattttggcaatggatcacgatttgacgttagtttgatccccacattgtaggcatattcgctagttaacgtcgcccccttggttttaagatgttgatctgcaattttaacttgccaacttcctaaaataatccctttgttcaatttcgttggcgtttttaactgtgcccgcacgatccgtgatttattagctgggatcgtcgtttcctcatccggtacggtaataatatcagctagttttacttttaaactagtatcatcattcagattagcagcaccataatcaataacacctttcgcattagtatacgattgtaggaattgatttttgactttaatttcatgatttgagcgattattaacacgcatcgctaacgaatatgttctcttcggttgaattttaaaatcccaataataagcgtcctttgataattgttgcttttcattaagcattggctgaacatcaaaagttaccgcattattggccgtgtcagcagcatggccaatcacagtcataccagccaacaaagtcattattagggttaacatccctaataatagcttcttattccagccgttcataaaagggcctcccttcaaaaaaacgagttaactattcaacatagccactcgttttcgttcattaagccgttggtgtcgagttcaatgtccaaacaatattccctgaataattcttagcggctgcgtgaccacctttaacatgtaattgcacattattaatattccagtattgttggttgacccccataccttgaccgtcaccaactttagaccctgccgtggctgttgcaacatcggttgtcgatgaagcgccggcattgagcacaattggtgttgcaacggttgcctggttcgcatccgccgcagtgacccaagattgttgattagcttcccctgtcagatattgtggtttcccaccacttaaaacaactgacgcgttcgttaacacttggccgtcagaagccgtaatatcagaaagctgtgcctttaattgccagccagcaccagtcccccgtgagtcagaaacttgcgtgtaaatgatatcattaccatttttcttaccactagtcgtcacattttgggtcttatcatcattagctgtcgcaaggctctcctgactagcatcttttgaaagtaaagtgtaggccgtatcaacattaggttgcgtatgcgtcccaaaattaagatacgttggtaccgcatctaacgaaagtggcccgttgttcccagtaccaccgccgccaggattatccggattgtctggatcaacaggattagtcgaaccaccgttagacgtaaacgaaacatctgcttgagactttccagttgaaggcaaggtgtcagcggaagctcctaaattattgaatgataaacaagcaatactggctactgaaaccaacatagctgctttgagcgtacgtgactttgtcataagtcaattccccctaaaatttaattagcatattaatcttcttcatcaatagcgcgtaatacctttttgtacaaacatattaatatttaaatcaatattataaattcacctttattaataaacttttagcaaactaattgacgaagaatatttatatgtctatactggataacttaaatcagtcattatccttgaaccaattaaagcataccaattaaagttaatcaagtacactattatgtacgtttactatttgtataaaattcactatttttgtaacttatgggggaggaactgtccattgaattttccagagctcaaactttctcaaacagaacgcgatttcaattttgattttgctatattggaacatgatttaagttattttttcgaaaagcgttgtcttgactacgccttggaacatatcaatagatttaatcacaaaatcaaggataacttatacaacgtccgcccactcattctaaaagaagccttaatttcactaacctgtgatctagcaagtgtcagcttttatcattatttgaacatgatcacattcgttaacttaagaaaggacattttgcattacctcacaacaacaacactaacgaatgatgattttatgccacttttagagtcaatcgttaacaattattttagcaatcttgatacacttgatattccaattgatggtacccgcctctctaagcaagtcgcgctagttgtctattatattgataatcattgtgatgagccattaagagcaaataccatcttagaagaactgacgttagatcctgaatacactaagcgtaaatttcgtaaagaactagggtttaccatcaacttctacattcgccacgctaaattacagcgagcaaagcaattattaattaatacccatcttcctataggtgaaattgcagaaagaatcaaattttttataaagaagaataaataggatatggtagattgtaaaat

SEQ ID NO: 43 - DNA, 31475 bp, Lactobacillus plantarum
aaatttgcaatctaccataaatctaaaatgcgcccgttgaagttaagcagactgacttcagcgggcgcatttgttagcggcaattttaaatttattatcctgattgatgaaactttagcgaatcttagttaagcgttttgcaacggtcttaatatttagtagatcccaatcttccaagttgtgtgaaatcgagttatgcccccatgttccacaaccgagtgttaaggatggtgcgacgttatcatatttataaccaatggcaccttgtgaagacggcacgttgatcaatgctcgacaagcagtcatttctaaggcaaacttgttcataacagcttcgtcggtcgtatgcaaggcggccgtatgtcccagtccgccaagtgctaggctgcgtttcatcaggttgaagccggcctcagtatccttggcatgaacgacggcgaggactggtgataacttttctcgtgataagacttggtcaccaccgatgctaggcaattcaactgctaatactttggtatcggatgggacatcaaagccagcccactgagcgatttgccatggcgtttgcccagctactttcgggtcaacagcctgtttatccaggttcatgacagttgcttctaaggccttgaagttctcggtaccgacaaagtacacaccgttgtgacttaattcacgtttaacttgatcatagatttgatcagcaacgattaagtttgattcggaagcacagatcatgccgttgtcgaatgacttggaagtgacgacatcactgactgcctgttgaatgtctgcggtttgctcgatgaagcatggcacgttaccagggccaacaccgagtgccggtttaccagttgaatacgcggtcttgaccatgccggcaccgccagttgcaataatggtagcgacgcccggatggttcatcaaggtgttggttgcttcaaggctaggcgtcttgatccactgaatccaatccttaggagcgccagcggcaatagcagcatcgcggatgattcggccagtttcaacacaagatttttgtgcaaagggatggaaaccaaaaataatgggattgcgagtctttaatgctaacatggcattgaaaatgacggttgatgttgggttggtaactggggtgacccccgcaataattccaactggttcagcaactttcatcacgccactgactggatcgtcattaatgataccgaccgtcttgtcatccttgatgtagttataaacgtttttggctgcaaagtcgttcttcgcaactttatcacgataatttccgcgacccgtttcttcgacggccatagcggccagcatgccacgagcagcgtgggcagcgcgggccatggcagcgacagcctgatcaacttgactttgatccatgacttcaagacggttggcagctaacgaagcatttaagactaaccgatcgattgaacgtgatacggttgtttcttccatttctttcagcattcacggttcctcctatgcaaaatcaacttgtttcttatttcacaatcactattataaatactttttcacaaatgtaaatagctaatatttaatttcataaattgcttttaaaacactataattattgatttaatagcgtatataaatgtaaataaactgttcgcttacattttcaccgaacggatttctgttataatattcacaattaattattgattaaattcgaagcaacttttggcttgatctgtaactgattttatataaatggaagggtttacaaacgggcggttgtcaaataagcaagaattgacggggaatcgttggttaataaatatgacaaatcggttatcactcctatgtaaaatgtgctaaaatgaatgtgattcaaaaatcgtatctcttaattaacctaggagggttattttatgtcatttgtaaatgctgttgatatgacacaagacgcatacaagaaccattatgctattggtgcgttcaacacaaacaaccttgaatggactcgttgcatcttgaagggtgctcaagacactaacaccccagttattatccaagtttcaatgggtgctgctaagtacatgggcggctacaagctcgttatggacttagttgctgatgaaatggaaagcatgaacatcactgttcctgttgttatgcacttagaccacggtaactacgaagctgccaaggaatgtatcgaagttggttactcatcagttatgtttgatggccatgacctaccatttgccgaaaacttagaaaagactaaggaaatcgtcaaattagctcatgctaagggcatctctgttgaagccgaagttggttcaattggtggtgaagaagacggtatcatcggtgaaggtgaattagctgatgttgaagaagctaagactttagctgctactggtatcgacatcttagccgctgggattggtaacatccacggcaagtacccagaaaactggactggcttacacttcgatcgtcttcaagaaatctcagaagccgttaagatgccattggtacttcacggtggttctggtattcctaaggaccaaatcgttaaggctgttgaattgggtattagcaaggttaacgttaacaccgaaaaccaagttgcttttgccaatgcaactcgtgcttacatcgaatctggcgcagaccaaatcggtaagggctacgaccctcgtaagttattggcacctggtaagaaggccatcgttgatgttgttacatcacggattggctggttcaagactccagctgttaaataattggatttttgattcagaaaaagtcgactcctcggggtcggcttttttcctgcgcttttttggggaacttgggactgacttatcacctgggagtgccagtgttagtgtgcccttttctggttgctattatcggggaaccgattatagcgtgatttttaattttgcggtttgctaaaataacggtaacttaatgggatgctgttggtatccaattgaatgaaggaaaaaatgaggtcagtgattctcgcatgccgagggtcactgacctcattttggtgttaagaacggataactaaacattaatcgcgtcttgcaattgctgctcattgtaaaaaattaatacgataaacatcaccacgtaaagtaataatggtaaccacgcatagttcagggtaatcatatgctgagtggcgatattttgcgcatgattggccgtgtagccgcttaaatgaaagagtccggcggtgactaggccaccaagtcctaagccgacattaacgccgaagtcatcagtagaggctaaaataccttctgcttgaattcccagcgccgtgccataacggatcgtatcagcaatcatgattgagaccaaaccaatgatgagaccgttaccgacagcattgatcaacgtaccaccgaagacgaaggccagttgattgatggctgtcccgagaccgaggatcagttgccccacagcggcgattgcgatacccgccaacatggtattctttttcccgtggtggttggctagccggacaattaagatgaccccgatcagtgacgcaaacgtaaagccgttaacgactggcactaagtcctcacgctgaatcaagtatttaaagtagtagatggtcgtttgattcttgatggcggttgttaaccaatacagtaaaatcacgctggataaaataaaccacggctggttttgcttgagcatgccccacaccgcactgagtgattggtgcggacgctcaggttgactaaagcgttccttgacttggaagaaggtgttgaggatcagtaccaacgaaataatgccaaatagaacgattgtcagtaaaaaccctcgttgctgatcaccctgaccaaataaagcaactagtggcaaggtgaagacagcgacgataatttgaacgctactaccgaagaattgacgaatcacgcctagtaaggttaattcacgttcattctgggagagtgctggtaaaatcgatgtgattggtaggttgacggcggtatagaagaatcctaaccctaaataggtcacataagcccagacgagtttaccagttgctccgaaattcggggtcacaaaggtcaaaacggcgaacaagacgtagggtaacgcgtaccataagaaaaacgggcggcttttaccgaagcgcgaatgggtattgtcaatcatgacgccgataatcagactttcaacgacatcggctaagcgcgcaacgacaaataaaatcgccgctgcactcgtggataggccgtaaacatcggtatagaagaataataagtatgtggtcatcatctgaaagactaagttatccgcggcatcactgagcccataactaattcgttccggccaagctgtttgccaaggttgtttcaatattaacacctctaagtatggttttgcacaatctaattctaacctagttgcacgcttaaacctaacggaaaggtttacaaaattgattaggtcttagattgatcagaaaaaagcctgcaggtggcgttcgtcaacctgcaggctgtgcattgtttgtcctgattaaaagctacttagttgttaatttgctgaccttggtgagtgctgggattaagcccaagctatctaacgtttggtttggtaaaacaacggtgttggcattgccgtccgctaaggctttgacagcttccgtgttttggaagataaagtagttttcggatgattgtgccaaggctttgtttaagatccgcgtccggtaagcatcagcatctgcttcagtttgaacggctgttgctttcgcctttgcactattcactaaagcttcgttttgggctttgttggtggctaataaggcccggttattggcttcattttccagtgtgattgacttactcttaccttcagcagttgcgatggtggcatcccgttcccgcgtagcttgcaggagtttattcatggaagcctgaatatctgccgaagggttaacggaatcaatattgacccggtcaacatttaaaccgtagcccgccgtaacggaggagatctccttgaagagggcggcattgatttcttgcgtcccattcaggacttcatttaattctttgttcccaatgataccacgcagtgccgcgcgggtatcttgaatcatactacgaacggagtcttcgtttttaaaaacgaagtcttcaatattagtgacgtggtacttaagcgaaatcttaactgagatttcagcgttatctttggtgataacgacttgttggttaagatcaacgggtgtctgagccgtgttaacggtgatgacacgtgagatgaacggtttaataaagtgaaagccggaactaatgacgcgctcgaactttccaaatgttaagacgacaccttggttcggttgggtgatgatgcggatggaagcgattaggactaaaacgaccagtagaatgacaataattgcaacgatgatgcctaccataataatttccccctattgttgtggtgcgataatcgttaccgttagaccatgagcactgacggccgtgatttcaacggtatcgccgatgtgcagtggtgttgcggcgtgcaaatggtacaagatgccatagaatgcgacgccgtcagttagatcggtcggtttgataatgaagcgctgaccgattaagcgctgatctaagtatccctcttgcatagatgacccacctttaatgtgataataattaaattatatgctgtttttggttagattgatagggccgttataaaatagtgggtgagttttggattgttgataaagtatggcgataaatggtgaattcatgctgcatatcgctcagtaactatttggataagctcgttttagagggcggttcagtaatacggagttaaaggggcgcttgaagtatttaagccgacaaaaaaaccttcgtacgggaatacgaaggtcaaaaggagtaggtcagcatatgacggggaatcatatgctgataacttgatgagcgtttattcatataagcggggggacgttcacatgccgctcatcaagctgtcaaagttgttacgctttgacggatttcattactttggaggagtaaatgaaaagaatgttaattattatagtagcaatcttggagggggatccttaattgctatagatacatattaacaacgaattgtgaagaaaatgtgacgatgatttttcaaatttaagaattattgattagattacgaaaagatttatgactattgataaatttatcggcaattaaaattgcgtaagaattatctgtcagcgctttcgcaatggtggctttttaaattagagcgtgtatcattaataatgatcacggaaattaaagacaggagatgcttgcatgtacgaacaagcttgtaccacaattttagttggaaaaaaggcgaccgttgatggttcgacgatgattgcccgtaatgatgatacgtttatgccgattacaccgcaaaaatttatcgtccatcccgctgttcatggtcgcaacgaaacgttaacttctgggaagaatggctttaccgcaccacttccaacagatggttaccgttaccaagctgtaccaaacattgaagtcgctgaaaagggtgtttttgaagaaaatggctttaacgaaaaaaatgttggtgtttcttcaactgaaagtgtttatggtaatgaacatacgctgacttttgacccattcgtgcctaatggtctcgcagaagattcattaccaaccatgctcacgccgttcattgattctgctcgtggtggggttgaatacttgggccagctgatcgctaaatatggttcgccagaaggtaacggtgttttgttcaatgataaagatgatgtgtggtacatggagatcgtcactggtcaccactgggttgcacaacggattccggatgatgcttacgcggtggctgccaaccaagttgcgattcaatgggttgactttgatgatcccgataactttatgtggtctgatggcattcaagaatttgttgcggaacaccatttgaatcctgacaaagaaggctttaacttccgtcatatcttcggtactgataatgaaaaagaccggcattataatactccccgggtctggtacggccaacgttatttcaatccagagatcgaacaagatccacagtcgagtgagctaccgttcatttgtcacgcagccaagaagatttcagttgccgacgttgaatttgtactgggttctcattataacgaaacgaagtacgatcccttcttgaatacaccagaagctaaaaagtttcggccaatttcaatgaatcggacgcagaattcacacgttatgcaagtgcggaatgacgtaccagcagaacaaagcgcgattatgtggatgacgtttggggtaccagcttttgcgccataccttccattccatgcgaacgtttctgaaactgatcctagttttgcgaacacaccgctaaaacatgatatgaatagtgcttactggctctaccggacactatcaatgattgttgaatcacactatgctgatttcgttcaggatgatattgattatttgaaagaatgtcgaatcgaactgggtcaatttgtggctgcgaccgatgaacaagcggcgaagttatctggtgacgagttaacggctttcttgactgaacaagataaagtgatggtcgcaaagatgcgtgataaagcccaagctttgattggtcaattagtcaccaaaggtttaacgctctcgaaactaacctataatgttgatatcaatctttaaactttcgttatgacggtatcagcgtgtataattaagttattaagaggacaaggagctgatggcaaatggatgaaaatgtcttatttaatcctggtgacgcaatttcagaatcgcatgactacaatgaagcgctccgtagtgcggatatttataatgcgcgtcacggacgtaagcgcggactcatgattgcgcggccgctagaacaggatcacggttattcggttttttacgcggatgatttactgacagccgatacgccaagaccagaagcacgtcaatatcacgttgaaaagcgtattccaaaagaatagtgcagtcatcccatgatcagtaaaaaggatcatgggattttttattcgctaaacagtaacccagctagttgatattgggttactgttgttttataatagcgtttaaattgattaacaggggtgcgatgatgacgaatcgacagacgattaaacacctgacccagacggcgatggtgaccgctttgattattgtattaggtttctttccgggaattccagtgggctttattcccgttccgattgtgttgcagaatatgggcatctttttagccgccgagttacttggccgcaaatatgggacgatcgcagttggattgttcttaggattagtggcactgggactacccctattatctggggggcgtgggggtgccgcgatttttctcgggccaacgggtggctatctcgttgcttggttgctggcaccaatgctgattggaacgttgatcaaaataacccgggcgatgacaagtggttattggtggctagaagttggcattgtctggttggctggtatcttatttgttgatgtaatcggtgctagttggctagctgttcagtcacatatgactttgacggccgccttgctgtcgaacgtggcctttcttcctggtgacatcattaaagggactttggccgtatttattgcccggcgtgtgcgggccatcgttgattttgaattgccagcttagtaaatagctaatgtgattggcaggtcaggaggtcataatgacaactaaagaacaggtcttaacaattttattgcgtcatcatggtgagtggcaatcgggggaccagcttgcccaatcagttggctgtagtcgtgagagcatttggaaggcgatcaatgccttgagaaagcaaggacaccagattgagagtcgtaaaaaccggggctactgctatctggaaagtcgtaatttggatgccaaagccattcaaatctatgggcaacgtcaatttacggggccacttgaagtggtcgcccagacgccgtccactcagattctagctaagacctttttaagtcatcatcagccacagtttgctgccttcttcgcggatgaacagacagctggctatggccgtttgggccgggacttctattcaccggccaaaactggactgtattttagcttggttgttcctaatcccacgaatgcattggtcaatgtgggcttactgacaactggtgtcgcagtgagtgtcctgaatgttttgcagcaattttatcctaataagaactttgggttgaaatgggtcaatgatatttatcttaatcagcataaggtcgggggcattatcacggaagcaagtttggaattagaatcgacttccgcaacggcctttattgtcggtgtgggtctcaatttaacgaccaccgattttccgcgggaattgcaagctcgtgcccaggcggtcgacccgagcataccagtggatcgcaatcggttagcagcggccttattatcagtactagtagcgctatcaaaacgctacgctacggccgactttttgccagcatatcgggctaaatcactagtgttgggtcaacaagtgacacttcaagtgggcgattccgtggtgaatggggtggctgaagatatcgatgaacatggtggcttagtggtccgcatgttgaccggggagcggcggacatttacgagtggtgaagtgatcagggtagggttaccagtatgactgagtgggtaccagtgatttacggcatcggtttagacgctgccggtcggtgccaacattatcaccttgaaactgatattgcggcattgtggtgtcggcgatgtcaacactattacgcgtgttaccggtgccatgatacgttgtgccagcatacttttgtggccagcgctccgacggatttagccgtgatgtgtggtgcttgtcgttatcgaatgacggttgatcggtatcatgaggggcaatgcccgcactgtcaccggccatttaacccgcggtgtcggttgcatgacaaggtttactttgaaaagcaaaattgagacgtattttagtagttttggctgaattcagtggttaatcgaaaaacaattaaaaaattgacatattctaattaaaaactcataattaagcttggaattatggttgattgtgaatttgtgctgacaaccattgacagaagggaagcactaattttgaaatttgaagagtccaaaattttgcagcaattaccaaaacagttctttgcgaatctggtcaaaaaggtcaatgccaaagtggcggccggtgcggatgtgattaatttaggtcaaggcaatcctgaccaacccacccctgagtttgttgttaaagcaatgcagactgcaactgccaatcccgcggatcacaagtattcgttgtttcgaggtttgccgcgattcaaacaagccgcggctgatttttacgaacgcgagtacggtgtgaaattagacccggagactgagattgcggttttgggtggcagtaagattgggttggtcgagttaccctttgccttactaaatccgggcgatacaatgattttacctgaccccggttacccagactatttatctggtattacgttggcacaggtgaagttggctttactacgattaacagcggacaatcatttcttaccggattatcagcaggttgatccacaagtggctgcggcggccaagctgttgtacctgaattacccgaataatcccactggtgctgttgcaacgtcgcagttttttcaagacacggtggattttgcaaatgaacatcagattggtatcgttcatgactttgcttatggtgcaattgggttcgatggtcagcgaccagtgagcttcctacaggcatcgggggccaaagacgttggaattgagatgtacacgttatctaagtcctttaacatggcaggttggcgcgttggttttgctgctggtaatgctgacatgattgaagccttaaatttgattcaggatcatctgtttgttagcgtctttccggccattcaagatgcagcgattgcagccttgaacagtgaccaacagacggtccacgaactggttgggctgtatgaacgacgccgtaatcagttctttacggcggcccgcaagattgggtgggagccctacccatcagggggctcattttacgcttggatgccagtccctaaagggtataccagtgaagcatttgccgatttgctgttggataaagcggcggttgcggtggcgccaggaaacggctttggtgcgggtggcgaaggctatgtgcgcgttggactcttgattgatgaaccccgcttcacggaagcctgtcagcgaattgcaaaactgcacttattcgatcgttaggatgacctcttagcattaatgatgacagccaatcacttactgagcataattcatgcaacgggggcgcaactcgtttttgattgctcggaaatattgagctgtaataacggtatcaaaataacgcaactggcatgtgaatgccagttgcgttattttgattcgaggtattgaattattataaattaccggtgctctttaaccgcttctctaacaggtacgcgtccatgtacccaaaggataattcaacgacctgatcgagttcgatcatcgtgccaacatgattaatttgattatcatcatccacgttatagaagatgaagtgcccgttcgttaacgttcccggatagccagtcattgctggcaacatggggttttctgtcgtgatgtgaacgaggttattgaaagttgcggcttgtcgcaaaattgaatcaaaaagatcagttgtggcgtcaaataaccgttcgtcgtttaagacgggttgaacatttaactcatactggcgatttaattcaataaagccacgcatcgtttgtaaatagtcggactgggttgtcaccgattcaattagtgaacggcgacaaagggtgtagcccccaaattggcccgtcatatcgatcagattgagcaggacactatcagcgttcaatgcgttaatgaagccaacaaagaacatgtcagacccgtccgctgaccgaattgcaatcagttggtgctcatttaaagcgttgtttagagtatgatcaacgtcgtcaaactcgctgactttgacggttgctcgatgcgtatggatggtcttgacaaaggcgctttccaataagagctcattgccgcaaaactctaatatctgaatagcagccaatggaatttcctgttgcccgttgtttttaaagttaaatttgtcaaaagttttaaaggtaatcgtttggtcagtgacttgttggacctgaccttctaaataattttcgttgtcttcgaggactagtagcacaacttgatgatcggtttgggcttgggtgactaactgtgttaggactggccgttgatcgtctaaagctacggttggttgtggcacactgttcaaaccttcagtagttgcattttcaaggcgaaaggccatgttatcaaggtcttcactcatcatttcaacttcatcaatgacgtcgtagcgcatgaagacggcgccgtcctggagcccagcatcatcgtaagtattcacgacaacgccatcaggtgccagacggtcgatgtagccggtgtaaaccacttcgctattggcttgatataggttgatgaggtgaacctgttgtgcggctaattgtaaattctcaataattgaactcatcgtgtctaacccccttagttaatgttccctcatcatagcactttttgaggtgaagacgccattataagtcattattcagctggtttggtaagtgtgttatgactaggtaagtaaacggatgctcacgtgctattcaggtcgctcatctcattagaagggccttgttctgcaaatttaaaaccgttttcgcttgcacccggacgctgtcaccggcattgagtgcggctgtttggtatgtgtgcaacacaacacggtgctggtcatcgctacgtaaaaaatagtgtttcgatgatgcgttcacggctagtgatcttaaagtgcaattcgatattcaaatgatgattgccaaaataaacgcatacgggttttttaaaacacaacgtatgtaagggctttctttgcttgtgaaataggagtatcggtcaataagtatccattgataataggtaaatatttaataaaaaatgttattttcggtgctattaacgaggtttatcgttataatgtagtctgcggtttatcttgaccgtaaatctgtcatgacctttcaagaggcgcttgatcgtgttgcgacatacatttaaggagtgcactatgtttacgatgtttaagacgattggcgatcagttcgccaatttcaagattattcggcgaatggcgaagtatgatgatcgggccacataccaaagccattaccttgggttagcgtgggaatttctaaacccactgattcaaatcggaatttattacttagtattcggggtcgcgttaaaacgtggcgatccgatgccaggaatcccgtatttaccatggatggttgtcgggattgcaccatggttatacatgaacaaaacgacgctggacgcgtcttctagcatttatcgtcaggttgggttagtttcaaagatgaaattcccagtcaacgtattaccgtcaattaaaatttatggtaatttatatagtttttggacgatgattgcttttgggatcttcctgatgttcattaatggtatttggccctcagtttcttggattcaatttatctactactttggttgcatgatcgtattaatgtattcacttgggatcttcaatgccacggtcagtgttctgattcgtgactggcatatcacgcttcaatccgtattacggatgctgttctatatgagtggggtgctatttaactttacaacgtccaacttccccgcagtttttgtgcgcctactagaactaaatccgttctactacgtgctcaacggaatgcgagaatcgttgcttaatcgtggttggatctggcaacagcctaatatcacgttgacgattgtcttttggctcttcaatctcgttgtgattctgactggaacgtatctctataacaagttccgttcgaactttgtggatttgatttaggaggcggaactgatggaaaatcaatataaggttgaattgcataatgtcactaaagaatatgatttatatcgtagtaacaacgataagttaaaacacttttttaacattggtaatgttgatgtcccgcggttttggtcgctaaaaggggtcagcttaaacgttaaaccaggtgaagcgttgggtattatcggaatcaacggttctggtaagtcaacgatttcgaatattatttcgggaatcattcctcaaacgactgggacagtggatgtgcacggtgatacgtccattatttcaatcggagccggcttaaagtggaatttaaccggtgatgaaaacattcggttgaaaggactcatgcaagggttgagtattaaagagatccaagcggttcgtgatgatattgttgatttcgcggatattggtgattttattggtcaaccagttaaggactattcgaccgggatgcggtcacgattgggatttgcgattgcggtgcatatcaatcccgacatcatgattattgatgaagcactatcggttggtgatgacaccttctatcaaaaatgtgtggataagattatggaattcaagaagcaagggaagactattatctttgtcagccataatttacggcaagtagaattgctttgtgaccgggtcgcttggatgcactttggggatcttttagaagtcggcgagaccaaggaaactgttgatcattaccggaaattttctaaggatttcaaagcgcaaacggcggcttatcgtaagaagtatcaggtcggtaagaagaaggaacaagcggactttgacattgtcgcttatgaacgacaattagtcgaagaaaaggctaaggatagcgataagagtaagcaggcagttagccgtcaagttcatcggacgctatacaagcaaatcttgccagaaaagatgacgattgccaccaagctcgtcatgttagtggcaattgtcctgttcgtcttctttgcgttagtgaatgtttcaggtcactcggttacttcggcgattgagaatccgacagtactgttacatccagtcaatcattatattaaaagtcagtcagtcttattcaatagtaagtgacggcggctggttagtggttgcattaaattaacattaatatcgatgggtgattgcgatggcaatcacccattttttgtgtgcattcaagacggctttggttggaataaagtacaatacaacgtcgcacattattcggactgggggacgctgatgcttttattcgaggggacgagcttgggctgaccgtactaccgatttgaaaggaaaatgtctaaacttcaatgcacaatttatgagttggtttcgggttaaattaagcttgattttttgtaatgcttcagcaatctagttatattcgttataagcattagattattttccgcctggaataccatttggtgggttatcttaatactagagcataaagggggtcatatcatggatacgccactattcttaaatgttgtcgcctatgtgctattaatattggtattacaatatatcaaattcaaatttccagacagtacctttatccgtttctttcaaaaatacgggtggtggttaattgggctatgttttgtcgcaatattggtgattttggccggaccgcaatttcagaacccctttaatgcgttagatgtaccggctattggggtcatgttagtattcgggtacttctttattaaggataaaaaatcgaaacataagtgatgattaaatgagatagcacctcgaacgatgatgtcgtcctgagaggtgctatttttttgcctaaaaatcgatttgagaagcactgatgtttagccgttttaatctagcattaaacgtgaactgggttattcggtaacggaggggcataattaaaaaatcagtttggaaccttgcaatatatctaaaagatatatatacttaacagcgcgaaggattggtgaatttaatgtatgaattgtttattttaggacagttgatggatcatccgatgacgggctaccagttgcgtaaagcgctggtaaacgtagttggttcagaattaaccattagttttggtgcgttgtacccgttgctagataagttagccgcggctgaagaattaacactggcgtttaagcggaccactaataaacggccacaaaagttagccacgataacagcggctggtcgcacgcaattttggcagttagttatgacgccagtcgcgctcaacaagcaaacgcagttaacgtttcagataaagctgaattttttacatttattaagtcgtgatcagcagcaagtaatcttgttggattttcagcaatttgcacggggacaggtcgcacgcttaacggcgcagcacaaacgggtgatgacgaatacccacatgcttgcagctgatattcaagatgcgttgatggtcaatgagttacaacgggtacgagcccaagcacaattagactggcttgaccgccagttgcgcaatggaggggaagttaagggatgaaaacaatgtcgtttgcgactgatccacaaattcaaaagcatcgctggtggatactggttgcggtatgtttatttacgttcatgtcaacgttagatgggagtattgtgaacattgccttgccagtcatgagtaaggatttagcgattccaatgaatcaggcggaatgggtcgtctcaatttatttgattgtgatttgtgcgttattgttattatttggtaaattaggtgatatttacggtaagattcgggtgtttaaaatcgggtccttactattcattattggctcgttattgtcaggattcagtgtggggttgccatttctactcattgcacgcagtattcaagcagtcggagcggcaatgacgatgagtacgaacaacgggattattaccgaagttttcccgtttaaggaacggggccgggcgctaggtatgattggctcattcgttgcattggggagtattgctggccccggtatcggtggtttgatcctagctcatttgagctggggctatattttctggatcaacgttccggtaggaatcttggcgatgattttaggtgcaatgattttgccaaaagacgttacgacgacgcaacaaccattggataagaccggggcggggttatttgccgtactcatggttgcactatttgcaggtgtgtttatcgggcaacagattgggttcttgcagccggttatcttagccttgtttgcagtggcaattgtgacgctgattatttttgttcacgtcgagttacgtcatgaaaatccgctgctagcgctacaattatttaagaatgcccgttttagcattagtatcttatgtgcgttattaatttttattgcgaactttttctttaacgtgattgccccgttttatttggaaaatgctcgggggctagcggcaaactatgcgggctacgccttgatggtattcccaatcgtacaagtggtggtcgccccgattgctgggacgatttctgacaagatcggaccagaattgttaacgttcgtgggattggtcctgatttcaatcagtcaagtgggttacatggttgtggggctagcaacaccactttggttcttcttattattcgtcggattagttggatttggcaatggtatcttcatggcacccaataattcgatcgtgatgagttcagtggcggtcaaagacttgggcgttgctggcgggattaacgcgttggcacgtgaattaggcatgattgttggaatttcggttgccacgaccgtactatattcggcaatgagtcaatcagcggggtataaggttacgtcatacctgccagctcacccggagatctttattgatggtatgcacattgcgttcgtggtctcgttagggatttgtttagttgcgacggtcattactggcgggcggttactaaaacatcgacgcacggcacctgccaagtaaacattagcaaatcaaaaaacgtgttgcgagaaatctgagatgatttcttgcgacacgtttttatattcttgcatccttgatgttgctgaaagggggtctggttaaatcaggcttgttttaaagatccagggcataagctcactgaaaaaaactcggattagcgccgttatgacgccaaactcgtcgtttaattccctagttaggctaatcctcagtcttctcccgtctgatttatgcccgcttgtgatactgagcattgatagaaatgtgccatgcgactgctttctcgaacgcactgaaacctgtgcatattacgcccatgattccgattatcggaatcgttgttgcttatctagcagttgcgctaactgaccacgaaattcatcgctatggtgttgaatgttcgtcaagtcgtgactcatttgaacggtgtagtcagcgacttcgccgtgttcgccttgatcgagtccgagttcttcctcttgttcgtcaacgcgcattctgatgactcgtttcaatagtacgataatgacgatgcaaacgatggtagtaaagccaatggtaaagatcgttgctaatagctgtaatccgaataatttaaagccgccaccatagaaaagaccgtttagagaaattgtgttattaacggctttgctagcgaatagcccagtcatgatactgccgaccatgccggaaacaccgtggcatccaaaggcatcgagtgcatcatcgatacctaagcgtggtttgatgaacgtaatgaagccgtaactagttaatgtggcgataaggccaatccaaaaggcaccagaaatggtgacgtagccacaagcaggtgtaatcgcaacgagaccacaaagggtaccggtgcagacaccaactagggttggtttgcccttggttagcatatcaacgaccatccacgtcatcatggaagtggcggtggcaacggtcgtggttaagaaggcttggatggcgatgtcgttcatggcaagcgccgaaccggcattgaaaccgtaccagccgatccataaaatagcggtccccagcaatacccataagatgttatagtgctgggtcatatccttgccatacttgtggcgggcacctaagaatgctgataagactaaagcggtgataccggcattgatgtggacgacggtaccaccagcgaaatcgatgacgccaagtttagctaataaaccgttatcccaaaccatatgaaccattggatagtagatgaggagtgaccagaagatgatgaaggttaataagaatttaaaacggatacggccgaccactgcgccaacaaatagtgctggcgtgataatggcaaacatcatttgaaagatgagatataaaccgttgggaatctttgtcgcggtaagcgcggtcaagtccacaccatgcaaccaagtggctttgagattaccgacaaagccacctaaatcaccggaaaaagatagtgaataaccgaatgcgagccataacaagattgctaagccacaaatcatgaagacggataacatggtgttaacgacattccgtttggaaactaagccaccgtagaaaaatgctaatccgggcgtcatgaataataccaatatactagataacactaaaaacgttgaatttgcagcgttcatactcccaacccctatccataccatttgatgttagaaattataacattgattattgagtgacgcactctttttttgtgtttaggttaaatattaaacttacaaacgggctttggtgtcattatggaactgctgatgtcaggttttgtgacgcaaaactattgaaaacatgagtggactccttgtaaattcttagcaaaatccggtcaaagttgcttgttggcagaaatgtaggaagtgacttccaagagtggtcgcgattagttcggtaatgaaaataattaggcaatggggggcaagtgattaattatcttaaactaattaggggaattggtaactatagtgcgtgctattgcttaataaaatgatgatatgaaaggtgaggcgctttcagcaattgaccattactaactagagcagtaaggttatcaccacataaattaaaagacaatgagattattacataacgtcttaataattaaaacgggggttcagcttatgcgaaaatatgcgattattggggtcggccacgttggggcgaccattgcttatacattagtttgtaaaggaattgcggatgaattagtcttgattgatactaatgcggctaaagctcgcgcagagcaattagatttacaagacgctcaagcccgtttagatagtcgaacgattattaaaatcaatgactatcatgaattagacgacacggatattttatttgttactagtggcaacattcacgcgttagaccatgcttccggtaaccgatgggctgaatttgaatatacgaagcaaatcgttcaagatatcgctccgaaagttaaagcaaccaaatttaatggcgtggtcatcgatacaatgaatccgtgcgacgcaattactcactatttccaacgcgcaacgggattatcacgccaacaggtctttgggactgggactttcttggatacggcgcgcatgcaaaaggttgtcgcagaagccttcgactgtgatccaaaaaacgttagcgggtatgtttacggtgaacacggcgaatcacaattcagcgcgtggtcaacggttcaggttaacggtattccaattacatccttagttgataagtatgatttggacttagatgcacttgaggcagctgcacgccatggtggctgggcggttcattctggtaaggggtataccagttttgccattgctacttgcgcggttaaattaagtgaagcggtctttgcaaatgctcgcttagcatgcccggtctctgcgtatagtgaggcctttgggacgtatgttggtcagccagcaatcattggcaaagatggggtcgagagtgtgacgacgcttgctctgactgctgatgaacaagctaagttccgtaattcagcggacacgattatcgagaaattccacgcctttgatgacgtcttaagcgatcaatcagtaaaaaaacgtcaacaagcctaaaaagtgacggttgttaattgtcttgtttggcaaacttctaccaaaatgttaaaattttactaagcagaacgttgactgcattaactatatggtgggatgaatatgcgccgacaattaacaaaccggcaacggtggttcgtgattgtaatcgcgacgattctgggagtaggctgtgccttgcttggtcaatggggccagttcttcggagtcatcgcagcaacgtttgcgctaatgttgttaaccagtggctgtttgactttttgtcatcgccgcgggtggcaacctggaagcggcatgttgctagcattagtcacggctacagggtatgtactagttattttaggaagctatggttatttactgcacagctaagcgcagcactttgatacgaggaatcgaccgtatcaaagtgctttttgtctgcaatcatttttagcgtgctaattaagttatgtttcaacaatgattacggccatcggtgctcataaaaaaggtcgcgactcatcatcgcggccttcctgggtgcggtattgattgtaaacatcaaagtggggtcaccgcacccaaggtattaatggcagacctagttggatagctttacctaaagcctgccaacaggtaagcggtaacgcagatgcaccgccgcgctatcggctgcactaataccgttatagcgattatcagctaacatgacactgtggcgatcacggctgtgttccaaaccgatagtatgtcctaactcgtgttcagccacgtggacttgatccgtataagaatagtggtagcgtacaaaattacgtgttaacaagtacacttgcgcttttgtgtaataaccattggtataaccggtcgaaaaagtaataccagctaagcgataatactgcccactggtggcattactggtccccaaagtaatttgatgatgagcagtggttcccggtacgaatttaaagtgaccagtcgcattccaggcttggatggccgcttgatagacgtgccgctcgtatgatgatgctgaatgacgtaggtcacttgagcgtgtggccaacgactccgtgaatatggtgtcgcaatcgattttgcgttggcaattggtgtcagcccaagaccaaaaatcacggttaatgtggttaaacctaacttagcactgtacttattcttcattgttgtaaccctctttcccccaaaaacgaaggtcgccatcaataattgtattttaaaacgttgctgagataggggcctcatcctagacccgaatttgaccaaaaatcgcgtgatttggttgcgattaaagttagttaaataggttatcgcgtgctatgatgagaatatcttatgatgatggaaggaaattgatatgacgattaaacaggcaattgttcaacaagctttgacgttaataaaaccgcaaatggttgttggttttggtggtggctcgacggttggtgaactggtcaaggaggcagccaatcatgtgaatgatattacggtcgtcaccccatcaccgacgacccgccagcttgcgaccgttctcgggtataccgttgtagatactgcatattgtgaccgggttgatattgcttttgacggctgcgatcagttagatcatcacggtaacgcgctcaaaagtggcggtggaatccatgctaatgagaagattattgccagtttggcggatgaatattggctgttaacgatgcaggaccggttagtcgatcaatttgatatcaagacgccattagtcttagaagtactaccagcggccttatcgttagtcatgcggacggtgagtgatcttggcggtcaggcaaccattcgaactgctaataatcgggatggcttcacgttaaccgatagcggcaatttattgatcgattgtcattttccaacgtatgccaaacttacggacctgaatgttgaattggcaactttggctggcgttgttgaaacgagctattttgatcatttggtgacgaatgcttggttgggcgatgcaaccacgaatacagtcaacgcgctattttaagtgttatcagggacgacagcatgaccctaatgattagcaattgagcactgaaattcgtttgacacttttttaaaataattctaaactgaaggtgacgtataaaagcgccaccattttttgaatctaagttattttaaatatctaaggggatgtcaacatggcaaaaaaagtctatactgattatttttttgatgaacctgcttacaacacacatgacggtggctatattccactagttacaccgaaagtcgagccacaaccgttagcgattccgccgttattgaagccggaccgccagacggatacggatgattactatattgtcacggcgcaagaaagcgaaactcagtttttacctggtaagaagactaaaacgtggggctataatgcgggcttcctaggccaaactatcgtctttcgtaatggtaagcagacccatattgacttggaaaataaactcccagaattgacgactttccattggcacggcttgaatgtcccagggcccattaccgatggtggctgccacgcaccggtctatcccggtgaaacgaatcacattgactttaaagtacatcaaccagctgcgactacgtggttacatgctcatccgtgcccatcgactgcgacgcaggtctggaaaggcctagcaacgatggtgattattaaggatgacgttgaagatcagttaccgttaccacgtaattatggtgtggatgatattccgttggtattacaagaccgtgaatttcacgatgataaccaatttgattaccgggcggactacgatccagatggtgttcaagggcatacggcgttagttaacgggacggtcaacccatattttgatgtgacgacgcagcgggtgcggctacgaatcttggatgggtcgaaccggcgcgaatggcgtctgcacttcaatgacgatttggaatttgcacaagtcgcttccgatggtggcattttgccggcaccggtttatatgactaaagtgatgatgacctgtgcggaacgggacgaaattgtcgttgatttcggtcagtatcagccgggcgatgaagtcacgctgatgacggatgatacgccgctatgtcgcttccgaatcaagtcgttcgtaccggatgacaccaaactaccagaacatttagttgatattcctgatgaaaccccaacacctgacttacctgttcgcacaatcacgatggatgggatggatgatgaagtcgcgctggatggtaagaaattcgatatgagtcgcatcgacgctcggcagaaagttggggatgtcgccatttgggaaatccgcaacaccaacagtactgaaaacggcatggttcatccattccacgttcatgggactcagtttagagttttggcacggaatgatggtccaatttatcctaatgaacatgggctgaaggatacggtcggtgtcaaccctggtgaaacggtgcggatcaaggtcaaatttgagctgacaggagtttacatgtatcactgccatatcatcgaacatgaagatggtggtatgatggcccaaattgaatcatatgatccccaacacccacaaacttatcatttaatggatatggacaccttacggaatgcttttgcgaaggaacaaggcatcaagcccgaagatgtttggatgcccggtatgtaagtgtagattaagctaatttagtgatgagatgtgaataaagtccggttgcaaccagcaagttatctgcttggtcgtagccgggctttatcatttaaaagcacctcggggtcaaaacggtggcggttttgaccccggatttaccatgttttaatcatgatttgtgacgaattagctcgtataaagacaagtaagtctgtatttctacagtttaggcgcagtaactggtacaattcaagtaaggaccgaaaaaaggaggggattaggatgcacgttgcagcaatgattatggcgatcttggttgccgttgaacatttatttattttgtggctggaaatgtttaatgcggatagtgaaatggccgcaaaagcgtttggaattccacggcaaacgctacagtcgccgtcagtgcaattattgtttaaaaatcaagggttatataacggtttcttggccgtcggtattttatacagcttgtttgtgattccggccgtcgcgagcgccggtgcaaccctgtttttcttagcctgtgtgatggttgccgcggtttatggtagtattactgtcagtcgcgcgatcgtcgtgattcaggggctaccggcattaattgcgtttattctgatgtattttgcttagccggttctttgaagtaatgccattatattagtgttaataaaaaacgttgctacgtgattctgtagcaacgtttttggttgtttaagctatccatattatatggcagattggattacactttgccaatgaccgtcgttttagcagttgctagcacgtgaccggcaatggcatcatgaaattcgttgagccagtatccaggttggaggtctaactcagtatcaagtgcaaatagtttaaatgaataacgatgatccttgtcaggcggatacgggccgacgtagtgttggctaactttcggatcagtctcgtgaacataggcgcccgctgtggaattattaccttggaccatcggaatagcaccggtctgactggcattttcagggatgtgggtcgtggttgccggtaaattggcggcaatccaatgaatccaggtgaagccacctaccggaattgcatcgtggtcaacgaaagtgaacgccagtgaatgggtgccagctggcacatcactaatgtcaacgggaaacgagatgatggggtggcccttatacgtttgggcaacggccgcttgtttggaataggtggctgcaagggcgccattgatggtcggaattgatagttgcattgcaaatccctcctcgtgtaattagtcttattataacgctaatagtcgctggcgtagtgctgggtcaaccgcataaatataaagcccataacgaccacgtttcatcaagacgttgattgagttaaagataatctgctgtttaaggggacacagatcgcctaagtctgtccggtttttgaacgcttcttgatcttcatagcgttcagggcgaacgacaatctgatcatggtcttcatcatagcccacagaagggccgagaatgacccccgcataattcaaatcaaacccttgaatggtataaatagaaccaacttcattcagtgtctcaggtcgtaaggcccaaggatcatcagttaagttgactttatcccacggaagcttcaattgtccggccgtcacgtaccaagtgccatgattaacgacgtacgggaagtcagcggttgccaccatccgagcgagtccatactgctggtcgcgttgtttgatcaggtcgtataagggttgcccgtcatcaaaaaagcgtagatcaaagttatcgctaacgggttttggttgtaattgcccgcgggtaaaaccatcgatccagtcgacaacatcggcgccgccagtgacccgaaattgctcgtctaagttgtagttcgcgtgcgggtactggtctaaaaatggcttgagatcgttgctgtgccagtagctctttaacttcaagacttgacgggtgtcgaagacgaggacaacgacgcgactatgattgatcagttccgttaactggttgtgacctgtaaagcggttatagcggtctggttgcgtgagtaataggtgcgcttcgtcgataaaaacaacgtctgcttgccggtgttcttttgccaaccggttgatcaacggagtgggcttttggaagtcttttttgcgcaagacgggatcttcactagctaagcgcttataaattttgagcatttcattgtgattgacgacgagatagttgtcagtggcctgcaaatcgtttggtgtcaagctacgattgagggcttgtagccgagcaaacgcggcggctaatacggcactcttgccagttcctgcatcaccatgaataacaaagaggctgggctgtttttgctggcgatgggtacggataaaagttaatagttggtgctctaatgattgttgtgccggtgacaacgcagcttgatcatttagcttgaacgttgcggcactgattgtagatgacatattttttcactcccaaacacattatacctgcatattggggctaattgaaatgagagtcattacagttggtggtagaatagaattatgacaaagtgtgggaggaagtaacatgaaacttgatttttcggtggcggtgcatagtatcctgtaccttgatgcacaccgtgatagtaaggtcgctagtcgggaactcgcgcagtcactgcatcttaacccggtgatgattcgtaatattttatcagttctacataagcatgggtatttaacggggacggttggtaaaaatgggggctaccaattagacttggcgttggccgatatgaacctcggcgatctatatgatttaaccatccccccaacaattagctatgcgcgcttcattacgggaccatccaaaacggatgaacaggctgatcaatccccgattgcggccaatattagtgaaacgttgacggatttatttacagtagctgaccgtcaatatcgggcttactatcatcagtttacaatggctgatttacaagccgacctgaaccaccacggtacgtttttacaacacgaacaagattcagaatcttaagtaaaaagcgtcacttgattgaaaaataaggcgattttcgttaataaccttaatttgaaacgggtttgccattcaggattgtcagggctaattatcggtgctatcttagatgttattatgaaagtggcattgagattgaaaggggccttggcaatgacagcacggttagtgttaattcatgaagttggtcgttatcgagaattatcggaacaacggtactggttagaatccgccgatttttggggtgtcgatgggcgtggcgcgacggtcaatgaggccgtcggtaactttttgaccaacctcgtgcaatattgccgcgactattaccaacgcggcttgtggcaacttgatgatcggttgttacagctagaccacgttgatacagtgttagcgtacgcgcaggcaggtaagtcaccagcaccattatttttgtttaaattagttccggcggatcatgagttggcgtctgcttaaacgaaatattgacgaattcttaaagaagcgttcatacttccaccacactcctgcgctaaactatgcgttataatcaaagcgtaaattaattggagggtgttgtatggaattagataagatttatcagttaatggacaagtttgaacaaagcagtttaactagttttgagtatcgggaccaagattttgaaattcaaatgggtaagaagggacacggcaagacgacggtgaccccgcagccggcgccacttcccaatcagccggtgattgacccaacgccggtcacaccgacaccggtctcaacagttagtaccccagttgttgcggaggcggaaccaaccccagtggcgaccagtacggctagcaatccgacgagcgttgtaacacctgatcctgaaccagaaccagcgccgattgatcctaaggaatgcgtgacggcaccggtcgtaggaatctattacccagcgcattcttcagaagaagcgccatacgttaagttaggcgaccacgttagcgttggtcaacaagtcggcctcattcaagcgatgcagatgatgcggccagtggttgctaagcaagcggggacggtcaaagccttcctagtgaagaatggtgaagaagtcaacttcggtcaaccattgattcaattagtcccagatacgccggatgacatttaatcaggtacggtcagtggttgctgagcgtattaagcactttgagtagcactacgttttgataaaagcgtaacgcaaactaaaaatgaaccacttcaagcgcacatgataattgtgcaagctgaagtggttcattttttagcttaattaatgacgattggtagtggtttatttaggttggtcaatggctgccacggtttctaggaaccacttgttgaaagcagccgcatcaatatcgacacaaacggtcgcgttggttttgccgtcatggtaagcaccacgaatatcgccaacggtctcgccattagcggggccctccgtctggacatcaatccacatcttttcagtcgtgaaggcttctggatgtagtaagtagaagagcgtattgacatcatgcatcgcaacgccagtctggttgcggtcgttgtaatgaccaaagagggcgtggagcatttcgccagttttaccgagggtcggtaactgttcaatcgattcgcgcgttaaaagggccttcatcgtcacgtctaagccgaccatggtaattggaacgccggattggtacatgatttcagccgcgtgcgggtcggtaaagacgttgaactctgcggcgctggtcatattacctttgcctaaggccccacccatcgcaacgatttctttaatgtgtggcattacttcggggtaggtcttaaataagagcgcaatgttggtataggctcccgttggcactaacgtaatcggttgttcagcagccatgatgtagtcacggagcgcttcaacggctgtttctggtaatggttccgcaaggtcagtcgggaagtcgtaacccggcattcctgaaacaccgtgaattcggacggcatcttcaaacggtttgatcagcggttgggcagccccacccgctacgggaacgtcactgttaaagaagcgcgttagtttgagcgcattcagcgtcgttttgtcgaccgtcacattgccggcgaccgttgtaattaattgtaagtccaagtcaggatgatttaacgcaaaggtaattgcggcggcatcatcaataccagggtcagtgtccatgataatctttgttgacatgttcattcctccaattaaattgacgtgcttgaaattagttctattttagcatactacgggcaatgaattcgattgcaattgtgaagggtttgacgtagcatgacagtaaatacagttaacgatggaggaacggattatgagtcaaccacgggtcatcttaattacgggcgcatcttcggggatcggtaaagcaactgctttgaagttacaagctcaggggaacattgtgtacggagccgcacggcggattgaaaaaatgacggatttagcagcggctggagtgcacgttttaaaagtcgacgtgacggatgaagcgacgttaatcgcggctgtcaagacgattcaggtcgaacaggggcgcattgatgtcctaatcaacaatgcggggtatggctcatacggttccttggaagacgttccggtcgcagaaggcgagtaccaattcaaggtcaatgtctttggtgtgatgcggttgacacaattagttttaccgttgatgcgggcacaacatcgtggtcggatcattaatgtttcttcaattgggggaaagatctatcagcctttaagtgcttggtatatggggaccaaacacgcaattgaagggatgagcgattcgttacggatggaagtcgcaccatttggtatagatgttgtcatcgttgaacctggtggaatcaagactgaatgggctggtattgcggaaaaaaagctgttggcagtttccggtgagacagcctatcatgaacaagccgttaaggtcggtgcgatgctgtcattgttcgatcagtttgcttccaatccgggagtgattgctaaactgatggttcgcgctgtcaatgatgtgaagcccaagactcgctatcacgcaggtatgggcgcgggggtctcattaacggctcgtcagtggttgagtgatcgtcagtttgaccgcatgatgaactcagccgtcaatggtgcggctaagctgtcaaaagttacgcggcgtaaggaccggcgaaccgggagtcggcattatcggcatggaaaaatacccgctgataataattaatctgaataatgatgctaagaagcgagcccaacgatcacagttgttattgtggtaggggttcgcttctttatttcaagtctaaactttaagcttcccccatgtagcatgggagagatagggtctcgttagttattattttagctggtgcttggatgatgacaagcaggtggattcttgttcggcagcaatgatcgtcctattcc

SEQ ID NO: 44 - DNA, 19276 bp, Lactobacillus plantarum
ttaattttacaatctaccattaagtataaagttgataatggtgaatatcccagtggtaaggacgctgtggatcccaagcgagttaaatatctgaaattgattagtaagttagcgacatttacgtgtattgcgatgtacgtgtcgtatattccacaaatcatttcgaatttctcaggtgacccagtatcgccgctacaaccactcgtggcaatgattaatgggatactatggactggttacggctggttcaagacttataaggattggcccgttattatttcaaatgttcccggggtggtttttggatttatcactgttttaaccgtatatattcattaaccgaatgacaaattgactgtaaactaaaagtccgctgatacgtttaaacgcgtatcggcggacttttttgcaaggtgttaagcgttctttaaagcagcctgagctaacaataggccaccggcaatgccagaattgttacccagtccagcgggaacgatatagtcatccagtggtgggacttcttcgtagccatttagataggcggcaaacttttcacgaatcatgggaaagagctgccgttgattcataacaccaccgttaagaataattttatcaggtgcgaaggcgacggtgaggttgacacatgcctgtgcgatgtagtcagcgatgattggccagaccggatcgtcgacgggaatatctttcccagctttccccgttcgttttccaactgctggcccagcagctaaaccttctaaacagatgtcatggtaggggcagttggacttgaaatcgtccccaggtaaccggttgagtcgcatgtgaccaagctcagtatgagtgcgaccattaaaaatgtggttctgactaatgacgccagcgccaacaccggtaccaatcgtcatgtagatgctgttagggacgtccttagcgattccaatcattgattcgccataagcggcttcgttaacatcagtggtccagtagagtgggatgttgaagcgacttttaagatggcctaaaaaatcgaagtcaccccagccgggtttgggagtcgtggtaatgtaaccatatttcggatcatcgggattaacgccgatggggccaaatgaaccgataccaatcgcgtcaacgggatgagtcgtaaaatagtcgtctaccgcagtcatggtttcagcgggggttgtcgtggggatcgaaattcggtcgctaacttgcccgttttcagcgcccgtggcacaaacaaattttgtaccaccagcttcaattgcacctaaaagcatagtgtgcctcctgtagttaaaaatgtagtcctatttattaatagtatactcttaatcagaaattttgttaacgattacattaactttgacgtaaataaattagctgactagtgaaatcagcgttggtgggtttaagtggaattcccatcgtgtttaactgatgccccgtatagctattacctgatgaatcgctataagttaattcagcatcgagatagtgtaatggtaatgggtgctgatatttaatcaaggctcctcgaagaagttgctgttcactaggagcaagttgtttaggattaagttccaatcctagttgcccgatgcaggctaattgtaatcgagtttcaaatggtgttattcggccattttgcgcattgggtgatgcggttatatggttgctgaatatccgtggtggaaatagataactaaatccgttctcgatggttgctcggtcgactggatcagtcaaatcgcttatccacgtctgattggtgtatggtagcataccaaaatcaaaccggccaccaccagctgaacaattttcgataatcagcttggggcaggcgcgcttcaagcgtgtgagaatatcataaagtccacagacgtagcgataatacagttccccctgttgtgcagccggtaagcgtgtgctgccaacctgtgtaagatggcgattcatatcccatttaaaataatcgagttggttattttgaaccaagttcgtcagagtagtgactaagtggtcacggacagcagcctgcgaaagatctaagactagctggtggcgagctgtgatgggtgtccgatcaacatattgtaatacccagtcaggatgttgttggtaaagctggctgttagtggtgatcatttctggttccacccagagaccgaatttcattcgatgatgatgggcttgttgggcaaggggtttcagaccattaggaaacttaatggggtcaacataccagtcacctaattgcccattttcaccgttacggttgacaaaccagccgtcgtctaagacaagcatttgtaagcctaactggtgggcgtgttcgattaagtgttgaactttagactctgaaacggcaaatgtcagtgtttcccaagtgttaagcacacttggaatgttagtctgggagggcatcagctgatggctaaagtcgtgaaatacttgtgacatgccgttaaaaccagtatttgtccaagttagcacggcttcaggagtctgaaaactgctatttggtttgagctgccattcgaatgtatctggttcaagaccgattgttaggcggctatgttgatattggtcaacttcgacagtactgtcgaagttaccactccatgctagtgcacaaccaataacagtcccagctaattctgtcgtgttaggttctgctagagccatgaacggttggtgttgtggtccactagtgccgcgcagactgcgaaccgtttgtaaccctgggtgtaaacggttaaacgatggattagcttcatgtgcatgggtaccgcttaatgtcagcgcagtatattggtcagttggtagatctagttgagcgctggatagggctgttacttgcaaattagtagtgccgtgatggcgcagagttgtgcttcgcaagataagcggctgattttcaaaaatagtgtagttaagatccatctgtaacttggtcactgaatcggccaaatgaatgactagggttgttacaggcgtgtgtttgctaacggtgggtggcaattggcgcgagttgattggctgatcattcacagaaaaaccggtatattctaaaattggcagtaattgattgttagcatccttaataacgtaagctggctggcgatagtcaccactgccaatagtggaatattcgagtggcagtgaagtcacggaatatggaaagcgttctgttgggtcattagcaaaagcatggctaccggatggcatcggctcaaagtacggttgttttgaaaagtaacgtccaaaatatcgatgcactgggtaacgatgggctaaaatttgaataacatagctaatttggtcattatgaagattgattaagccggttttggggtcatattcaacaggcatgacgtcctcctaataaagtttagacagttgtagcagcaactgagctagctgccggttcagtcagcgcaacgagctgttcactagcttggacattcgtgactttgagtcgttcaacattagcgtaattggccgtatttgtgacgactagcatgacggttggatcatagttagcggcttttaaggcagcgacgtcaaacgttccgagtagatcaccttgatgaacggtatcgcccttctgaacgttagtagtgaagtgttcaccatttaaattgaccgtatctaatcctaagtgaatcagaatttcggcaccagcagttgttttgatgccataagcatgatggctatcataagtgacagtgatgaccccgtcagctggtgcgacgacctgatcagcgcttggcacgattgcggcgcctttacccatgatttcggctgagaaaacttggtcgttaacttgtttgagactttcgctagtccccgttactggtgcactgataatctcatcattaacattgatgacggtactcgttggtgctggtgattttacttgatcacgatcgtcaccgagtgttcgtttggcatagataaaagttggaataaatgcgacgacgaacgagatgacagcactgagcatgaatgctggaatcgactttgaagcaatcgaaatgaacccgatgactgatgcgggacccatcgccacagacagaacgtggaatagtcctaagaaagctgaagcaattcctgaggcaatcgctgcaaagacaaatggaaatttcatcttgaggttgaccccaaaaatagcaggttccgtaattccgagtaacgctgagaccccggctgaagaagtcagggctttttgcttttggctcttagtggcaaagaaaatagctaaagtggcggcaccttgcccaatgttggccatcgaggcgactgggaagataaaagaacctcccgttttggcgacgttagccaataactgggtttcaatagccgggaaggtttggtggagcccagtaatgacaatggccgagtagagaaggccaaagatgcccatgccaatccaaccagtcgtgttatataagcctactaaaccgttagttaatgcgtcgctcaccgttcgtaagacaggaccgacgattgtgaaagttaggaagccagtgatgacaattgcaaacattggcgtgaacgtaaagtcaaatgcacccttgatatgtttgtggaagaacttctccagagtagccaaaatataagcaacggccaaaacagggagcacttggccttgatagcctgcttgtgcaacgtgtaaaccaaagacgttccagtaaaccatcttgccggcggccatggtcgttgcaacgctatagccgttaacaagtgatggtaagaccatgatcatgcccatcgtagcacccagataggggttgccgccgaagcgcttcgttgctgaaaatcctaagagaattggcaagaaagtgaacggggcactagccatcgcgttaatcatttcggcgatacctttgagaccggggtaaacttcaacaactgacttcgccataaaaagatgctcggcagtcaaaacgttgtttagtgccattaatagacccccagcaactagtgcagggacgattggaataaaaatatcagataagactttgaggaagtccattaatggatttttcttttgacccgcagcggcaactgccttgatgtcatcgggggtcgcttctttaagacctgttttggcgattaaggcgtcatagactttatcgacatcgccagggccaataatgatttgatattggccgttagtttcgaaggtccccttaacgtccgcgtcgtcatctaaggcttgttgatcaatcttggattcatccttgatgaccaaacgaaggcgtgtcgcacagtgggcggcggcttgaatgttgtttttaccaattgcattaagtacgcggtcggcaacttcttgatgattcataataattcactccctgagtctaaaattatttttaatttaataatgcaagcgctttacagacccaataataacaagtttggaaaatatgtcaagcgtttgatacaaaattgaattgcttgataatcttgctaaaaagccgaatttgaaacgctgacatgaaaatataatataaaaatgtcaaacgattgacatatcggtgtaagcggttttataatagtgacaattaagtcgaacgttaaaaaggagctcatcgtcatgatatggaatcgtaaaacccgttataccccttatgaacagtggccagcaactaagctaccacagctcgttgcccaggcacgccagtctaagtggcggatgcaacatcatattcagcctacatcaggtttgttaaatgaccccaatggcttttcatactttgatggtcagtggcacctgttctaccaagtctttccgttcggtccggtacacggactgaagtcatggcaacacgtgacctctaagaacttggtggattggcatgatgagggcttagcgattcgaccagatacgccgtacgactcacacggcgcgtacacgggtacagcactaccaattgatgatcagttatttattatgtatacgggtaatgtccgtactgccgactggcaacgtgaatcgtatcaattaggtgcctggatggacacggataatcacattaaaaagctgtcccggccactaattgcgcatgctccggctgggtacacgagttcgtttcgtgatccggacttgatccggactgaccacggctactacgcgctgatcggtgcgcagacgactactgagatcggtgctatcttggtttatttctcaaaggatctgaccacctggacgtgtcaaggcgagttgaacgttcccgcaaatgcgcggggttatatgattgagtgtccaaatctggtctggatcgatcaacagcccgtcttattgttctgtccccaagggttatcacaaacaacgaccccgtatcagaatatttatccgaacatgtacctagttgccgatcaattggatctggctcaggcacaattcactgaaccccacgccctgacgcaattagatgatggctttgacgtgtatgccacgcaggcaatcaatgcgccggatggccgcgcgttagccgtcagctggattgggttacctgaaattgcctatccaactgatcgtgaaaattgggcccattgtttgagcttagttaaggaactaacgcttaaagatgggcacctctatcaaaatccagtggcagcggtggatgatttgcggatgacggcgcatgacctagtctttgagcaacaacgggcgacggtggccgctttgaatggcagctttgaactcttactgacggttcccgctgataaaacggtcacggttaacattgctgatcagcaggaaagtggccagctgcaggtgactgttgatgccaaccatggtcaggttatgattgatcggcggcatacggggaattcgtttgctgaagattatggtcagactcgtcaagttgagttaacggcccataagacgataaaaatccggctaatcatagatgtgtcagtctttgaatgctatattgataatggctattccgtaatgaccggccgtttcttcttaaacgctaccccgagtcgccttaacgttcaaggtgacactacggcagtcaccggtaaagtctgggaatggcgccaatcagagcatactggagtcgataacaatgaaaccaaaattaaatgatgttgcgaagctagcgggggtctcagcgacaaccgtttctcgggttattaataaccatggctacctgagtagtcagactaaagaaaaagttttcgcggcgatgcgagaactgcattatcagccgaataatatggcacgctcactgcaaggaaagaatacgcgcttaattggcgtcatcttttcagatattagtaatccgttctttggtgaactggtgtcccggattgaaaaaatcttatttgctaaaaattataaggtgattttatgtaatagtgcggatgatccgcaaaaagaacgcgactacttacaaatgttgatggctaatcaggtcgatgggattattgctggtgcccacaatttaggtattgaagaatatcaacaatacggccttccgattatttcatttgaccggtacttatccgacaatattcccatcgttagttcggataattaccaggggggctggctagcaacccagacattgcatcaggcgggggcgactaacgtggctatttttactggtaagtcacacgctggttcgccaacgaatggtcgccgtgaaggatatgaagcctacttgactgcccaacagctaacaccccatgtccacgaattaccgtttgaattgacccccgcgctgaagatgatggaaattaagacgattatgacacaacatcagtatgatggtattttttgtagtgatgatttgaccgctttactagtgctcaacgtcgcgcgacaactgtcattaacggttcctgagcaattacgcgttgttggttatgatggcacggcgctcatacgtgattatcattctgaattaacaacagtagaacaaccgttagcggatattagcacgttactggtttctctactattgcagcggattgaggatgcgaattgtacactggaatcaaaatatacgttaccagttaagctcatcaagggccttaccgcgtaactaaggagttaatcgtaattatggcagcaacaatcaagtggtggcaacaagccgttgtctatcaggtctatccacggagttttcaagataccaatcatgatggtattggtgacttaaaggggatcacggcccacctagactacttaaagcaattaggaatcgacgtcatttggctcaatcccatttatcgttcacccaacgatgataatggttatgatattagtgattatcaacaaattgcggccgactttggcactatggctgattttgatgaattattgcaagccgcccatgaccggggcttaaagatcatcatggacttggttgttaaccatacctctgatgagcatccatggttcaaacgcagtcgccaggaccgcaccaatcaatatcgtgatttctacttttggcgctcaggtaacggcaaaaaggcgcccaataattgggatgcggcttttggtggttcagcatggcaatatgatgagcagacccagcagtattatttacacacgttttcaacaaaacaacctgatttaaactgggagaatccgaccttacgagagtcagtttatacgatgatgacctggtggctgaacaagggtgttgacggttttcgaatggacgtcattaaccaaatctctaagttacccgggttaccaaatggtccactgaaaccgcacagtcagtttggcgatgctcgagtaacgaacggaccgcgagttcatgaattcttgcaagaaatgaaccaagaagtgttgtcacagtttgatatcatgacggttggtgagacccacggggtgacaccagcggatgcgctgaagtatgcgggcgctgatcggcacgaattagatatggtctttgaatttcaacatctgcgacttgataatagtcagcatggtcttggtaagtggagtacgcgtaagacaccgttagtggcgctaaagaaagtcattagtgactggcaagtcggacttgaagggcgggcttggaacagcctgttttggaacaatcatgatacgccacgagcggtctcacgttttggtgatgaccgaccagcatatcgggtacgttcggctgaaatgctcgcaacgtgtttacacctcttgcagggaaccccgtatatttatcaaggtgaagaactggggatgactgacgctcattttactgaattaaccagttaccgagatattgaatcgctcaatgcctatcgtgatttagtgactgagcgccaactactatcaccggcagatatgatggcccgattagcggcgcgttctcgggacaactcgcgaacgccgatgcaatgggacacggaggttaacgcgggttttagtgacgcggcgccatggctcacggtcaatcccaactatcgtcaaatcaatgctgccgcagctttggctgatctggattcagtgtggtactattaccagcacttgattcaattacgacatcaataccccttagtgacgttaggttcgtttgagctcttgtgggccgatgatccgcaggtattcttatatgaacggcaatgggaagggcggacctggctagtttgttgcaatttcacagccgagacactgtcccgaccactggatcaatatctgacgcccacggccaaatgcttgattagtaattatggcgagcagcagccaaataaattacggccttatgaggcttgggtctaccgactcgcataggtatccgggacttggctaattgaggcggtctttgaaatatacccaatcgttacgattagtgtgaattgggttgctcaaaattctgcgatggtcttaataagcgaccacctgactaaaaaactgctttcaaaagttatccttttgaaagcagtttttttagcgcgcgacgaccacttgacccacgtgaggctcatctagtcgttggtgaccttgaatgaagcccgtgaggttaaacggtagttgttcattgatcgtcgtggtcaattgaccagtatctagcaacttgaatagcaattgtaaggcggcctgatcagaaatcacttcggtcggttggattgcttggaaacgaattgatttactggtggctggcaagtgacgggcaaatgaagcgatggtcgcatcaaatttggccattgctaagtcatctttgccaccaacgccatcgatagcgacattgattacgacgtcaccgcggtcggctaacacgtgaactggattttgatgctgatagtcgacgaattggtcgactcccagtgtcgcaatcaatttagcataacggtcactagcaatcgcgataacgtgggcacctaatcgtttggctaactgaataattaacaagccgactgggctgccagcgcctttgacaatcaccgtttggtcggcctggatgtccgcaaagtagcgcaccgttttgtaagcgacaatccctggagtgactaagctgacggcggtgaccggatcaagattagttggcatggtcaccgctagatcactatctaaacaaacctggtccgcgtaagtatggttcgtgcgggcagccaccactgtcccaacgtccaagtcagtgacagcggcgccaacttgaatgattttcccaatgacatcatgcccaggaatatgcggtagtgtgacgctttggatagtacctagccgttctaagcggtcttcctcggttaggttaacggctaaagttttgattaataattgattatctgttggaatcagctgtgattgtggtagttcttcaaatacggtaggtcccccaaatttttgatacccgtatgcaagcattgtaatccccctcctcatatctaagttcgttagttgacgtggtgccgggatgtgacttattagtaaataaatcatgcagtatcaattgacgaattgttagattgatccaaaacatgctcttgtctaattgtagccagcagtgggggcgaatcacaagcagtaacaattatattccgggattggttcggtcaccgattaaattaaacaacctagttttaaattaaccggcttcgttggctggctgatgcttcaggccccagccagtgaaaccactgataattgagaataccggtgatagtaagctgaagaaacaaaatggcaggtaagctaaggttgataccccgagcgtgttagcggcaaaggccccggcaacgccccacggaatcaggtaattgatgacagttccaccgtcttcaaggactcgactgagggctaagttagccaatcctcgctgattgaaggtcgttttgaacgctttaccaggcaagataacggaaaggtactgttcaccgacaaagatgttgacaccgattcccgctaaaatcgcagccgtaacagttgccccggcacctttcaatcgcttagttagcggcaccattgctgtctgaatgaggttgaatttcattagtaaaccgcctaacgacagggttaataggattaaggagaccgtgctcatcatggcactgataccgccacgtgagagtaaggcgtccaccccggcgttgccagttttggctacaaagccggtttcgatcatcgtggcgatcttagttaaggcaatatgaggttgctcgataaaaatcatgacgatggcaagaccgatattcatcaacaaggttgcaatggctggaattttaagtagggcacaggcaaacatgacgacgagtggcaaggccgcccaccagctgatggtaaagttattattgaggacggtcaacgtcgtttgaatcttgcccaaatggctttgtgttgcggctccggcacctaaaacggcgtagagtactagtgatacgacaaaagcaggaatcgtagaccacatcagattacgaatgtggtcgaataaatctgcttcggcaatggctgcggccaggttggtcgaatctgacaacggtgaagtcttatctccaaaaatggctcctgagatgatagctccggcaatcaaagctgggttgatgcccatcgttgtcccgattccaaagagggcaatcccaatcgttgagataatcgtgaaggcactcccgatggaagttccaataattgcacaaacgagaaaaacggatggaacgaaccactgcgcagagatcagatgaaacccaaagaccatcattgaaggaatgatgccagctgcaatccaaacgctgatgagtgccccgatgagtagaaaaataaaaattgggataatcccagttttaataccatcgatgatgccaccgtgaatgtcatcccagtgggcaccgcgaattcgggcccataaaatgatgagggcgataacgagaataacgggggtctgtggtgacaggccgaacttaataacgccaagtcccataattgcaagcataatgagtaaaacgagtagggcttctggtaactgaactgaacgccatttctttgaattaggcataataattaactcctttgaggtcgttaaaccagcagtgaatagcccgacacggactgcttcaacagcggttgtacgccgataatagtgggtgaatataaaaaatcgtccctgttgcataataatgcaacagggacgattgattagaccgtggtaccacccagcttgagccacaatatgaccccactcactagcagttaacggctctagttgttatccgccgggcgtacccggacctctcctaccgtatttcatcgagattaacctgatcggttcgcagcacccaccgacttcctgacgcacagttaattcgctacttgaaagtaagattatcgttcgttatttgaatataagcgataatagcatggcgtttttgattcgtcaactaagatatggctagaaacgtgttaggctaacaaataaatagcgataagtgggtacgctcaaatgaccgacaatggtagaatggttagtgttgtaagcggtgccttttatggttgaccgtgacaagttttttaaagcaaacttttttagggggataatcatatatggctaatcaatggtggcaatcagcggttgtttatcaggtttatccacggtcgtttcaggattcaaatggtgatggaatcggtgatttgccaggaattacacaacggttagattatattaaacagctcggcgcggatgtgatttggctcaacccaatttaccgttcacccggtgtcgataatggctatgatattagtgattattacgatattaatccagaattcgggacgatggctgattttgatcaattattaacaacggcccatgcgaaagggttaaaaatcatgatggacattgttgtcaaccattcatctgatcaaaataagtggtttacgacgagtgcgcaaagtaaggataatccgtacgcggactattatatttggcgtgatcctgttgatgggcatgaaccaaacaactggggtggctttttcggtggctctgcttggaaatatgttgccagccgtgatcagtattacttacattcatttgcggttgaacagccagatttgaactgggataatccgcaactacggcaagcagtctatgacatgatgaatttctgggtcaataagggcgtggacggtttccgcttggatgtcattaacttgatttccaagcctgatagctttgcagatgggcagccagaagctggggaaccatacgcggcaatcggtggaattattgccaatggtccgcatctccatgaatacttacaagaaatgaatcagcaagtgtttgcaggccatcaactgatgacggtcggcgaaacgcctggggctacggttgctgatgctaagcaactggcaagcagccaaggtcaggaattaaacatggtgtttgaatttgaacacatgggcctggatggtaatccagatccggcgctaggtaagtggaatgaccagcccgtccgactggttgacctaaagcagagcttgtctaagtggcaaatgggcttacaagggacagcctggaatagtctctattggaataatcatgaccaaccgcgaattgtgtcacgattcggggatgaacggccagcttatcgggaacgttcagccaaaatgctagcgaccctattgcactttcttcaagggacaccctacatctacgaaggtgaggagctaggcatgacgaatgcccattttaccaagttaaccgactatcaagacttggaatcactgaatgcgtatcatcactttgttgatgacgaacaggtcgttcaacctgaacagatgttaggttatctcgcccatatgtcgcgggataatgcgcgtacaccgatgcagtgggatgatagtcagaatgctgggttttcaacggcaacaccgtggctagcggttaataccaattatccgcggatcaacgcgcaactcgcgcaacgaacgcccggttcagttctgagctattatcagcggttgattaagctccggcaccatttaccagtcataacgacgggaacttatcacctattatcacctgatgatgcggccgtttatgcctatatgcggcatatggggtcgcagcacctgctagtaatttgtaactttactgcggcaacccagacgcgacactttgcagaattacccgctgatgcgcatctgttgatcagtaactacgatgaagatcatcaagacgtattacgagcgtacgaagcaaaagtttaccagttttaggtcacaattagcttcgctgctggagtcgtgaatgtgatttttaacggcggttgtgtgattacgagcacgagttggtcgtgtaaatttaatcgtgatgacttaaccaaaaatgcgccccaataagaacgcccaacctatcattctagataagttgggtatttttattggagcgcatgtgtgattatgatcaagtttgtggttaagatttttgttcggcattgtcagcctcaaatgttttttcaataatgtcgataacctgtttgactaagccaattggaaattggtgggcccgacgaatcaagttgatatgcacgctaggaacctgaacgtcgtcgaacggaatctcaacgagaccatcgtcttcaccatcgttgggggtcgtgatgtcggaaatgaagcctagtgccaggttctctttaactaatcccttgatcaaggtgctgctatcagattcgaagagaacttggggttcaatcgaaagttgttcagcaagttgccggaagactagtttatttaagtaagttgcattaagcagtacaaaaggcgattttagcgcttctgcaaaagtcggatgctcagcctttgctaaggggtgcgcaacattagcgagaatgcgaaatttaaaaggccgtaatggcgttactgctagccgttcatccaatgtttgatccaagttaccactgatggctaagtcgagttggccggctaaaacctgtttgacgagttgattagcccccatttcaaccgtgtggacgctactaagcaaatcttgctcgatgattggttttgttaatgccggtaaataatgttcactgacggatggttcgataccaaaccgcagtgtatgttgacgcaaatgactgattgattcattgacatgctgccagttgttgataatgtcgttggctgcgagcaatagttgctagccactaggtgttaacaccagcgccttggtctttgcttggcgaaagaacagtgtcacttgaaaatgacgttctagtcgtttaattgcttgggagattgtgggttggctaacgtgaaaatcagcagccgtttgcgtataactctgagtgctgattaagcgttggaagtaatacaagtctttaatgttcatgaaaaatgtagcctccataaaatattaatgttggttgcgcaattaatagtcgcaggtaagcaggctccgactgattgattaaagctggttattatacgtcatgttaatcataccattgttataacgaatagtgtcaggataattagtgaaaattaatttacaaaatagttaacgcgcttaaactataatgattattaataagaatgttagtgctgattggtacagatgtagtgttgctggtaaattaggttttgagtcattatataattttatcagttaaagggctgccgcatcgttttgattatcatgacgtgtcggttggtctgattaatcaccggaaaaaaagttgcattgcttaagtgggagtcgttagaaataaaggttaaagtgttaaagcgataagtaaacattattcagattaagaagcatacaagttaatggcaaactattagtaataaagctataaaaaatacttatcagttaaggtgctgttatatatcgctcgataaatcaataattggtctacgtgccatcggtagcgccagtctgccccgtttttcgacgtaattagttgacaagcaactaaagcagttaatgggtttaaattataaatgaaacgaatgacatcatttttactgattgcaattagttaaatctatattaatcagcataaattattttaattagctaacaactgtcacgaactcgtcaaaattgatggcatacaacttttgtataaaatattataatactaattatgattaatgtctttaaaatgttgatatatcggtaaattaattaagtgtacataaataaaaattatatagacgtaatgagccttttgaacaaatattgctggtatgtaactgctatctgtgagcgacgaattttgacaaaaagtgtcttcaaatttgcggaatgtggtttataattaaggcgtgtaatcggtttaaaagttttaacttatataagaaagggggggatatcatgcgattaatcgatttcaaaacttggataatgggaacggccgccatgttgacattgattgtgacaaatcaaacagtgagtgcggcggacacggctaccactgccactgaaacgacgcagacttctggctcgagtacacttgctaatcaagtggtgttgcgacaaactacgtgcagtagcagtagcagtagcagtagcagtagcacgaaagcatcggcaactggtgcggcgactgaaacggcgactagcaaagcggtcaccacgtctgagtcatcaacccaatcatctagcacaacagctactagccaaacgacttcaggtgtgacagccgctcaggcaacaacggacagtactgatacgacagcgacgtcccgggcgacggctaatgccaaagcggatcaacgagcggctagtgcgaaggcgaacaacgagcaagcaacgacccagaatcagcaacaaacgactaatatgtacagtggtgtcgttaccagtcaaaaagactcggcgagaacggcaactacgacggatcaatcaactgcgtctgtcgcgacactgtccagaatgagccgggccagtcttcgcagtttagcacaacgggcaacggttgcggttcaggggctcgatgctactgacgcaacggtgactgacgatgatggtgttacgtatagcgctacggatgtattgagtctgtatgcgaactatatcgcgaagtatcattggtcaatagccgatgatgttagcgtaactgctggcagtacagcaacggtgaccttacccgagaatgttgtctttaccaatggtacgcagcatattgatgtccaaaaatcagatggaacggtcgtcgggacttttacggccgagaccggtagtcaaaccggaacactaacttttaatgattattatgcgactagtgatcgttataatcgtcaaggagacttaacgttttatgttactgggactagcgcaaccactggcagtagtacgactgggattaataaggttggctgggccgatagtaatagtttagatgctgatggtaatcccaccaaaatgatctggcaagttgtcgcaaacattaatagtgaaaagtggcagcaagttgcgattgttgatcagctgggcctttatcaaacgcacgaaggtaccatgacgttggaaactggtcattatactgacggtgcctttgttaaagacgcggcactgggcacttatgattttgcaacgcagcagtttacctacgctgatggggtatcaacaccacaagtaaccgtgacggttgtgggtcagcagatgacaattaatattgaccaattagatgtagcggtcaatatattttatgaagttggtctgacagtaggacatacgtacaccaataatgcgggtgtaacgtatgcacctgtcattggagatgcgactgatccaaatgagggcagttcgacaggcgaaccaaagagtgaacaatcgaacgtggccgttagatttggtggttccggaactgctagtgatgacattcagagttacagtttggtcattaataaaactgatggtgacggccagtcagttgctggtgccacttatcagttagaggatagtacgggtacggtacttcggaccgatttggtgactgattcagttggacagttacgcatcggtaacttgtcggctgggacgtacatgctagttgagacggcggctccgagtggctaccagatcgacacggccaagcacgtcttcacggtatccgcagtgcaagcaacggctaacgtggtcacaggtagtgtggttgacaaacgaatggctaagacggggctgactgttaacaaagtttgggctgacgtgccagctggagtgcaaacgccgaccgttgaagtgacgttgcaacgcaatggtcaagcttatcagaccttgcaattaacgtcagcaaatggctatacgggcactttcagtgatttggatgtgacggatgtttatggcaatgcgtacacttatacggtgattgaaacggccattgctggctatatcagtagtcaaacaactagtggtgagacggtgacattaacgaatacgtatcaaaccgggaaattgacggtggttaagacggattcgagtggcgccaatcgcttggccggggcggtttttgccgtgaaaaatgctgccggaacgctggttgctcagttgacaacggatgcgactggtcaagcacagcttacaggtctaacgcaaggcgcttatacggttagcgaaattcaagcaccggacggttacttgatcaatacacaggcgcaagtgcttgtgttgaatgagcaaagcgcttatcaaggccaattagtttttgccgatgaggtcgaaccaagtgaaccgagcgaaccaagcgaaccgagtgaaccgagtgaaccgagtgaaccgagtgaaccgagtgaaccgagtgaaccgagtgaaccgagtgaaccgagtgaaccgagtgaaccgagtgaaccgagtgaaccgagtga

SEQ ID NO: 45 - DNA, 16387 bp, Lactobacillus plantarum
ccgagtgaaccgagtgaaccgagcgaaccaagtgaaccggtgctaccaggacacgctgacgaggatagtgattcagatcaggttgtcacaacgaagactgagacagctaagttagtcaagcaaactaatttagtaaccacgactcggccaacgaaattgttaggacagccaataaaattagtagcaacttctaaaccagttgttaaagttacaaaagcaactaatcgcaagtcggcgcaacaattgccacagactagtgaacaatcaatggattggctaatgattttgggctggttcttgctagggctaacagttgttagtcgtcaacggcgatttaattaaacaaaaaggctactggaatttcgcttccagtagcctttatttatatcatagataagtgtcgccacattatcgacgattttgagatgtgcgttggtcatgcttaattctgactggttgggcagcgggaacacgggcgccagccacgacgccggcaacggcagctagtccggctgcggccaataaacctgctaataacatgggcaagacctcctcaatagttgtaaaaaatcgtcttttaatacttgcagtttaggcgacttattaacaaaaatcaattatttaaccgtaaattagtgagaatctgaataacttgaaatattcttaagtaattgccggttattgttcattctggcaagggcggccgcatcatttaaatattcatgaatttgatccggttcatcggataattgagcctgtaagaatttgatccgcgctgcgtaataggtaacgtggaatcgcgcacaaatctcaatcccgtagtttaataactgcaaactccgcggtgtatcattaatgttagcgtaaaaagcccccgtgtaataagctaagttaatcacgcgccaaacactagcggtcgtttctagcggtaggttcggtagggcgtggcgtactttttcaaaatagtactgggctttatcgttatcctggttctgctgataagcaatcccgataccacagtaggccagctgtgtatagattgtgatgtgagcctcgtccaaatcggtgatgatttggtcaaaattaaagatgacatcactgatcgggtggtggttaagggcagcaacatagccttttagataacaatattgtaatttggtttcgcggtcatgtcgcggcatatccgcagccttttcaagttgtacttcggcatcttgatattcagttgtaatgaggtcgaactcgacctgttccaaaatcttcaaaacagcggcatcagcgacgcgttcggttggaaagacatcttccaattgtaggttgagtcgctgacaaagttgggcaacgattcgtatggcaggtgctttgccattgttctcgaacttacttagtgtcgcctgagtacaaataccatctgctagggctttttgtgaaagtcctagggctttgcggcgggcgatgaaaagctcaatgttcataccatcaacgcttcctttacatatttaagtcataattgaaacagctttcatttaccctaattaaaaactttttatataattttgtcaatatttaaacataatcttgcatattctaaaaatatatcttgactatataaaaaacgctcgctagtctttgctagtgagcgtctgtgagttatctgatggtttattttgccatataggcgtctttgaagttatagttggtaccagaagtgttataaatcaggccctttaacttagggttgaccatctgtgccagcgttgtttgagttaatggtgcaacgccttcatccgtcccaataattttttcagctttgcctagagcagtccagcgtactgtcggatcagttgcttgctcggcctgcttgacagcagcgtcataatcagcatttttccacttaccaaagttgtaatcattcgtggaagtgagaatgcctaggtcagagatggggtcggcgaagtcagcttgccagccagaaatagcgagttggaaatcacccgatgtttcacgtgcaagtcggtttttgaatggcaaggtaatatcggtaatcttcaaaccgggtagttccttttctagctgtccctgaacatattcggccgtctctttggtttggtcaatattatcgtgcgtaagcgttaaggttaatgactttttgccggtttcttttaatccttctgcccacagtttcttggccttagcggtgtcttgagttgtcgccgcactaactgcattttcagtagcgaaatcttcaccagtcgttggatcggttgcgagcccggtggtgacaaagccctttggaactgctgagccatccgctagtacgtccgtgacaagttggtgccggtcaatagttaaggacatcgcttgccggagcttggcattagctagcgcgggcacctttttctgattaaactcgaggtagttcagacgggatgtcttacggagcactaacttgggattattcttttcgtttttgacttgttcgccgctcagggtggccatgtcgagtttgttgctctggaataagttgaatccggtcgtggttgacttaacgacttggtcattgatcttttctaagtaaacgtgttttttatcccaatatttaggattgcggttcagggaccatgtcgtattagtgcctttccagcccttcatggtaaacggcccatcgtagaccatcttggtggccgttgtcccatagtccttgccgtatttctgtacggcgtgttggttctgcgggaagaagatggcaaagcccattaggagtttaaaataagccatgggtttatcaagtgtcacggttagcttgtatttaccgtcagctttaattcctaaactattggctttagctttaccattggtgatttggtcggcattcttgataccagaataaagataagcatattgcgaagcggtcttgggatcgatggttcgccgccaactataaacgaaatcttgagcggttacgggatcgccgttgctccacttggcgtctttgcgcaatgtgaacgtataagtttttttatctttggaaatgacagtatgggtcgcaatgcccggtgtgattttattattattgccaatacggtagaggccctccatcgtgttattgatcatattggcactgatcgaatcggtgactagcgaagtatccaaagtcgttagttcggagccattttctgaccagttcaagacttgcttttgtgccattcccgcgcgtaagttccccgcattatctgacttggactgaccttgactacaggcagctaacaaaaggccggtcgatgcggccgcagtagcagttgtcaacattactttccatttcatagtaaaacttccccccaacttgaatggtcacgagaatacattaaagcaagattaaaatcaatgctttgattctaataattaaagtaattaacagccgcaaaatgtgtcaagaaacacaaaaaaagtaccgtagtttgttgctacgataccttttattgtgcgatttaagggtagtttgacgtgaggcgatgctagttaggtcaccttatttggccatataggcactcttgaagttatagttaatgcccgccgtgttgtagactaggcctttcagcttagggttgaccatttgtgcgatgacgttttgtgagagcggtgcgaccccttgatccgtcgccatcgtcttttcagcggttgcgagagcttgccaacgcttcgttgtactggttgtactatttgctgtgttgatagcactatcgaaagtcttgttggtccacttaccaaagttgtaatcgttagttgatgtcatgataccgaggtctgaaactggatcagcaaagtcagcttgccatgcggagataaccagctggaaattacccgcaatttctcgggaaattcttgtcttataaggaacggtgacactttgcactttaagtcccggtaattccttttctaattgtccctgaacgtattcagcgagggccttcatctgatctgtatcgtcatgagttaacgttaaggtaaccgacttcttgccggtttcttttagtccttgtttccagagctttttagctttggtggtgtcctgagtaacagctgatttaaccgtattttcggtggcgaagtccttaccagtcgttggatcagtagcaagtccggtcgtaacaaagccctttggagtgacggaaccatcgccgaggacatcgttgaccaactgcttacgattcaaagtcagtgacattgcttgacgaatcttcttattggcgagtaacttcaccttcttttgattgaattccaagtaatttagacgtgaagacttacggatgaccagtttgttattattcttttcgttcttgacttgttgtccagataacgttgccatgtcgagcttattactctggaagaggttaaaggctgtcgtcgtcgacttcacgacttggtctttgatcttagttaagtaaacgtgttttttatcccagtaattaggattgcgcttaagtgtccaggtcgagttggtccctttccaaccagtcatcttgaatggcccgttgtaaaccatcttgctggaactggtcccgtagtcctttccgtatttttccaccgcgtgctggttttgcgggaagaagaccacgaaacccatcaataatttgaaatactgcatgggcttttcaagtttgacggtcagcttatacttaccatcggccttgatgcccaaggtactagtcttggccttgccgctgacgattttgtcagcatttttgataccggaatataagtaggcgtattgggaagccgtcttcggattaactgtacgacgccagccatacacaaagtcttgtgcggtcacttgatcgccattactccatttggcatttttacgcagggtaaaagtataagtctttttatctttggacacgatcgttttagtggcaatacctggtgtgaccttactgtttttacctaatcgatacaaaccttcttgcgaattactgatcatcgtcccactgataacatcagtggctaaggacgggtcaagggtggtcaaatcctggccgttttccgaccaattgaggacttgagtcctggccattttggcagttgtgttgccggcattgcttgaactggatgaggactgaccacagccgacgagtaaaacgccggtcgttgccgttaacgtggcaactgtggcaaataatttccattgcatatatgtaccccctgcttcaaataattatgatatgtagatgagaatacattaaaattagattaaatacaatattatttttttaatcattaatattattaagcaaataaagccagtacgactcgttaagaatcgtactggcttaattaagaaaactaacgttgccattgcatcgtatattctggttgctgggttgcttggtcattagcctgatcaatgacacggaaaccgtgatagtgataaaaggcaatggctgggcgattagcaacatagacgtttaattgtaattgatgatggtcagcttgggcagtcgccaatagcgccgtccccagaccttgatgttgagcatcattgcaaatgaaaattccggcaatgtaatcgttttgtaagcctataaagcccagaatataagcttcaggtccgtcggtcagtccgacgatgagttcggctgattgtaatgcttcacgtactaagggggcttgttgacgccagtagtcggcactgacaaagtcatgggccgttaaattaccacttaaccagattgtcattaactgatcgagttggtgagttgtcgggtgttgtaagtgttcaatcttcattcgacgctaccccgttttaatagtcgaacgcgactcactgccggaattttagacagttcagctattaggtcggcttgttgtggctgctgtaggtcgtcgacgtcaatgatggtgtaagcaatctggtgcttagcggcgttagccatggtagtgatgttgaggttggccgctgctagtttggccgtgatttgactcaccatgttaggcacattttcgtgaatgactgtaaagcggtaagccgcgttgaacgggacgtttaagtctggcagattgatggccgcatgaacgttaccggtttccaaataagtcatgatagtgcgcgcagcttgtgtggcaccgttgatttcagcctcgatagtcgagccgccgatatggggtgtcacggtaaccgcggattggttggcaagctggggttcgccaaaatcggtgtagtagtgggcaacttgtcccgtggctaacgcattcatgacggcagtattgtcaacgatgcccagccgtgaataattaaataattgaacgcctgttggcatggcggctaacgcatctttattaatcagatgaagtgtgtcggcatttttaggaacgtggacggtgacaaaatcagcttgtttgactgcatctggcagcgtggccgctcgctggacttgtttggcaatgttccaagcggcatctgcagatagataggggtcgtaaccaattacattcatgcctagactcaatgctgcattggcaacgagagcgccaacatggccgagtccgatgacggccaaggtcttacccgttaattcaataccattaaattgcgtcttgtcgtgttctgtgcgttgagaaatatcagcttctgtatgctgggccgaataggtcgttgcagctattagattacgggatgccataatgagcaggccgatgatgagttccttaacggcattagcgttacttcccggggtgttgaaaactgcagtcccgttggcggttgcctgatcgataggaatgttgttaacgccggcaccagcgcgcacaatgactttcaacgatgacggtaatgtctcggtatgtaggttgaccgagcgaattaagtaagcatccggatgctcagattgattgagcgtgtaatcagcagtaaacgtgttgaggccggctggggcgatggcgttataggttttaacttgatacataaatatcctccttgattaacgatggtgtgcttcaaaagcggctagatagtcaactaatgcctgaacaccggctaacggcatggcgttatagaggctggcacgcataccgccaactaagcggtgaccctttaggtttaataacccgtgctcacgggcgccttgaatgactgcggcatcgaggtcggcctgacctgtgacgaatggaacgttcatggtcgaacggtcgctggtcttgactggattagtaaatagttgtgactggtctaagaaatcatagagtaaggcggctttagcgtgattgcgagcagtcattgtgctgagcccgccttgggcctttagccacttgagtacgagacccgcggcgtaaatagcaaaaacaggcggcgtgttgaacatcgaatctttagccgcgaatagctggtaatccagcatgcttggcaggttggcgacttgaccaattaaatcatcacggacaatgacgattgtcaaaccagcgggacccagattcttctgagcaccagcaaagatgagcccaaaatcgctgacttggtaaggttcacctaaaaagtttgatgacatgtcggctaccagtggtacttgacccgtaactggcaggcgcgtcatcatggttccttcaatagtattattagttgtaagatgaatataatcgagggattgatcgatgggctggacgaccgttggcagttggttaaaatggttggcagcgctactccccagtatcgtgactttagtaccgacccgtttagcttcatcggcggcgcgttgtgcccagtgaccgctgtcaagcaacccgatacgatgatgaggcgccagatttagtggcgcagctgtgaactgtagcgtgcccccgccttgaaagaagagcacgtgatagttgtcaggaatggccattaaatcgcgaagatcttgttcggcatcttgaaggacttgcgcaaataaatcggagcgatgcgagatctctaaaatgctcatgccggagtctcgaaatgatggtagctccgcttgaatttgagtgatgactggttgtggtagaacggctggcccagcagaaaaattataaattggcatgaaaaatcctcgctttcagtagtttaatcaaggtaataaaaaagtcctcgcagtcggtttcgactaccaggacggataataacgagattaagcaattccacctggtagcgaatgtcttagcatccgtgctcaggctgatttgcgtacgcaaaattaggccgacacagatgggtgtgtagaccaggaggaactgatatgatgattgataggattagttagaaccatcagttggacactccttcgttaaactggtgttggcaccagtcagttaattgcgttggtattaatttagcaagcacgtaactatttgtcaagctagataatgagaaaagactgtggcacaattagtattattaataataatttaatcttggaggcgcacgatgacaaccttttacgtggtacgacatggacaaacagtggccaacgcccaaaatttaaaacaaggcacgattaatacagccgtcacgcatttgaattcggttggcaagcagcaagcgcaaacgttgcacgatacgtttgacattagcttcgcggatcggttgatttgtagcccgcttgaccggacccaggccacggcggcgattttgaatcaaggccggcaactacctgttagccaggacgagcggttattggaaatttcatacggccagtgggatggacaggataatgatcagttgctagcggcctatccgcagtactttgatccacttttacaggacgttttgccaagctacgtggaggttgcgacggatggcgagacttttgagcacgtgcaacaacgggtagcagcatttttgaagacaacagcacaagcccatccagacgagcagatcattgtcgtgacccatggttttaccgtcaaagccatggccttagcgatactaaagccgaccgatccgatgagcttaccggagccagctaatacgagcgtcactaaagtaatggtggatgctgtccatggtcgccaatatttagcatattataaccgcctacctcaattctgacgcgcaatgacttaacgaacgggcgattccgggctacaatagatggtggtttgaaatagccacgcactgttgaaccttatttcaaatcaaagtctaattaggcagcaacagcagacatcacatataaactcctaagtgaggtggtcctagcatttggcgaggatcgcccttttgtatccgcttaagcgtttgatcagtaccaatattacaggcgcggtataatataaatagtattcaaaaattagatgaggtgagtaatgatgacatattcagcagcatcaacgcgctatgacgaattaccgattcgacgcgtgggtaagacggggctacagttacccgttgtctcgttagggctatggcgaaattttggggatgaagcgccgtttgccaattcacgaaaagtggttctagatgcctttgatcatggcgtttttagctttgatttagcaaataattatggaccatcgaagggatcggcagagcggacgttcggacaaattatgcaacgagatttaaagccgtatcgtgatgagctcgtcatcacgactaaagccggatatccggcctggtcagggccgtatggggctttcggctcacgcaaaacgttgatcagttcattggatcgtagtcttaagcaaatgcatttagattacgtcgacattttctactcacatcgtccagaccctaacatcgatttgtatgaaactgccgcggcccttgaccagttggttcgtcaggggaaggcgttgtatgtcggaatttcaaattatgaccgcgaccaaacggcaacgatggttaagtattttaatgagatgcacacgccgtttacggttaatcagtactcatataacatgttgaatcaacaggctcaaacaacgggcctgattgactatctcggccagcataatgcgggcttggtggcatatggtccattagctgaaggattattgacgcagcgctacttacaaggaattccagccgattttccgattcatcgaacgaataaatatttatttgatcaggagactgcagccgttgtcaatcagttgaatgccctgaacagaatcgctgagcaacggggacaaaccttggcccaaatggctttggcttggctactacggtcacaggtcgtcacgagcgtcatcattggtacgaccaatgtcgaccacttgcacgctaatcttgaagcaacgcacaatttaacctttagtgatgatgaagtaaaagctattaccgcgattctaaagtaaattgcattaaaggccactcccccaatatgccggggagtggcctttttattagcgcgtcctgtttattaaggtcaaaaatagctcactcttaggctcgttaggtagactcctgttcttcagcaataatcgccctatttccgacctccggggcggagcgacaattgctggaacgtaaaccgacatcgatttgagcccgaacccgcccagtctcaaatacgagacttattctaagctggcggcttttgaatttaatgacggtcatgttttgaactgagccatagccgtgcgctaacttcaactgaccgaatccgggcaattttaaaataatttgggcgaatgttcggtaacctcggtagttaacggcataattagttagctggtgaaattactgattggtacaagtgaccggtttatcaacgtcatcaaaatgtaatagtttttatcgaacgtacgttctaaaaatgtgctatgatggagctactatttcgatgaggtgatctaatggaacagctgaaaccaattgaagcgtcgttattgcaagcttatgagttaaactgcgtggttcggttaactttaagtgatggtcatcagccgagtggcttaattgcggctgtggacgaccagcagctttttttgaatcaacaagcgggagtcgttaagccgattgcgttgagtgacgtaaccgccattgattttcttaaacagtcttggtggcagcggtaatcctaaaggtcgtatttcgctatgatttcgtgacgacggaattcggtaatagcagtaatcaattcaagtggtaggggctgatccagcggaaactggatggcccctttgcttgttttataggtgattaattgatcatgaaaagtctcaattgcacttggcgttgggtacaagccaaagtgatgtttgaataaagcaaaatggatgacgttttcgtgccaatagaaggtcggcatctggtactttaactgctcttgcgcctctggtaagaccgttgcaatggtttgctgtaaggctattaattgcgattgataggcttgtggtgtgttagcaatataggcctcaatcggcgtcatggtgaatatcttcctggtcacgtaagtcagcagctaaagtagcatcagggacaacggtgatcgtgcgtgcaggaccactaaaggtgacaagcccagccttagcacccttgggtttacgcatctggccaacggtgagcacatcaacaggtacgcggttcatctgacgacccttactgtaataggccgtcagtacggccgcttcctgcaaggtttgttcactcggatgattactgtgaataaccacgtgtgaaccgggaatttcaccacccgcgtgcatccagtagtaatctttacgggccgtcaatgttaggtggtcgttttgacgactatttttaccaacttcaaccagcacgtggtcgtgcgtgtaaaagcggcggggatgggcgggtgttggggccttagatgagtgtaaaacgtgggtatgaatcgcgcccgcagcaatcagtgtttgcttaagcgcggcgaccgcttgtggatcattagggtcgaaagctgcttgagttgctaattgctggtatagttcggtcttggccgtcgccaaattttgttgaacggtcgcttgaccgcgtttgcttttgtgataacgatgaaaataatcctcggcattttcaataattgattttttaatatcgagtttaatactgagttggtggccttgatagtcgggcaattcgacgaaatgatggtgcccctcgatctggctagcatacgtcttcaataacgtgcccttgagttgcaaatcactgacatcaggcaggtggtctaatgctttagttaatgattcgatttgtttacgcgtgtggtgaattaagtgcgctaatccagtttggactaggtcgacatcggttgtggtcgtcattaattgggttcctctaatctgtaaaagttaacgtcttaataataacatgttctggttagttaacagtggaagattgggactagcgaatgaattaagatgtcaaatgacacgattgaaaaaagttgagcaattttcagaaaagttcggtattctattacatgggagttgattgagaaatgcaaaaaacattaattattaacgcaggtagttcatcattgaaatggcaattatttgctatgcctgctgaaacggtggttgctagtggtctcgttgaacggattagtatgcccggttcaattttcaccatcaagtatggtgaccatcaaaagtttgaaacgacagtcgataatttagatcaaaatcatgcggcgcagatgttattggctgaattacagcgattagcaattattgactcattaacggaaattacggcagttgctcaccgagtcgttgcgggtggcgaaacgttcaagcaagcagttgaagtgacgccagcggtactcgaggccattaaggggcttagtgactttgcaccattgcataatccgatggaggcacgtggtattgagacgatggctcaggctttaccgaccgttaaacagtacgcggtatttgatagtcaattctttaccgatttaccagaaatgaatgcaatttacagtttgccatatgaattgacccaaaaataccatattcgccgttacggtgaacatggtatctcgcatggttacttaaccggtcgggctgcagaactgctggctaagccgaaagatgacctcaacctggtgacgttacacttaggtagtggcgcgtcattagctgccgtaaaaaatggccgggccttcgacacatcgatgggctttacgccattaacgggtgtcacaatgggaacgcgcgcgggtgacgttgatccggccgtattgccattcctcatgaaagctttaaagatcgatgatccgaatgaaatcatgatgatgcttaacaatcagtctgggttgttaggaatctcaggaatttcaccagatatgcgtgaaatccgtgcgcaagaagccacgaatccccaagcccaactagctgttgaaatttttgtcaatcggattgttaagtatgccggtagctatttgacagaattaaaacgggcggatgcgctgatttttgcgggcggcattggcgagcataatgcgaccttgcgccagcaaattattgatgaactgagcatctttggtgtgaccctggatccgaaattaaatgaagcgggtcaagaaggactcatcagtggcgcagattccaagattaaagtgatgttgatcccaactaacgaagaattagcgatggtgcgacaagttgcggcgttgcaaaattaagcttctcttaatttacgactgcaatcagtctgccgctgtatagcgcgtgctatactaactggcaaggtacccatgatgggacttgtaaggagggaagctctcttcgcagagcgcatagatgatcggtttattgattgctttagtaattggtttatggttgctcaaagttatctttaaaattggttttaaaattatcggttgggtgttcatgattgtgattgggttgtttttatttaaaatcgcattatggttaggcttgatcgtcgtggcgattgccggcgttgcattattcggaaatgccaccacgtaatttgaaagataaagatgagcgttgttaaaactagtgtcatcggcacgctagccgtaaaggcggcttgttggaactaaatagtcattgaacaaaaacaggaaatctcagttagttttgtgagacttcctgttttttgagttagattaaagttccgagataaaccatgactaggccaccgacgagactcaagccaaagtattcccaggcgacccgttgatggtggttacggccgagcaacacgagttcgttgatcattgttgaaaaagtcgtatagccacccataatcccagttcctagaaaaatctgccagttgggcggtaatgagctggttaaaatccaaccgagcaataaagcgccggttagattgataaataacgtggcaattggtaacggccatcgattgagaggtagtgctaagcgcatgatgccgtaacgacttaaggcccctacagctgcgccggcaccggccaatccgactaggactaacattaaaattcctcctttggtagccaataggtgctaaggaagtttccagctagccccgctagcaaacccaaccctaagctagcagcgacataacttaaagctaaaacgctatgaccactttgaaacgattgtagcgtttcaaaagtgaaggtggaaaaagtagtaaagctaccaacgaacccgacgctcataccgataacaatatcttcagagacgggtaaccgcgctggtaacaagttagtaatcaggctaagaacaaatgctcccacaatattaatcagacacgttatccagaaatgctgtggccaagtgacgagcaaactaagcccctcccggagaccaccacctagcattgcgaagccggtaattgcaatgatctttttcaagctgacacctgctttctgaaagtaattttagtttactgaaaaaacttttaaaaaacaatggttcttgcaaattgaaattaaacatgctaatctacaaagtaacttataaaacacgaggtattcagccaatgcgcaactaattaattctagtaactgaacagagccatgcctagcgataggggtggactgtccgttttgggattaattagggtgctggtggaatcaattgccagcgttctcattttgaggacgtttttttgtgccataaattagtccctgcaactaaggggatgcttattaatgacaatgattaatttaaaaaatattcaaaaagatatggcgggacggccactatttacaattgaccgattagtcgccaatgccggggatcaaatcggcgtggttgggcggaacggtgctggtaaatcaacactggcccatttactgacgggtactgatcgtgattatacgggacaaattatggtggacgagccagtcagctatgttgcccaaatcgcaccgacttttgaccaaagtggtggtcaagctatgctaaccagaattcggcaggctttgagcgcccggccaacaattttaattctagatgaaccgtcatctaatttggatgaaacacatcagcaatggcttattaatcagttacaacgttttcgtgggttgctgttgttgatttcacatgatcggcaattattaaatgctgtgacgacacagacttgggcggttgaacaccaaaaattcaccgcatatgcaggcaattacgcatattatcagacggtaaaagcgcagcaaatcgcaactcaggaagccgcgtatcagcgccaaaacactcatcagcgtgagttactagcagcgcagcgtcaacgtaatgaaaaagcgcagcggattcgaaaaggcaatcggcgaatgtcgcaagtagagcgtgccaagacgaaagcgactagggaagctactgcggccaagatggaacgaacggctaaacgcatggtcgcccgaggacaacgggaaccgcaagttgctaagccctttacgacttcaggctttaagttagtcgcgacagattttccgacgtttacaggtaagaccgtggtaactggtcttaatgtcacattggctgaatatggaaaaacgttgttagcacaagctgactttcaaatcaggccacatgatcgggtcgctatcgtggggcccaacggtagcggtaagaccacattactgcgtgtaattttaggtggccgggtgtcaggattacgattggctccggcggcacgagtcggagtattcaaccaagatatgacagtgctcgacggtaaacagtcagtgtggcaaacggtgcggcaagtcagtcagctaccggatcaaacgatccgtaacgtcatgggcgcgttgggcctgccagcacgcttttatccgcaactggtatcggcgttaagtggtggtgaactagttaaattacagctaattcgtattttagtcggtcaatataacgttttaatgttagatgaaccaaccaattatttggatgtggacgcgctggatgcgttggccgattacttacaaaattgagagcgtaaaatatcttg

SEQ ID NO: 46 - DNA, 18911 bp, Lactobacillus plantarum
ttgagtcgtctgtgttgaagttgaagtcgtggtagtgctatcaccatttacttcaagttgttgaccaactaagatcaagttaacgtcttttaagtggttagcttgttggatcgcatcaatcgtcgtgttatgatcagcagcaatggcagaaaccgtgtcaccggctttaacagttaccgtagcagcttgagcggtagcaccaatggcaaagagactagcagtagcggcagcagttgataataaagcattcttaatcttcatttgtaatgtacactcctattttttagtccgaatttggcttggccccgcgaatcttccaagcactcaatggtacctagtataactggcgattgtgacaggaaaatagcaggagttttacgaattaccctaattcttgtaataaacggcgtgttttgtaatcttttgtaatataacgcgcggcgcaattgtttctgagcgggtcaatcaaggctgtttacaaatgaagacggtgtctgttggttaacataaccaaatgttgtgattaaagttcgaagcgtgatatcactgggactggcaaccgctgatgtcgtgactaagcttagttaagccaatttacgagttcttttagtggaaatgtaagcgtttgtttgaatgtcagccaacttacttttggtaactcgaaattagtcggcctttaattggaccagccagttgtcggtttgtttattgttaatgagcgattggggtgccgcttgtaggtctttgttaagcttctgaacggtgccactaaagggtgttgacaccagatgcgccccttgatcgtccgtaatcgtgacgagcggatcacctgccacgaggtgctggcccttagttggtaaatcgagttgatgaacgacacccagattgtgttgtccttggtcacttaaccccagtagaagccggtcatgtgatttggtcttcagccaaacgtcgccgtataacatcggagcatgttgctcttcgtaatcatgacgatagaaatggatcatttgtttccaagcagattcttgttttgccatcatttctcctcaattcagtgctagtagtcggtgcatcaattgaaagtggtgcatgattgctaatttcttaattattcctaaccctgggaatttatcaccctcagcgtaggccaatagggtggcaagcgcgggggtgcgattgagtcccgtcaggtgtgcgggtgcccagtcggtgagctttgttaatgcttcaaaaaacttttgcttttgaccacgcatattggcattgctgtccgaaacaaaatgatggatgcgcaggtcaccgttaaccgtaacataaataagatgtaatgcaattgcgcgtgatggcataccgtggtcaaaatagggtcggcccatgagtgagtaatcgccaaaaccatcaaagccaaccggtgtttggtgccagttagcgggggcaaaataggcgtcagttatttcttgatagtccgcaacgtgcgctggggttgccacgggatcagtcaataagaccgcgtgttgtggtaatagttggtgcaaacgcgcttcatcagggattaggacatgaccagcatgctgtaaagtggtcgtatgctgataggccttaagcaacggatagttaggcgcgatgagcaagcttgtttgaccaggagtggttgtcagaaagtcgcgactaaaatcagccgcaagaattgcgcccggccggtaaaatgggtagggacgcagatccggaagtggatggagcttaacggtattaagaccatagacactcacttggggattcgcaataatgctaaatggttgttgggcttcaataaaagtcgtgactatttgttgtaattctttggagtcacggactggttcaattactgggatgatgtgtgggccaagttggtgttgctcgcacaatgttcttaaggctaacaaatcatacatccgtccacgtagataggggtagtaagtgctcataactggtcacgcagatctggtgccgttagcgcctgatattttagtttgagtgtctgatattcggcattgcgggcatctaattctgtttgtagcgcagtcaccgcgtcattctgggtgtcatcgatgaagcgatcgtacaagttttgttcaggatcataaacgtcgtagccggtgctggcccgtttgcgtaattctttgaagagttgatcatcagagtagagctgtagtcctttcttcacacgcttggctttatcgacctcacgaaagagcgatgtgataaagtgactgataaggggcgtttgctcgacttgtaagtcttggcgttgggctttcttagcgacagttaggaaaccaggcgttcgcaacggttggggtgcgagctctagggcccgctgatcaaaagcacggtagatcaatacaccaatatggtctggaatttccgattgaacttctaggtaaagttgttgcggcaagacaaagtaattgtaatgaccgataaatgaaagtttggcctttgaatgaaaatctgctttggtgactttcaattcgtagcaacgccattcaatctgaccatcggggagttgttgatagcttaatgtatcaacgatccctttatcagcgggcatcgcaacttcttcaaccacgtaggcgccctgttctagacagtactgatagagagtactttcaagttgtttagttaatttagtcttcattaatgagtcacctccatttggtgccaaaagttggcaatcgttgcttcgagctgcgggactgattggatcgtctgatagtactgccaatgtgctggaaataaatctgtgtagcgccgactagcgaagcgttggtctaacaagagaacgattccggtgtccttggcactgcggatcaggcggccagcagcctgtaagacgttgttcatgcctggcagttggtaagcgtaggcgaatcctaagccgttttgatggtcgtagtagtcacgaatcaagttcgtttcagggttgatacccggcagaccgacactgacgatagcgactccaatcaaacggtcgccacgtaagtcaatgccttcggagaagataccacccagtacgcagaaaccgagtaaggtttgcgagggggctgactgaaactggttcaaaaaggtctgccgggcagttgcatccatcgtcgaggcttgggcggtagttgccacatcagggtaggcggcttcaaaggcagttttgatctgcagcagatagccatacgacggaaagaacacgaggtagttgccatgtttagccgtcaacatggcgtgcaagctggcaataatccggggcacgttatgttcgcgttcgtgatacgttgtctggacgtactgggtgacgagaatggcctgatgctttggtggaaatggtgatggaagctggtaggccaaactgttggcttcaccgccaagcacccgctggtagtaagccatcggggtcagcgtcgcagaaaataggacagcaccactgccgagctctaatgaccgattaagaaagtcactgggatctaggcagagttccttgatcgttaagtgatgaccgtcaaggacgaagcgcgtctggtagctgccatcatataggtcgccaattttaacaaaggtcagacagacgaagaaataatcacggacggcgtcgagcagtggccccggcttttgttgcgccaaccagtcagtcacaaattcattaaatgttctgagggtgcgtaataatttgtccgggggatcaggtagcacctgttccgttacttggtcatcaatcaaggttttactgatgcgcgtaaaactacgccggactttcttgagttcgcgttgtaagtcgtcacttggctgacttttatcgggcttggctaattttagcaacgcactgattggctggtcactaacggctgcagagtacatatcacgggagcgactaacaaggttgtggacttcatcgataaggaaaaagttgtcgtcatcacgttcgctaaagaatcgttgtaaatagactaatgggtcaaaaagatagttgtagtcacaaataatcacatcacagaagagcgacgtgtcgagtgaaaattcaaacggatcgacagtatgcttgcgagcatactgttcaatcacggaacgggtaatctggtcttcatgggtcaacagatccttgagtgctggtttaagtcggtcgtagtagccaatcatataaggattatcttccggaagtacatcttgttcctcgggaaaccgaatctgatccttggcagttagcgtaatgcttttcagtttgagtccgtcatgactcattagcgtgaccgcttcttcagcaacgtggcgcgtactttgcttagcggtcaggtaaaagaggcgctcaatcacgtcttcgcccattgctttgatagccggaaatagcgttgagatcgttttccccgtcccagttggtgcttcgacaaagaggcgtttttgcaaccgaattgtcttataaacagcgccagccaattcatgttggcccggccgaaaagctggaaacggaaatggcaagtcttcaatagaagcgtttcgttgtcgtcgtaaatcggctcgtaatgtcaaccagtattcatattctgtaattaagtcgtggaagaatgcgtctagttcagcccggtgaaggatttgctgggtcttcgtgattttttcattgatgacttgaaagtaggtcagctgcaacgtgacctgctcaagatcgggatgttcttgcagtaacaggtaaccgtagactttgatctgcccccagtaaagtgtcaacgtgttggtacttaagttctcgaagacttgatcggatgttttgatttcttcaatcaacgccccatcatcatttaactgaatcccgtctgcccgacccgcgataatgtaatcagtatcgttcatcgtcacaatttttttcaggtaaacttcgctatcatagtcttcaccacgactactctggagctgacgatgaatcttagcaccgttcaacgcagtgttctggctattctttacttcatttaaatcgccttgtcgcaagacgaattctaccaattgtcgaattccaatcttagttgccatcggagcatcccttctgaatttagtcgcttcctattataaaacatctgttcgtgtttgtctgctgttgattgatgatgccgggcggggctctgtgatgtggccttaaatgatggttaagctgcggcagaccaatatttaagacgcgggcttcggcggcttgaatctgggctcgtcgtgttccagcaattggcgaaaatgcctgggagtcaatgtaggacgaactagccagacgggtgcatgctattccgaattttttccagcgaatcttagctggtcacttttgcctttgaaaaactgatacgggttaacaatctggattgaaagctaaataaaaaagcatcgcgataagggcgccgatgcctgttgcgatgtttagattgacgattttgatttagaagaaaatgaatcagactaggaagttaatcgtaccaatggctgtggtgttggcgaatgctcttgcggagactaaaaccgtagctgatgatgccggctgtgataatggtcgctaaaatcgcaagcaaccatgaaccggacgtgctaaagtaggtggcgtaaccaaggctgagactgactaatgtgatgacgggaattagaattctcacaggggctggatgtaagaagacgacaccggctagccacagagccgctgctgtgaccatggcgtcgacactgattggtgaaccaaagctaataccaagagtgatgatagcaagaattgttcccacggtcaggaggaggacagcaaagccgttgctgacggaccaagtaaacgtttttttcatcatgatcgcctcactttctattaactatattataggctaatttcgccttatgaaagaaataatatgccgacaattaagtttgcaatgttatgaaaattgaaagtttgtgaacaaatccttgaaagcgtatccactattagttaaactggcattaggcacacttgatgatggatggaggaaaaatagtcatggcaaaaattttagcaattaacgccggcagttcaactttaaaatggaagcttttcagtgttcccgaagaaacggtaatcgcatcgggaatggttgatcggctgggattgccagattccgttttcacaattaagaaggcggatggtagtaaatattctgaaactaaggaccgaattgatgcaaaagaagccgctgcaatggtcttaacacggctgaagagcgataatattgtgactcatcttagtgaaatcactggggttggtcatcgggttgttgcgggtggcgaagatttcaaagactctgtcgttattacctcgcaaaccttgaaaaaaatcaaagatttatctgagtatgcgccgctacataatccaacgcaggcttattatattgaagtattccgtgatttattaccaaaagcgactcaagtagccgtgtttgacacttcgctgtatgcggatatgcctaaagttaattacctatatagtattccttacgattattatgagaaatttggcgcgcggaagtatggggcacatggcacaagtcatcgttacgttgctaatcggacggcccaactattggggaaaccattggattcgcttaaattagtgacattacatttagggtcgggtgcttcgatcacggcttttgatcatggtaaagccgtcgacacttcaatgggctttacgccgctagctgggattaccatgagtacccgttccggtgatattgatgcctcaattattccattcttgatgcgccatttagggatctctgatgtggaagactttgttgatattttgaatcataagtcagggttacttggtatttcaggtttgtcacctgatatgcgtgatcttgataagacgcaagatacccgtgaacggtcaaaactagcaattgatatttttgttaaccgggttgtgaagtatgtcggcagctatattgctgaaatgaacggaattgatgcccttgtcttcacggctggtgtgggtgaaaactcatggatgatccgcgaacgcgtcactaaagctttaggatactttggcgtgacagtggatgatgaaaagaatcatatgcacggtaaggaacaaattattagcaaagatgacgaaccggtaacggtcatggttgtcccaactaatgaagagttgatgattgtgcgtgacgttgaacggttatctaaagctgaataaatgagtcaattaaaaacgcgtgattcggattgtggtccgagtcacgcgttttgagttttggattctaatcagcatagcgctaagtcagctcttgtccccgcatatgtgccgatgtgatgtgctcagctattggcgttgtcgcgcaggtttagtcattttgatgtggggcgtgtggttgaatagaaaaggggtaccgctcgaagtgaagccgaaatgctggtaaaatctttgtactggcacttgggcttcaatttgaattggcaaatcagcatagtgttcctgtacgacctgttcgatatgggccattaaatcagcgcccaagtgttgtccgcgttggtttttgtccaccacgacccggccgaaggagagatggtcatcttctgtaaagattcatgcgtatgcaacaatattttgattgacggttttaaagacatgataagcttttaaatcagtatcatcgacttcctgatagatgcgctgttgttcaacaacaaacgttttgacgcgcaattcataaatagcgtataattcagttgttgttagttctgagaatgttttaatcgaccacatggtgatgcctccttagcatagtgctaagtttatcatcaaatgattgcatatgcaataataaaaaggagcttctatgataccaacattaagattgatgggcacgttgtcgcgaatcgtcacgaacgagggtaatcaacgttttgcgaaatacggcctcaataacaatcagtttatttatttaattcgaatttgtgagcagcctggcctattttttagtcaattggctgaccaaatgaagatggatcgaaccacgaattatcgcgccgttcagaacttaataaaaaaaggttacgtgattaagcagacacatccagagaataaaaaggtccggtgtttgtacccaacgagcgctgggcaagcgttgtacccggaattgcatgcttatgagcagtggtgtgcagacttggttggtgagcagttaacgccgggccaacaacaagttttgtttgaaagtctgtcgttagtcacggctaatgtcacccagcatattgagtaagtttaatcactaaactagattaattgtgaacaattaaaatggcgtggcgttttagctgaattttaggcgtgaagagtgtaccatgtagttatcaagttataactggattaatgtgatcaacgcaggttagcacaattgctggacaggcggcattagtcaacaggaataatgaaaggggttaataaatcatggcaacaactttggtgttaggtgggggttacgcagggatgcgagccgtcaagtttttacagaagagtctaccaactgaggatgaaatcattcttgttgatcagacaccgacgcatacggagaagactaatttacacgaagtcgcagcggggacgatcgcacctgatcgaattacttatcagattccagatattatcggtaagcgggtccagttcgttcaagcaacggtcaagagcgttgatattgaacaaaaacaagtgacctttgaagatcatcctgaaatgacctatgactacttagtattagcattgggcttccagtcagaaacatttggggtagctggcgccgatgaaaatgccttgccaatggatgatttggcaacttcacaggctgtttatgaacatttggaagaacggtttaaagcctaccgtaccagtaaggacaaaaatgatttgaagattgcggtctgtggtgctgggttcactggaatcgaattattaggtgaactgacccagacgttaccaagattgcaggcgaagtatcaaacacctgctgctaagttagtttgtttggaacggatgccatcaattttaccgatgtttacgcaggaattgcgggactacgctttgaagtttatggaaaagaataatgtcgaaatgcggttaggtgccgttattgaggccatcaaaccgggtgctgtggtttacagtgacgcggacaagaacgaacatgaatttacggctaacactattatttggacggttggtgtcagtggttcacacgtcattgctgattccggttttgatcagcgccgtaaccgggtcgtagttaagcccgacttatcactggaagggcatcccgaagtattcattgttggggatgtcgctgcagtgatggatcccgaaagcaatcggccatatccaaccacagctcaaattgcactggcagctggcgaacaagctgccaagaatattggcgctttgcgtcataaccaagcaacggcgacgttccactatgaatctagtgggaccgtggcctcattgagcgatcgtgacggtattggtgaaatcttcagtagtaacaaaccggttcatggctacgcggcatcagcattgaagaaaattattactgaccgctcacttttggaaagtgcgcatttaggaacggtcttcagtaaagggcgttttgacttatatcattaatcattaaattaattccagtagtatgataaatagccaccacagaaatcgaatttctgtggtggctattttggactagttaaccgtcgaatggctcagctggttgctgattcgggcaattaagtaaccagctgttgggactaacgatactttacgggcaccccttacaattaaggcatgataagggggcggtcaaaatgacgactaaatcaatacgaacaccaattcaaccgtggtttaccctagtggtagcgggcagcttactgataaccttgttttctaccgcactttggtggttggctagcagtgcgttttgcgcgttactcattttaaacttacaatttatcgtctttccaaccaccgcggatcgttattggctaaatcggctcagtttaggattggtactagtgctagtagtgctcgcgaatattaaatttttaatcattagtggcttgacatggcagtaagcgcctagacattaaaggacctgacttgaagcactctgtttcaagtcaggtccttttgtctaatgatgccagtcatttgaatcaagtaggctgatccgattagtgatgcatcttaaattccaaataacggtcattatacaagccgactttggctggtgataaatcttgatagatttgaagatgcttgattgtgttattgtctgggtaaaattggcgatcgttgcgaatggccttaggtaatagcgccttggctttccgattaggtgttgcgtaaccgatatattccgcattttgggcggcgttcttgggttcactcataaagttcaagaaggcgtaaatcgccttaaagtgtttggccgttttaggaatgaccaagttatcaaaccacaagttactcccttcggatgggacaacgtaatgcaagtgtgaattgccagccaacatttcactagcctcaccggaccaatcgaccgcgattgcggcttcgttttggatcatgtacattttaatttcatccgctacgacggccttgacgtttggtgatagccggttaagcttgtttcgcgcagccaatagagtggctggatcggtcgtattcatggactgattcattgatgcgagggcgaaccccattacgtcgcgggcgctatcaatcagcataattttgttatggtattttcgttgccacaaatcattccagtgttgaatactgcccggctgaacgtacttgtcgttataaatgataccaagcgttccccagaaatatgggactgagtaacgattgtgttgatcaaaggccaagttcatgaagcgcggatcgtaattcttcattccagtcagttcacttttattgagcggtaagagtaagtgcgcttttttcattttttcaatcatgtaatcactaggtacggtcagatcgtaactggtgccgccttgcttgattttcgtatacatagcttcgttgctatcgaaagtttcgacgttaacgtgatagccagtctgtttttgaaacttagtgagcagactagggtcaatgtagtcaccccaagtatataggttcaaaacctttttgccagtactaccagagctcgtctgcaagcgttgcgcgccaaaggccagtaagccacagacgactagtaagctaacgataatgcttaataattttttcacttccgccgccccctaactgctggccgccggtgccgactactgtattggttaatgaagtagtagccaattactaacaccagtgccatcaggaacattagaccggacagggcgttgatttccaggttgatgccttgacgggcccgtgagtagatttcaaccgacagcgtgctaaagccgtttccagtcacgaagaaagtgacggcgaagtcatcgagtgagtaggtcagggccatgaagaagccagaaaagatcccgggcatgatgtagggcacgatgatttggctgagtaattgccaattgttggcacctaagtcagccgcggcatccagtaaactggtgctcatttcttgaatttttggtagcaccatcaagaccacgattggaattgaaaaagcaatatggcttaacaagactgagccaaaaccgagcggaattttaagggcagtaaagaaaatcaagaaactggccccgatgatgacgtcgggtgaaaccatcaagatattgttcaacgataacaaagtgttgcgggtaatcggtttggtcgtactattgattccgagtgcccccagcgtgccaatgacagttgctaataatgatgataagagcgcaatcaaaatggtgtcgagaaaaatggcaattaaacggctatccgcgaataagtcttggtaatgttgccaggtaaaaccatgaaagttgttcatagtcgtaccttggctgaaggagtaaacgactagaaaaataattggcgcatacagcacgatgaaaacaagccacaggtataagttgcgccacttgaagttacgtaaggtcattatttcgtcaacccctttcgtgcgcgctttttactgctgccagttagccacatgatgatgaccatcgcaataatcaggacgaccccgatcgtcgaacccatgccccagttcattgtcgtcaagaagtgttcctcaatcgcagtcccgagtgtaatcaccttattgccgccaattaaacgggtcaacatgaagagtgacagtgagggaatgaagacggcttgaatgccagccttcacaccggggagtgtcagtgggaaaattacccgattgaaggtctgccaatttgtggcaccgagatcccgactagcattgacgtaagatgggttcagttcgctaatcgagttgtaaatgggcaggaccatgaacggaatctgaatataggccgcgacaaagatgaagctgaaattagtaaagagcaattgcttgggcccgattccgatgaaacttaaaaactggttggcgatgccggcttgactaaaaatgccgatgaaagcgtacgccttaagtaataagttgatccatgttggcataatgattaagagcagccacagctgcggatgcttcgtttcgttgagtaaataagccgtcggataactgatcaataatgttgcgagtgtgatcaagaaggcgtaccagacagagttgaccgtcatcattaagtaggtatttgatgaaaaatacgtttggtagttgcccagtgtaaattgcccgttaatgttgaagaatgattgatagatcaacaataggactggggcaatgacgaagaggatgatccacaacatgtacgggataaagtaggcggtgttacgacttaatcgttgttttggttgcatgttgacacctcctaatcatcttcgtattgttcaagacgagcgtcaaaagcagcttcgctctcgtttaaccgcatgacgtgaatgtcttgtgggtcaaaggtcaggccgatcggttcgccttctgcggcagggttagttgaatgaacgagccattcgttatgatcggtatcgtaagcgacgatttcgaaataattgcctcgaaatagttgggagtcgacagtgacgactaatttgccttgattcgcggccacaatgtcgagatcttcaggccgaagaacgacttcgacagcttcattaggctgcattcccgcatcggcgcattcgaattgtttgccgacaaattctacttcaaaatctttgagcattttacccggaataatgttactttcaccgatgaagttcgccacgaaatggttgatcggttcatcgtaaatatcaactggggacccaccttgtaaaatctcgccagcgttcatgacaaagatttcatcactcatggccaaggcttcttcctgatcgtgggtgacaaagagaaaagtgatgcccaggcgttgttgaaggtcccgcaactcatattgcatatccttacgcagtttggcatcgagagccgataacggttcgtcgagtaagaggaccttaggctgcataacgagtgcccgggcaatggcaactcgttgttgttgtccaccagagatctcactgatttcacgttccccaagatcagctagttggaccattgcgagtgctttttggacccgcgtctcgatttcatccttgggaactttgtgtaatttcaagccaaatgccacgttttccgcgacattcatgtgtggaaaaagggcgtaatcttgaaagactgtgttgacttgccgctgattggccggcagagtgttgatgacctgaccgtcaaagtaaacttgaccggaagtggcatccgtaaaccccgcaatggtacgcagaatggttgttttaccacacccagacggaccgagtaacgtatagaatttgcccgcttcaagatctaagttgatgttttttaaaacttgatgttccccgtaacttttagtgacatttgtcaatcgaatgattggttgtgtattaaccgccaaagtaaagacctccttaaaacgtgtaccaagctagtgtaacctaataccagctcgattagttgtgacatgattataagtaggacgcggtcgtaaccaaggtgaatgtgcaggacgtggtgccaagattacgaatctgatgcgtcttagtcgcatggaagtacagcgtatctcccgccgtggcagtatattgctgagctccgagctgtaagcttaaagtgccggtttgaaccataataaaggtctctgccggcgacggctcaaaagatttgaagcgaccactaggtgccagtgtgacggtgaccggttctaactgattttcgttagacgcgggtacgagccatttcacacggtatcctaaggcttcatcgtcatacgtggtctgatctgctggatggtagaccactttgtgagtgggctgctcagccgcaaaaaaatcagcgggggcacaaccgagtacttcaagaatcgcgaagaacgtctccattgaaggcgatgactgattgtgctctaactgtgatatgtaccccttgctaaggtcagttcgttcgcctaattcttcttgcgtgagttgcttttgaatccgtaagttgcggatgcgttgaccaatgtccatgacattcacctcgaatcggtagttttgttaaactaaacaataagtttagtacgagctttaattataatgaaaaatgacgtggtgacaagcattttttacaattggcagcttctttttttaagtctgccagcttgtctggtcaaatcgcccagaaacagtggtgttgaggggttggaactgtcgtttggttagtgaataaattaggtgcgttgtggacggactttttgtggcgtgccgctgaagcctgcgcttgctacgccaacgaatcaatgtaaaaatcgccactgcaatatagacgaaacgtgttcggagcaacctgggtcttgcggttagcccagcattgctgccggctaggaagcccgcctagccaacatcaatgctaagctaatcctcagtcccaacccggttgtcctcgcactctgctgaaacatgttcggagccgctgaagcctgcgctggctaggcaatgctcagcttcaacccgcggcccctcacactctaataaaaaagcccaagacatccgtcttaggccgttagcgttgttgattaatccgcgcggtaaacgacttcaaaaacttcactgaccatcggtgtgtccgatgagaggtttttgccgtgttcttctaacgtcggggtgaattctgccgtcttacgcttgcgccaatcaccaattgtgcgatcaccatcgccttcatggtaagcgtgttctgccgagatgcgataaaacggaatgagttcagacaccaccgttttcagaatcgcgaccggtttcatgtcaccatttagcaagacgttgtagtcgccaacttgtggaatggcaatttgttccgcggtataactgtccagcggcgtggttgtcgctgtcttcgtcccggccagaattgcgtcggctaaagcagtcacttcggcagggttattttgttgaccgaaccaacgtgtttgataagaagccccgtttgtgtcggtgctttcgttataagcatgccataattgttctgctgattgagcgggcataaaggtcacctaatttcgattagaattattgaattcgaatgcatgtaaccgaattcacaattcaagtatagcatgacatttctgaaaacgacacgttcgacactggtttttcggggaaaattaagttagtcaactattgaccgacatttgctataatatacgtacgaattggagggcgaaaatcaatggaaattacacctgttaaaatgctggatttaccacaaatcatggcgatcgaaaaatctggtttttcagaagcagaggctggcagcgaggctgcttatcgcgaacgcattgagaaattagcggatacttttctggtcgcccgcgatggtgcagtcgtacttggctttatcgtgggaccagctgtcggtgcccgctatattgaagatgagatgtttgtagagacaccgactaacttgccacgtggcggccatcagctggttttcacgttggcagtttcgccactagcacgtcaccaacagatcggtagtcaattattgaccgcgctagctgagaaggctcaagcagacgggcggacaagcatggcgttgacttgtttggaacgactaattccgttttatgaacgtaatggttttattaatcaaggtgtggcgaactccgaacatgctggtgaaacttggtataatttagagaaagtctgggattaaatcatgaaattagcaacattacaagcacaattaccggattttgagatccgattactaactttagctgaccaggaagcattgctaaagctggaacaaagtaatccgcgctatcaccaatatttctcaccggaaccactaacgatgactgaggtacaacatgatttgacggcccacccggacgagctagcggcggcacaaaaacaggtttttggtttttacttagcacaccgtttagtagccgttttagatgtactcaatcagtatccacaagaacaatttttattcgttggattactcatggtcaataaggcttaccaacgtaaatcagtgggccgagttattgtaaccggactgatgcaagcggcacttcaagcgaatataacggcgatccaactaacgcgcgttactgctgatgaaggggtcgcaagattctggcagaaactcgggtttgaagatggtaaccagttgttcttacctttaaaagccggtggccggttagcggtgacgacgatgacacggctactccaatagaattctcatggaactcttagcaataaggcctagtaagcgatatcagacatgttaaactcgtgatgactaataaatagaaatgaggttaacacgatgattaagcattggggaaaagccgaaactggcatgttgattgcagccgtattgttattaatggtaatttttaccttttttgaaattacggctagtttaacagttagtgtcattgcttttccgattagtttgattgtgttgatggcgattatggaattcgccgcaacggaattacggcgcaagtaagtgactcgcagatagatcgtaacctaatatcgtgcttgtttagcaggagcacgtatatatagaagcccgtatttaccacgattggcagatacgggcttttttcgtgacggctgaggactattcctactaggtctaaaggacactgtttggactgtacaagtggcctgattttaacgttttcttagcttgtttataactgtactatactgtactatttaacgtaagcgaagtaacgactgtgtattaaatggaggtgggccatgcaaattgatcatggaagccgacaaccgtattacgctcagatagtaaccggtattgaacaagatattgctcatggtgtgttacaaagtggtgaacaactgccgtcggtgcgtgaaatggctcgtcaacacttgctgaatccgaatacggtcagtaaagcctataagcgactggagacacagcaaattatcgagacggttccgggaaaaggcacgtacgttaaagtggtggattcaacgctgttccgacaagaattacgggaacagtttacacaaattgtcaggctagcgggtcaaagaggcgtcagtattgctgaattgcatggctggcttgatcaaatgggggaaaaataatgagtttagtgattaatcagttaagtaagcgcattgaccatcaccagacgttagatggcattagttttgagattggacttggtcaaatcgtcggtgttgttggccgtaacggggttgggaaaacaaccctttttcggacaatcaatgggcagtacctcacggatcatggtcaggtcctggttgatgggcaagaggttgttgatcaaccggaaatgcggacgcaactgtgttttattgatccactggcaaatttttttaaaggcgcgacgattgcgcaaatccagtggtattatcaagctgcttacccggactttgataatgccaaatttgcgcaattgttagaccgttatcatctgacgtccaaacaaaaattacgccatttctctaagggaatgtttggtttgtttacaatcattctcagtgttgcgacgcaagcgccgtatctctttttggatgagccgctagatggtttggatgtcctaattcgaaaaaacattcttggtattctaattgatgaagtggctacgggaaaccgttcaatcgtgattgcgtcacataatttggctgaattagagggggttattgaccgcgcgttgatgcttaaacacggtcgcattgtcaatgactatcaattagaagccatgcgacgaagtgcacgaaaagttcaattagtgtatcgtgacaagcagatcccagccgttgttaaacaattaggccatattgtacacgtttctggtcgggttatcgtggtagtgtttgaagattataatgctgaggtccaggcgcaattagcgacaactaacccggtatttcaagaagatttaccactctcattagcagacttgtttatggctaatctgacggatgaagctgactttgaattattatcttagggggacgataaaatgacgaaacgaaagttatggcagttgttatggcgccactatcgcacgttgttattaacggcgggcggtgtcttactactagtaggcataaaggaaggctacagtattgcccataatccgtcacggtatgttgcacaaaatgtcagtagttttgcgttgatggaagccactcatcttcggatggaaacggtggtcgccatcatcgttagaacgtgtttggatac

SEQ ID NO: 47 - DNA, 18675 bp, Lactobacillus plantarum
ttaaatttgcaatctaccatagaacctctttaaagtttgatttttattttaaaagataaaactatctttcaacggttactatcataaaagataattctatctttgtcaagcttgaaaaagatatttttatcttttatactgaagacatgaagagaaaagatatgaacaaacaagttaagattcaagatgcggttgcggctatcattctcgctgagggtccagccggggtttcaacgactaaggtggctaagcacgttggcattgcacaatccaatgtttatctctactttaagaataaacaggctctgatcgatagtgtctatgcgcgcgagacgaaccgaattcttagtactaccgacttagaccgattaagtgattcaacaatcgatgtgacgactcggattcgattatatgtacagcaggtgtatgactattcgttagccaatccagatagcttgacgatcattcaacagatcaaggcattgaatggacaggggatgacgatttcggcggcagatgccgatccgaataatattgtcgctaacttattaacggcggctatcgatgctaaggtgattaagcagttaccggttagtttgcatatgggggtcgtgttttcaactattcatacgcatacgacgaatatcagtaaaggacggtatgctcaggaccaatatacatttgatgatattttccaaatgatttgggacgcgatgaaacaagattaggaggtttaatgacaaaagacgcgacttaattgataggcacgagtggatatcaattaggtcgcgtctttttttgcgttcatgtagcgactagtcgtcttgaaatgatgatttagtatcttaaaggctggttgaataattcggttcattgtgtattcttttcaagtattggtgagtgttttaaactgtaggtaccagtttgaacaaccaatatgtaagggggactttgatggtacagtgggcaaaaagattcagtgaaacgaaggtaccggttgtattgattagtcataatcaaaataggtgtgccggcaaaatagtggtgttaatgatgagtagactggagctgtggggcagctgatgaagattatttttgtgcaaacgctgttcatattcttgttcgttaaggtgcttttgcgtgattggcgggtacttagtatttgggatatcagttatgcggtgatcagtagcctagtcagcggctggattttttcagtgatcgggcaatatgcagcattgccattattgggactggtggtgctgtttacttggtggcatacacatagcttcagtgagtcattatttgttagcctacaggtgattatctggtcaattgtcgtcgatcatatcagttcacttttaacgtatatgttgaaattagatgacgggtatcttttgatttttatgggattacagctggttggtttaatcacattgaatctgattttaatgaatacgcatatccagacgacgttcaatcgtcccagactgaaccgggttacggccttgctgctactcgccatctatttatacattattgtcagcgagggcctcgacagtgaattgagaatggtcgtcagtaacttagttgtgttgttggtcgttatggggctcgcgattgccatctatgatgagtatcgggttacgattcgggccaagtaccaggttcaacaacaacgcctgcaaatcaaaaatgatacacggtacatgcatgaaatcgaaacgcattataatgaattgcgccggtttcgtcatgattatcagaatataatgttgtcgattaatgagtatttgaaaacggatgatttggcaggcttacagcaatattaccaacaaaatattgccccagtgaccaagcgcgtttcggatgagcagtataatctcgaagatttaagtcgtgttcaggtcaaatcggtcaagagtattctatttagcaaactcagctatgcgcaatcacagggagttaaagttcaatttgacttgaagcaagtgcttaatggggtaacgacgaatgaattagacttggcaattgcgctaggtattattttagataacgcgattgaagtcacggccggtcactattatggtgagctgatgagcgccatttttgttacggcccacagtacggtgttcttagttcaaaataacgtttttgattccttgccacctttatggcagctaaaggaagcggggtattcgactaagggacaagagcggggcttaggcttgagtcagctcagcgccattgttaatcgaaatgaaaatatgatattggaaacgcggttattggcctcagcctttgttcagcgtttaacggtaaagcgggaatgataaaatgatcaaagtatatatttgtgaagatgatactaaacagttacaaaccttgcagcaactggtcagtaaagtgattattgatcgtcaattggatatgggatttggcctaacgagtgccgatccgcatgaaatattagcgcatgtcaaaagtcagcaaccaactcaagccgtctttcttttagatattgcgttgaattcggatattaatggcattcagcttgccagtcaaattcgtgatttaggcatccgaagtaagattatctttgtgacgacgcatacggagctatcattgacggtgtttcagtatcaagtggaagccctggattttatcttgaaggattttccggatcgcttatacgagcgattaaataccgtcttacgcgtggcacaggagcgtttcaaagctgaagacaatgatcaaaatagttatatccagatcaaaattggcgagacgattcgatcgttggacgtgcaacacgtgttattttttgaaagttcaatgagtccacataagattatcgttcatttagatgatggtgaacttgaatattacggtttattaaaggatgtgccggatttgaattctgatttttatcgttgtcataagtcatatgtcgttaatctgacccgcattcggtcattggataaacggtatcggcgactaacgatggctaacggtgaaaccgtcctgtgttccgcagcggccagtcgctacttagtaaggcagattggcaaaaacaatcgctgattgaaatcttagtcgatttatattgacggcagtaaaattcagattggcaagattcggtttgctaactggtaaaataatcgtttcagaaatttgatttccctgaaacggttatttttttacgtcttattcaggtgtactgaattatgaacctgagctgggccgttccaatcaattcgcttgcgtttattttgaacttatcttcaatgggccaaataaggtcttaatgtagtgtaatggttagtccgcctgtcttaaaacggctgttgcgacgggctacactaaattataattagaggcaaccagtttgaatcaagtgggttatgttcgccaaaagtacggctgttaattatgatcaaggttggcttgccattatttcgcaggtcaaatcgtcgtactggacatgggttgtctgtgatttgagcgtgacttgtgattggtcactaacgataatattggtgattagtcgtaataacttaagtgtgggagtgaatagaatgtgtggattggttgggtgcttaacggatcggcgaaaagttgataatgccgcgtatgatcaggttgtgcgggaaatgactaaaatgattgtgcatcggggcccggatgatgaggggtactttgcggatgataatatcacgatggggtttcgccgattaagtattattgatttggcgggtggtcatcaaccgctgtcatatgataatgaacgttattggctaacgtttaatggtgagatttataactacgttgagctacgtgaacagttaattcaagaaggctacacgtttaagacggattccgattcggaagtgatcttagggatgtacgccaaataccaggccaagttgacgacctatctgcggggaatgtttgcctttgtaatctgggataagcaggaaaaaacgttattcgcggcgcgtgaccaatttggaatcaaaccgttttattatgcgattgccggggataatttttactatgcgtctgagagtaaggcgatttataagattttaaaagataagcattttgatcaagaggcattacaagattatttgacgttccaatatgtgccggaaactgagaccctgacaaaggaaatcaagatgctggcgccgggctgttcattaacaaaacagttgggacacgcgccgcaaatcaagcgttattatcatcgggagtttcatccagtcgtccgttctgaacaggactacgcgacacggcttaaggagacgttgattgattcggttaagatccatatgcgttccgatgtcccagttggggcgttcttatcgggcgggattgattcgtcaattgtggtggcgattgccaagcagttcaatccaaatctcaagacgatctcggtgggctttgaacgacctggctatagtgaattagacgtcgcacaggaaacggctgctaagttgaatgtcgataacgtccaaatgaccatcacgccggaagcattcatggcagcctttccacattttgtctggagcatggatgatccgttagctgatccggccgctgtcccgcagtatttcttgactaaggaagccgtcaagcacgttaaagtttgtctcaccggtgaaggggctgatgaactttttggcgggtatacgatttatcatgaacccgaatccttgaaagcctttcggtatacgaagccaatcaacggggcccttcaacggatagccgcgatgatgccagcaggaatgcggggtcgttcgttgcttatgcgggggacgacaccgttagagaagcgatacgttggcaatgcgtttatcttcaatgaaactgagaagcaacagttcatgaagcactacaatcgtgaccattcgttccaacagacaacccgggtattttacgatgaagccaagcattatgatttaatctctaagatgcaatttatcgatatgcacacgtggttaaatggggatttgttgcataatgcggaccggacagcgttagcccacagccttgaattgcggacaccctttgttgatcgggaggtgttcaatctggcagcggaaattccagccaacttgcgaattagccacggtacgacgaagtacattttacgaaaagcggttgaagatattgtacccgcgcacgtgttatatcgcaaaaagcttggtttcccagtaccgattcggttgtggctcaaagatgagatgtacgattgggctaaaaatattattgtgacgtcgcaaaccgatcagtattttgacaagacatatttcttaaaactattggatgaccatcgagcgggtattcgtgataattcgcgtcaattgtggaccgtgctgaccttcatgatgtggcataagttatacgtggaagctgatatgttaatggatagtgtaacggccaatcatcttgctgagcaagtcgaaatcggttaagctgttcatattaaagctaaataagaactcgttcaacgtgccaatgagaataaaaatcatccagcgacctgattgtcttaatacaaataggttgctggatgatttattttggtggttttgtagttgtttcgttagtcgatgacgactttagtgccatacttgatgttgttatagacccacttggaatctgcaacgctcagatgaatgcaaccgtgtgaagacggtcgcttgccaagatcagcagcgtctgatttgataaagtgaccttgggcatctacgggtgtggagtggaacaaatattcaccatggttgagccatgagacccagtaataggcaccttcatcaacactagcgctataaaaatattttccccgttcggcttgcacatgataggtgccacggggtgttttgcggtcagcagttggcacgccactggatgcatacattgtatagagaacgtggtgatggttcatcaagtatagccgttgtttagccaacgatacgtgaatccataagtccggatagcggttgacattgggatacgcgactgtttcggatgattgacgccagttgattggtgtgcgcatgaccgttgatttagccgtggttttggctttcgtctttgacacgacttttttggtggttaccgttgattggctaggtctgtgggcatcaccaacaactttgacagtgccgaccgccagtaagccgataactaaagtgatgctagttaataaaattaatgttgatttgcgttgcatgttgcgcccccatagttggttggttctgtctggctctgacttgatagttagtggtaatagtcaatactgaccattcaatcaggaccttctcagtaaaagtggaaaccaatcgtatattaccgttatagctttctgaaagtgaaaatgcaacccagtcgaatgctgggtaagtcggttttacgaacaaattggggtcgcaatggcgtaaagcgggcatattcgggctttaagtcaattaagacagcctaaaatggcaataattagtcttcaaataacactgaaaataaacaataaatcccaactaaaagtaggaaggctgccggtgaaaatcgggacgattcattgctaacattccgagtcgcctcctaatgaggttcctgaactagtgacggttaagtggatttaaaagatagtgacataaagaaaaacactcagcctagcgataggacaaccgaattggcggtcattgttaagccgctaagcttagtgttttcgatgaccgtttaagactactacgggtcatttagttattaattttgaacgcaatgccggtcggtgctttttgcgagccgcgctaaccaaattagacctaacaataggactaagctaacagcaaccatgatggcaccaaagatcggtgtccagcctaagccaaggttggtcgtgacttgaccaccaataccggagccgagtgcgataccgacgttaaaagcggaaatatttaacgctgaggccatcgtaatatcgtgtggtgtattctgttcagctaactgaacaatatagagttggagcccagggacgttcatgaaggcaaagattcccatcagtaggacggtcaatagtcctaaccagtgactgtacccggtgacacttagaatgagtaaggtgatgagtaacccactgaacatcttgaatagtgcaattaagggccgtgcattggcccaacgaccacccagtgtattaccaagggcgaccattaagccgtaaacgactagaatcaaaacgacagcgctcgctgaccaatgcatctgctgttctagtagtggtgataggtaggtgtaaactacgaaggtaccaccgtatcccagcgccgtgacgagtaaggcgaacagtagttgtggattagtgagtacgcggataatcccccggaccgtggctttactgggtaacggcagattacgtggaattaaccagtaatcagctaacaaaccaatgacaccaatcatgctaataaagataaaggaccagcgccaaccgcctaattgaccaatcatcgttcccaacggaacaccagtaactgtggcgacagtcagtcctgtaaacatgatggcaatcgccgaggcccgtttggcaggtgcgaccacgtcagcggcaattactgaggcgacggtcataaaaataccgtgagccaaagcggccacgacccggcctgcaagtaagacaccaaaggttggggcacttgctgcgagtaagttaccaataataaataaaatcataattaacatcatcaagcggtgacggttaagccgaccggtgagtaatgtcatgacgggcgcgccaatcatgataccaatggcgtagatcgagacggtcagcccagcttgcgccaagttgatgtgaaagctgctaacgagtagtggcattaaaccaacactaataaattccgttgacccaatggcgaaggcactgattgcgagtgccaaaagtgtccaactgggattaaactgttttgtcataagataagcctcctgctattgctaagttgataaataatgattatactagcaagtgacttttagacaagtaccaactttaaagtgggatacccactaaaaagtaagtatggaatggagggacaattattggaaaccaaaacttatcatattggggtcgaggccacaatggaaattatcgggggtaagtggaaatcaattattctgtgccatctgcgtactcagacgatgcggacgagcgaattggaacgggcgattccacaaatctcgcagaaaatgttagtacaacaacttagagagttggaagccgctaatattgtgacgcgcaaagtgtaccaacaagtgccaccgcgcgtggaatacggactaagtgattatggccggagtttgtccgttgtcttacatgagctgtgcgtgtggggtgaggataatattgatcgccgccgagctgcgggtgaagagattgccttgttacatcgagacgatttatagacaatgagtttaaattaaaaatggtgcgtcaagaatgaaaatattctggcgcaccatttttgattagggggagttaatgttgggtcggttgacgactaaataaacaacaaatcagtggagttaacttattgctactagctattgtgtagggatttggctaggagttcatctgcgaaactcactgggttgttactaaagaactgcgggggtattttactatgcttactaaatatatagaaattcgcacaaattctgtactaaccagatttagttttgaaacttaatattagtagcgatgactccgcttacatttttaaacagttatgataagcttagattattgacgataaatagactggagttggtgagtatgacgaaggcagttatttttgatttagatggattattgattgatagcgaggttatttcattaaagatgtatcaacgaatcgtacaggattatgggcagacgctttccatggcgacttatgcacaggaatacagtggtaagtcggcggtgacgaatatgcaacacttgattgaacgttttgacttgccgtttaatgttgatactggattaaagcgggcgttagcgttggaaaagacgtttatgcaggatggcgttgagctcaaaccgggagcacgggtgttgttacagtttttacaccggaatcattattcagtggccttagcttcatctagtatcaagtcgcgggcattagacattttgacgtcccatgatgtggcgcaatatttcgaccagtttaccttcggaccggatgtcgatcgtggtaagccatatccagatatatttttgatggcgtgcgccaaactccaacaacaacctgcagattgtttggttctggaagacagtgaagctggcattcaagcggcgacgtccgcgaagattccggtaatttgtgtgccggatatgaaacggcctaaccagccctatgctgatcaggcgactgcgattgtaccgtcgttaacggatgtgataacgcatttaaaatcagttcgataagattcagttgtaattaaagcataaagattattaaattattaataaggagcggttgtccgatagaaaaactgctatactacgaggcgtaaataaatcgctgacaagttagccagtggaacgaaggagtcttgatcaatgaagaaattgatgattgctgtaactggtttagccatggtggcaacgctgggagcagcggtacccgttacagggattacagcgaatgcggcgactaagaagacaacggctacgaagaatgtcgcaccaagtttgaaggtcaatgcaatttacaataatacgacgcaaattacaggtacggcaaccaagggcgctaagatcaccgtaaaaagtacggccaacgccaagaaaaatcttggaactgcaacggcctctaaaacgacgggaaagtacacggttaaattagccaagacattgaaggcgcaaagcaatgtttatgtgtacgccacgaatccaacgactaaggcttatttctaccgcgtcatccgtgttcagactgccaaaactactgcctcttcaactaagaagacgactaacaagacaaccacgactaagaaagtggcaactaaatcgacggcggccacttcgtcatccaagaagacgactaaatcgtttaaagtcaacgcgccagcgggtacttggaagtcgaatacgactaacaagtactcccaaatcttaacgtttagcgctaagaatggatttaatcagacgctttataagaatggcaaacaagttaaaaagctggtctcgtatgcgagttatagcatgactgccaagacgccaacgttctggaaagtcagctataagtcaggctcgactactaagaccctatatttacgctatacagcaactaataagtttacggtcgttaatgctaaaaatcagatcgttaaagttaaggttggcaatgccccagcagctgtttggacgtttaccaagaagtgacgggtcgttaaatatcttaagtacgaacaattcctcggtattttggggaattgtttttttgttgcttgctgatcaattagattgaacgtggcctagtgaatattaaaataattgaaaaaacgcagatagcttatcgtcattagcaggttaggtgagcgcatataaattggccaatttgggctgttcatagtgaccatgatggaaaaggcactacagcgttggtaagtcatctagttcgctcgaaaaatgacttggtcgtgagtcacttcaaaaatgaccatcgtgcagttgtatccatgaagaatactgaataaacaagtaaatgaaaatgggtgttcgttagctgatacttatcatttaattacggttattaacacaaataatatcacggtgataaaaatttaatattcggatatctgtaaaattgtaagtctttttctgaacgtcacaaactgaaaataatgtaagataattaacgtcaagagatgttaaaatactatctatgtgaagggagcgatgggcatgcaacaccggcaattatggtatcggggcggcctaggactggcattagcactagttgtggtcggatatcgtggatcacgggcagttattcgggcggttccccgcgcacaattgagtgttgatcagaaaatgccatcgactagcagtgttttttctgcttcgaaattgacgttgcaagatgaggcaaacaactcggcactacaagtgtcacctgaggcccaggaaagtgcaggacctgacaagcagtcgaatttaacatcaggcagtagtaccagtagcagtggtatcagtagtggtatcagtagtggcatcagtagtggcatcagtagtggcagtacaatactggaaaacgctaaaaataatcaaacatcagaaacggcgacgaccaaagcggcagaaatggtcaatgggacggttaaaatgaccttagatactaatggcacattgcatttgagtggtgggtcatttggtgcatcgctagggtcagccacggggagttggattgtaaaaaccttgacggctaacggctatcaaccgacccaagtttcaaagatcgtcatcgacggtaagataacggcaactactatgactaattattcatatctgtttgctaacttacctaatgttacggcgattgatgggctagccaaccttaatttaactggcgtaacggatatttcgtggctatttttgaactgttcacagttaggcgcgttggacttgaatagttgggatgtcagcagcgtcatcagaatggagggaacgtttcaaaattgtaccaagttagttacgttgaatgttgccaattggaacacggattcattacagtatctaattgacactttcaatggtgacagttcattaacgtcgttaccagttggcaagtggaataccagtaaagtggcgacgatgatgcgaacatttacggattgttcttcgctgacgtcattagacatcgctaattgggacacccgtgtcgtaacgaacatgtccgcgatttttagaggaatgtcgaaggttaagagtttacccattgataagtggcaaacgggacgcgtggttaatatgcagttagtcttttcaggtgatactagcttggaaagtattaacgtcgctaattgggatacgagtcgggccacggcgttagatgggacttttgctaagctacctaatatcaagtccctgccactcgacaactggaatacaagtaacgttcaaacgatacggagcacgttttatggcgatactaacttgacccagctgccgattgataactggaatgtcggcaaagtctttgattttaattcaaccttcagtggctgtgccagtttaacaactgcaccggttgcgaattggaacacccagagtgccaccaatcttggttatacttttgagggcatgactagtctcacctcgttaccagtagataattggcagactggtactgtcacgaatatggccggaactttttctagagttagtcagttaaagagtctcccgattagtaagtggaatacgaagaatgtacaaaatatggcggggactttttctgaaatgagtagtgtcacggcattgccagtagataattggcagactggtaatgtgacgacaatgaggggaatctttaccaaagttagccaagttaagaatctgccagttggtaagtgggatacggcgaaggtcgttgacatgggacaagtgttttatggcaacccccagttaactagtctgcccattgaaaactggaatacaagttcagccacggatttttcacagctatttgcggaagattcgggtttacaaaccttgagtttaggtgcttggaatacgaccaaagtgactaactttgaatcagttttccaaaataccagtctagacaaattagatttgactggctggaataccaacagtgcgcaaacttataccaacgctttcagttcgaagttgccgcctaaacgtctattgttgggacccagctttaacttttttaagagtgaaagttggcacttgccaaatcctagtagtgaggcaccttatattgggaaatggcgtagtttaaataataaaaaagtttatacttcggctgatttgatgactaaatacgatggtaaaaccattgttggagaattcgaatgggccactggcaacacgattacagtgaagtatgtggacgctgctggcaagtccttggcacccgacacgaaaatcagtggtgcaactggtgatgcctatcatattaaaccaattgagattgaagggtacgtgccagataaaccagatggggttcaagggaattttaccgacaaagatgaaacgattacattaatgtacagtcctggaggactaatgtttgcctcagcaccacaggccattaattttggtcagaatccgattactggtaaatcagaaagttacggtgcctcctatgatactgggctagttattcaagatggccggtcaataggttcaacgtggtcgctcaatgcaacgctctcagcatcaggcttcactagtaagcagtcggcacgaccattagcggctgtgctcagttataaggatcaacaaacgggtggcgagtcaattcttacgccaggtgtggcacggttgatcgtcaataaccatcaaactgtttcgaaccaaggcgtcaatatccttggtcagaaaacggcacttggggcactatcgttacaagtgccaaccgatcgtgccttgacggatacgtatcaggcgacggtcacttggacgcttaatcaaggggttcctaatcgatgatgaaaaaaataatgattaggtaacataagatttgtaagactgcttgattgttgttagtaagttagttatatatatttacaatgtaccacaataactattctagcttaatgattggtttcggccagggttggttttagttatgccgcaaataatgatatagaggaggagtggtgttgatgaagcgtttggggttcatcacaattgccatcagtaccctactttgttgggggtggttgtcagcaccgattattggtgtggctagtacggctgaaagcccagcaacgattcgtttcgacggccaggctgagtcatcgaactcagacactggcgctaatcagttacaggtgactgaagcgtcaaagtcgagtcattcgattgtgcatcagccgaatgctagtcaagctgttcatcatcagaacccggggtggttaccacaaacgagtgaacaatggtggctgagtgctttcattggtggtattgggttattggtcgttttaattggttggcaattggttaactatctaaaaaaaaggagttcattatcatgaaaaaaacattattaggacttttattctcagtagcattgattgcaacatcaggtttgaccgcgagtgcggccgatacgccacaaacgtctaatgggacagttggtttcactgggggcgacatcactattgataatggtgatacggacttagctggtgctagtcttgactttggtaccaaccaaatcaccgcagctaacaaagacgataactatgacaacacgaataagtcagcggcggtatccgttgtggacttacggggaacggctgctggttgggatttacgtgtgaagcaaaatgacgtttttaaaaacgacaaagcggttgctaataaagaattgacgggtgcgattctaacattgaatggtgttttggattcaaatgcatcgacgactggtgcggacgcaacggccaataccggtgttgcgctagatacactcaatagtgacaaggttttgatgaccgccgctgtgggtaaggggaatggtaagaacgtggctgatattgctaagtcacaactaatggttcccaagactacggcacgagctacgggaagttatagtacaacgttaacttggagcttgaatactgcaccagcgaatagctaataagtattgatcggaaaaataatggctagtaggggttaatgtcatttttccgaatcatgattagggggagaaatgatgttaacaaagagatggtggcagttaggaattggtttgctagtcggattagttagtctaagctggggacgaacgggttcggctaacacagtcggttttgaggtcgcaccggtggcttccaaatatcaaatcgataaggctgtttcatactatgatctgaaactaaagcctagccaaacaaccactttggcagtgaaagtgacgaacacaagtatccaggaaatcaccgtgcatacggcaattgtaccggcgacaactaatcccgatggggtggttgagtatcaggcaacggctgatggcaagaacattgatttgccagctgatgctagtcaactgattacgacggcggcgaataagattacccttgctaagggaaccagtaagatcgtgacttttaaggtgaaaatgccggctcagaagtatgatggtgttgtcgttggtggactgagtttcttaaaaaaggccgccaaacaacagagtaagagcgcaatggcgattaagaatcaatacgcttactcagtggcggtcgtattgcatggtgaccacgcgctcaccaagaacaagttgacattgggtaaggttgatgcgacgcaaaataacgggtataaccaaattagtttacccctacaaaatcgaacggccgctttcttgaatcaagtcaaaactgatgtccaaatctatcgtcgtggtagtaacaaagtgcgctacaagcaggtcaatgaacacggtcaaatggcgcctaattcagtttatgccttaccgttacgggttggccgggatgcgttgaaacccggccaatataccgctaagttggccgtgacgtccaaaaagcaacattggacgttcaccaaagattttgaaatcacgcgtgatcgtgcgaaccaactcaacaaaaccgccgtgattgaacatcatactaactgggggttgtggatcagcctcggtctgctagtcatcttgttgttactgattgcttggtacattcatcgcaagcagctaaagatcaagcgattagaagaacggcttaaagataaatcataaattcatagccattagtactgttataaacggactcggtcaggttggccgagtcttttttgtgggttcggtggcaatgaatataaatttacctttgctaacttaatcattatctttttgcaggcaatgcgcagcggcttgtttctaagtataatgaaagtgtagttaacttaaaggacgtgaatgaagatgaagtatgaatggcgtaaacaagaaaaaacaacctatgctactaagaagcaaccccaactgttgacgattccagcccaaacttttatgagtatccatggaacggggaatcccaatggcccagagtttcagacgcacctgcaaacgttatatccagctgcttatgggctcaagcatgcgtataagcagtatgcgcaaacacaggcgtgtgaatttgatgattacgttgtttttccgcttgaaggggtctggtcactgacgactaagggacagcaatttgaccatcttgacaaagatgagttcagttatgacattatgattcgggtcccagactttgttcccactgaactgattgcaccggctttggcagcggttaaagctaagaaacaactgccaactgaacaaattaacgtgcagcagttcgacgcaatgcaagtggcacagattctgcacgtgggtgcttatgacgatgaacccgcgagttttgccaagatagatgaactggtcgccaatcaggggatgcatcgtactagcaagattcatcgagaaatttatttatccgatgcacggcgggtggcacctgataaactgaaaaccgttctccgatatcgagtggcgtcgaattaatgcgaaaacttttgactggcattgggcgtgaagcacgaatataatttaaatatattataactcatataaaattataattaagagatgctgatagtatgacgcaaatagagattagtaatcggctgaaagctttattggttacgaagggctttgataagaagcaattggttttggtgacggatgatggtggtggcaaatactctttgcacggaggtgcttgcagtattggaactaaatttacgataatcgtacttgatcagccggacccggaatacaacgtaacggtggtgaataatcaaagcctcgcgctttggacctccacatacgatctcattttctttaacgatggtattaagatggattacgatcaggggcggatcgctattaaggacaatgcccatatgctggacaatgccgttcaaatcgctaaaggagcggaagttttagctgcttttgaacagggcgtcccagccgacaacctaacttgttaattgcgatatgaagaaggcataataatgaaggcagttatttttgacgattttggtagtcccgatgtattgcgcattgctgacgtgcaacggccggtggcgacaactgcgaccgtcttagtgaaggtcatggcggtggccgttaatcatgttgatacgtttgttcggagtggggcgtttaagacggccctggcagcaccacacgtggcgggacgtgatttagtcggtgaggtcgtagccagttcacaaccggactttcaaatcggtgaccaagtctggacgaactcaatgggctatgaaggccgaatgggcgcaacagccgagtatgtggcggtgccaactgatcgcttgtatcacgttcctgatggcgtggcgcccatgccactcgtcgcggcggtccattcagctgcaacagccgccatcgtacttaacgacgtcatggaaattcgtcgcggccagacactcctaattgaaggtgccgcgggcaacgttggccgcaagctgattcaacttgcgcatcaaatgggcgtgacggctgtgataaccgcatcaccacgagattttgcacggtgtcagcagctaggcagtaccgcctgttatgattatcacgcggggtttgcggaccagttaacgacggatcagtggacttttgaccatgtgattgatacctcgggacgcgtaccactggcgattaatttagcgttattacgattaggtggtcaggtgacattgattacggcaccgcaggataaccaatttgagttccctgttcgccagttttacatgtctcaacaacgaatcactggttttgtgattagccatgcaacggttgaccagttagcacaagcggccagtcgtttaaaccgagcttttagcgccggactgctattggatgatcaggtcagccagcgatattttaaggatgccgctcagtgtcacgctcaattggaagcaggcacggatcatcaccagcgctttgtgttattaccgagttgattcagcataacgattgaaagcctgattaattaatcagtaatactatgtcaacaatagtattgtaattttggtgatttaaagtgattacttggcaggaggactggacagtcggctcccgcgcgtctaaagttgcgaccaatattatctgtgaaaggaccggcgtgctaacaatccgaaaggtgatcgatacggcgatctttactaatgttaatggcattcctccgtggtaatacgcagacttgaaaagaatatcgatgacgaaagtccaacacttgtcagcaagggttggactttttgtggtgcagcaccagaagcaatggcagaaaaataattaatttactacctatactagggtccgtcttaaa

SEQ ID NO: 48 - DNA, 51213 bp, Lactobacillus plantarum
cggagttacggttgtaaataatggtgcaacaaaaaagccatccgttaagatgactttatgtattgcccgccaattgattttttgactacgtttttgactacggtttatttgtggtttattgtgccgtattcaatcacatagaattaaaaacgttgatttagcaagcattttgaggctcattgagccttattggacttcaaggatggagatggcgagagtcgaactcgcgtccaagcatattgcccctcggatatctacgctcatattcatactatttaaatttcatcattgcaaacgctgtatgacagggcacccagcaatgactaacctgattagtctcttctcgcaactccaggtggaagctttgagcgtaagtccactaaatttaggacccagatccagaacatggacgatcctgggaggatctacgttaagcgcttattaggcagctaaagcgtaagaattgttattattttttgcagttataatttaaactgagcgtttttacgtagacgcaacctacgaagcgcaatccgaactcaaactatacctgtcgaatccagaacatccccaaattcaacaatcctagtttagcacagctcaactgttctgccaactaatctgtctactggtcatgacaatcattacagcagtttaagatgaagagtgtgctcggcggcgccgcaaaaagtgcaacattttatgtgtgttcagtgaaagtgccatgactgccaagataatcagtaagccgccgataaaatcgaagctagtgagttgaacgtttagaaaagtaatcgagaaaaccgtcgcggctaagggctcgaaggcgtccatcaaactggccgttgtcggtagaatatcgcttaaactacgcgcaaacatcaggaagggggccaccgttcctaagagaataatgacgattaacaagcctaattggggccaggtaatcgtcaggtggacacgccacatgggttgtaacaaggttagaaacagacccgcaatcattaacccccagccagtgacggttaatgcgccatactttggtaaaatggttcgcggaatcaaggtgttcgtggcgaccccgatggcggataagccgccccagaacaagatgacgggtgaaattgccagactgtttaagtgaccgtgtgtcacgatcaatagtgtcccgataaaggccatgatcataccaatcagttcgatacgactgggtgtcacgtgcttaaataagaagtaatagatgctgataatgaatgggccaagaaattgaataatcgtggcaatcggggcattaccaacgcgaaccgcttcgaaatagcaaagttgaaccggaatcagccccagcaaaccgtaactcaccgctgtccaagcggcatggcggtgatgccagattttaaaggggtgtttaccagccaccatcccccagacgagtaaaatcaagcctgcactgatcatgcggacctgcgttagccacattgcggttagatgcggattattgatgaagagggtactcgcagccacccctgagataccccacagaatacaggcactactagcgagtaagacgccccgtaaatgattttgttgtgtcaaattacgactcctttctgaaaataataagcaattttcattatagcaaaggtgcgtctgggaacctatgtttatgaggaatctcttattattctcatgggttacttcatcaaaagtaacgggtgcgtttcagaagaactcatgctatgatatgaacaatcaaacgcgaataatgatgcgtctaacggaggctataaagatgaaagcaattattaccgttgtgggacaggaccaagtgggaattgtcgcaaaagtagcgaacgagttagcacgtttaaaaatcaatattgtcgatatttcgcaaaccttgatggatcataattttaccatgatgctatcggcggaatgggatgaccagcaattaagttttgcggcggccaaagcggcgttagaatcgctcggtgaggcatcagagttaacgattcgaattcaacggcaagcggtttttgacgcaattcagaagttataggaggcggccatggaaagtcgttcaattttagaaacaattcagatggtggccgaggaaaatcttgatattcgtacaatcacaatgggcatttcgctctttgattgtgttgatagtgatggtgagcgggcccggcaaaaaatctatgataagatcacgactagcgcgaaggacctggtcaaagtggccgctcaaattcaagaagagtacggtattcctatcatcaataagcgaattgcggtaacgccgattgcattgattgcggctgcgagtcaggatcaagactatgtcgcgtacgcagtaaccatggaacgggcagctcaagcgctaggtgtcgatctcattggtggtttctccgccctggttcagaaggggtatcagagtggggaccgcaaactgattgcatcgattcccgccgcgttagctgcaactagccgtgtttgcagttcggtaaatgtcgggtcgacacgggctggaatcaacttggacgcggtcggtgaaatgggtcgtattataaagcagattgcggctgacgatccggtcaattgcatgagtttagtggtatttgccaatgcggtcgacgataatccgttcatggcgggcgcttttcacggtgttggtgaagctgatcgagttattaacgttgggatcagtggccctggtgtcgtaaaacgagccttagaagaagttcgcggtcagtcgatcgacattgtgtcggaacaaattaagaagacggcgtttaaagtgacacggatggggcaatttgttgggtccatcgcgtcagaacggttgcacgtcccatttgggattgttgatctatcactggcaccaacgcctaacgaaggcgattcggttgctgagatcctggaagaaatcgggttggaaagtgtcggtgcgccgggaacaacggcggcgttggccttactgaatgatgccgtgaagaagggtggcgtgatggcctgcgaacatgtcggtggactgtcgggtgcctttattccggtttctgaagatgctgagatgattcgggcggtcagtgctggtcgtttgaatattgaaaaacttgaagcgatgacagcagtgtgttcagttggtctggatatgattgcagtacctggtgatactagtgccgcgactatcagtgggatgattgccgatgaagctgcgattgggatgatcaacaacaaaacaacggcggtgcgtgtcataccagctaccggcaaaggtgttggtgatgcggttgaatttgggggcttgttcggtcaagcaccagttatgccggtcaacaccaatcaaccaacgacgttcattaagcgtgggggtcatattccggcaccaatccactcctttaagaattaggcacagtggacgttgtgaaggggcgaaccggcagtcatcctgaacttaaatggtgacttcacgctcgcaactcgtgaaatgtaactgaatgatgcacgatttcctggtcggtatgaacggcagaaaatcgtgctttttatgtcagtgagcatgactctggtatgatgtgtgactgatgtgccaagattattaagtgtccctcaatgatgggatgacacagttatttcacaaatcgtgcacgctttgttattaatttgttgttatactaatcctgaatcctagcgcgaagtagggtatgataatagataggttaataaatgatgattaatcaacaaagttagcaatcgtaattaacttggaggacgttgcactatgaaattattaatgattgaagataataaatcggtctctgaaatgatggccatgttttttaagaaggaaaagtgggatgcccattttgcttatgatggcaatgaagctgtcgaaatgttcaatgaagatgtcgatggctgggatatggtgacgctcgacttgaacttgccaggcaaggatggcatgcaagttagtgcggatattcgcaaggcttccccaactgtaccaattattatgttgacggcccgtgattcggaaagtgatcaggtacttggcttagagatgggcgctgatgattatgtcaccaagccgttttcaccgattacactgattgctcggatcaaggcccttcatcgccgagcagatttggctaagaccacgccggctgaccaacctgccagcacggtgagttcctttgatgttcagacggaccattttaaactgaataccaagacgcgggaagcctatttagcagacaaacaaattcaagacttgacccccaaagaatttgatttattgaagaccttagctcaaaagccgcggcaagttttctcacgcgaacaacttttgcaactggtctgggactatgaatattatggtgacgaacgtactgtggatgcacatatcaaaaaattgcgccaaaagattgaaaaagctggaccacaaattattcagacggtttggggggtcggctacaagtttgatgatagtggagttgacgctcaatgaaactgatttatcaacaaatgctagcgttctttgccgtcattattacggtaatcgtcgtcctcggattttcatttattcgaacgactagaacgatgctttatcaaaactcatggcaacaattgcagcagtacgccgcgagtattgaaaaggaagctattcggtataatacgaagactaatcaagttgtcgggtttaatcaacaatttctaaatgatgggaccgtcatcttacgagatcaacatattcacttttcggtatatgatgctaacaaaaagttggtctatccaagtggtatggggacaacaatgagtgggacccccggtggctcgatttatgatcccaagatctcagccaaagattggaagaagctgaagcggaataagattattacgcagtcgccccacgtaacgttcagaacacgcaatcgtgatcaacccgtgaatacaccgtcgttgcgaaccattgacgttttagtgccccttttctataagaatggagcaacgaagaagtttgttggggccatctcgattgggtcgtttgaacagaccttgcaggccaatgaacagcagatcgaaaaaaatctgttcattgcactgttagtctcggggattgcggctctgttgttaagttacattttggcacgttattccgttcgtcgtattaatcgattgcggtacgcgacgcactcggtcgcaaatggtgattttgacattcaagttgacagtaatcataaggatgagattgatgacttggcggatgatttcaatggcatggtcaactccctgcgaacttccaatgaagaaattaagcgacaggaaaagcggcgtcgggagtttatggccgatgcggcccacgaaatgcgaacgccgttgactacgatcaatggtattttggaagggttagcgtacgatgctattccagaagaagacaagggtcattcaattgaactgatgcaaaatgagacgaaacggttgattcgactagtcaatgagaacttggattacgaaaaaattcgaaccggacagattgctttgaacaagaccaattttgatggcgccgaggttttgcataacttagttgaacagctcacaaagaaagcggccgccgcggatgatgaattcaagctgacggttcccgagaaactgccagtatgggccgattatgatcgctttgttcaggtcttgtttaacatcatgcagaatgccattcagttttcacaagctaacgtgatcgaagtaacgggtagccgtacggatcatgcgacggttgtcgcgattcaagaccatgggatcgggatgacaccggaccaagtcaaaaatatttgggaacggtattataaggctgacccatcacgaaagaatacgaagtatggtgaatcaggtttagggctagcgatttcacatcaattagtccaacaacatggtggttcgatcaaggttgacagtgtggagaacgaagggacgtgctttaccgttactttcccagatgaaggttttgataaaccgattattgatgattaacgtgatagtttaaagcgggtaaatccgtacggaccgggcttggggatcgtaatgatctcgaggcccggttttgctaatgcggggtaacggtgggccatagcaataacccatcattaatagtaggaacggacgtttaatagtaatcgattgcggaccttaagcctaatacttttcagcgattgacactgttctacctcgcactctgaggctaaatatgttacccttaacaaggctgcaaacagcgatttatcaatagtttagataagatttgaaatgaataggagaaacaacaactatgcaaagagtacaaattacgggaaattcgcaacgtaaagtcaaggacggctatcctttactcgtacaagatgatctcaaggatccgagtatgaaactaaccgatggctcttttgtggcgttaatggcaagttctcaatttatgggctacgcgctgattgcgaagcatcgtcggcaactaggctgggtcttgagcttggatgaaagtgagacgccaacgaccgattactttcgtaagttattcaaacaggcgttggtccggcgagcaacgagcatggatccacagttaccacaacgggtcttcaatgcggatggcgacggtctcggcgggttaacaatcgatcgttatcaagattactatgtctttacatggtacgcacaaggtgtttaccagcaacgcgaaatgatctatgcggcttttgaagcggctactgaacatcaatttaaaggcatctatgcgaaattacgatttaatgtcgaagaagctaacttaaagagtcaactcgtcacgggtgaagcagcaccagagccgttattagtgactgaaggcgcggtgacgtatccattacaccttgctgatgatttaacgaccgggttactattagatatgcgtcccatccgggaatggttggccggagccgagttgcaaggtaagacggtcttgaacttgtttagccaggaaaatggggttacggctgctgctgccgttgcgggtgctgccaagacgatttccattgaaacaagtaagaagggtgccaaagagaccgctgatcaattggcggtcaataatattgaccctgataagcaggaaattcgagcaatcgaagtgaacagctatctagattacgcccagaagcaccgactaagttatgacgttgttgtcgtaacggcaccgacttttgcgcgggtgaaaaagcagaagttccaagttgcaactgatttaactgacttattgacagcgaccttaccagttgttcggcgtgatgggcaattagtgattgcaacgactgcgaataatttttcaatgaagaagtttaaagccgcggtcacggcggcctttgtcggcagtgatcggcacttcacacttagtgagacgttccggttaccagcagacttcgtgacgcgcaaggcttacttggcaagcaactatttgaaggttctggttttgacactcgataagtagtgtgtgcgccataatttaagtggaatagaaaaaaattttaaagggtatttcggggaccgttttcattaattgaaaacggtccctatcactaagaaaacgaattcatgaaaatataaaaataattatatttaaccctgaatccctgattgtgactggtaaaacggttacttaactggtaaaataattccttgtcgttaggcaagagagaaaacatagaaatgaggattattagtaatgggaattctaattgcactgattcctgcgattgcgtggggcagtatcggcttaattagtggccgaatgggcggtaccgctcggcaacagacccttgggatgaccatgggagccttggtatttggcttggcactctgggccgtagaacagccaactttaacaagcaaaatttggttgattgggattgtctctgggttattctggagtattggtcaaggtcaacaatttacgtcaatgaaggcggttggtatttcacggactacgccgatttcaactgggatgcaactggttgctaatgcgttggccggtgtgctgttattcaatgaatggcacggaaacatgtattggattggctccgcttctgtaattgtgttgattgccggggctgttttaacttccttaactgataagactgatccgaaccgtagtgcttctgaaaattggggtgttgggattcgtgccttgatcttatcaacgattggatacgctggctatacgattgtggtccattatggtaacgtcaatgcacaggcagttgtaatgcctcaagctgttgggatgttgctgggtgctttgatctggtcctttaaggataagccatgggttgttaaagcaacttatcgtaatatcgtcactggtctggtctggggtattgggaatctcttcatgtttatggcaatggcccaaatcggacaagctgtcgcatactccctttcgcaaatgggaattgttatttcgacgtttgggagtatctacctcttaggagagcacaagacgaagcgagaaatggtttacgtggtgattggctcgatcctggtcattgttggtggagtcgcgttatccttaatgaaggcttagtaaagctttactaaaaaattaattatttgatttacagattaaaaaaatctgttgaaggtgcggtaacggtaagttatcagcaccttttttgttaataattgtatttattttttacacaaatgacgaaaatttacgaaaaaagggaggaagcgcttttcattattaggcgagctattgtataatatgacatgtaaatacgtatagaaagaggtaatagtaaatggcacacatttcatttgacagctctaatttaactaagttcgtccataataacgaacttggcgaaatgcaagctatggtcacagctgctgataaggagctgcgtgaaggaaccggcgccggtaatgatttccgtggctggttaaatttaccaacagattacgataaggaagaatttgcacggattaaaaccgctgcaaagaagattcaagacgattcagacgtcctcgttgtaatcgggattggtggttcatacctcggtgcacgggcagccattgaattcttacacgaaactttctggtcatcactttcacgtgaagaccgtaaattcccacaagttgtctttgctgggaactcaatctcatcttcatacgtcaacgacttaattcacttaatcggcgaccgtgacttctctgttaacatcatttcgaagtcagggactacgacggaaccttcaattgcattccgggtcttcaaggaacgtttaatcgcgaagtatggtgaagaagctgctaagggccggatctatgccacaactgaccgcaagcgcggtgcgttgaagcaagaagctgacgctgaaggctacgaaacctttgttattcctgatgatgttggtggtcgtttcactgttttgacaccagttggtttgttaccaattgcggtatcaggcggcgacatcgattcattaatgaagggtgctgcggatgcccaaaatgaatacaaagatgccgatttatctaagaacgaagcttaccaatacgctgcttaccggaacatcttgtaccggaagggctacaccactgaaattcttgaaaactacgaaccaaacatggcgatgttctcagaatggtggaagcaattaatgggtgaatctgaagggaaagaccaaaaggggatctacccatcatcagctaactttacgactgacttacactcattgggtcaatatatccaagaaggccgtcgtaacttgatggaaacggtcgttaaagttgacaacgctactagtgatgttgacattcctaaggaaaccgaaaaccttgatgggttgaagtatcttgaaggcaagacgatggctcaagttaacaccaaagctttcgaaggggttattatggcccacgttgatggcggtgttcctaacatggtcgttaacattccttcacaggatgcctatacgttaggttacacgatgtacttctttgaagctgcagttgccatttctggttacttgaacgggatcaacccattcaaccaacctggtgttgaagcttacaagaacaacatgttcgccttacttggcaagcctggttacgaagaattaactaagaagttaaccgcacgtcttagtgactaaggtgctagcactttagaaattaagatggaagctcctaaaacaaacaactatcagctggctgataggctgcttgttttgggggctttttgcttgtctttctgacgctgtgttcgtagctgttattgagcgtcgtcgctaatctaaaatttatgaatcacaacgttgttggcgaaatgaatcgctacgtccgcaagatgaccctaatttaacatggtgatgctcgtaatttttgaccgcactggtcgcactaactttgaatgacatcacgcaatgaaaaatctgccgacctatctcgagtttaatcgtgagtggttggcatgtgatttaacagcagacgggttataatagattaggtgttaaaggacaaatatagtcatgcatggtagttgctcgcaacgatgtgtgatgtacgtgaggagtttgagatgcgtaaattaaacattatcgaaagtatcattattgttctcgggttactagtcttttggctggggagtgaagtgacagtaatcaggcaacaattgccatggttgcaatttgcagggctgattgtcgtatttgtgactggtttagcggatgcgatttaccgcgtggtcacgaagcggtccttttttaagtaggaatcctgctgattgaagttggagtcattaggtgtaatttaatacgatgaagcgtccgttactggcagtcagtgtgcctagtaatggacgctttttagttcatgccttgaatgtgtggggtgcttggatttatctctgctgacggttaagtcgtgattgccgtcataaaataagttcgaaatagaaaaaattttattgtaaaaatcagcaaaatgggtgatattttacaaattgtaactaccaagtaggcggtttattaggatttaggatgattataattttaattatgaatgatgaccacaggtattcaataacactttacatcattcaccaaaaatcgcaatgttattaatgaggaaatacattgtggggaatgtagttaataaaatagtggaggtacatatatgagctttttagaattacacgatattcgtaaggcctataccttaaatcaccaagagaatgtcatcttgaagggcattaatctaaacttcgaacggggggagtttatttccattcttggggagtctggtggtggtaagtcaacgttaatgaatattattggtggcttggatcatcattatgatggagatgtcttgttagacggccaatccttgcgttcaatgaatgtgcggcaaatggaccggtatcgtcgggagacaatcgggtttatctttcagaactttaacttggtaagttacctaactgtcttggataacgtcatgctttcattaaagatgactaagacgtcccatgcgcaacaagtccagcaagcgcaggacctactcaaacgggtgggacttgagcagcagacgcaccagtatccaaatgaactatccggtggtcaaaagcaacgggtcgccatcgctcgtgcactagccagtgaccccgatattattatcgcagatgagccgaccggggcgttggatagtgaaaatacccaagaagtaatggatattttatactcaatcgctgcggaaggtaaacttgtgatcaccgtgacccattcgcaggaagtggctgactacgggacgcggatcgttcatttggatgacggccagattcatgacgaattagtgatcgggtcgcctttcgacgtggtcgataagcaaccgacgcgttaccgaacacttggctttcggcagatgttccggatgtccatgcaacatatgcgtcgaatgtggcttcgttacctgctgattatctttggatcgtcgatcgggatcagtagtatcgttgtaatgctgggcttgggatcagggattcaaaagtatatgaatcaccagattacgtctcaagttaatccaaccgctgtccaagtatcaaagaagacggggaaagtcagcacggctgcgcgtaaaaaagcaaccagtgcagcagcttacaaagcagcggttaaccaagaacaagtcacagccgcgaagaatgccgaagtgacgactgcaaacgtcaaacaattagcggctatcaaacatgttaagtctgctaagctgggctattacgcgagcacacaagcgagttataaaaaaacaaccgtgacggccagtctccagacggataaccccacagttttgagtaagacaattaaggacggttcacgtcctgaaaatggtcaagttttgattggtcgtaagttagctaagaagatggtgggtaagaaaaattatcaacaagcgctcaataagaagttgaccgttaaattggcaacggttaatcgcaagaatcagtccgtaacggtcagtcagacgctgaccgtcagcggaattacgggtagcgatgatactagcgtcgtggtcttaccacaaaccgtcaaaaagatgttaactgctaagaatgtggcttatcgaccaaattttgccattgttcaaatagataaattggcgaatgttaagcaagtcgaacaccaaatcaaggccatcaagggaacgaataagaagcaacagtataactataccggaatcggtgatttaattgattcattgaatacctatattcgtttagccactaacgtattgaccggggtggctggtattgcgttattagtctcagcaattatgatcattgttgtcctgtacgtcagcgtttctgaacggactcgtgaaattggggttttgcgcgcacttggcgcccgcaaacgcgatattagtcatttgttctttgctgaggccttaactatcggggtattagccgccgttatggggttactgtttggagaaggttggcaattcttaggcaatatggccatctatagcttaattaagtatccaatcgttcgaatctccggggcagcaatgctgggcggcattacagtcagtgttgtcatcagtttattggctgctttggcaccggcacatatggcggcacggttggatccagtcgagagtttatcacatgaataaaagcgggggcgtagcaaatgtatttctttattacgagcaaaattgattcgacgccatcagctattgagttagccatgattcagcgtcaaaaattattcacaaagcaccgggtacctgcgttgatcgtgacccgtaactttgtacgcgatttacatcataatatgcaactcattgggtatgatgatgagttccaggtcaatatgtatgattattttcaaggcactacgaattacgaaggcgaaccgttaactgcggccaattatccacgggtgacgggtgaaacgctggaacgggtcagcgctaatgaatttgacgtcattcaacgggaacaacggcaaaaagcactgatgttaaatgcgcaggggaatattgattacgtcgatattctcaatccacagggcgcggtcagccgtcgagactattatgatacgcggggcttcttaacggtggcccagtactttgatgacaagcagaatattgtgttagagcaacactgtaatttacaacaacagcctgtcttagagacgtttttccggccaaatgagaagcaacaaccagttgccactcatcaacggctgttaaactatcacgggcataattacgaatttgaggactgggatcagctgactgcctttttcttagacgcgttaaatactgagtatggcggtcacggaaccatgatcgtggatcgtagtgatgctgggatgaatccgattgttaaaatgtccacagcagcgcgcaagtatgagttcttacacagtaatttcacgctggacccacttgacgttgtgaactcaccaattgtgccgtacactcaaatcgggttagatcacgccagtcaaatggctggtttgatcatgtccacgcaagaagagtgtgatgatatgacgaaccacattcataatgtgattccaactttagcgattccagttggtagtgtaagtgacgaacaattagcagctcgtccggttgactttaaggatcggattgagggcaaggtgattgccgttgctcgcttatcggcagagaaaaatttggaacaattgattaaggcggtcgcctatgttcatgaaaaacagtcgaatgtgaccttagatatttatggttatggtgattcatggactggatttaaagaagaaaatcggttgcgagccttggtcagttcgcaacgttggcagtcatttatcacgtttaagggctttgagcgcgatttgacaccggtctataaccaagcacaactgatggtccttactagccaatatgagggctttaacttaggcattttagaagggttaagtcatggcgttccggtggttgcctatgacattaagtatggtccggcaacgatgattacggatggtgaaaatgggcgattgatcacccccaataatttagttgaattgggcaaggtgattttaacgctcttacaacaccctaaacagttggcgaagatgagtgaacgggcatatggcaacagtagccgtttttctgaggctatgatttggcaacggtggaatgatcatgtcattcagcctgatattcaagcaatgaggggagttacaaccaatggaaacgcatatcacgtcatcggctaaacaaccacatgccaagtatgggacccgtgatttattgagattgatcatgacccatgctcacccgaagaagggactctttgtgattggaatcctgttgtcgtttgtcgcaacgatttgtagtcttggcattacgttgatgttgaaggagtttatcgacgcctttaaccatggtacttcgggtcaactgttgcttcggttaggcgctgtgattgtcgtgcagctatttgctagtgttgcgtcgagttttctacttagttatacgggggtcgacgccgtttcgacgttgcggagcgcgttatggcaacatatcgtggacttgccgattccgtattttgaccataaccggacgggggaactgtctagtcgggtagttaacgatacatcgacgatttttgaattgatttcaagtcagttttcgaatgccattaatgggatcatctcaattgtgggttccttgacgttaatgttgttattaaacttccgcttaacgattattattttaattgtggttccattgatggccgtgatcattgtgccaatgggtcaagtgttagcgcggatctccaaagcgattcaaaaagaaacggccaacttaaatagtgcagcagtacaaatgattggtcaaaatcggttagtgaaagcaatggttgctgaaaaggcactgaaacaacagggaaaagatcaagttgatcggatcaaaggctttagtgtccgtcaaatcaagctgatctcggtgcttaatccagtgctaaacatcatgttactggccgcaattttcattatcattgtttacggtgggatcttggtacaaacgaacgcgttgacaattggaagtttagtagctttcttaatgtatgccgttcaaatgatttcaccactgagtagcgtaactggcttagtgactgccttgcaacaaacggtcggggcaactgagcgaatcgacaacattttagatagtccggaagaagataagcggttgtctggcgagacgctgtcaacaatcgatacagtcgactttgatcacgttgattttggctatgaaagtgataaaccggtgcttaaggacattgatttgacgattcatcgtggtgaacggatcgccttgatcggtgagagtggtagtgggaaaacaacgctagtctcgctcttagaggcttactatacgccaaagcgtggtgagctggacgtgaacggtcagacaatggctagttatacggttccctcgattcgtaatcagattggctacgtaagccaggaagtagacttgatgcccgggacgattcgcgataatctcctgttaggctcgacggaaccggtccctgatgaacaattgagtgcgttgttgacacaagtcggcttagcggactggttagctgaactgtcagctggtcttgatacggacgtcggtgaacggggcttgaatgtttctggtgggcagcggcaacgtttggccatcgtccgggcactcgtccgccacccgtcgctattgattctggacgaagcgacggctagtcttgataatcagaaccaagaacgggtgacccagctcttggcgacgttaccagctgacctgacgactattacgattgtccatcgattaaaccagatcgaagcgtatccgcggattctcttcatggaggatggtcggattacgggtgatggcaatcatgagtccttattagcaacccatgaacgttatcgtgacttttatcggctgcagtatcaacacggttaaaaaaggccttagtgaaatattgtttgattattaaaattagtaagtggttattgctgagtgttggcaatagccacttttttgattcaaaaatatgtatttaactggataatgatggctacggtgtgaaataaaaccgccgtaaaaaatataaaaagtattaataattttaataataagtcgaaaaaagcgatatttataattattttttagggaataaatttcccgatggcatggttcataattcggaaaaaaaggggagatgtcgcaccaagcaactacgctgaaatgctgatattatcaggggtttaaacgctttctactggcatagttaactggtgataaacataaataatattgatattggacacaaattttgaccgttaatgaaacgcgtaagttgtccatagtatgcacatttactgattgaatatgatactgccctgtatttattcaaatattagtaattttattgacgattttggggcgaattagttaatatttaaatcgtaaacgaggttatttgtttcacgttcgcattagtaatcaacattagttatttaacagattaaattaatgattattgagttgctaatttgtgaacaatttgtaaattttctaaggaggatattaatatgagtttcttcagtgatttacatctcttaccaggaacccacacatcatcacatactagttacgttagcaaccaaccacttggtactttctatcagtttgtgttgaacgtgatcgccgcaattaaaggttaagcgttgctagagacgggtgttagggaatctaatgattaattagttgaaatttctaaccatttaaccaagtttgtcggaatttaatttgttttccaaactctcaaggcttttcactaattggctaggcttggggatttaaccattaactaacttaaaaggaggagttattcatgagtttctttactgatttgcacttcttaccaggaacccacacatcatcatattcatcaagtgtttcgaatgatatctttggtggcttccacagtttcatcttaaacttgattccagcaatcaagagtttgttcagcaaataattacagtcaatcatataggaggatttcacaatgagtttctttaacgattttcacgtattaccaggtacccatacatcatcatattcatcaagtgtttcgaatgatatctttggtggcttccacagtttcatcttaaacttgatcaaagcaatcaagggctaatcgatcgaacagatatattaatcaattaattgattaatgacttgatattatctagataatagaggaggatatgtattatgagtttcttttctgatttgcatttcttaccaggtacacatactgcaacgcatacgagttatgtaagcaaccaaccattgggtactttttatcaattcgtactgaacgtaattgcagctattaaaggctaattaattaaccaattaaaaggggaatagatcatgagctttttcaatgattttcatattttaccaggaacacacacatcatcgtattcatcaagtgtttcaaatgacatctttggtggcttacacagttttatcttgaacgtaatcaaagccattaagggctaatacgttatttaaaactgaaatgccaacaaaaccatttatggtgtaataagcacaatacgatagacgcgtgactaagatgatgggctggcaagcgatttgtcacccatcattttacatgaggccaaaaaaatcgtgagtgcttggggaggaatccatatgtcaaaagataatcaaaaagtgaccggtgattcaatttatcgggtaaagatgtataaagacggtaaacgctgggtctacgctggtgcaactacgttagctttagctgccggcctagtatttgccaacgtcaatgcatctgctgatacaacaccagcaaatgaaactaaaacggaacaagttactagtggagccagttcatcagcaactagtcaagcggctacttcggatgccagttctgcatcttcgactagccaagcaacttctacgactagtcaatcaacttcaacagtttctgctgcaacacagagtgctacttcaacaacaagtgctgccagttctgttgctagtcaaaatgatacaacgcaaaccgctgttgcaacttctgctaagattcagtcacgagccgctagtgctgatacaaccgcgactgttcaacaggaaacgccaacagttactgcaccgacctctagtgcaacgccaaaggttactagtgaagcaactttaacaacttctgaagctgctagtggttcaacttctgaagcaacttcaacagttgctactggtaatgggtcattagctgccagccatgatattaacgccaacaacgtgaaagtcgacggcacaacggttgccaagaccgtcaagggacaaaaatacgacatgcaggtcgtgcttaccaagaactcaaaaattgactggaatacgggtcgaacaaacggccaattctcaattgctcctgcaggtagttctgaaacggctaacggaacttggaaggctgtttcatatcaaatcgatcagaacaccccagtgactattggtactggtagcacaatcgtagttccagttaaggacgttattaacgcgaccacgttaatgtttaactatgaatatacagctactaatgatactaattcaaatagtgattatttatcaattaacgatattccaaatgctgatgataaagttcatattgaagcggctggaaatacagacctgtatcagaatggatgggattacactgcgcagacaactactgatgtaacgactaccacaccagctgaagatgcacaggatgtttcggtggcatacgttgtaatcaccggcgttaatgctgatggtacccctaagtatactaagattgatggcggcgtaattaagagtggcaaagttggaacaactttcactattaatccagcaacaattgatggctatgccctttatggcgcaagcgataacgttaaacctggtgacaatggcttaactggtacagtcgattcggttgctactaataatgaaattgtattggtctacgccgaaaatactggtattgttgctaactatcagactgctgatgggacaacgttggctacgcctaataaatatactcaaggtactgacaaaacatttacccgtgctggtggtacttacaaattgacggctccaagtcttgatggctatacctacgtaggctacaagattggtgacggtgatgttcaatccggcaatgttgctgctggtacgcttgttgctggtgctaatacagtaacctttgtttatgcaccagttgttgaacaatccgatgttactgtaaactacgttgatgaatctggtaagacgatcaaggccgctacgacccaaactttggataacggctcaacttataacgttgatacaccaacaatcgatggttacacgtacaagtcagctgatgccgctttgactggtacggttgatggcaataagaccattaccttaacttacactaagaatgccaccccagttgaacaatcaacggttacggtaaactacgtcttacaccaaggattcaacgacaccagttgaaaataaagctaacttgacgatcaattatgttgacgctgatgggaacaccatcaaagcatccagcgtaactgaatatatcgttggtcaagcttacacggttggtcaaccagaaattgctggttacacttatgaccatgccactggtgatgccattgccggaacgattgcctacaacggtaacacagttacccttgtttacacgaagaacggtggcactactccaactgaacagactaagacgatcacagttaactatgttgacgcagatggtaatacgatcaagagtgcgacgaccacagcttacaaagttggggacacttacacggtcgcaacaccttcaattgctggctacacttacaagtcagctgatggtgctttgagtggtacggtggctgatgacgcgacgatcaccttaacttatgctaagaatgataacggcggctcaacgactgcacctaccaccgcacctggtaccggcgacaatggtaataacggtggtggcacgacgacaactgcacctacgactgcacctggcactggtgacaacgtcaacggtggcggtactggtacaactacaactgctcctgttacgacgccaagtgacgatactgttgataatggtaatggatcatcaaacaacggttcatcaacgacgactacttcaacggcaccagcaaccacggtttctgatgatgaagtaacgccaacgacgacggctactactaacaatgggactagtggggttgttcctgcatcagcctcattgaagccagtagttacgactaagacgacttcagacgcaaagacgttaccacaaacggatgaagacgaaaacgggactgccttggctgtcttgggtctttcaaccttattgatgggttcagcactatactttggcgtttctcgtcggaagcatgaagcataataattagaatagcttgattatttgctgaacggatagaaaggtcagcgatgacctttctactctttgagcaaacaatcaagtttatggaggagttgcattatgaagatgttcaataaaaagcgcagagataagaatgaggattaccgtaatcattctgagcgtgcaacggcgacttcaaccgttgctgctcaaaagccaaaaccaaaggcgactcaaagtagtacgacccccaatgtgcggtcatctgctggtgtccggccaactagtagcagtgtgactgcttcaactagtgccccagttaagggccaaaaccgggtcaaccaacggcgtgctacccaaacagcagccaaaaacagtgtggccattgaacgcgaaatggctgacttaaacaagcaataccaaactttacgtggggagcttaaggtccaattggttcaggaccgtaagcacgaaaagcaacagtatgaaactttagttgccgaacagttaaacttagaacaacagttaaaggacgctaaggttactctgtctaaacaggacaaagtcgttaacacgaacgatagcgaacggcagggaatggtcaagaccatcaatgctgctcaaaaacgttatgatgatgctaagaaagctcttgctaagagcgatcaaaccatcaaatcgttggaaaagaagattacgcagtctgaacaatcattagctgatttgaagcaaaatgaagctgatatgcgtaaagcaattcagggcgaacaggatcttaagaagttattcgtgttgatgaagcaacaggagaagcaagcacaggatctgtatcaaaagagtgacgcaatcaacagtgaactcgtgaaactccagaagcgtgaacagactgaaacccgtgaacgttcgcggaagaaacacgcgattacgagtgcggaaaaagacttacataccgctcaagatgcgttagttgcttatgatcgtaagaagagtgctcaagacgaacaagaacgttcactcaacttgattaatcagaaaatcaatcgattacaacatgattatgatcaaaatgccacgattgttaaggggctccaacaaaagattgaaagcattgatgccaagttaaaatcggattacgggacgactcacttagtatcgcccgtcgaatttgaccagtctgcgaagtacttcttgttcagcaccgatctgattcaatcattgtctggtgatgaaaaggcttcgatggaaatgatcatgggcttattgaagagtgaagttaaggataaagctaatgttattacggttaactataatgacagcttgccagaaatttggaacagttaccaatcagctggcttagttgataaacgaactggcttgtacaacatgtactacacgattcaggcaaaggtaccgggtgctgttgcgaagactaaaccagaattacctgataatcctgcatggcaatataagcgcaatgctgataagcagattgtgtcaattgccgatgacggcggtaacccaattatgacgttgaagtaccgtaagaatggtgccatttggtacatgacttacttcaatgggtcattagcaactcgtcgggatgtgtacgatgctgccgggttcttgtcagtcactcagtaccttgaccggacgaataactcacaagtgacactagaaaacttctatcgtccagaccactctttagcaatggtcaagcaatatggtagtaaccacgaattatcaattcaattagtgaacaaggaagaagccatcacgaatgtcttccattctgaagcacaattattgaactggtggttggcatcagtcttacaacaacaaaacagtgtgttggttatgggagttaacgccccattgttcgaccaatgcttacaagcaacgaatgataatttccatctcttaccaatcgtctctgctgatgatttggataatcaacacgtccaagatattatcaacggaaagagtaagttgtcgagcttagttgtaacggatcgtgatgttcagactgcgattgagaaacaaatgacacgtgatcttgaaatcaccgttatgccagctgcagaagtccgtgcgtaatcacggggttgttgatgatgccttgaacgtgacgcatgaatggggttttaaataatgatgaagactaatactaagaaggccaagtacgacgatgcggaattgttcgaaaaagtcttagtgggcatgtcatggcttgaaagccatcttcgcgagattattcaaacgatggtgactgatgcggacgtgtcgttcgaacagttcttgattctctactatcttgaccatagcactgatcaccggattacggtgaaagagctagccgctgaccgccacgtctcttcttcagcgatttcaaggaaactgacctacttgatcaacaatgacttgattgtgttgaacatcgatccttatgatcgtcggtaccgttatctaacgttaaccgccaaaggtgagaagttagcacgggtcattgaaaaagttaacgaagaacgccttggcaagttcctcgacgaatttggccggattcgaacctctgaattaactgatgagcttcggatggtcagcaaagttttagtggataccaaggaaattaaaggctagtaaaaaagagtcattcaacttgtataagctgaatgactctttttagtgttaaatattgatcgctaatgagaacaagataaaaccaccaagtaacatggcaagaatcgccacgaccacccacagcacttgacggacgttgtgccgcacgcgtcgctcaacatggctctttgattggagatgctcatgttgggcattaaatagcgaagcattcgtgtctttgacccaatcagcaccatgctgaccatagtaggggttggtgttatgattgagcgagtgggggacccggccatttgatttggttaacggttgatagcgccgcatcgtaatcctcttttcaacggttgtttagtttttctgggccttataaggaacggcatagttcttaggggcgtcgctagcttttgcatacttccagtgcccagacatcttcttttcgagtggggcatcatctttgatgcaagtaaagcgagagccaacttcattttcgataatgaagatccggttaaactcgtgccgcgtctgaacaatgtgacaatcattgtgatcgataccaaaaacatctttgtataccaacaacattatctcctttggattgaatttaaaatagtgacaattttacaaggcttcacagacagtctacactatctattataaacccctaatcaagtccgtaaaccgttttgagtgaaaaaagataaaattgcactggcaagggtgtgacaattcataaaaagccacgcaggtaaatttgaacttacctgcgtggctttatccgtacttctgattgggtatactgggaacgacccctatatcatcaaaaatgcttgtataccagctattatgaggcgttcaggccattaagaaattgagttggctgtccttttggctgactaccattaaattaaccctatttcctgctggagctgaaacttttcgttttaacgtggtacacgtggtacacgtggacaatcgttgatatagcaacgtttcaaagtgccctaacgtggttcattacccggtacaacgtggtacacttggcaaaaagtgtcaaattcagcagtctaaatattaaaaattaaggtaattagccagtttttcagtggcttcgtttttttgcttggcagtaactgcggtgtaaatatctaaagtcgtgcgatagcttgaatgccctaactggtcttgtactgacttgatggaagcatgggcttcaaatgcaagtgtcgcataagtgtggcggaatgcgtgaaccgtgacatgcttcaagtcatatttagttagagtatgttcaagccatttacgtggcttagatggttgaaacatttcgttattttcattggcaaacacatagtggttaccctgattaatgttgaatccgaaacgtagtagccattctttttgatcaacttgccagcgttgcaatattttgaccgtagtgggatctaaatacaccgtccgattgctacgcgctgtcttaggcgcttgtactagcagacgggcaccatcaccacgggattgtgttttattaacccgtatagtgtgattgctaaaatcaatgtcagaccattctaagcaaagcatttcagattttctcataccagtaaaggccgctaaacgaaagaatacattggcttgcggtgtattgtcatcatcattcaggcactcaaagaagtgttgtaattcagccttatcaaagtaattttctaagtttttgcgtgaacgatcatttttatttactggcacaataacgcgcttggcgggattctcaccgatcaagtcaatgttgatggcataatcaagcaccttggcaacgtaattcattagagtatgatactttactaagccagcattaaaccactgatttatggctttttgacaatccttaatggatattttagcaatccggtaatcactaaatattggtaaaatatgaagtcggaacagccgttgagtcgttacccaagtgctttccttaactgtttgtttatattgtgtgaaccacagctggtaaatatctttaaaaattgtattatcgtttttagttggtagtccatgattgtaaatatcaagttcaagtcttgataatacaatctgggcttctttttttgtcttgaatccacggcgccgtgtgtttttcttttttcccgttagtggatcaacacctaaataaacttgaaactgataacgggtattcccgtccttgtcctgatacttcttgattgttgccatttataatttcctccataacgtaccttgagcggggcagtgttatgtacggaaatgattataacggtattgattattcatcaattcgtagtgaactagtgattggaattgcgattttttattttagtgaaatattgttctttagtttcatcaaaatcaattaaaaggtcgggttctactttaatcttactgtctttattaagtgcagactctacaaccccttcaatgtctttttttatatctgaaacaaaggaaacagacatcttgtttaaataagtattcaattttttcaattgaccagcatcagaagggagaagactggtaccaattaagatgctatcttcgtcgtagtgccctaaaaattctgtatagccttgtaactcaattgaatcaatacgattattattttcacttacattaatgaacaatgatgcctcatgtgtttctggctttccattagcatagtcagaatcgggaatgagatctccttcaataaatgtgtaatcaaagtcgaaaggaacatattcaaaaaaatcagtgggtacgatatccaatgcctggcaaagcttatttacggtttccatttggaccatcttcgaactattagaagacagcgatgtaagagtagttcgcgagataccagtatcattcgagactttgcttattcttagttgtcgttcagtcagtaatacagataggttatttctgagcatggttaatggcctctctttcaattgaaattgtatagttatttgaacaaaaaatcaataattgatataaaaagattgaaattagaacaatggtgtaatacaatggtaactgttcaattaattgaacaaaaaagccgaaagaggtgaataatgtgcaaaatgttatgaccataaaagatgctatgcagtatttgaaaatttctagctataacacctttaaaagaaattatttggatcaagggctcccagtaatactagttggaaagaaccggaggatcgagcgtaacgacttagatatgtttctcaataggcacaaaataataaggagtggtgaaaaatgaagtacatgaatttaggccaagcatgtaagtatctcaatgttaaatcacgtaatactttaaaaaaatacattaatcagggtttaccagttattatcatcaacggtactaagcgtattgatcaattagacgcagataaattcatgcagacacacaaaaaataaggccttgggcggggcaaaacaaatttaaggaggtgatttcatgatagcaacaacaatcttatgggcaatcaagtttatgattgtgtcgtttgtcggcaacgtggtggttaagttaatcaagaacccacgtcggtattttggagtgtgaggtcagtcgcatgggaaagcatacaaaaaagacctactttactttggaaggtagtaggtcagaaagaaataatcaaaaatatgctttcccttattttaacacgaataaggagaatggaaaatgacaaatagtgaattagtggaacgagctaagaatttatcagtggcacgtgacaatctgcaaatggcaattgattacttagatatggtatctgcgtcagttaatagtggggacacatgggcaggacaattatttttctcaaaccaccgcgctggaaacgttgttgaaaacatgcaaaatgttgctgattcgattatggcagttagcaatgacatttgtcccgaagattaggcggtgatggaaaatggatattgaatatttacgcggtgaaatcataaaaactcttggacttcacgaagcactttccgacattgttgatagtttaagtgattcattggaagaaaacaagcaaaacagcagtatggttcaatacaacttaaaacgtgaaattcgaccattatcttcattgacctgggcgatcaatgaagagttgattaaaattgctgatgctactgatgaattaactattaaatgtgctagggctggtgatgaaaaatgaaggagttcgcaacacttgataaagccattgagctggcccagcaaggctatgcggtttacccactgattgaaaacacgaagaagccacctaaaggggtggcgggctaccaagccgcaactagtgaccagaacaccatctttgcatggttcaaaaagcaccccacttacaacttaggcttgcgactagatttatcggatttattggttgttgatattgatatgcacgagccaactaaaaacggccggactagtttggcacgattattcaaacaaggtcagatattacctaatgatacctacattgagcggacggctaacggcggagtacattactttttgaaatacgcgggtgctaaggttcgcaaagttgacgtttggccaggtattgacttgctaagtgacttcacggtgattgcaccaagtgaaattaacggcaaaatgtatgaacctttagatggtcgaaccttagctgatattaagccagctcctcaatggttagtcgataagttggcgggccaaaaagtgaactggtcgtcagaacacgcctgtaccacacaccaaaagaagtatactggaaaattactggacgaaatggtaaccgggacaacccagggcaatcgcaacgcttggttaactaaaattgctggtcgaatgtttggtgtcggcgccaatcctaagacggtctataacatgttgtcagtgatcaatgattcgttcgttgatccggcactgccaagcaaagaagttaatgtaatttttcaatccattttaaaacgagagagtaagggggttcattaatgggcaaagcaatggatttaccagcagaggcacgagaagcggccaacaatgttatcaaaatgcaacgtgacgctgattggcagaacgatttcaagaagaattcggacgatggaattaaaacacagtctctttacaatatccgcttaattatggaacatgacgaaatgttgaaagggctagttgtctttgacgagttctcggaacaaattgtcaaaacaccacaagcagaaaattcactgttcaaaaaaggtttttggaatgatagtgatgacacgttattgagaagttatattgaggatcattacaacttgttattcagcaaggaaaacattaccgacgcggtagttacagaggcacgccgcaagacaatcaatccggttaaggctcgtattgaagcggtagaatgggacggccagccacgtgctgaacgttatttcattgattacttaggtgccgaagataatcattacacccgcaccatcactaagaaatggctaactggtcttattgcccgggcctatgttcccggagttaagtttgaaattgttcctatcttagagggaagccaaggacttggcaagagtacggctggtaaaaatctatacccggataaattcaatgattcgttgaaaggaatgggtaagcagaaagacgattatcaacagttacaaggtagttggattattgaagttgccgagctttccgccatgaagaagacggatattgagggaatcaaaaatttcattagtgcacaatccgacacataccggaatagttacggccgctatgcgttaccgcacccacgtaaatgcgtatttattggcacaactaaccaaaccgactatttaaaggacgcaaccggtgaacggcgcttttatccaattaaatgtggggtcaacaaggccaaattagatgtatggcacccggacgagaattacatgcttcaagtattggcggaggccgcgtactggtttaggaatggtgaactgctatatctggatcaggccactatgaaagaggctaaggcgtatcagatggctgcggaagctgtcgaccctatgcgcgatgctatcgaagagtttttagcaatggaagttcccgcagattgggaaaatatgagtaccggcttaaaacaaagctatgtcagtgactacggccatcattctaagtggctaaaagataaagttagtaatgaacggaaactactcaaccaaacaacaactctggaaatcatggaagttgtcttccataaaacagtcgatcgttatttaaccgggcgaacaaactcggaagctaagcgaatcaagctattaatggacaatatggacggctgggaagctaaaagaattagaatgaatggcaagtttccacgtggatatgtccgcgtacaatgatcgaaaatgctaagtgtaccacgttgtaccgggtaatgaaccacgttagggcactttgaaacgttgctatatcaacgattgtccacgtgtaccacgtgtaccacgttaaaacaaacatttccagtacaggaggaaaaggaaaaatgaaagtaatttatccaagtttagttgagcaagcttttgacatttacgttaaacaatatggaccagttgtctcaaatagagttaatgaattaaaatcgtgtatttacagagccttgattaaagaaggtgctttagatcaaaatggtgagccaactcaaaaagcaaaagataaaggattggttgggagctttaccccaaatgaagatggagaatatgagccagaaactgtaagagacttaaaactcatgtaccccatttatgcacaatttagtgacgatcactttatgaaatcaagtcaaggttggttagctgacgcctacgttatccgaaacgtttcaagccaagttttgaataatcctttaagcgatgaagaacaacgcaaaaatgcgtacaagatgttggaacaattagatgattaacatgatagaaaggatctaactataatgattaaaacaaaaacgattatgcgaatgtctgtacaagatttagaccgagcaattaacagagaattagccaaccggattgatagtgacaatgtcattgacattaagttttcaagtaacgcgtttggggcagacctagattcttcttctgcagaatattgcgccatgattatttacaagtgaggttagttaatgaagaactataatctaaaccgcctaaataagcgggtacagtttggcaccgtcaagtctgttccgaacctaataaacggcacaaccaagcaacaatttgtgacactgttcactgtctggtatggtgagtacacgttaactgtcagtaataccattagccttactggtacgactgcgacaactaacgagctaatcgtggtacgccatgacgatcgaatcacgacgaccttggaggcaatattagatggggttacgtatcgcgttgctggcgttagttctgatagcgaactgaatgcctatgacgtggtcacactaactaaggtcaacggtcatggctaagccaatgaagcaatgtgagcacccgggttgtcggacgttggttgcctatgacacacgctactgtgagaagcaccgcaaggccactaacaagtggcgatatcacaaacgcatgtacgattctgacgagagcaggtaccagcagttttacaagtcgtcagcatggcgcaagttgtcacggcggttccttgaaagcaatccggtatgcgtgcagtgctaccaagatggggtgatccgtaaagccaatgtggtcgatcatgttattgaaatcaaagacgattggtcccggcgactagatgagagcaatctccaaagtctttgccatagacaccataaccggaagactagactggttagagaacaacgggagcaacaaactaaataaccaatgagtgtcgtgctgaaaggtgcggcgctttttagtatctgtggtcgcaagttacgaccttagataacgtactaacttggtgcactagctgactcgctaagatgacgtgacaggttgcttgtgctacctaagcttaacttagataggtaaacaaaaagccgcccgttaaggcgaccgctgaaatctatgataattaacctgacagttaagttaattatatcacgtgaaagcgagaaaacaatttgtgagtcgcaattttatacccacaattcaagattcatattaaaaggtatttccacagtagtagatctgcgcaatactgcgctgaactttcagccgagctactgagtcgaaattttcgaccaagttaaccaacccgcattttgcgtcaacgttgccaaaattggcaatggactgcgcctatttttcggccgagtgaacaattcaagttggcggctcaattttgagccacgagactaattcaaaatagcatgacagcccagaaacgttgatatggggggggctatggtcgactcgaaatgagcaactagcggacttttgtgtttataaaagtcccttttgaactttgattttttgcttattttgctggtttgtgaaatatccctactaataatgcgaaatttaaacaaatagtcagtcagggggtaacgtgtaaatatatacatgttattaattgtactttttagagatatgtgcgataatataggtataataaacgaattctggatatatgtatcaatcagccgctatgggtctaacccgtgggggctttttggtacgtaaatttaaacgaaaggagtgctccgaatgagccaaaaagtaaaagccttagctagtatgaagaaacacttaaccaatgatgagcgtgatcaacgtaaagacgctgaaaaagcgttatttgattatccggtgcttgatttaaccccgccagattggttacatgatcgggccttgactgaatggcaacgggtagcgccttatttaaaggccaataccccaattagtgaacttgatcgggccatgttagccagttattgccgcgcttatgccacggtacagacttgtgagaatgatattcgtaagaacggactggtacaaactaatcaagatactggcgtacgtaagccgaacccttacgtggccttgcagtcacaagcgatgaaagatttaaaagccttagccaatgatttaggcatgtcgttatctagccgggcgcgcatggaattaaacaagcaaaaagatgaaacacccgaagatacttttgaggcgatgttatcatgattgaatatgttgaccaagttttatcgggtcgagtgctggcttgtcaaaagattaaatgggcgtgtgagcgatttaaacgcgatttaagccgttctaaggacgacagcttcccgttctactatgacgaagacaaagcggcacaggcggtcaaatttatcgaattaatgcctaagactgacggcagccaactcaccatgcaaccatttcaaaaatggattattagtgagctgtatggctggcgtgaaaaaactaccggtaaccgccgttatgatcgtgcgtttattagtatggcccggaagaacggtaaaacctatctggcttctggcatggccgctaatggccttttaagagaacgtcagcccgcccgcaaccgacaagtattattcgtcagcaacgcccttaaacaagctaaattaggctacgacatgctttcaagtgggttaaggcaagtccgtaaacaatcgaagtacatgcggcaacggattaaggtacagaaacaagccattaccgacctagaaactgattcgcaagccttggcccttgccagtgataccagtacgcttgatggttatgccgggactaccgttattttagatgaatggcacgaagctaaagaccgcaaagtgtacaacgttttaaagtctggtcaagcacaagaagataactccctgctggcggtgatttccacctcgggtcttaaccttaacgttccaatgcacgccgaatatgacatgctgacggacgttttaaaggggaaaaccgaagctgaccgttattttgtggcaatttgggaactggacgaccgcgaagaagtttacgatcaaaccaattggattaaggccaacccgttattcagtgaaccacacgttaaacaacgcatgacggaaaagattcaggccgacgtagatcttgccattaaacaaaataatctcattccaatactggttaagaacttcaacatgtggttgcaagccagcgaggatagttatatttcagcagacgattgggccgctggtaaattggcaaaggtgcccgacttacataatcgtgacgcctatattggcattgatttatcaaaaagcaatgacttaaccgcggttagttggcttgttccaattggtaacggtcagttttattgtgacagtcattcgtttgtggggactaaatacggccttgattctaagattaaacgtgatggcattgattaccggtcaatggaacgggcgggtgagtgtagtatcacccgattagatagtggcattattgattatgacaatctatttgattttgtacaaaaactggtcgggaaatacaactggaaagtgaaagcaatcgcttatgacccgtataacgcgcaaacgttaattacaaaattcgagaaattaagctacccactgtttgaagtgcgacaaggcaccaagactttgaatattccaactcgtaatttccgtgatcagctttacgatgacaaaattaaacataacggcaacaagattctcgcttatgcggtcaataacgccatcttaaaagtgctaaacaatggttggcaactggataaagcccgcaacagtaaccggattgacccgattgcggcgttgattaacgcgtttgtagcaggtatggactattaccaagaaagtgaggatcaacagcatgcagaagattactacaaaacagcgactgcggcagatctgttctgattatgtacaaacgatcttgttggtgattggcttaatatgcttagtgattggttttggttgctggatcagctggcaagcggggctaatattggctggtatagccatgattctgctggccttgctaattaattatgaaaagcaaagaggtgattaaatgagtttttttgttaaaagcaataccaccagtggcacgcatgatccggtggctgacgccttggttagtttatcaagtaacgacccgtatacgtttgtgagtgcggcggtgttgcgtaatagtgacatttacgcggcgattaatattattgcgagcgatattgccagcaatccgattatgtgtgatacggcaatctttaacacgatgattaatcagaatcccaatagtcagatggacgggtaccattttaaatatgcgttggcggctaacctgttactcaatggcaatagttttgcggagattttgcctaatcacacacttaaatttgtgcaaaacaaccaaatgacggttgagcaagacgatgtgagcggcgcgttgacctacacctataccccgattggcggcaacagtcgtcagattgcgcctaacaacattttacattttaaatatttcaccaaagacggtgtatcgggaattagtcccctatatgccctcaaagacgagcgtcagattcagtcggccggcaataaattgctaaccggcttttttactgctggtgtgcacggcaccacgattattaaagtccaccaatcggatttagggccggaagccaaggataatattcgtaaacagtttgatgaagccaatacgggtgacaatgcggtcaatacgattgtgactgacgacaccatggatattagcaacttatctttaaataccgatgtgttaaagctggtcaattctaatgactggacgacccgacaaattgctaaagcttttggcttaccaccggagcgcttaggggttgaaaacgatcattctaaccaagaacaaagtggcgtgcagtatctacaagggacgttgcaacattactttgatagctttaccagcgagctgtcgttcaagtttggtcatgactttacgtttaatacggacaagctattgagccttgatccgcaaacgcaacaagcccaagcggtggctggtttcactggcggcgttatgagccgtaacgaagctcgggccaagattggcttgccaccaactgacgatggcaatattttcttaaacttacaaaagaatggagtgactaattcatgaaacaagaccgacggttaacgattgacgccgaattgcgagcacaaacgccgcagtcagcaacacccgaagacgggccagctgaaaattcagcagacccgcaacctaaagattcccaaacaagcaagggcaaaacaattagtggttatgcaattgtatggaactcaccaagtaaagacttaggcggcttcactgaggttgttacccctaaggcccttgatggtgtcgatttatcaaacgttcttatgcttaataaccacgactatacccaagtgttagccagtgccaaggcgggcacattaacgttagaaacggacgacaaggggctacatttcaccgcacagttgccgaatacgtcgtttgctaatgacgtctacgaagaagttcaaagcgggaacgttgattcctgctcatttggctttgatagtgacgacgacaccgacgaatggactaaagatgatggcggcaatatcacgcgcaccattaatcaagttaagagtttgttcgatgtgtcagtggtagccgttcccgcttatgacgataccaatgtgcaagttgatactcgtagctacgaaaaatttattaaccaagaaaaggagcctgacaacatggcaaaacaaacaattattgatcctaatggcaatgaaaacaaaaccggtattccggcatttgaacaatatgtacggacacacggggaaacacgggacggtttaaagactgacggggtcagtgcggttattcctaaggaactgattacccccgtttcccaattgaagcaatccaattacaatcttgcccaatatgcgacagtcaagcaagtttctagtggttccgggacttatccaattgctactagccgacaatctgcggtattggctactaaggaagaactagcggacattgccgacgttaacgcgaacatgtttacggaagtgccgtttgatgtgaagacccgggcgggtaagattgccttatctaacgaagtggtggaagacgccgaagttgatattgtcagtgaagttaaaaaccaattacaacaattggttgataacacggacaacacgcagattatgagcttgttaacgggaaccagtttcaccaaagcaacggccaccaatattgatgatcttaaaaaggttttcaatgtgacgttagatcccgctttgagcaaaatgtggttagtgaaccagtccgggttcaactaccttgataccttgaaagattccgatggccgttacctgttacaaccgaacccaacggcaccaagtggctttaccttgttaggggcgccagtcgtcatgattagtgacaagttactggccaacaacgtcgacgggacgtccccaatgattgcgggggacttatcacaagcggtggcggttttccggcgtaaccaagtaaccgcccaatgggacaagttcgaccagttcagtcaagggctttccgtaattgtgcggaacgattataaagtgattgataagaccgctgtaatcaacgtggcgttaaaaaccacgcctggtaaataatcgtacccacttttgggcacggttatacaagggggtggcgatttggcacccccctatacataaattaaaactaagggggcacgattcgttaccccctaataaaggagtgattacatggctgtaaccgttgatgatattaaactaagcctgcgaattgatgtgaccgaagatgatccaatgatccaaagctatttagacgccgccgaggactatgttcagacggccgttagcaaaagtgaggatttgactatctacaaacagtacgattttgccgtgtccttgctgacacaattctggtatcaaaacagagtaactgatatgacaaaaacaccgtatcaagttgttagtatgattcaacaactgcgtggaaaaattgaagcttaggcttgacatatgaaatgattgatactagagttaatgttgtaattgccctaatattactttcctataaaaacggcgattatcatatcctatagtgagaggctctcccccgagcctcttttttatacatatatctggaattagaaagtgtgattccaatgcgccaagatgttaagaaaattcgcaatttattaaagcaatatgccaaactaaaacgtgatttcacggcttttaatcaggtttctagtccctcgctcgatggagtatcaagccatagcagccgaaacggcactgaaagccgcctgataaactatgttgacttatcttaccagttaaaagaagtcgaagactccctcaatgcaattgatgacccacaatatcaatttatcttacatgattacatcattgagaagcggttcagccgcaacgaggcttgccagcgattatcagttagtgtcagcaagtttaattatatgaagaatgaagcattacacgcttttgcaaaattttacagtgatctaacggtttgaatgcctgctatagccaaacttcaacaattttactgtataattaataatgtgcagttaaatatttgatggagtgtccttgtaaatgagttcttttataaaaaaatggttgtttgaagttactttaaatattacattgttaattgttccggcttatttgatagtttctagcatatttcaagatggccccatagttttatgtttatctacgccggtacctgtttttggaataaaattattaacgtttaattttatggttttgtcagtgcttgattttttgcattggccgtctgattatcatgaacctaaaactataagaaaggttatttttgtgatacacattactatcgcagtcattgccttgataataagcgttagactaatggcttaacaataaaaaaactgttaaccaaagttggctaacagtcactgccccgcgcaagtattaagtcactggaaacagtggcttttttgttatatttttggctgtccttttggctgacttttagtgaaaagagatgacaaccaatgacaaactagagtaataaaaaagctgtaatcacggtgtttttgacaaccaatgataacagctgataacgaatattgggtatactgggctcgaaccagtaaattacggattcagagtccgctgccttaccaatttggcgaatacccaataacaactatttaatagtaacttttccagcaaatactgtcaagactttgctgaaactttgtgtctattttttgcatttttgcttgaatatcgtatcagttggtggctaaactagttgaatggaaggtgagtgtatgtcgaagtcagaattagatcatttattcgatcatctgcgacaacaattgatcgtatgggcggtcacggccatcggattagcagttatgcgcagctttttgttaccgcaattattgactttcgttttttggtgtagtgtggcctactgtttgctcttatttgttggtttagttgttgtgacgatttttaggtggcaaaaatcttaattatatttgacaagccgcttatcattcggtaagataataaatgaatttgtgcccgctggtcaaattggttaagacgtcgccctctcaaggcggagttacgggttcgatccccgtgcgggtgataagttgacaaatatagagaaccgacaaagcaccaaaacgctgatataaaggcgttttggtgcttttgttttacactcgaaaaccactcaaactcgatatgttcttccacgattcttccaaaaatgaaaaaagtagccaaaatatagcagtttttggaagaaaaattaacaaatgattttgtaatcccttgcggcacaaggactacagcaatcataaaattatcatttttaaaatccttcgtccattagctcggtagccttcttatctgacacgccgttttcttcttcaataagatggacataggtgttaacggtcgtttctagtttttgatgtcgaagacgatgttgaacatagggaagggactcatgatttaagataagaatcgaagcgtgtgtgtgcctcatggcgtgtgttgtaactttgttgatctttagacggttacaaatacgtcctagctcttcgtttgcattcccattgcccacgatttttcctagtttagaccaaaatacgaggttcttaggattcttcatttcgtgtagttctaaataatctttctgtgtgatgcgataggccctcataaaacgacagtaggcgggtcctatggttatatctccatcggcctgtccatttcctttagttggacgaaaagtctgtctacgtgcatcccattgctgtttaatgtgaactattccattattcaaatctaaattatcccacgttaggccagcagcttcctcgaacctggttccagtttctagttgaaacagcatcattagcatagtcatgtggtcataatcagctgttttaatgaggtatttacgcagcttcttataatcggacaacgtcaaatacttttcctctacgggcttaggagggcgtccggtgacgtgtgccttgtaagcaaagtcacgttttagaataccatcggctacagcgtccttgattgcggtgtgtacttgttgatgaagtttgtgagatgtggcaattccatgactgcgaccaaattcattcagaaatttctgataatccggccgtttaattgagctcataggtttatccttaaaatacgcggagatgtgtcgccaattgcccatatacagctcatgagtatgacgcgatacaccgtcagttttgtatattctgatccaatcaagaaagtagtgctttagactctcagtgctacgtgataagtcagcaccttccagcagagcatttttagttttagtttcccactcaacagcgtcggttttgcgcttttctaaatgggtaaccgatttataattaccgtcatcatccttataagagacacgggcttgccatttaccattattaagtttggttactgacatgttttattcctcccaactggaaataataataggctgacatttccaaacgtatgttcttttatgtgctaaaataaaagcactaaagtagtaaagtgctgtttattttatatatgatatgtgtaatcatatgtaagtggaagaaaggaagtgaaggttatgaagaaggtagtagcatatcttatgttaacgtcaatggagtcgacattcattgcattaatactgtggccgctaattcatagctatattccctttgccatttggatattttccattcttgttattccaatatttatttctctggttcctgatcattctctggcttttccttcgattttaggttttcgtgtgaaattacggttccaacatccttgatctgaggtttgatattcttcacttcatcaggaacattttttgtttcttgtttgagacgtttaagttcggccttcttttgtatgtgcgagattcggtaatcatcccaccaattcagaatgccttttttcttcccctctttcccaattactaaagagattaaagtaacaattccaccaaaagtaattacttgattccctccaagactagctactgtgtgaatgatgtttataattgcttgtatgttttcctgaccagttataaatcctaaggtgcccggacaatgaacgtctgcttgtagttctacttggtgtaaataattagactgttcgtcttttgccatttcgacaataccttgccaatttgcaagagttaaatcgtcttctaatgtggtgtagacggttaaatgaatttttttatgtttttgaaaaagaggaaatattaaacgatcaatgtattccgcgtaacttgaaatgttaaaaattgcttgatgtgcagacaaaatccaataaagttcgccggggagtgatgatctgtgtattgttttcatccatgtaacgtttcgccgttttagattttgatcgactttatattgaattccattgggtccggagttttctttttttgttcttaattttgatttatcagcatcgaatggatctcctgtaataacacctattgcaaaataatcagaacttttaccaggcgtaagaacaacatctccaattttcatgttattaataaattcaaaacattgagacgaggcaatcgtctgccaatgtttggtttgatggggataagaatcaatgtacatttgatggatatctgggttttttagaccatctttggggctatcatcggagtggattgactcgatagttacctgattatgtgcaatcgaaatgaaagaattttcaatgtagtcatctagatattttccaccatcagcacgaactaaccagtaacttgtgtcatctggaattgttaaaatttcaaaagtgcctttattattcatactttaatccccgcattagtatatacaatattaatttgatttttgttaaaataaattattttatttaaagcgagtgacgggaatcggacccgcgactacagcttggaaggctgtcgttttaccactaaactacactcgcgtcatggaccttgttggactcgaaccaacgaccggatggttatgagccgtctgctctaaccaactgagctaaaggtccagaagctttgcaattaagtgctatttatttttacttaattgtaaagcgagaaaactaataatccattctggtaatttctggttctgaagttagatagtcactgacgtgtgctagaaatttctggaaatgaggggtgtcattatggaaatccacggcttcttgatctttccagtgttcgataatttcgtaatcattatcactgtctaactttttgaaatgtccatagaattcattaccagcttcttgtgctgaattaataacaagttcatgaatgaaatcttcatattcttttttgagttctggtttaacatgcaatgcgacgttgataatcttcatttgaaattcttcctttgacatttagttttattattcatcatctgagtcttcgatgagctctagccaaatggttaatggttctgggttaaactctggccacattttcataatctcgtaagctctactcaaaacatgactttcgtttccttcttctaagtctttaaaaacacttaaagcgacggggttattagatagatcgtccattaaaatatttgttttatgttgccattcggtaactaatttttggtaatttattaaacgtcttgcatgctgaatagcatagtctacaccattttcttgaactcttttaataaaatcttcgtactctttgaagacggcagactgtgcttgtttccaatcattagtagataaatcttctgatttttccataaatgacacctgatttcttactacaattattttttctgttgctttaataatgatacaatttctgaaagatatttttcctcggctgttggaataggatcggcttcgacatcctccttcttaggcataattttattaatcattttgactagtaaaaataccacaaatgcaataatcaaaaaattaatgacagaattaataaaggaaccgtatttaaaagtagcattgccaacttttaaaacaaggctagagaaatcaatttgccctaaaaaaacacctattagtggatttattaaattattaaccaatgatttaacgatagcagtaaatgcagcgccaataataacggcgactgctaaatccattacattaccacgtgagataaattctttgaattcttgaatcaattaaatatcctcctgaaaatatattctagcttttcatgacatcttgactggtcaatgcgagtggcaggagtcgaacctacatctgttagtatctagtcagcaattcaaaggagcaccgttctaccgttgaactacgctcgcgtgaaagccccgacgagggcttggacctgttatggtcttgcgtattgattgccccgtggtgctggcttggcaccagaattatcagcagcactctgggtcatatattggtaattacctggatttttaacgctggtgtagtacttattggagtctgatacaaaaaccataccagaagcagcagtagtccaaccaccattttgtgtataggaagcattgtctgttttacttgtttcgctcgcttttttagctgatgacgagctagcaactaatgattctgaactggctttagctattgaagagctttctgcctcagactgttttttgctcgactcagattcagaactagctatactctctgaatcttctttggattccgacttggaggcagcaatactttcagattcttttttgctactcgatagggcactttcagatgactccttttctttaatagagttagctttgctgatgctagcctttcttttcgatgcatcttttgctgaacttttctttgctttgctacttgaggctgtatctgactgtgatgcactcgatcttgctgtgccagaaggggcggcccaaaccgttaatgctaagaataggattgttagtcctactgagattaaggtgtattttttgtatggacgattaacacctgtttttgtgaaatgatgaattcccccacgaattgaaaagtaagctaacgcaattaaagatacaagaaacataaatgtaaaaaatatatccaaagtaatccctccaaaatatgttattccccaataacaataattccccgaattataagtagtcccaactcctagcttttaatgacttcctatctggtcagcgcttttagatcagcgaagccagttcatgcggtagcttgaaaaaatctaagaagtctaatacatcttcttgcttgctccaaccatattcctctttcaacatagccagcataaacttgttggcctcagtttcgttgtcatcggataaaaaacttgtagtatttattgcaaaaaactgcgtattaaatcccttgtgatgccgtatatgaaaaatttcatgatagcaaacaccatcttgtgtccgctcatcaattgtattgttaatgacaatcattgggattcgatgcgagttattattgtagccgtaaatattgctgccaaggttattgaattgcacgttaatgcctaagttacgctaatgtttacttttctattccatctttaaaattataattattcttatttccatcgtgattagttaggtctttataccaaccgtcgccagtgtatgttgcatatccaattacaccatcggagtctttaaaaactattggatattttgtattaaatttattctgagccgttttaatctttttgaaaattccacccaaatacgcagtatctccaacagttgttactggcggaacaacatagacattatcaatagtaacaataatattattatccttaaaagcaacttttccatcatcatttgtcttttttagatttgaaatcagttcttcttgattttgaagttcatcattcgacttacttcgagcattatgctttactgctacactactagattttttattttcattgttcgtagtcttagtagctgaattagtcttagttttacgcccacttttatcaacattttttgttgaatcgtcactggtataaggtccaaataacgatgctactgtgagaatacttgtaaaaataattagtcctacgcgcaaccctttcctaatgttcctatttttatacaatcgatatgtaatatatccaaaaacaatagttaatactaatcccaaaatcttttcacccataatatatactcctcaagctatataaattttccaaaataattcctccaaattaatatttccccaaatagaaatcccaatgatgattaaattttaactcacattatgaaaacgaaaaaaactccataaactcgtctggtaatccgtacgcattttttagtgcattgaagctatcaggtaatttatcgtattcttcttcgtatagcttcgccaattcttggcatgcaaagtcattggccttatactcggcactgtttttctgataatcaccaagcgtgtaccaagaaacacaggccgtgtcctcaatgccatggcataattcatgggccataactggaagtctggccggtgaatcacgaaggctatcgctaattattatatctgtgattcccaatattggagtacagacccccatatttgccccaatgtccttaaagtgaacttcgaatcccaatctatctgctatcgcaaatggatcatacgttccaaaggatttcgcaagttgttctaccttaagatacgtgtcgtatcgcatgcaaacacctacttttttccttcttcacgtaattttttcaagcggtcccagtaaattccctcaataacattacggactttttccttatcctcgggtgccatactcattccaccatatcccataggcgtatttgactggagaagcttatctaaatcaatacgatcggcttcggtagcccagtctggagatttacgatttttttcgctatttccaagaagatagtcagtggatacttcataatagctagcaagaagccttagtaattcattgtcgggttcgttacgttcattttccaaatgtgaatatcgagctctactgataccaattgattttgcaacctcatcttgtgtcttgtctttcatatttcgtaattcttttaaacggttcccaattcctgaagatgccatagtatcactcctttcttaatggatattacatgtatcagtatagatacatcacgtatcggtttcaatctatgatacaaaaagtttctaaaaacacttgacgatacttaaagtatcgtttattataatagttgttgatacgatatgtatcaggattggaggcgcaaaaatgaagcgtgagcgacttattgcagaaagaaaaaggaatggttggtctcaaaatagtgttgcaaaattacttgatattgcggaaataactgttagaagtatagaaaatggatcacgaaaccctagtagtaaattaattgccaaattctcatacctttttgaggttaaaccagaaattttatttcctgatatttttttaccagataaagatactaaacgtatcatatcggcaaaagcatacaaattgacaaaggagacggcaaaatgaagccaataacaagagatgttttaatcaatgcactagcaaaggttaaaccagaaacaccaagagtaatgtttgaggcactaagcgataaagcactagatgctgaattccgatcggtaacggccgagtataacgagcaagctagccaactcatgtcagtttcatattaggaggtgcgaacatgtcagatacgatattgattcggcatgaggctccaaagggtttccaattcattagcgaagaagaatacgagaggttccaagcctggcagcaagcacagcgtggtattcgtacttggaagcttaaagatttggccaagtataaatacggaactaaatcaaccgaacgagcctcacgatatttaaccaagcatcgccatgatttggatattgaacagggtggcttcattgattatgtgaatacccataacggctggcagattccagcagctgagatgatggattacttattagatcatcccgattaatttaaattataggtgaattacgtggaaaggcgatataaagccatttccaaaatacagaggtgtaggtatgaagaacaagtttgcagagcaattgtcattggcattaggtagagataaaacacaaacacagcagcagattgcagataggacgcatgtttctcccggacaattgtctcggttgaagagtggatcaagaagcactgattcacaaataaggaagtcgttagcaaatgtaattaacgatttttggcttaattattctggtgctcgtgagaatttcggcgtgctgtcattccagaatgatcgtcagctacaaggtgatatgttctcggctttgatgaaacagaaaaaggaacagcgtcagcgagaaagaattgaggctgagtttgaagaagctattacagtcaagccgagagatcggacaccagcgcagcaactagttattgaacgctatccacgtgaatacgcagaagagattagcgccgagataaccgatttggctaagaaggctgagtatgccggtattccaatggataaattgcaggaagtaatcgataaagtcaaccaagaaaatggctaggaggaaatagcaatgattgaaggagcaatagtaggctgcgtgctaacggcattgtggttcaagcgtcatgaggttgctagttggtttggaatttaaggagatgaagacgatgtaatttacattccggattggaaacgtgctttacaaacaaatcacgattgaagaattgaataatctttttgacaaatttaaggaggtcgaacgaattggaagtatcgccaaagcctaaatttgagtacgaaaaaagctgctcgagtattggcagtacccgtgcagctaaaattaaaaatcacagtaaaattttctttttcgatttttattgtactccgaaacagtcgctaaaacaatggttagtcacgttaatacggaggtgggcaaaatgaacggctacgatagctggttaattgaccaagaagaagctgcggaaggctggcgtgatgatgaacctactgaggaagagctgattgaaagtggcgtcattgctggatattaaataggaggatttcaatcatggatgcaatgttaaaagaagaacttagaacggtgacagagcgtgaaaacgaaggattcaaaattgactcattagagaaagccgactgggcattaaagaagctcaaggctatccaagcgcatgatgatgaaattggccaagttgcgaagaacaatattgaccaggcaattgcatggcgcgaccgggagcttgataagaaccaagccaaccgcgagtatttcgaaggactattgactgactatttacgtgatcaacggttagttgacaagaagttcaaaatcgatacccctaatggccgtgtatcaactcgtaagaacccggctgggttagcgtatgacgaaaagatggttttaaactcacttcataatcagggcatgagccaatatatcaaggtcaaggaatctattgataaagtcgatttaaaaaaagctggtcgcatggttggtgacaagtttgtcatggaagatggcgagattatcgctggtattactgaaaaaccggcaactgagaaggtcacgtttaaatactaggaggaaccgatatgagtgaagcaatcgcgaaagcagaaaatcaaacgaatagtctatccctaatcatgggtactgatcaaaacaagatggctagcgaactacaggctatctctaatttccaaactatggttcaaaaacagctaaagaatggtcaagactttggggttgtccctggcacacagaagccgacattattgaagcccggagctgagaaaattcaaatgttgatgggtgtaaccagtgaatataacgtcattgataaggttgaaaactacaaggatggttatttcgactacaccgtcaagtgcgtgctgtacaagagcggtatgcagttaactgagggattagggtcggcaaacacaaaagagagcaagtacgtttctcgtgatggattttcaatgaaaaacacggtattgaaaatggcgaaaaagcgggcccaggttgatgccacactgactatcgctagtttatcaaatgtcttcacacaagatgtcgaagatatgcagaactttaaccaacgtgagaataacgaaaccatgacttatgatgaagcctttaatttgaaacttaattttggcaaaaacaaaggcaagagcatgggagatgtcatgaatgagaatcgtggctatattgaatggctagctgagaatgcacagaaacctgaatttaagactgctgctaaattactactagctggcaagcaacagcctgaaactgacgataaagcacatgaagattttgatcctactaacatcattgctagttcaaaacagacgagtgagattgctaaccttgctggtgaactggccactcaaaccaagaatggcacaccattatcagtgactaatgaggttattcaacaaattgtccctgattggaaagggactgacgatgattggaagaacctaacaatagcacaagcagaggatgctaagagtcagctacaagggttgctagcggcatttgataagaaataaacattcgaattggcttgaatgcagcagtgactgaatccaccaaatgggtgaaaggcccattaataatggataggaggtgcgagatggcccgtccagtaaaagagggattggattacttcccattagacgttgattttgctgtaaacgacaagacagaagccattatgggcgagtttggaccgaaaggtgttctatttatgatttatctgctgtctgcggtgtaccaaaatggatactacttgcagtggaataaattgaaacagatgcagttagctaatcgaattgaaggcgtatcacctgaattagctaatcaaatcgttaaccgcttgattgcttatggaacctttagcgaggaactgttcaattcggctaaggtattaacgagccagcgtatccaagagacctatgaagatgctactaaacgtcgcaaatcacagaaaccaactaagtattggattgatgttgacatcaataaagatacaagtgtagttaatgtcgacattaatccacaaagtaaagtaaataaaagtaaatcaaataaaagtaaagtaaataattatgatgatgacgcgggtgtcacacgcgagcaggtcattaacgactggaccaacctgtggggatttccaaatggtattgcccgacctgagattgatgaatggctggaagagttcaagcctgaggtgattgcctatgcaatttgggttgctggagaacatcagattagatctaatgcatgtttgaaatacgttcgtgcaattgttgcgggctggaagaaacgaaatattacgacgttagagcaggctaaaaaggctgctgctaatcatgacgaccgcattaagagcgaaagaaaacctagtggctattcaaagccacgccgtaaagaagttacgccaaagtggatgcaaaaaggcgcttctcaggcggattctaagtcaagctcaagcgatgaccagcaggacgatatgagcgacgaggcgttcctagcgttcatgaacagtcaggaggaagctaaatgaattggggtaatcaattagtcaagttagccgctaaccatgcctatgaaccggccgcattgcactggactaagcagcgcatgaaacggcatttaaaggctggcggtagcgcgcaagatgaagtgtgcgctcatgagtacaagctatttgcactcgaagttttaattattgaatatcagcgggatgacttaaattttgatttgacccaatgttggggtaaaccagccgagtattttattgatctagagcaagctagacaaggattgcaaacggaggtgagcgcatgactgaaa

SEQ ID NO: 49 - DNA, 17797 bp, Lactobacillus plantarum
ttttcagacagtccctagtattaactctcattatcaaatggtgcctaactatctggtctcgaattatccttcaattcaaacttaactttatcccccacgagtttgacaaatagttcctggtcaggctgaggatcaaatggccccaagtcgacaagaatctgaccattatccgccacttcatatccttggtaacgatcggcaagcagatgatagattgtttgggctggtcgcatccgctcatccacctgagcggccgccgccttcaaggtataaccagtctgcaataaattactcatcgcggctgccttgataaccattttcattgtatacacgcgagcctggcccggctcatcctcgttcttaggaataatgtacccctttttttgccaataccgtagttgtcgtggcgagacaccagtcattctgcttagttcactaatgccaatagttaattgtcctttatgaaaaagctcacgtaaatctgcacgcgtcccgttagtcatactggcgactcctttccaaagttgctattgatataaattatagcatggaatttcgtcgcgaccattaactcgcttggaattttccgtgattaattaacttttctgataatttgtttgtaagtaatccagcaatgactgggcgggacgatccataatcagctgataatcatcacttactgtggctaatagtccgcgggcgccaccggcatacatcgaggccaacattggcccctcaccattctgattgtacatatcgctgaaggcttgcaaggacactggtcgatacccgattggttgcccgctcacctgactaagcacagtagcgagttccggcatcgtgtaagctcgggactgtgttaacgtatagattcgaccacgttgtaataaatcaggcgttgtggcgactttagcaaaagcggccgcactatctgcctgactgatgaagctgagagcctgatcagccattggataaacgacgttgtgccgttcaattaattctggcaaatatggcactaacggatccgcgtaaagcgcattccggacaatcgtatagttaatatcacttccagctaatcgccggggcacgtaaccataaaatgctgataatgcaaatggattattcacctgatcggcaatgaaacccatgactaggaaatgatgcacattcgcctgttggactgctgctaagacgttctcaaattcttggacccgcgaataactatcatgactcttactaggaatatagatcaggacatcactgtcttggaaaaatgcgcgtaactgctctggctgctggtaatcaatagccgcaacatgcaaaccttgttgttggtatacctgggccttactgagtgtatggacccctaaatataattcagtggtggcgactaacggtctcatcgcggcaacaatctgttgtcctaaatgaccagtggcacctgtaatcgcatatttcaatttaactcgccctttcatgtaactttattagttacatttaactaaatatcgatatatttgtcaaataaagcggccgcttatgatattaacgtcacccattgccgccattaattcggaaacatttcgtcgctacatcgttaaaattaaatacacagaaagggctaccctcattacaagagcagccctaagaaatgcttttctaaaaatagttaagccctaatttgcaacctgttgaccaaggtgcttcttttcaggcgccttcttaacgtttttgacatcattatcggaaaagccaaacatccacgttaacgtaaaggcgacaatcaagtcgatagcagaggcaatcaagaaaccgtagaaactaaaatcaagccccttaggattgatgaaggaggtcacaccgatcaatgatccggcgaagccccacatgttaacgttaaacagtccggtcaagaaaccgccgacagcaccaccgatacttgcagtaataaatgcccggccgtatttcagattgatcccgtacattgcaggttcagtgaccccacagaaggctgagatcgttgctggccaagcgagctctttaatattagcaaacttagacttcagcgcaattgctaagaccgcgccaccttgggcaaccatcgttgcagaaacaatggcattcaagtaactgtgcccagttgtcgtaatatcgttgacaacaattggaataatcgcccagtgtaacccgaagataactaatacttggtagaagccaccgataattaagccagagatggctggactgagtttgtaaatcgccacaattcctgcagccaatgcgccagacaaggctgtaatgattggcccgaggatgataatgatggctccagaaataatcacaacttcaaacaacggtacgaagatcatccgtaagactgttgggatgacccgcttgagccatggttccaacttacttgctaaccacgcccccgcaatcatcgggaaaatcgagtaggtataggaggcaacgtgaaccggaatgccaaagaagttcgcattgattgccattcccaataagtgacccgtaacctttccggttgttgccatactaacaattgctgggtatgttaagaccccaccaataattcccatgataaccggatcagcccctaacttcttggctgcggtgaaaccaacaaatatcggtaagaagtagaagacggaatcacccatcgcattaataatcacgtaggtcggcgttgtcgcagagacgaggttgaagttctttagtaacgacaaaatcccctttaagatcccagaagctgccaacaacccaatcactggaatcatggatcccgtaataataccaatcaagctgctaaaaccgtatttgaccttctgccacggcgtcattttctgccacgctacccggttcgcttccttctccattgcaacagccgaagcgtcagcatccccaaagcctgcgcctagttgacccacgattgcatcatacacgtcggtcaccgctggcccaatcaccacctggtactgaccacctgcctttgcaacatcgataacgccctttaggtttcggattacctcgtcattggcctgcccttcgtcctttaagtaaaatcgaacccgggtaatgcagtgaatcacgcttttcacatttaccggtccaccaacttgagcaatgatttgagtcgccaattcatcgtacttgccgcccttacccttaaccaccgatgcttcggcaacgtgttctttcaattcaacaacagcaccgacgaccccggcacggacttcacccagttcgggcgttagtttggtaaccatatccgccgtattcgttacggccatgattaccgtggtatccttgttcgcactagtaatcgccgctaaatccatcacggccactttttcgccggcctcgaccgtatcaccaacttgcacgttaactttaaacggtggccgatctgctagttcgaccgtatcgataccaagatgaaccaacacttccagaccattgttccccgtaaagccaatcgcgtgcagactcgctgcaaccatcgttactttaccactgattggtgcaacgacctgtccatctgtcggttcaataccaaatccttgccccatcatcccttgtgaaaacaccggatcgtgaaccgattcgagtggcactaactgtcctgcaactggcgttaataaatgcacttgcttcatagcgattctccccctttgactaatcaataatcgcgttgttaacaaactaatttcggacactggttgttataaaatcactaataattgccaatccatccagtgaccaactgtcaggccctcctaactaatcaagtaacgcccttaataataaaagcgctttcttttataaacataataatagccgcccctattaagtcggtcaataaaacccgattaaattaaggcggttcacttgaatttaggaacttatttaattagtttgccaaactttgtgaagcaagtgttaatctttgcgttgcaagaaaggaccgttcgaaatcagccgtcgttttgacctgtttaccgaaatcaacaatcagtgcgtgccactcccaagccgtcgttaaatcataatgccacgcctgcataatcagttgttgggcctttaagtagttgctcggtaacggttggttaagccagccgaataggcgccgcaaatacgtgtcaataatgatcgttggctgatgaaaaacgtacatgctaaagtagtcagccgtttcatcgccaataccgcgcagggcgattagttcacgccgcaattgttctgctggcaaggctcgcatcacggtcaagtcaaaatcatactgtccacaccacgctgctaaggcttttaaagttggaactttgcgcgtatagaagcccgcaggtttgactaaagtcgtcagttcagtatcagtcaatgctagtaactgccgaggctcaaagtcagtggctgcttttaaattagccagtgcgtaatccacgttgcgccagttggtattctgaacgagaataccgccccagagaatctcccaaggcgtctcggcaggtgggattccggcttggagccagtgccggggccccatggcagctaacatctgctgatacagtgtctcaatggtcattgttagccctcctcacatgaattgattaatgttgagaccaataatttgatcttacaaaaaaatagtcgtaacggcaaaacatcaatccgctacaactattgtttacgcttgtttattagtcatctaccaccgtactgcgcttaacagctagcacaatgtcagccttccgattttcaggcttgatcttttcttcaaagtccaattcggcatccttaaacaggttctgaatctcagtattaactaacgacaagtcgcgtgaatccccagcttgttggcgaatatagaccacatattgatctggtaattcttcaagatcatattccacatcttcgtcattcaaaataacataaatcaacttacgttctttgttcatttgaaacttccccttatcaattattttatccgaattagtcgtttgcggctaactggtgagcaaacttaaggtagtcagccacacaatggtctaaccactcaacgaccttattgtccgtaaggtcccaatcggcattcatcttgtcctgcaccgcgctcaacaagaattcatttccaggcagaatctgcatcccaactccgggtgaatctaaaacttgccgtaaatgactctgcgctcgcactgtccccaagggtcccattgtggcccctaaaatcatagctggtttcccaattaacggtcgttcaacacgcgatagccaatcaatcgcattttccaagacacctggaacactatggttatattccggtgtcacaaaaatgacgccatccgcgtccatgaccgtctgcttaaaggcttgcacctccgcgggggcttctagctcgatatcctgatcataaaaagtcaacgcgcccaagttaggaatcgtgacatccagttgatcggcataccgtttctaaacaaacgttgctaacttacgattatatgaggaacgtcgaatgctaccgacgagtgcgataatcttcatcgtgtgaaaaactcctttaagttgtaattacttttagtataccccttttttggcaaatagtcggaaccggttacaaaaaaccagctgctttcatcaaaattttaatcttaactgctgaatattcagtcagtttagcaattccagtccccatccgcgtaactgccattatcttaagtctaattttaaacgaggtgagacattcattagcgggcctgattattgcttgctcatcgaaataactaccagacataataatcgaggcagtgctttatcgccatcacaggattaataaactttcacaaatgtttcttaacttttttcaaaaccaaacgtccattgttagtgtgatgaatagagtctgctatactattgattagagaaattgattggggggttaatcgtgtattatcgtggtgaagcacttgactttttgaatatgctacatactacaggtgccgcgccattaatgcgttcgcgaatcgttttttccagtcagatcgacgtggaacgcttaaaggctgccgtgctcgcttccgcacaaatcgtacccgagattttcggtcattatcaagctgaccgtaatcgtttcgttgttactgatcaaccagtcaaccaagttattcaggaagttcaaagcccgtatagtcctgaaaacactgattttgattttacgaatagtccgcaactacggttatttgtcattcatcacggtgactacgatgtcttacaagcctttatgagccacctactaacggacaatcgtgggtttaaagaatatctgtacctgctcgcacaagcctacaattatgccgatctcacgaatttgcataatgaacggcgactacgcccagttatcactaagttgcaacgtcaatttgcacggccacacggtcatgcacccattgttaccggtatggttaaactaccccattatccgggaattaacttgcggcacggtggtcacgtaatgctcagtagcacgcaattcatgcgcgtccgacgaatggctaaggcccaagacgtcggtattagcgaggccattttggcggcatacgctaaagcactccaagttttaactggtcatacaaccgtgacattgccgtgcccaatcgacctgcgccgcttcacgactgaagatgcgaacgtcacccaaatcgctaatttaaccgtcaatgtttttctgacaatcaaggtagatattgatgcaccttttagtgagctcgtcaatcaagtccacgacttgttaacggtcgagcgtacgcgggtcgccttcctttatcgacttagcaatttacagaaaatgaaccatacaatgccaatcacggtcatgcgtaaaatgaccaaacgctggttaccacagcctgcgctccggtataccaactttggtgtcgtcgaccaggaacggcttaaatttcatgacttgacggtcgtcaattgcgtcttctcgggtgccttccagtgctcacccgttatggaaattgccgccagcacgtttgccggaacctgtacattgagcttcaatagcaccgggtccgaacgtgactaccagttatccatgaaaatcctggaaaacattcaagctcaactgctagtatgggcacaagcagatgctcaagtagccacaactgataatgtgacgttgcgccaccaagcataattaagtcaattgataggccttaaataccggccacaaaaaatcccaagctaaatgagcttgggattttttatggccgccgttaatctggctatcagtgtgattatggattatttagaatcatccagctaatgacgactagtcatccggccgaatcgtttccgagtaatgacttaactggtatatcggtgcccgtcgtgccaatattgctggtgctttgtgaattttcactaggcaaccagtttgcccacttggggtcagtcgaacatcataattttgaaaactagggcgtattggcgtagtcactgtcagtggtccagtaacgcgctgtaagccaatctgaatatttgctaggtgttggaaagggctcccaactaaattacttaaaaagccatcatataggcgccatagtgccccggcggacggcacccagactggttgtccagcggatgcttgtaattggaatcgtaacgtcacgcactgccgggtcacggtcaactgaatcggtcgaaccttcaaccgagtagtagcggcttttaggactgcaacttgggccaacgcttggggaacatcatagctcgccgcaaatactgggaactgattagtgggtacctgtcgtcctttttccgtagtcgtaagttgccggataactttcatcattgcttcaaggccaagtacatatgcgcgttcgtattggacccgctcaaccggtaatgctggtacaattaattgtgtcattttgccacccccatcaacacgcacttaattatcgttagtttactcacgtcttcagccccagtaaagccttttcagctatttcgttaattaattttgtcaaaagttttatctagtaatgtttctaaattggaatccttctaaaaagtgtggtttaataagggtgaatatgataaaaggaggaaccgcgtcgtggcagaagatatgttgacccaagccttgcagcaattaaaggaccataaaatccgtgtaacgccgcaacggcaaatcattcttaattatttgattactcaccataatcatccatccgtcgaaaccatctatcaggaattagcaactcaattacctaacctgagcttggcaacggtttacaatacgttaaaactttttatcgacttaggaatcgtaattgaattacaaaatggcgatgctggcacccactatgactttttcggtcgaccacattatcacgtcgtttgtgagaattgtggtaaaattactgacgttttcgaacccgacctccgcagtgtcgaagccaaggcggcggaactctctgggtacttggttacgggtcacaatatggaagtctatggattatgcccagactgccagaaactactcaatgtaactaaaacagctgatttaaagcgattgaaattgacgcacagtgaatagaaccagttcaatggcaaccggctatttagcgcgctggttatcctaaaacaaaaggaacactttcagttttcctgtattagtccctgtcaaccttaagtggactatcacagcctgaggtgttccttttaatttatacgataagctggtcttacttacgctttaatcagcatcacaatcggaggacgctttcggaataccaatcagcaattacacgaccggtagccctcaaccccctggccggtattaatgttgtgggacttcttccagcatgccatagaactgtgacttgtcagagaaatcagccatataggccccgttcaatccggccttttgcccgattattcctaagtcgatcattagcttttcttcttcatctggaaagtgtaaccgtcccttaatggctacactacgaatatagtttactaggcgattgactaaggcttctgggttcttagtcgtagtaatttttttatcgacctgcattaatacatcaataatatccaataagtcccccgactgatcagaccacccacttaaccggacgattagtcccttaatagcctcttgagcttgttgtcgtaattctgattctcgctgcattaataaagtccccctctatatgattcggattaccataataatttcaaattataggtatctttatatacacttttattatacacgcttatgattgcattcaaaaaaccattcataaacgttcaaaaaacgcccatcaacgtaaaaaagtccgagctttcacccgaacttaaccccactttaatttactaattaccctaacgttcctgtccaaacgcaaaatagagccacggtccaaatggttgtacaaaggctaataacaaccagccaagtcgatgtcctcggcgaaatgacttcgccgtcaagacatccgcaaccacaattgtggttgcggtaatctccatggcggcaacgggtaacaaccgttgctttaatttacgtttgatccgtggtggcatttgattgtgatgacgaaatagtcccatattgacgcctcccttaattattaccaacattataccttgttaattaagaaagcgctatcttgattcatacccttgtggggctcgcccgacaaacttagtgtctgggatcgtcaattcatcaataaccgctttcccatgcagtaactggcgcgttgtcacaccgacctgtcctcgatcgattgtaatgatttggtaactactgccctcatgaacataatgatgatgtggatcatggcaatcgatcgcataggccgcagaaccggccaccacattcagaatattatctccaatcaaataacttgaaacaaagtgaacgtgaccagagaatacgccgcctaaattatgtccccgaagcaccgataacagcgccggcgtattttgtaaaatcgcatagtgcatatttgtcatcgtcggcccatctagggggtgatgcaaaaatagaaaagcccgctttgtcggtgcctgtcgtagatgttttcccaaccattgtagctgttatggtgccaaccagcctgcctcataaccgctaacctttgaatccaaaaaataaaagtcgttgttgccaatccgcatgcgactcgcgtagtatggtcccgggtcagccggcaaatacccctcgtaaaacgccgctcgccgatcatggtttccaaggataactcgaacatgacaatcaaattcagcttccatcgtatggatgattgcgtgcagccgctgataatcgtcagcgctaccgtcatgaatcaagtccccggtaaaaacaatcaaatctggcatggttggtaatcgccgaatatcatcaataatattggcaagcttgccccagggatcgtactgctgaccatgtgccggtacttggccgcggggggttaaatgtagatcagaaatctgaataacttgtaaaggacgcaattcgatcctccctctcatactttaatcaccagatggttatctctaatatagcgagctaacgtaaagttttaccaatcttcatataaagtaactgtaaagtttgtgctaacctctctttacgcaccattgaaaggtgcccccacagcaacacctttcaccaatagttcagccatcacccgtattgccctcattatactgaaaccacattatcggcagcacgtgcccaatggttttactgtaagtcttcagtatatccgcatcttatttcaccgtcccccaaagctagttgttcttgacatcagcacttggcacatgccacccgtgtttcatactgagctagctagtctgacgcgtaatctcataatttttggttgacaagcccaccttttgccgccaccatgaagataagctttaataacatcatacgagtgagggattattttgaaaaatatgtttgtcgggccccatgtggcccttgctgttccccagccagaagattttgatgagatcagtgactggtacactgacgccgattttgttcgtaaaatggatacggctgccgcccgaccactgaccggtgaagaactcgaacgaacttaccgtaaccttgatcggaataccgaatactactttcacgttcatagtttagaagacgaccacttattaggctttgtcaccctattcaatatcgaatggcataaccaggttgcccaattagccatcgcaatcggtgatcccgacgaacgcggccatggttatggtaccgagacactcagcttgattttgaactacgcttttaacgaattgaatctttacaaagtctgtttggacgtcatcgcaacaaaccccgccgctatcgctgtttaccagaatagtggttttgaatttgagggcaccaataagcgtgctatcaagcgtgatgggcaacgaatcgacctctatcacatgggcttatttgcagctgatttccagccccgcgttactttaaactaattaatcagctcaattagttgcagccaataacttttgcaattataatagtcgcagattgatagaaagtgaccaactgactgtcaatccttaatattctttagttttttcgattattagtgcgttgctgccataatgcagctaataatcactttcattcatagactcccccaagtctgatgaatggggttcatcaaagcccccactttgatgtttcctactccttgaccactacatccgttgatgtggtggcttttttattgccgtctaaaaaagccgtcatgggtatgcaatccccacaacggcctgctattatcttgtaatagccaaaacaagcggttcaacaactgcctgtttcgattagatccaactggtacccaatctactcacgagtaaattatgtgccaccaagatttaatcttcttccaactcaacattgctgttcgttcgacgagcaatgaaccattccttgacttgaattaaaacccacgcgattcccgctgtaaaaagcaacaacattagtgtcgaaacaataatgacgatcacaatctgaacgccttctgcctttaacacgtctaacttagttactaacgcgatccctgatggaatgaaaatcaagctgataaattggacgaaaaagttgctaacacccgccacctgctcaagtttgaccactttaaacgttaacagcaagtatagtagaatcatcccaatcaacggtgtcggcattgggaatgcgggccaaatcttattgactaaattagcaattaaactactagccaataaaatcaaaccataaatcacaatttgtgtaataaacgcgccttttttcatcgaatccctcccggaccatctaacctaaaccaatcaactgcgcaaaccctggaaccataaaattaacaagaataccggcaatcacaaaggcgattgcaccagttgcgcccgcagcctcgctcacttcaatcgctttagtggcaccaaccgcattaccggcaattccgaatcctaacccggcaccgagcggattcttgtgcaatttgaaccagcgaataaaatggtcgcctaacgcgtaaatcaaaactgaattcagaatgactgcgaacgccgcaatggcttgatcgccacccaccgactcagccaccggtaaagcaattgctgtcgttgctgcttgtactaacatggcacctaacgctgcatccgtcagaccgagcaaccgtgaaatcccatagataccaaataatgacagccctaacccaatcgctaacgcaatcacaatgacatcccaatgtttcttaaagatatcattacgcttatatagtggcaccgcaaacgagacggtggcgggcgccacaaaccagaataaccagtcgccaccaacctggtacgcttcataaactttttgcacgggtgcctttagaatcgacgcaatcaataccaataaaccaatcccaagcagcattccaaaaaataacggttggaataacacaaagcgatttgttttgtgatataaatactcgccaatcccatacaccaagatcgacagtccgatcccgaaaaacggattattgagaagatagctcacataagttcctactttcttttagtgaaaagagtgacaaaaaaggtgccccatccgggtctagtcatcattaaatggtggttaggctcagaacagtgcaccaacacggttctcatttatcattaattaattataacacatcaaagtaatttttaatagtaggttagttcgtcaaatttaatcaactgtataaaacatcaacgcgtaagcgccaacaccggtgtgcgtcgcaataattggactagtgcgcgcaaccagtggcgttacttgtggaacgacttgttggagaagcttttctggcgcttccgcaacgctcggttcgccgacgtaagaaattccagccgcttcgactcgagttgcatccgctaattggtctagaatttgttcctgcgctttgattagcgcctttttcccgcgaccccgcgtataaagttttaattttccggcttctaattcaaagacaaattttaatttaatcaaattcgtgaccatgccagccaacttagggacgcgcccacctttgaccaaattgtcgagcgtatccacgaacaagtaggtcttagtatgctgccgaatgacggttatcttcgccaaaattgtggccatatccgcaccggcgtgagccattcgtgctgctgtaagcacttgaaaggccatcccacggtcagccgcctgggtatcaataactgtcacatcgccactagcaagtttggcagcttggcgagcagcattgaccgtcccactcaatgtctccgtcaaatgtagtgataatacttggctaccatccgctgtcaattcatcgtagcaactgacgaaatcaccaattggcggctggctagtcgttggcaagactgggctgactgccatctgttggtcaaattccgcggtactaactgccgtatctgcagtcaagtcgccaccgaaccccacgagtaacggaaccactttaatattatactgtgcaatctcggccgtcgttaattggaccgacgaatcggtgacgattttaattgtcatatttggaaaacacctttcgattaatttgtgcttcattatagcacctcagagtctaggaccaataaaaactgcgtcacaccagcatttagccactcatattgatttatgacggtcatcatttcgttataaactttgtaaaaatcgtcatattttttcgttccatgacctaactttttcgtctgaaaatcatgcttttaaacttttcgcgtcacactttcttcacgcgtcgccgctatactatgtttatagtcattaaggaaatcccaatccttaacgaccccctaactttaatgattacttccccaagtaatgatgtgtgtgtacttaattacattttaccgatttacttcccttttcctccgtatttccccgatacggaggttttttattgccttcaagcagttgtggctcacgcgtgaacaccgtattaaccataatcattgccaatccaatttccaccataaaaaacgcgccaaggcgagaaacaaacttctcaaccttaccgcgtatcgtggtcctaatacttatttcatcttatcgagatcttctggtgcaataaaaaaactgacctgtcccgtttctaaatcaacgtgcgccttcacttcaacacctttaggaaaaatccagcctttcccagtatctaactttaacggcatttccccatacgttttggttcgatacgtcttttccatcagaaaactccttcgctctttgccaattacgattaactgggctaattatataatctgacgtcgtttctcgatagtaaagacactttccaatggctttcttcagtaggaatgtcacgctaaatctgatagaatcggattaacattaaaccacttaggaggagtcgaccttgttctattcgttttttgatccgacttacctattagtcatcattggactgatcatctcaatggccgcatcgggttacgttaatcggacattccggcattatgatgcctatcgtagtcaatctggcacaaccggcaccgatgcagctcgctttattttaagccaatctggtatcaatgatgttggtgtccaaaagataagcggggatctgaccgacaattacaacggtcaaactaagattctcagcctatcagaagccacagcagattcaacctctgtggccgccatcggagttgcggcccacgaatgcggacacgcagttcaagatcacgttaactattggccaatgcgcttgcggaccgccctcgtgcccatcacgaacatcggttcaagcttatcattaccactaatcattatcggcgttttattgagttacaaccaaacactgattcacattgggattttactcttctcactggcgttattgttccaacttgtcacacttccagttgaattcaacgcctcaagacgcgccctccagattttatctgatgagcaagttttgactcgcgacgaagttcccatggtgcgtaaagtgcttgtcgcggcggctttaacctatgttgctgcagccctgtcaacattcttacaattactacgactaattattctatttggtggtaatcgtgacgataactaatcgtgccaaatggcagtgcccacagccagtcaccaaaatctgcttggtcactatcaacttagcgtcgccgcaaacttgttattactagcattgattgcgaatcaaaatagtcacttcaaaggacaacttttgaagtgactattttctttggccccaaacagccgatcatcgcacctcgccaaggcattccgtaagaacgttgatgattcttcacacttcttaataaagcctttccctttttttcatgacattcgccatgttcagtcacaaattcttcacacaacctcggtatgattacatcatagcaattgaggttaactcaatcagctataacacaacctaaaatttttcatttactcctccaaagtaatgaaattcatagtaacatgtgattccccgtcacatgtttaccctactcctttttccaccgtattccccgatacggtggtttttttgtttttctcgtccgctctattcgcacctaccgactactttaatacgtcatagtaatcatatttgttgtactttttacattattaaaccaaaatataactaatgattaaccatgctttttagttattcatctgttaagggggagatttactgatgaagcaagtatcgattattggcgctggtattggtggcttaaccgctgcagtacggcttcaaaaattaggttataatgttacgatttatgagcaaaacgcgcaaccgggtggcaaaatgaaccagattgttagccaaggatttacatttgacgtggggccgacgatcgtcatgatgaaagacatctacgaagaagtctttcgcttttgcggggtcgatccgcacaactatttaccattcgaagaagttcaacctttgatgcaccttgtctttggtgatcaatctagtctagatttgtcacgcgatctcccaacattaattgccgagattaaccgcattgcgcctgatgacgtcaatggtatgttaaattttttagcggatatttatcaccggtataccatcgcgaagcctaattttttagaacgatcatttcgtaactggcgtgacttttataacctacccgctctgtatgcaggactacagttacgcacctttaacaatgcctacaaaaacattgcaaaatttatcaagaatgaaaatctacgtaattcattagcctttcagacactgtatattgggatttctccctaccagggcccgtcgctatacaacattattccgatgattgagctcttctacggggtctattttttaaagggtggtatgtacacagttgtcaatagtctcgttaagttattcaaagaacagggtggtacgttaaagcttgccacaccagttcaagaaattatcatcaaagataaagttgctgttggcattcgtgtcaataatcatccgatccacagtgactatgtcctatgtaatgctgattttccaaccgccatgacgacactgattccaaatgagcaaaatcgtggtcagtacacagatcaaaaaattgccaaaatggattattcatgctcatgtctcgtcttgtatttaggactagacaaaaaatacccaaccgaagcattacacacgatccactttgcacaagatttcagcaaaaacgtcgccgatctatttgacaacggcaagttaccagaagatccctcgtattatgtctatgttccatcaaagatggatccaagtttagctcccgaaaacagtgaggcactctatgttttagtaccagttcctgagctctcaaagtttaatgactggtcaccaacaacattgaagaactatcgtcaactaatcattaacaaactaagacaaacggctaccttcagcgatattgaacagcatatcgttgtcgaaaagcagtttacaccggttgacttcaaagaacagtttggcgcctataacggagccactttcggcttacgaccgacgttaaaacaaagtaattattatcgtccccataacaagttcgactatgccgaccatctttatttttgtggtagtagcacccaccctggggccggtgttcccattgttatgcaaagtgctaaattagccgttgaggagttgattaaagatcgcgcgttttataatcaagt

SEQ ID NO: 50 - DNA, 17389 bp, Lactobacillus plantarum
aaatttgcaatctaccatttaaacaaacatattttgcattaaatatttcttcaactttttgagttgatttagtttatctttattggcagcgataaggctgtctattttaaatatggataatcctactttagactgttcgtcaataattggaaccagcaaagaagcattggctaattttgaactgctaatcgcaggatagctagttccagtggataaagcaagtattcgattaacaaacggcgtagtctgtaatgcataaaatagatatcttatatcttgcttggttctaatttgtgtataccctgttgaaaaaacaacgttatttttgtttgtcaaaaaaagcaagttatttttttgatatggtcttacattttggaaaaaaatatcgcctttttttgctaatcgttgtgccctagatggcgcatcatcttttgtcactgctttatactgtgtgactctattttgacttactgattccaaatccacataaagaaaatgcggagaaataactgacttcggattaatggtcgcaatctgacaaagcttacgctgctcccatgggtcagtgaatcccttgaagcgccattcctgagaaaaaatcttttgcatcatcaactttttgagagtttttaactgttctagtttatcctcattggcagcgataaggttatctgtttttctaaaaaacttagctattttcatttgttcagttgcaattggtacttgtaaattaatattgaaaaacgcatcaaaactaatgtttaacaatccatccattcttgcaccagatgaaactaattttctcaattcacgatttggacttcctgttgcaaacaaatactcaatgaaatctgccgaattattatgtttaactgtaaagctatgataaacacgtggaactaatgcttctgtatagatatcaagcttgaataccgcaccatactttgcagttttagaatttccatgattatatgacaattgtcccttttttaataaagtatagtttttttgttcttttccagcgatattttcagaaaatcgatctttctgattcagccatccttgtgtagccgaaattgtgagagttggtaattccattcttccgtcatttccccgaactcttatggcgatattctttagcttacgctgctcccaagggtcactaaagcccttaaaccgcacttttggcactaaattttcgtttttcattgtaacatcctcttaatggcctcaagctgctgttgagcgacagggtcagtcgccactaagtcggccatcattccggataattcagattgtaggtcgttgattttggcatccgcttcgcccatttccttaaccaacttatccacatcttcacgtttttcaagggtttccaaaatcttatcgacattttcgtccgttaggttgttttggttcttacccttttcaaaatcattagacgcgtcaataaagaagatatcctgacgttcgcgacctttcttgaagaccaatacaacggtcggaatactagttccgtagaataagttcgctggtaatccgatgacggcatctaagacgttgtcatgttcaatcatgtactgtcggatctttccttccgcagcaccgcggaataagacaccatgtggtaatacaactgccatcgtgccttcattatttaagtgatagagcatgtgctcaacaaacgcaaaatccgccttcgacttcggtgccgtcttcccatatttccgaaaacgttcatcatctaatttatcatctggattccacttagccgaataaggtggattggcaacgacagcgtcaaaagttagatcatcaaagtgatcttcctctaaagtatcgccttgacgtaaatcaaaccgattataactaacctcatgcatcaacaagttcatccgcgccaagttgtaagtcgtaccgttgatttcttgaccatagtagtttccaatcgttgcgtaattacccaattgtaataacagcgacccggagcccatcgtaggatcataaaccgtcttcaaacgatctttaccggctgtaacaattcttgccaataacttagaaacttgttgtggcgtataaaattcgcctgcctttttcccagccgaagcggcaaattgaccgatcaaatattcgtaggcatcacccaaaatatcaattttaatatcttgttcaccaaaatcaatattcgacaaggatagaatcactttggcaatcagttcactacgcttggcaactgtatttcctaaccgtgatgactgcaaatccaagtcttcgaatagccctttaaagtcattttctgactctttgcctaaggtcgaattctggacttcgttgatggcattttgtaacatttcaacgtcaaaatcgccagcgttaatcttcttgaccatagttgtaaacagatatcgtggttcaatgaagaaacctaagacgtcaatcacttcatccttcaaatcttgcatcaggtcagcatcttgttccgcatctgcaaagtcaacatcatcgtcttgaagtaactcatttgcgtaattttcaactttttcagacaaaaagcgataaaagattaatcctaagatatagtttcgatactcactggcatccatgttaccgcgcagatcatttgccacagcccataatcttttttgtagttcagcctgttgttcggcctgttcaatatgactcattaaattcattctcctagcttagtgaatactttcggtcgatagtcgatacaaaatccttaatctcgcgtttggcctgccgtttctctcgaaagccgagcccattagcacttaacttgtcaataatctctttgtccttggtcttaccgtagaagttgtagtcagaaatctgctcgttaacgaagtcttccgaaaggtggtgttcttgtgaaaagcccttaatggcagctcgctggctctcggccataaagttactcaacgacatgccgatatcatcgtctgtatcgagcgttggcaaaacttcattcaaaaattgttccaacaattcaaccttcgactttaattggtcattggtcgcattatccaacaaatgttcaattttctgaatatcttgcttacgttcggtcgacgacattaagtcaatgcctgagattaagttcacaatatagtcaacattgatggtatcagtctccaatagactgatatcaaagtcaacgtcatctaatattgagacgcgctcctgcgttttacgttggtaaatcgtttgataagccgtaaaatatttgccccgaaaggcttccatcagctgatccgaaaattcaggttcatattgcgcccattcaaaatcatcatacacgcgaatacgattatatacccggaggaccgcccgaaacgccatcacaaactcatatagtgcgtcatcgcctcggttatagaggtcgtccactgactggacatctggagtcaccgtcagtaattggccaatcttgtcagtaaattcagcttttaattcatcataatctggtgctaagaagccggaactgtccccgtctgaaaacaacgctacagcctcatccgtcttatttttgatatttcgataagcaataatatttccgaatggtttttgtttgccctcaacacgattggttcgagaaaatgcttggattaaaccgtgccattgcaaatttttatccacgtatagtgtggacaaccgtttggagtcaaacccggttaggaacatgttcacaacaatcaaaatatcaatattatccgtcggcgtttggtcattatgatcgcgcatccgcttagaaacatccgcaaaataatctttgaatttatccgttgaaaaatccgtaccgtacatttgattatagtccttcacgacttgatctaatcccatccgtgaagtgacatcatcctgtttttggtgttcctcgttgtcgtcctcattggcagcccacgtaaagattgtcgtgaccttcaaattatgatcaggatccaactttctaaacaactgatagtactttaaagccatgcgcgtattcgctaccgtaaagattgcattgtaatgcttattctttgtaatgtggctatggttcaacaggatatgctcaacaatcttggtcaatcgctcctcggactcatagacctcttgcgtatcaattcctggtacttgttcgtctgtaatgtcatgatcagtctcctcaaaggtcgacagatactgaatcgaaaaaccaagcacgttaccatcacgaactgcatcacgaatcaagtattgatgcaactgattctcgtacagatcttttgtggtccgcccatcgggtcccatattctgttgaaaaatcggggttccagtgaacccaaagtgttgggcattcttaaaccaatgattcacgttttttcgcatttcgcccatctggctacgatggctttcatcttcaatgaagatcactttgcggtcatggtacggtgtcagaatatctttataccgatcattagagaccgcattattcatcttctgaatggtcgtcacgattaagccattatcattagaggacagctgcttgactaatgcagcagtattgtcagtccgatccaagggactctggcccccagttgtttcaggcagataggcactaaaattctttaccgtctgaatatccaagtcggcacggtcaatcatgaagataaccttttcagcatcagtttcttgtaataacaactgactggccttaaaggaggtaatcgtcttaccggaacccgtcgtgtgccacacataaccattttcatgggggtgatcgatagcttgcttaataattgcctcagtggcatatatttgataaggccgcattaataacattttatggtcactactatcgaacaccgtatattttgcgattaaactatgtaaccgtggtttactcaagaaagtggtcgtaaaagcgtccaagtcattcaaccaattattatgttcatccgtccagtagaacatgaagtttgaatttaactcaccatcgccattcgcaaaataccgcgtttcattgccattggaaatgacaaatacctgaaccagtcgcatgagttttgcttgtgcgtacgattcagttcggtagcgaataatttgattaaaagcctgagtaaattcaaccccttgccgcttcaactcaatttgggcaattggcatcccgttgatcaagatcagcacatcatagcggttctcatgacgaccttcaaccgtcatttgatggctaacttcaaaaatattctgatcaaattgttttccattaaaaatttctaggtataagctgctatcatcatcacgtttaatattaattttcccagttggctgaacaaccgaaccacgtaaaatttgggcaacttgataatgcgtcttagcgccaatcaaatcatttaatacggcctgaaattcacggtcactcagtggtgttccctttaaacgttcttgattacgttcactcaagaccgcacgaaaatgtgtgtttagcgtttcaacatcgggaatttcaacgtaatgatagccaatgctttgtaactttcgaatgaggtgattttctaattctgcctcagattgatgtccacttgccatcataggtcctcccatctatacgactattaattagccgtaatactaatcaagtctactctccataattaccaatatcatatcatatttaactgacgctgtaggccagtgttagttatttctatcaattattaaatcattggcaataaattaaacatggtttgattgcaaactaaaaaggtagcccgcgctgaaacgtccagcaccgaactacctttataacgaatattaacttattttacaacttccgcgaccgctgcattcaccgcatcacgttcatcctcaactaaggcaacgcgactggcgattaccttcgtatccatcttaatttcacgcgttaaaccaggcgtattgatttttggttcaaagaacgccttgaattctgctaaacgttcagccgtatggaagacccgtgaaatgacggtgatgtaagtggtaaattccatgtcaccaccaaccgtggcttccaaccatgaccattcgtcgcgaatccaatcccaagctgcttgttcaccagctggattagccaagacgccgcggaaccaggcccgcaagtcttgtggcttaatcgtatccgcatcttcaaacttcacaactaactgtttgattaatttggggtccgtagttgcggtcaatgcgtcacaaatgtcagccttgtaactagcatcagctgtctgccgtgacgccgtcaataaactatcgaataagtccttgctaccaaagttcttgacttcattccgtaaaatgaagacccgcacatcggctggtaaggtcgctaacttatcacggttaccttcgaataattcatgggcagccaatacggccgcactattcttggcgtacaaagccgcactcaaaacgtatggccgcgtcaactgatcatcgttagattcaccagcttgtggcaaccaccctaaccgtttaacctgagcggcactcaattggtcaaataacgtttgtaaatgcttttcttcatcagaatctggcgtaacaaacttacgtaagttacccgcaacttggtacaacgctgcattaacgaccgttgaatggctggctgcaaaccggcttaataatggcacaacggctgcgtatgagatttgacgaccttcagctaacaagcgtaagtcttgtaacaactgtaactggtcaatagccgttaagtcatcaacatgcgctagaatatcatccaataacgtttggtcatacttgacgatgaagtgggagttattcccaacattcaagcggaatggttgcccactcgcatcacgtaatttggcataatcgccgaccgtcacagcttggtccttcataatcgctggtgccgcctcatagttgctattcaacggaatctgccattgacgaccgacttcttcaccttcaccgatgaagaactgttgttgtgacaaggtcaactgaccgtcaacaaccgctgccgtgaccactggatagccaggttgttccagccatgaatgcatgatgtccccaacttgcatcccagaagcatccgctaaggcgttccacaagtcatcacctttggcattaccatatttatgattgataaagtactgcttcaaacctgctcgtaaggcatcatcaccaactaaggcccgcgccattactaacatccgcgcacccttagcgtagacaatcgcaccgtcaaaaatcgagtcgatttcggccggatcttccacctgaacgtggactgactgaaccccatccgtggcatcccgttgaagcgccattgatgcttcggacgtttggaaagtttcccaaatatgccagtctggttctaaggcatccgtcgccacatattccatcatgttggcgaaactttcatttaaccagaggtcatcccaccacttcatcgtaaccaaatcaccgaaccattgatgggcaagttcatgggcaatcaccgtggcgacccgttgtttcgtttcgagggccgtgttgtcaggatctaatagtaagtaggcttcccgataagtaactaagccccagttttccatcgcaccagctgagaagtctggtaaggccaattgccatgagtgtggcaatggatatggcgtctgataaaaatcttcataaaattcgattgagcgcttagcaatgtccaaagcaaagtcgagctcgttagccttgtgggccttagtaccgaaaacaccgatggtcacgccactcttggtcttcgtctgcttgccttgtaattcaccaaaggcaaacgcaatcaagtaagtcgacatccgcaccgtggtttcaaagtaatgcaccccatcggcttcatgatcttcgggcatgttgcttaagattgtttcaccatcatgttcatcgtacttgatggcaagatcaaaagtcgctttagcttctggttcatcgacacacggaaaggcttgccgggccgcggtcgtttcaaactgcgtcccgattagttctttcttcacaccgttgacttcgtaatatgatgggtagatacccatcatcgtgtccgtcaatttggcgctgtacgtaatcgtcaaagttgtttgaccggccttggcaagttcaattcgaattccttgaatcgcatcatccacagtaaagggcacgtccgcaccatcggcttggacaccagcaatggtcaaaccattctgatgaatcagcacttcctgcgccttagcatccccggtaatcgttgacttccccgaaatcagcttatccgcccggttaatattgatataaagatcgtaatgttctggttgaaatgtttcgtaaaaatgagttgtggttgccatattattctcctcgttttttaagaatatattcattatacgacaattgcgggtggaatgcgtcctctgccgcccatgaatttgtcacgcgcctagcaactaattctcgacaacccccatcactaatgatgacacggttccttgcaccgtacgatatcgataatcattagtgtaaacgacgatattacgccgcttgtctaaagtcatcaataatttcttcaaactccgcatccgccaacaccggctgccacttcagcgactgacccaccggctccaacatgatgtagcgacagctatagcggcgttcgaattggaccgtggtcggcaataattcaacatggcgcgtgtcgtcttgaatccaggctgtgggcaaccaactggtcacgcgactagcatcgacacttaactcttgcaactgttcggcaaaccttgtccgcatcagtaacggcgcgtccattggcgaaccggccacgtcaatggcaacttgaaaatggccgacgtatagcgctcccaaatcataaatcaaacgttcatgcttatgtagcgcaattgcaccggtgactggttgccacgtagctgtcgctaaggtagcctgattgatcttggtgaccaccaaataacggcgtggctgaatggtacgggtagttagtggtactgatatatttgcctttgtcagtaatttaggattggcagtaaaacattggtcagtaagcttatgaaacttgtgatcatcttcattactaaaagtaactgtcattttttaaccccatctctatccgtctaagttgctaccgaataccatcttccaaaatctaatcatgaaccagtacgcgacctttcactcgtcagcttaacgttcgtattaagccgcttctggctcccagcgttcaaaagcgccaatcagattctcagtcatctgtaactcgcccatcacgttgactaatgccgactgggcattcataaagagtgtcgagtgcacaaaccgttgagccttggcattctcgatcagtcggcgtacctgtaaccgctgggccgttagcaattcagtttcggcctgacgtaatttttcacgtgccgcctcgtagcgataggccgcaatctcggctaaggcagccgcaatcattgaccgggcgctgccgattttcaaaatcatcgtcatcgtaaggttgagcgtgtgttccgtatttttctgcatgtctacaccttttttctttgtatttcctactctttgaccaatcgtacacacttgtgttgacggtaatcttcatcatcgcgccattcccccaaatgacagcaatcatgatcgacaatcagctttaaaatgtcgtgccgttcacatgaatgcgccggccgttagatgtcttgacaccgttaacttatgtcatagtatagcattatttttagaaaacaattccgactttttcaatatatacataaactttacaaaatgaaaaccggggcaatttacgtgcatttgtcccggcttttatattaatattatattttcacagtgattaatttatccctgcccgcactaccgatcatgacaccctcgattaatctaatgagtcagcggccggactggtctttgattcatctccatattgccagtcacgcatttgatttgccgcggctgctgaaggataggcgttattatcgaaccaggccccagcaccactagcattcattaagactggaatttggcggccatcaaaataatgataacgcacgtattcaaagttaccggccccagcagtctgctcggcccccataatatgaatccatttttgtccctcagctgccacataagatagcttcaacccgtcggtatcattttgcgtcatcgaattaatcttgtgatcgtacttattatagtaataccaagtcccctgataactttgaggccattgattagccttcgcatcacgactcatgttcacgttcagcgcactatctgtcagcgtcgtcggtcgactgcccgtaatgatcttggcaaagccggcttgcaaagcactgttctgcgtgtcatgaatgatcaactcgtccccgttggtcgtctgagtcacaaagacgactggtcgccgatgatggaggcaaaagaagtacgtgtttggatattgtgcttccgccttaccacccgttgcgacggccaccacttgaaattcactacggtcttcgccgtccttggaccacttgagatccactgactgcgagccccacttgattcggcctgctaagctaccattaagcaaagcattgggaaaacgaaaacctaaatggtcaggaaccttgtcatcatacgtcccgacataggtctggcccatctcgcgttgccaagcggccataaacgttgataaagccgcttgcttgcccgtattccacaaggttgcctcagccggtgatgaagaatcactgctagcggtacttttttggctagcagcctgctttgccgctaccttggttgacgttgctttttgactcgtcttgggcgctgacgacttgggcgacgtcgtgcatcccgctaataataaacttcctaataataatccgacccacacttttttcatgttgctcctcaccggtcccgtaccggtatccccctattcaataattacttttatggtaccaaaaaaagtcggcattgtgctgggcgttacaatataaatcttcacccatctcacttaccgactatggctatttacttaatcgtgatatttaacgtccctaaatgtgtaatctgaccgcacagttgatcgccggcttgcaaaaagacttggggattgcgaccaacgccggtcccactaggcgtcccggtaaaaatcaaatcacctggttgtaactcacagaccgtcgacaagtagtgcaccaaatccggtaccttgaagatcagttggctcaacggcgcttgctgcatcgtctgaccattgacggtggtcgtgatcacctcatcgtctaagttagctaactcatcgacggtcgttaaccacggcccaactggtgcgtaattttcaaacgatttacctattgaaaactgtggattatcattctcgaactgaacggctcgatcagataagtcttcaccaaccatcactccggccacgtgcgccattgcatcagccgtcgcgatatcgcgcccacccttgccaatcatcacgactagctcggtttcccagtcggtctcaggaccatgtgtcgccacggtcacgttcgctggtgccagtgaactactaaacttcgtaaaaatacttggaaccttcggcagcgtaatgtggatctccgccgaatggtcgcggtagttcatccccaccgcaaaaatctgtcgcggggccgtgattggtgccgctaattcttgcggcgcaaacgtttcaagcgagccaagttgccggtccgctgctggcatatgtagcgcttccaaaactgtcttcgcatttaaaactgtttgtccatgctgttcatccgtaatgataaacggtcggttggcccgcatgccaattttcatattaatcacctcattaatattattgtacactcatctcatgaatcataacaataatgatagttgcgtgacggtcattccggacaatcttcatgaacgttcaaacgcaattacgaacttagttcaggatacttcttcatgtaacgctcatcactaaaaaaggtacccgcctaatttgcgagtacctttaaccattacggctgccattaatgtgggccgtcatcctttggttctggatgtttcttttctggtgctttttcttgcttgtcattttgttgccgccactcttctgtcgttaacatgtctttaacgactaattttaacttagtcacttgataaccagtcattgatttaacggccttggcaaccttatccgccacccgtgctagaatctcctgaccattcttaccataagctagaatggccgtcaattcgattccaaccgtctggtcatcgtcatcggtatccactgaaacaccggtctgcgggcgatccttatccgtaaagcgattggaaatatcatcaatcagatttccctgtaagctcaatactccttcaacttcttgggccgtgttactagcaatctttgccaataccgtatcgtcaaaaacaacttctggttttaaagatgtcgctgttgcttccatcaaaattcctccttgttttgtcaaaaatcgtcttaccaatgactactctaaacgaccgtgctattcaacttgccgcttatctgttgattgatccgtatttggtttgccagtggcctgatcttgccaatcacgcttgctcatgacgtcactgacatgtaccttaatttcaatgaccttcaagccagtataccgttcaacatcttgctgaacacgttgacaaatttgattgaagatttgtcgcatgtccttaccatattcaacgatcatcgtcatatctaaagcaacttgtttcttaccaacttgggcgtcaaccccctgcgtcgggtcagcttcatcacgaaagcggttcgttaaattgcttaacatgccgccttctagggataacacgccgtcaacattgcgtgaagctagaccggcgattttttcaatcacaccgtcatcaaacgtcaattgagtctgtaattgttgttctggttgtgccattgtaattcctcccattatttagataaatactcactcaacttctgactaactgcagccaaatcgacgtggacaaaccgtccaatcgcccagccgatcagccctaaaactgcgactaataagactgccgaaaaactggttaatacccagacgatacctaaaagcagtccaatcagaaaaccatactgtgcgttactcatcaggaccctcctttacaccacggttaacttacgctggtgatttgctggcttaacttgcactactggttgttcgaccgtcaatcccaattgattcttcaaatagtcctgtgccaaggttgccgcctgttgggccgtggtttctaacgatgcgtcagtattaaccatcgcatcaatttttactcgtacccggcgacgacgccgtaatttcaagtgaacctcaggatcaatcagattcaactgattaacgagtcggtactgcaaatcacgttccaaagcccgttgcggaatcgttaactggccaaccttgccatcatacgtcaacgtgctgactttaactggtcgaaacaagccaacaattatcaataagataccaacgattccggcaataatggcaaagaccatcaataagatactccaaaccattgggtagttaatcgtcagatcagctaaccaggacgtcaaccacgggatcgggtacaactgacccagttcaaaaaccgctaataacaccaatacaattccgactaacgtcaccgtaaacttagctaagcggctcatctaatcaccgcctaacgtttcttacgcatgccgaagattgcagaaacgattaatactaagataatagcgcctaagattgagggtaccaatgccataccagctaacgaaggtccccaagttccaagcaatgcttgaccaatccaggcaccaactaaaccggcaataatattgccaatgatccccattggaacgtcacggctggtaatcgcacctgctaacgcaccaatgacaccaccaacaattaatgaccatagccatcctaacattctaatcactccttacagttatatttgagtacatgcttatgataaccataatttgattttgggacaattaatatgcacactggtcgaattgtcacttaaaatctgaacaattaccatcaacgaatcccgccgcttcgcaatttaaccacaaacataaaaaaatcagcctgccaattgttacatcgcaagctgattatttctattaaattgactactaataactgctctgacttagctagattaggctggtttagccggagtctgtttggctgccgtcaatgcttgattgattaccttggcgtataaaatatcaccagcccgaatgccaccgaagtgtacgccatccgtccctttgaaaacttctggatgttgcgccgcaatcttgccccagtcggcaaccgtaatgaacttatacttagctggcagacgccgttccaaaacggccaactttgatgaattccagtcagcatcggcccgggcattataaggtgtcatcagaatcaacttgtgccccggctccaagtcatgaatgatcttcatggtttgttcttcgtaatcatccagcgcgttggtcccaatacaaatcaccacgtactgccgtaacgtatggcttcgctgctggttcatcatgactttatatgccaggttcatcgtccgatcgccctccgcatcaatattgctgttcgcgacgtgatcgcccaggtagctccgcgtccccagcgtgacactgtcaccaataatggaaacacctggtgctttttcttggtcacctttaggcgttgcctgcttcttcttgggcgttacggccgcgagcacagcttcatgagtcgttccgattttatcaatatcttggtaaatcccgctcacccataaattctgttccagtgtcgaaagttgcggtgcatttttgactacgaccccggtattaactgccaacaatactcctgcggtgataacgggtaactgcaactgtcgccacgtcactgtatgaccgaaaacgtgggcgcgtttgcccgcaattactggttctaacacgtagtatgacagcgcggataagataatcgacagtaccgtcgtgagcagtgccgccaaccagttgaccatcatgtgtgaaaaaatcacgtacaacggccagtgatagagatacacgctatagctcacatccgctaagaacgtcatccaccgcggttccttgaggttcggcgtgtggtcatgcaacaaccgggcgccatagatcatgatgccagcgagtacagtagccagtaacagcccatcctgatacgtttgtagcgcatcgaacttcatccggtcgcctaaagcaactaacaagataaaactaataagcatcaccgcgcccgcaatgatcggattgcagtgcgccgtggtccaacgatagattggcccttgagccttgatgccgctcaggacaccgataagcccgccgacaaagaacggaaaacagtgggtcagacttgaaaagtagactggtgaaaagtcctttaagccgaccgcaccaaagtacatcatgacaaagctttcaatcgcaaaggcagtggtcaacagccctaagccccagcgaaaacgggtcaatgcgcgccgaccactcgccaaccgccgactgattttagcgaccaaccacgcaatcaggccccataaaatataaaagtgcatttcaaccgctaatgaccacgtatggacaaataagtgcggaataaacttgttttcataactgccacccgtcgcaatttcaaaataattagtcgtaaatccgagagccgccgcgacctgcttaccaatgtcggtcacaaaatcgtggtcaatcaagtaagttagcggtagcaccaataacaccgcaataaataatggtggcacaattcgataaaaccggcgaccatagaaagccattagtttaaagttatccgaacgagcaaactcgtccaccattaatgacgtaatcaaaaaccctgagaaggtaaagaagatgtccaccccgataaagccaccagtaaactgggtttggaaaaagtgatacgtcaataccagcacgagtcccgttatccgtactaaactaaaccatttaatccgcattttctaacttatcgtcccccgtaatttttttggcataagtcttgttgccgacccgcagtttgaccacaccattcaacgcacccttgctgaagttgccttgcaaacgccacccgttcggtgcaatgaattcgcctgggccttcaaaccggccattggtaaaattacccacgtagcgcccctgtttgttaacctgcaacgtaccctgaccgtcaaacttgtgcttcaaaacggctccgctgtagctcatccgtccgtgatccaattgcacactttgctgcttcgccgttgatggtgctagactgataacggcaaaagtgacaataccgataatcgtgataatttcaaagaccattctgctactgatttttcccatacctctattcctttcacaaccttaattccccttaaagcaatcggcagttagccaccctggatttcccaatcatccacgggattatacggacacattatgtaccatggctgtcaattgcaactctgcatttaataacggatcatttttcattccgttaattatccattaatttaattcgtttatttaaataatcaaaaaaacttcaatggccgtattacttaatatattactaaatattagccttgccgtgtacaaaatatcaaaaatgagttgtcttttattgttaataccggttatgtttaattcactaaacttaatatctaaccactaaaaaaacagtcaggccaaggatttcggctgattgacaaccataggtaagcattcattgcctatctatcattcccggtatccatcggctatcctaatccaactgtttttattatttcatatgatcaataattctaaaaagctttgagctcagaaattaagcgcgtttgcgtaactttgttaaacccaataatgagaaccctgccgctagtaatcccaccacagtcaaactcgctgactgtttttcatccgtttgtggtaacgccgtggcctttgcggcagctggctgttgtttggcgcccgcaaccagcttcattgttgcattgccatctgaaacatctgcgctagtactcgtggcattagcggtatctttgctattcgctacggtttcagtcgcggttgcatgtggtgcagtaacaccagccgattgagcaacacttgtggtttcaacaattccatcagccacagccgtcgtcgttgtaaatttgttagcttcgacgcgtgccaagaaggctttagcagccgttaaatctccttgtgcgacggcgaaatcaactctggcagcgccaagcacttgtttaagttgtgctaaatcggcctttttacggtagattgcaaatttaa

SEQ ID NO: 51 - DNA, 16995 bp, Lactobacillus plantarum
ggagcttttgtgatattaagataattatgcccggtatgggacctggcaaggtacatcgacgccatatttgagtgtgatcaggtataactggtcaagcacggcggggccttgtgaatgacgagccccccaagtagttagcaactggtttaggcggctagcgacttgatggtggtccgcaacacagtctaagtcttgtgcggccttagctaaggcttgttgtaattcgggaattgcgcgtacttcggggtcactataagcgacatcgatggcgcgaattagcgcaatggcgttttcgttttttaacatgctaccatccctctcctgtgatgtggcgaacttagtccacgtcctaatttaagtatagcgctcctaaattgagattcaagttacaaatgtaaccgctatcacaagtaacggtaggtcattattgtacttttggtatcagctgtgttatattgtaatagaaaaatagaacactaaggaggccgttaaattgaaatttgatgacaaggttccgatttattatcaaatcaaacagtatatttatcataaaatgattgacggaacgttaccaccaggggcaaagttgcccgcagtccggcagcttgcgttggacttgacggttaatgttaatacagttcagcgggcactcagtgagatgattacggaaggcactctgacgtcccaacgaggtaaggggaatttcgtaacggaagatcaggcgcatattatgcaattgaggactacactggtgaacgagcaattagcattagcgtacgaccaattgcacgcactaaatttaagtgacgccgaaatcgtggcgagtctgcaacaatacattgcccaacgagaggagcacaatcatgacagcattgacgattaaggatttacgttataaacataatcaacgaatgattttacaaaatgttcaattaaccctggcgcccagcaagattgtcggtttattaggtgaaaatggggcggggaaaacgaccttgatgcgactaattacaggtagtgccaagggtcagggcagtattgtgatcaatggtgcgacaactgccgtagcccgtaagcagcaggtaagtttcacggatcatttgactggttttagtgccggtatgaaattacaacaaatcgcgcaattttatcaacttgtttatcctgattttgacgccaaacgctatcaagagctggttgactttctggaactcaaccaacaacaaaaattgggtgagttgtctaaggggacccgcgagaaattaatcattgcgctgaccctgagtcgcaaagtggctttgtacttattagatgaaccgtttagtgggatcgacagtatgagccgcaaaaaaattattaacagtattatcaagtggacgcctgccgaagcgacattattgattagtgatcattatttcactgaaatcgcgccgattcttgatgaaatcgtggtcgttaaggaccaaacaattgttgttcatcagggtgcagatgagattcgcgacgaacatggcatggaacttgaagattattatgagagcttatatatgggaggtgtgacggatgacaagtagttggtcactatttaaggccctcagttggccacgctttaagcaaatgagtttattgattggtatcgaagctttggcggtgattgtcactagtttgtggactgccatcaaaggaaacttcacagctgccacattattctataatttatgtgcttggatggcgttacctttaatcgttgggtttatcttattggcagtttcaaatgaaaaattcttccgggcggggacgttctggttattgccaattagcgattggcgacgctatacgattaatttagtcgtttcgttggttgatattgtttatgtttggttggtccaagtgattttattctgcttaactctgtggattggttggaatgaactgatgggaggcttaacatcagcgtcgctgttctttagccagtttgatgcgggtagtgccgtgcagttcgcactcggaacgttgctagtcttagttcttgtgacgattctgatttggagcacgataacgctttgccattttgttacgaatgcgaccaagggctttttaccacgatttcggcaacggttcgtcaatgtgattatcacggtggtggtcatttacgtagctttccgcttagctaatttgttgattagcatggtcagctttctctccagtcagctagtcaaccagggacaaatcgattctttatgggtcggtagtctcgtcatgttggcagttatcttagttgaaggtgtgttaaataccttgatgttgcaaaaatgggttgagccaaccttgaattaatttagtaatcctaaaaaatcactcattcgtattgaatgagtgatttttattgcgcattttttaaacgatggttgcacctaagctgtttttgaagtgacgcaacgcccattcgtgaccagcggcgtcaaaactagcaacggcatcctgatgaatgacgagttggtaacccaaattataggcgtcaacagccgtgtgaaggacacaaatgtcggtacaaacaccgactaagtgcagggtgtcaacatggcgttctcgcagacgtaaatccaaatcagtacccgcaaatgaactgtaacgcgtcttgtcgaatgcccaaacattatcggcggcttgatgatcagcgtaccaatctttgagtggcccatagagttcacgaccccaggtaccccgaacattatgaggtggaaacaacttgctttcgggatggtaaggatcatgcggggtatggacatcggttggcagtaagacccagtcgcttgccgtagccatttggttggcgagtttgacgatcgttggtgcgagcgcttggccgggttgcccacaagtgagtgccccgccgtcagccacaaaatcattcgtataatcaataatcagtaaggcttggtgacttgccataataaaggcctccaatattaggtttgagattggttttactgtaaacaactctgatgggactgtcaattgtttaactagcgttggattgactaaataattatattaatgagatttggagctataaggacagcagcttgctgaaagtcttttctgaacaataaaatattaataatattttgtggccgaccaaggcgccaggtattgggcgttaatataaataattgcgaatggcgacttattagccggcgttctgtttgctaattgctgatttttgccccaaattggcacagtagccgccgtcctgttttcccaatcgttaaactgagattgggttattgtcagttaaatataaaaagtctagccagcgtgttgagttcgacaacatactggctagacttttggtgggtaaacgaaagttgagtcgctggcctgatgattattctgctagttgatcagtaattgccgtgacaatttggtcaggggtcagcttaaattcatgccgcagttcattagttgtttcacggtcattaaagcgtttggcagcaccaaagttcagaacgcgcatagcgctgttgtcatagtagcgactaactttttcaccaaaaccaccgctgagactggcttcctcaaccgtgacaactaactgatggtcggcctttaagttggccaaagtcatcgtatcggggtcagaaatgtcccggggatcaatgagcgtcgcgtcaatgtgttgctcagctaattgttgttgcacggctgttgctaaaggcaggagactgcctacaccgagtaaagcaacttgctgaccagcgtgtaatgtgtgcatcttagttgcgtcaaaatcaggcgctagaggtactgactggacgtcattacttggtacccggatggcaaccggaccgttattttgatggagagcccagtgcatcatggcttgaagttcttccttggtcgttggcgctaagtaagttaagttaggaatattactgagcatggcaacgtcaaagataccttgatgagttggatcgcctgcgttaatgcggccaccggcaaccatgatcgtaacgggcaatttattgatgccaagatcatgggatagttgatcataggcccgttgcaagaaggtaccagaatggaagacgattggccgtaagccttgttgggcctgtccggcagcaaatgtaatcgattcttgttcggcaatgccgacgtcaaagtaccggtctggatattggcgagcaaagcgtttgaggtcataagttcctggaacagccgccgtaattgccgtgataggcgtcttggctgctaactcatcggctaacgtggcatgaatgacatccgtatacgtttccttggtgttgggatgcaacgtctgaccggtcgctaggtcaaacggcacgtgccagtggaaagcttctttattagtgatcgcgggttgatagccgtgacccttttcggtatggacgtgcaacacgattgggtggtcaacatccttaatttccttaaaagtcgttagcatggtctcaaggtcgttaccatcatcaacgtagcgataatcgaggccaaaatctttgaacaagttatgggaactcgtgccgttagtttcgcggagttcacggagattttggtaaatgccaccatggtcttctgcaattgccatgccattatcgttaaccagaataatgaggttagactttaaggtggccgcgatgtttagaccttccaatgctaaaccaccggataatgagccgtcaccaatcactgccatgacattgcctgttttgccctcaaggtcacgagcaacagccatgccagttgccaaggcaatcgaggttgaagtatgaccaatattgaaatagtcgtgggggctttcttctggggcagtgtagccgctgacatcattataatgagcggggtcaagccaagcttgctttcggcccgttagaatcttgtgtgtgtaggattggtgtgaaacatcccatacaaccttatcaactggtgaattaaaaatggtgtgaaaggcaatggttaattcgactacgcccaagttagggccaacgtgaccaccagtttgactaactttattgagtaggacgtgacgtaactcgcttgcgagttgtgttaattccggcaaggataattgtttcagatcggccggctgatcaatgcgtgctaaaatcggtgtttccattatctatcgctcactttctcattcatgaatacttttatagattagcaccttagagccactctaagacaagtgttttgtttcaaaaatatcataaaaaatgacgccgacaagttgtcaggcgtcattaggttaccatggtcacaagattggggggcttgttgagacgttcagttggcagttcgaccaatggtacaacgttagtgtaacggacccgatgcccaaatagtggtgtggacagttggtcacgttattgacattactaaacgaatttagtcggtattgatcgattgcaagtaaactaactgatcagttgaaatttgttcatagagttggttaccaagttctgagctgaatgttttattggctaattgggtctgaatgaagttatattccaactggaatgcttcaattagaagctcattttgagtttcctggaaatcccgttcaccagataggcggcgatgacgttcatcataggcgcggcgaacgatcccgatagcttgctgattgtcagcagtaatcgtgtcggctaaataagctaacacggcctcatacggcttttgttcgatctgtcgcatttgttgccacatttgccgattacgagtcatgagctcagttcgactctggccaccacggggccggtattgtcggaacattttacgtcgggcacgagcttttttgctgagcgaccatttgctgagtgtaaactggaaaaataatttcaagcgttcgaagaaagtttgttgattctgcagacgcgtctgactagcgacgcgcatgtacttttcggcggcatggggcgtgatttcattgttggcaaccatttcatcaatagtggtttgttcaactttgaaagtggcgtcgaacaagctcgccagttgcgagcgcttaggacgaccatctagtactcgttggccggacagaatcgcaatcactttactagtgccagcattattaccatggcgtgcttgcatgagatcaatagcgtgagttaccatgtcagctttggcggttgccaattcatcttcagtgaccttaacaacttgttttggcaacgtcaacggtaacaaaagtgttggcaccagcagactagttagaatgaccactgcggcaacgaaaataatatcgttgcgataaggaaaagcactgccattgagtgttagtggtaatgaaaaggccatcgccagcgtaatcgtgccgtgaacgccgctcagacccatcacgaatgcattacgggtcttttcatgattatcccacgcgcgaatacgggctaagtcgaagcgcgtccagagaaaacgggcgaacgtcatgattaggtagagcaagattcccagaccgactaataccgcgaccgaactagtatcacgttgctgtaagtggttgatgacacttggcaacgacacacctaataacacaaagacgataccgttcaaaatactagccacgattgaccaagtcgttgtcatcacgatttgtagccgggaagtggtcaaccgtaattgatcggactggacaccatgaatgagaccggtggcaacaacagctaagataccggaaacgcctaacgattcagctaagaaatagacgacaaacggtgtcagtaatgtgtaggggacgatcacagaaggtgtatcgacccgcatgcgaatcagcataatcctgacagcaacaatgacataaccgatgattaggccgacgaagattccaccggcaaagacatataaaaagttagtgattccgtgccagaccgaaaacttaccagtgacgatcgcagcaatcgctaagttaaaggccacgattccggaggcgtcattgaacagtgattcattttcaagcgtcgtcatgactgctcttggaatcgcaactttagtcgtaatcgatgagaccgcgacggcatcggttggcgtaataatagcgccaagggcaaaagcaagtgccagcgaaaactcgggaatcagtaagtgagtgaccgtaccaacaattaggatggtcacgatggctaacactaccgaaagcgaaagggtcgtgccaaactggtgactgagcttgcgaatattggtgttttggccatcattaaacattaaaatcgaaataatgacgaatagaaaaatttcaggttccaattcaaaatttcgatacaacggaatcagagacaagattaacccagccccaatttgtaaaaaggcgactggaatttgattgaaacgtgcgtagacggcgttagcaacgacgacagccgcaacgagtaataagactaagaaaacggtttgcaaaccaaatttcctcctagattttgtaaagtagtttaattttaacgcaatcatatgaataaaagtattatctgcaatgattaatttggggctggacctaatgtttaaaaaaagaccgattagaagttaattattgaacgttttgacctaaagtatgtcattagcttggcgtgacgttctaagtcagtataatgaaattatcaacttaactggaggacatcgcgatgttaacaattgcttatatcggcaacggtaagagtgctaaccgctatcacttaccatttgcactgaaactcaaagatcaaattaaggtgaagaccatctattcacgttcaggacaccagaattggcaaccaattgcgggcgtgcattacacgactacgttagcagatatttatgaggaccctgatattcagctcgtagttgtttcaacacctagtcatacgcactattcggtagctaaggatgtcttgaaccatggtaagaatgtcttggtggaaaaaccatttacggaaacatcagcggaagcccgcgaactttttgaattggctaagcaaaagcatttgtttattcagtgttaccagaatcggcgctttgattcggactatttgacgacacaaaaggtcattgaaagcggcgtcctcggtgacttgctggaagtcgaaatgcactttgattatttccggccagaggttccaaccaatgttgaccatttttcattagatacgagttatttatatggtcatgcttgccatactttagaccaagtgattgcatactttggggagccggatgacgtgcactatgatgttcggcaactattgggaagtgaccggatgaatgattattttgatatcgatctgtattacggtgccttgaaagtctctgtaaaatctagctatttccgcattaaatcacggccgagcttcgtggtttatggcaaaaagggcatgttcgtaaaggcgactaaggatcgtcaggaatacgatctgaaacatttttacatgccgaatcacgctgactttggcattgatcaacctgaaaactatggcacgttaacttatatcgacgatgcgggtcagtatcacgaagaggcagtcgtttcggaagttggtgactacagtcgggtttacgccggcgtttacgacagcatcatcaatggacaacctaagttagtcaaagatgaggaaacgttgttgcaagtgaaaatgttagaaactggtattcaacaatgccgacattagcgcttcttgagtgttgcactagcccagctattggtacgtgtcagctttagattgttgttcggctaccggtgtgcgtcctaggaggttggtgccaattgttggcggtcggcgcaagccgacgctggctaagcatgtttacgcaaacttgagcttttttcagtgggccttagctgatttcatttggccggtattaattcgttaatataaattatgaggaggattatgatgcgattaggaattttaggaacaggcaagattgttcaggacttcttgccaatggtgaagagcattcccgcgattgaattggtgggattgctgtcaacgccgcggagtgtggcgcgagcacgcgagctgcaagccacgtatcgtattggaacggtctacacagattatgcagctttgctagccgatacgacaattgatacagtgtacgtcgctttgccgaattcgttacattatgactatgcgaagcgggcattgcaagcggggaagaacgttatttgtgagaagccgtttacgttagtggcatctcagttaacggaactaatcgaattggcaggtcgccaagacttagtgttaatcgaagcaattacgaatcagtatttggaaaactatcaggcaatcaaacgtgatttgaccaagttgggcgacttgaaaattatcgaatgcaactattcgcagtattcatcacgttatgatcagtttaaagcccgaacgatcttaccagcttttaatcctaagcttggtgggggcgccctgatggacttgaatatttataatattcattttgtggttggcttgttaggcgcaccaacgcacgtgcagtatttagctaatgttgaacgaaatattgatacatcaggcatcttagtgttgacctatccgaatgttaaagtcgtttgtatcggtgccaaggattcgacttcaccggtacgttccacgattcaggggacgactggttcgatcattgtcaacggtcctactaatacggtcgaaagtatcactgaaatttcacatgatggaacgacaactgatttagcgcttaatcaagctgagcatcggatgtatgctgagtttgtggcgtttgaacgtcttattgctaatcacgatatggtaaccgttaagcggcaattagatcattcccaagcggtcatggaagttgttgaccaagcgttagcgagcgcgggattgcaattgggctaatgcgtcgttgctaacgtggctgcacaataaatagaagatattgtaaaaagcgtgtcctagaaactgtaggacgcgcttttgagtcgttagatgtgttattttgtggtgagcgggccgtcctggattaggtgctgtttttgtcgcaggtcttgtaaatggtgatgaaaatcatgtgcatacatgactgcgaaaagactgtctaagacgtattcaaacgccgcttgggatgcaaaagtaccgattttggcaaaattatattcactctgaacggtgagcaagtgctgggtcgcttgactgatgagtggtgattgtggattacctgttaggataatcatgggaatttgatgagcgtgaaaataggtggcaacttgctgatggattttagtagtaccagcatatgaaataatcagagcacaatcatcagctgttaagttggctgcgttccaggattcgtcagcatattcttcggcgattatagcaaaacgattgattttgacgagtttattttgaaaactacgggcccgtagttgtgagtcaccttgcgagaagataaagattcgttttgatcgcgtcaataagtcagcagcttgggctaattggttcgtatcaagttgctgctgggctgtctgaatggcccgaatattcaaggcggccatcttttggctgattgtggcgaccgaatctgtcgccgagaacggaaaattggcatccacagtggcggcttgatgtgcctgggcaatgttttcggcagtcaatttccgttggaaatcgcgaaagccccggtagttcaatttttgggccaacctaatgattgctgaatgggatgtgtacgtcttagcggctaggtctttgatcagaatagttggcatttgatctagatgtgccagaatatagctactgatccgctgttcagtactagtaaagtctgactgttgttgcaaggcaattaatattgacatgtcatcgacctccatagttagtatcatacggttaatattggaaaaaagcgacgattatcataaaactgagtaaaatcagcttgacctggtaccggtttcataaattatggtaattatatgaaacaacgtggtatcatcaattgagagaggaagttctgtgatgacgaatatacatgatattgcgcgactatcgggttattccgtctcgacagtctcgcgggtaattaaccatcagaagtacgttgcggatgataaacgggccaaagttgaggctattatgcaagaactggattacgtacctaaccgggtcgctcgtgatttaagtcgggggcggacgaagacaattggcgtggtactaccgtatgcgaatcacccgtatttcgcacgggtagttgatggtatcgtcagtgcaggctttgcggcgggttataaaatcatgttgctaccgactaattatgatatgacgattgaacgccattatttagaagacttaagaagtaaagcctatgatgcgctgatttttacgtcacgtagtagttcactggatacactggaacgttaccgcaagtatggtcaaatcgtctgttgtgaagatccaggtgatgaccgggcattggccgcagcttatacggaccgcatggcttcatatgttacggcattacggtgggcgaagcaacaaggttatgcgacgatgggcgttattttgagccgtaataacgtcattagtgctagtacacgggttacgcggcgagcctaccacgaagtatatggtcagttggatgacgagcgactctataccggtgctgccacttatgaagacggttaccacgctggtaagtattttgccaatcaagcgtctcgcgtggccgcgatttttgcaaatggcgatgatattggggcgggcgcctatcaatattttatggatcacgggttagcccccattccagtgattgggcaggagaacttgctgacgagtcgactattaaagttttcgacgatcgaccatcatctagaatcattgggtcagtcagcatttcgattggcaatcggcaagacccgtacccatgaattgattaaatcagaatttatcccgcgataacttggaggagcaattaatatggtagcaagattagcagtttttgacattgatgacacactattggctcgcaataagcaattattaccgagcaccattgaaagtattcaagcacttagagatgacgggattcatgtagccatcgccacgggtcgcaatttagcgatggcccggccagttattaatgccttacaattacaagattatgtactgtgcaatggttcagcagcgtttgctggtcgccaacaaattcatcaacacaccttatctaaagacaatgttggcaaattggttgcggcggcggataaacagaatattgatattgtggtcgaatcactggatgggctacatatccacacacatccgtccaccacgacgcgccaggtgttgaacacgtttcgggcacctgagttggattatgcccctgattactatcagcaccatgatgtgtatcaggccatgatgttttacccggatgtccaaaatcgattgttgccgcatccagatgagttttcctttgttcgttttcatgaacgcggggttgatatcattcccaaagtgggatctaaggcgcaaggaattgcaaaactggcagcggcacttaatgtcgattcgagtaacgttgcggcctttggtgataatgataatgaccgagagatgattcagagcgccggtattggggtcgctatgggtaacgcgaaagctgagattaaagcattagcagacattacgacgaccgattgtgatcacgatggcatcgccaatggactaaaaaaaattggttggctataaattttaatgaaataaaactgtgatccaaacagttgacttgcggaattcggttccagcaatcagtatgttggggtcacagtttttgattagttatcgcgtagcatcttcttgatcgccgctactgaacgggcgacttgttcgggatcaactggctttttttcagctggtgtcgagcgtacagtggccgattgattagacttagttggtgttgggttcgacatagccggctgtggcacactagttttagctggctgtggactaattttagcaccagtcgaggcttgggccggctgaccagcgtgcatttgatccatagtttgattcaacaaatgatcgacaaagacattgccctgattggtagcgtggcccttagtccagcggtaattaagtgcagtgaatgctggaagcaaccggtcgacttcacgccataactcagcgttaactaacggaccattgctgcgtttccagccgcgtcgtttccaaccagccagccagcccttagtgactgcgttgaggacatactgtgaatcaagtacgaacagaatcccagtcttagtttggccaagctgttgcaattgttcaagagctcgtaagaaggccatgatttccatgcgattattggtggcaccccattcgccggcagagtcagtgacgagttggtcgggcatttcaatccgataagcccaggcagccttatcatcttggtgcacgtgctgaccggcaacgtttccggtatttcgcgaaccgccatcagtataaacagtaatggctgcgttgaccggcgcttgattagatattgattttgagtgagctggggccttaccagccataaaatcctgagcgtctttctcgcttgtgaagctcttgtactgtgcttgtggataaccgctaacttgcttttgagtttcgggccaggtgcggtaaataccaggttggcgtcccttacgaacagcgtaatatttttgtgccatggcgatacctactttctgaatggtgatactgctaatttaacataaattgccggggaaaaatgaaaaattagcagacttgtaaataaataataacaaccggatcacggaagcgaacttctgtgatccggttgccatgatgaaatataactaatgggctttaaataatgtcgtcaggtaattcatgaatgtcttcaaataacgatccttgtcgaccgttaacgcaaccgtgacgttagttgggtcattgagtcgcgcagggtcaccaattgtccggccataatcttcaccactagcctggacgtacatattcagttctaacgtggtgacaaaacttggatcgagtgaaacgccgactgccagtggatcgtgtaaggcacaaccgtgtaagtcaggactcgtaatatcgtaagccgcaatgtaatagtcaacaatgtcagcaaatttttcgcccgcagttgtctttaagtcccgccattgttgtgtttcagtcttggttaataatgtccgtaacgttacgtcgagtccgaccatcgtaagaggcatcgtactggtgaagacggcgttggccgcttcggcatcttgattaatattggcttcagcgtagtgactgacattacctggaacagtcagtgcaccacccattaaggtcacattaccaatggtgctggcaatgtctggtgctttttcgagtgcttcggccaagttggttaagggaccggttggcactagggtcagatcggcgccatattggtgaacggcatcaattaagaagtcgacaccggactgcttttccacggcgcgtttcggttcaggaaggttcacgtcgccgataccgttcatgccatgaatctgctgtgaaatcggcataacgtcaaagtgttccgtcgtactggagtggggttcacctagaaagacgggtacgtcagtggcacctagtagttctagaatttgtaaactgttaatcgccgcctgatccactaggcagttcccataagaactgataatcccaattaaatcaacgtcgggtgcaccgactgcgtaggcaatggccattgcgtcgtcaatcccggtgtctaagtctaaaatcattttacgttttgccatgtaaaacatcctccctgattaggtctgaagcgctataaagctatgttttaattgtaaacgtttcagctgatgctgacaacggctagcggcgaattaaattaacattgaacagaaaaatgttcggaaatatttcacgaccacgcttactggcgaaatgttgaaggctgttttatactgacaattaaggaaggtgaagctgatgacgacgaatagtccattagaagcaatcatgaatgcgcgccattcggttcggcaatatgacggccaaactaaaattgggcgtgaaggaatggccgcgatgttacagaccgcatttttggcaccaaccgcattgaatcaacaaccgattcgggcgttggtgattgaggatgcagccttgcgacaacggttgtgtgccgcgactggtaataccagtcagttaactacggccagtgccgtcgtcttatttgtgctggatcgtgaaaatcaacaccaagcgccagcgtttcaggccagtcaggggcaacaatttgatactggtgacgagaccattggcgccctagatgctggcctgattgcgatgcaatttatgttagtggctaaagatcatggctttgatacgaatccgatgaccgggtttgatgctgccggattcacgtctattttggaacttgacgcccagcggtatcggccactattgctcgtttcaattggcaaagcggccgttgctggcaagccagcagatcatcagccgctagcgacattagttgattatcgataatattgaggggaagctagaacgtgaattttgaaaagcactaccgatatactggaaagcaaaaattaggattaactaaattagcaacggcggttgatccagaatttgaagacgaaaaggtcatcaaggcgcaaatcgccaagaatattaagcaactgactgagctgcaaggtaagttatatgcacaagaccgatttggtgttttagtcatttttcaggcgatggatgcggcgggtaaggacagtatgattcgccatatcatgagtggggtcaacccccaaggctgtgaagtcacatcgttcaagcaaccaactactaaagaaattgcgcatgattatttatggcgaattcatgatcgggtccccaaacgcggcatgattgggatcttcaatcggtcgtattatgaagacgtacttgttagtcgagtccatccggaaattattgtgaatgagcacgtcggtgagattaacgataagaaacaagtggatgatgctttttttgaacgtcgttttaacgatcttcggtactttgaagattacttgcaacacaacggctacttagtgctcaagttcttcttacacatgtcaaaggcggaacagaagcaacgttttattcgccgtattgaaattccaagtcacaactggaaattctcagctgccgatattcaggaacggcagtattgggatgattatcagcgtgcttatgatgatgctatcaccaagacggctactaaagcgacaccgtggtacgtcattccgtcggatagtaagtggtattcgcggctctgtgtttcggaaatcatcaatcaacgcctgtcggaattgccattagcgtatccctcactggatgcgagtgcgcaagcacaattaaaaacggcgctggagcaactagatcgtgagaccgactaacaaagtatcgcgcagtgttactagcagcaagttgaaattataaaaaatgagctactcacaccgttgatcgtcagttcaacgcgacgtgagcagctcatttttttgacggtgtgacaagctaattatgaatgccgatgcttagttcggcgtgtcaggacaaaagcgctaccgagtaatccaatcaataaggcgagaccgatagctactgaccaacttgccgagtgttcgttagtttgtggcaacgacttattcatcggtgctgagcctgcaaaagctgtagctgccgatgctggtaagggattagttgccggaaccgttgtggcggtcgtgttagtcgaatttgtcgctggattggcaggtgctgacagattaccactgacgcttggttcgggggtcgatggagacgactcatttggaacggctggagtgacggccgttggtttttcaggtgttacggttcctggattggtgggcttaggaccactcggctgttctggtgagacggtacccggcttttctggttcagtgattccgggtttctccggttcagt

SEQ ID NO: 52 - DNA, 17174 bp, Lactobacillus plantarum
attttacaatctaccaaataaataatattaatgaaaacgagtgtaataggcctcataaagctcattacactcgtctaacaacttaaaatttatttataacacttatggaaattttattgaaaatttttcagatctttttacgtcaatatcaaataaacgacaaattatgagtcgctttgacaattaatatgttgatactaagccgactaatcctgattttggtttaaatcagccgcgtgttgtgctgccgttttttgtggtccgtgatccaaactattcacaataaaggctagaataaccaaaccaaggccaatcaggtagacccaatgtaagcccgtatataagatacgatgaagtgtcggcaacaaatgagacggtaattgcgttgctgtctgtggattgatcaacttgttcatcatcgccatgttcgttcctgcatggtgctgaataccttggttcatcccaacgttcaacgcaattccaaagattgaaatcatcaacgtttggccaatcgttcgactcaacgtattgaaggacgttgcgacgcccacgttctcagctggcacaaggtgttgcgacgtgacggtcgttgctgtaattgtaattccaaagcccacgccaccaatcgctgtgatcaggaagaaccatgggaaagcagtattaactggtaaccacgctaagcaaatgcttgtcacgagaatgaaagccaaactcagatacaaaatccgtcgcggcgcccactttgccaataaccgccccgtcacgaatgacccgacgatccacattaacgagctcggtgtcactgcgaatcccgccaaagaagccggtacacccagtatcccctgagtccaagttggaatataaacttcaacggccattaggaagccactgactaaggccgccacggcattctgaataataaacgtgtggtttttgaataaatccatcgaaatcactggttcatccgtgcgactttcacgacgaataaatagccacaaactgagcgcactaatgatccaagcagtcccaacggccacccaactgatagtggcgtttcccaatagttggaagcttagcatcaagcacagcaagaagagcatcagccaaaagctacccaagtagtcgattttcacgttattgtgacgtttgggttctcgtaaataaaattgaaataggaaaagggtgatcaacccaactggcacattaatgaagaaaatccaatgccagctgagcttatcgacaattagtccaccaatcagcggtgccagcactgaagcaatgccccacgctgaactattgaagcctagcactttggcccggcgttcgaatgaataaatatctgcgataattgtcattgagactggcattagcgccccggcaccgatcccctgaatggcccgccaaaaaattagcaccggcatcgaattagacaaaccgctcatcatagacccgataataaaaataattagtccggcttgcatcactggttttcggccgaccaagtcagtcagctttccataaattggcgtcatcatcgcattagtcaataaataaattgagaaaacccaattcatcaatgaaaccccgtgtaaatcaccaacaatcgttggcaaggcggtcgacacgattgtcccttcaatcgcactcataaacgtcgcgacgtaaatggcaaccgtaaccgccattacgttagttttacgctgttgcatcttagtaattctccttctctatcaatcattttaaaaccccgtgcatctaaaatagcccgcaaaaaaaagcgaccttgaaaaaaggtcgcttttagcgtcgagtacctacagaccgtaacgaatcaacgttaccgcattatttaaatgctgcttttaaagcatccactttatcagtatgttcccatggcaaatcaatatcggtccgaccaaagtggccgtatgccgcagtttgccgataaattggccgttgcaaatcgagcattttgataatcccagctgggcgtaaatcaaagttttcgcgaatggcgttaatcaacgcttcatcactaaccttcccggtcccggcagtatccactgcaatcgaaactggttcggcaaccccgatggcatatgccaattgcacttcgacctgatcagctaaaccggcagccacaacgtttttggcaatgtaacgagcagcgtaacttgcagaacgatcaaccttggtcgcgtccttaccagaaaaggcaccaccaccatgatgggcaaaaccaccgtacgtatccacgatgactttccgaccagtcaaaccggcatccccttgaggaccaccaataacaaaacgaccagttgggttcacaagatacttagtttggtcatctaataaatcagctggtaacacagccttgatgacttgatcaatgaccgtttgccggatcgtgtccaaatcaacatcaggatcatgctgagtagacaagaccaccgtgtcgattcgcttaggttggttgtcttcgtcatattcgaccgtgacttgggccttagcatctggacgtaaccacttaatggtaccatccttacgtagcgctgcaattttacgcatcaaccgatggctcaatgcgattggcagtggcattaattcaggggtttcgttgatggcataaccaaacatcatcccttgatcaccagcaccgatttgatctaatgggtcagcatcgccagaacgcgtctccaaggaatcatcgaccccttgcgcgatatctggtgattgttcatccaatgagacaaggacggcacagttgtcaccgtcaaagccgtattgaccatcaacatagccaatcgacttgatcgtgtcacgcacgaccttttgaatatcaacgtaggccttggtcgaaacttcaccgaagaccagcactaatccagtcgtcactgaagtttcaacagcgacccgtgcttgtggatcctgggctaacattgcgtccaagatagcgtcactgatttggtcagcaatcttatcaggatgaccttcagagacagattcagatgtaaataagtgtctttcactcacaataaattcccccttgataatttcggttacaaggcatctaagcatcacttattcttcattgaacaagctaaacttatcctttcgggaacggctcataactatataaggttatcacaatcaccattttttttaaagatttctgtcaaattattgacgggaactgccccgaccggtacgattaactcattatcctaattagagagtgttgacaatatgattcgaatcggaaaattacatattaaacgcgattacatcgccttggcgatctttaccatcgttcaaagcatcattagttggtgggccgccctcgattacgggcgctcatttcaaacggcctcattttcagccgcgcagttaccactgattggctacaccttagccgtggccgccgcggtcttcattatcttagatcggcggatcgctccccagtggagcctcattgcaattggaattaccgtggcctttgcatttaccaacattattgccaaggaatccgaactactgtacctgctattaacgtgcagtgcgtggttgctcgtgatggctgttccacgcttcggtatgcaaaactactttggtctagtcgttttcggcgtcatcatgacgttcacgatcccagtggccgtcttcgatttacaaaataactatttatcaactacttttctctggaagctgacccccatgctggctagttatgtcttcctatacgttccgagcttcagccgtcaacgccaaatcaatcaattgatttcggccatcactggcctgctacttgttatcaccatcttcctgcagccgctgacctggcaaacgatcgttgcaattctcatcacgattgctgtctggttcagtcaacagtcctttggccgtactcggttacatctcatgatcaacgtagccgttcagttggtactgattttattactttattaatatctagataacaacaaggcgtctacctagtctctcaaactaggtagacgccttgtttgcccctatcaccggttcttaaagtgctgctattaactggcgccacttttcaataatcgtctgcttgctgtaacgagttgctgaattgtaggcattcgtaatcagttgtgcttgtcgttcagggtgctgtaaatactgacgaactttcattgtcaactcatcaacatcattgggtgtcactaagtacccgttaacgccatcttcgataatatcttccggcccgtacgcaattcgatagccaataaccggcacgccatagctttcagcttccattgtggctagcgaaaagccctcttccacactcgtcattaaggcgaggcttgcccgctggtactcttctgccagattgggcaagaaaccccgaataacgatatttttttctagctgattggcctgaataaattgacgcatttgcatttcaatcttttgcccatgcccaaacaactgcaaagtcaggtcgggaaattcaccaactaaccgacgaaccacttccagttgatgtggtaattgcttttccggcgaatagcgcgccacactaataatccggtgcgggtcacgaccatcaattttaaccggatgaaccgttgtatagccgactggaatcacgacaactggtggtaaattatcataccgtgccaataaatcacgcttttgatgctcggtcgacacaataattcggtgaaattggtctggatgggctaggacataccgatagaccgatttcaaatgcccacttaccacgtcctcaccaatccgtagatgcgtgctatgtaagactgaacacacgcgaattgcggggcgcgtatgacctaaggccgccgccgtttgtcggttacgatcacagaaatagacgtcatcagcagtggccaactcattgaagaagaatgtctgaaaagcctgttcggtattgaagaaaaagtctctttgttgatagttcttcaacgtaatcagtcgtagttttggctctggcccggtaatgtcatactgtttgataattttgacttgcccttgtaaatcataatacacttctgtgtgcacttcctgatgtttcactaaaaagcttgtccggctcaggaagccccggttatcataaaattcgcgtcggactttaacaccctgattatcaaaataattgacataatccaattgttgtcgcccggcgtccacaaaatgaacgtacatcaaatattgaccatcggtacccaggacgcgaaaatccgtcgtatttggaacctgaatcaccttaaagtgacaaacagcttgccaatagtgcatccaatcatgatagattttagtcactgcttcaggcatcgtcccctgaaagaaatcatacaaactaaagcattttccttccgcaccaaagcgggccgcatgctcatgtaaacgcggattataagtgacatagacgcatcgagcctgataaccagtggcgtcaaatagcgccagtcggttcaactgtgccttttcaattcccgtcaatttcaatcctaaaccagtacccacaaaataatacatcacctagccgttcccttctcaatctgaaaaatcaactcatcctgtcaccgagttcaaaaacttcgagtacgcacggacgattgaccacttcatctgttatacctatacactatctttaccctaccatattttacgttactcgaccaagatatgaacagttttattgacatacaaaaatcgctagtcgtgaacaactaccgtatcagcagtgcccgactagtgatttttcaccagtttcaattaaattgctagccatacctagtgacgctcagcacgctaggtattgttttgctcaaatataattaaatcaataattagtgtgtaacgaacaccccaagacaacttagatctctgagacacgcccaccatgaactaaaacaccgtcatttcttaacatttttcaaagcttggcggaatccgaaacactgagagcccgtgccaccgtcgcaatatccttcggcgttgtgcgacaacagccgccgataatgcgggccccggcggctaaccactgggggacaaaggatgcaaattgatgactcaaatgagttgcttgccaagtcttcgtcacgggatcatattgatcaccagaattaggataaacgatcaacggaaccgctacagccgccttcaaagtggttaacgctggtgcaatgttttccagcgtagtgcaattgacccccacagcgaccacgttcggctgggccgccacccactttgcggccacagctaatgacgtcccatcacataatgtctgtggatccttgatactaaagcttacccagtatggttgttgcggccaagtggttgtgattagttgtaccaaagcctgtacttcgtctaaacgtggcatcgtttctaatgcaagcacgtccaccccggcggccatgatcaacgccaggcgttcgcggtgaaagtcttgataggcactcggcgttaactgatatgcacccgtgtactcactaccatccgctaagtaagcaccgtacgggccaatactaccagcaatcacagcatccgtgacatgactagcatcacgcgccgtatgcgcaattgtcaccgcctgttgtatcaattgacgcgcttgtgcggcagcaataccagcctgctcaaatgcagggacgttggcctggtatgtattagttgtcatgatttttgcgcccgcatccagatagctctgatggaccgcttgaatcgcatccgggtggtccaacattgccgtggctgaccacagtgcgctattggttgccacgccccgtttttctaattccgtagccatcgcaccgtccgagacgactgggccccggttcaattgttcagttaatgaaagcattgcaataattgccttcctttctacttataaattatgttattctaatagcattgttgattttctaatcatagtctaatcatattaattctgcaagtaaggaaggccggtacattatgtcaaaacaaacccacctcagtcgccagatggaatcacggcacgtgctgatgatttcactcggtggcgtgattgggaccggattatttttaagttccggttacacgattcatcaagcggggccaattgggaccctgctcgcctataccattggggccatcctcgtctatctcgtcatgctctgtctaggtgagctgtcagttgcaatgccctacaccggggcgtttcacgtctatgcgaaaaaatatattggtcctggcacaggctttacggttgccatcctatattggttgacttggacgattgccctcggttcagaatttacagcagcggggctcatcatgcaaacgtggtttccgcacattgcaacctggatctggagcctcgtctttatggtggtcatcttcaccgttaacgccctctccgtacgctggtttgcggaagcggaattctggtttgccagtatcaaagtcatcgcgatcattgcttttattgtgttaggtggactggcaatggtcggtatcctgccacttcacggtcataccagtgccccgtttctgagcaactatacgcgtaacggttggtttcccaatggttttggtggcgtctttacgactatgctaacggtcaactttgccttttctggaactgagttaattggaattacagctggtgagactaaggatccggcccacaccattccgaccgcaatcaaaacgaccctctggcgtctgattattttcttcatcggtagcatgttcgtcatggccgcactgattccttacaaacaagcgggtgtgacgcaaagtccattcgtgctcgtcttcaaagcgattgggattccctacgccgctgatttaatgaatttcgtcgtattgaccgccattatgtcggccgctaattctggtctctacgcgtctacccgcatgctgtggtcacttgcgaacgagggaaccattccaaaggttttcaaacgaaccacgaagcgcgatgtgccgttagtcgccctaattactagcatgctgggtggcattctggccctattgtcgagtgtctatgccgccggttcggtgtacctggtcttagtatccatttcaggacttgccgtcgtcattgtttggatggcaattgccctttcggagatcaacttccgcaaagcctacctgaaaagtgggcagtcgcttgatcaattgacctttaaaacgcccggctacccggtcgtcccgtggctggcctttatcttaagtgggctctcttgtatcttgatttggtttgaccctaaccagcggattgccttgtattacaccattcccttcgtggcgatttgctatctaggctactatctcaatcaacgttatcgacggacccacgccgcaaagtaagcccgttagtcagctcaactcaccaagtccacccagcaatcgtcttttgatgctgacgacctgaaaacgaacatggtcatggtttttgctggcatttctgaatcgtactttataaagtacgatccagccgacgacaccgatttttgaactgcaacaaaaccaaatatcaatttcagatctcttgctagcccggccagttgctagcaagagattttatttatttcagcagtaaattgattatcactagataatcgaataaataaaccattaaccccgtatacaagctgacgattatgctatgattaatttatcaagagcattggaggggtttctatgcacccaggattattactcgtcaatttaggctccccggcatccccacggactaaggatgtcaaagcatacttacaagaattcttaagtgatccaagcgtcatcgagatgccagccgcactctggcaaccgctgttgcgtggtattatcttaccgacccgttcttggcgttcggccaccttttatcaggatagttggctcccacaaggctcaccattaatcgtctacagtcaagccatctgccaacaagtacaagcagcattacccgattgggacgtccgactagcaatgacgtacggtcaacccgatatcggtgcgaccttgaaagccatggttgctgatgggtgtgaaaagccaattattttaccactttttccgcaatacacccagagcacgcacggcggcatccatcgtcaagttgaagcaactggattaccacacacctttatcgacagtttctacgaccaaccgacctacattcacttactagcaaccaaagtctggcaaagctatcaggcgcatcattatgatgcggtcatcttcagctaccacagcatccccactgcaatggtccgccatggtgatccctatcaacgcgaatgcgaggccacgaccaaagctgtgttggcggagcgaccagaattaccagctgataaggtcattacggcgtatcagtccaagttcggaccgatgccgtggttgaagccttacttaaaaaatgagctcatgcagttggtcgaacttggcaaacgcaacgtattagtagttacgccatcctttgtcgtggactgcttggaaaccctcgaggaagactacgttcaaaattatcaaacctttcgggcaagcggtggtgatcggtttgacttagtaccaccgatgaataaggataccggcttcagccaatttctggctgacctcgctatccaaaagcaggaggcgtcgaaccatgcaatcacatcgtcatcaaagtcttgaagaaatcaatcagagcgtcgcggttcccgacgttcatcagacggccttttggcgcaaatttttagcctatagcggtcccggtgcactagtggcagtcggctatatggatcccggcaactggttgacatccctagccggtggcggtcagtttcagtaccggcttttagccgtgctcgcattagccatcattgtcgccatgttcatgcaaggcctggcaatcaggctaggcgttgtagcccggcaagacttagcacaagccatcgctagcaagctgccccggcccgtgcgttacgccgcgtggattttaaacgaagtcgcgatgatggcgactgatatgacgggcgtaattggaaccgcaatcgccttaaaaatgttattcggcttaccactacttgcaggaattttactgacgattgcggacgtcttagttgtcttgttgtttttgagatttggcattcggcgtgtcgaagtaatcgtcctcgtcgctattttgaccgtcggcattatttttggtatcgaggtgggacgggcccacgttcaatttggcaacgtgttgctcggcttagttccaacaccattgatcgtcaaaaatcataccgcactagtcctcagtctcggaatcttgggtgcaaccatcatgccacataacttatacttacactcatcgcttgcacaaagccggcgttatgattatcataacccagcccaagtcacagaagcactgcgcttcgccaattgggactcaacagtgcacttgattgcggcttttctcatcaatgcacttttgctcgtccttggtgggacgcttttcttcggtcacaccaacgcgttagcgagtctgcaggccgtcttcgatgggttaaaaagtaccaccgtggttggcgcccttgctagcccggtcatgagctggttattcgcattagccctactaattaccggcctaatttcatccatcaccagcaccttagctggtcagatcgtcatggaaggttatttacacatccgcttgccgctctggcaacgtcggctactcactcgtgccgtcacgctaattccgattctgattattggtatgctagtcggctttagcgacactgcctttgaaaacctgatcatctacgcgcaagtggcactcagcatcgccctcccctttaccttgttgccactagttgcgttgacaaatgacgccggcctgatgaaggcccacgttaattgcccggcggtaacgtgggtgggatatggactggccggaattattactgtgttgaatatttatttggtgtatagcttgttttgagatgagatccattcacatagctactttgacttcagcactaaactaaaggccgtcaaccgcgaagcatatacgcaggttgatggccttttgatactccaactcaattatcgtggatactaatttcccaatttttagcgataaatagtcatcccccgcaatgtatcttctatcagacagtatcgcaacgttatcactagttgctatgctaggtaaaaattccccagtacaacccgcacccatgaatcgcaacagtcccaattgctaaaatgaccattttagccaagctacatgcccaatatcaatggtgctggctcgaatcatattactaaataacattgaaaagacaacaagacactagtcaaattaattgccagctttagtcgaggcgcatccgttacgttaacttttttgtaaggtgtcatcatttatccaaaacctctttcacaaacaattagtttaaccactatatttagaagcaatccattcagtttaaacaatatcacaccatatgtaagtcaccttgaactctgggcaattacatgtgtggtaacccacccgcattccatgtactgatacaattaaatgacaccaaccaaactaatcataaggcactatggtaaaataaaaaccgtgattatcgcaaggataaccacggcacgaaacgaattggcttgaatatacgtgctatatattacttcgtttcatactcattataacagataaaagttacgatggcttttcatagtggttacattcataaatttttaaaacccacgtttaccagaataaaacatctcaccagagtttagattacatagtagaaaggaagcatctcaacatggtaaaaattgcagtcctatctgacgttcacggtaacgctactgcactcgaagcagtcttagcagacgcccagaaacaacacgttgacgaatactggacagtaggcgacatgaccgtttgcgggccagaatcggagcgctgtctcaccttactagaccgcgttcaccccaccgcctacgttctcggaaatcacgaggaaaactaccaaaaagtaatggcagccaatcccaacacgtttactaaacccaaacaaattatggcaacggttctcaccgcttttgatcggcgccagctgagttcgacacactttgaacggttactgaacttaccaatgacagtcatcaaacacgtcggcccgttaaccatccgtctccaacacgttttaccgaccgtcgctagtggacacgcgctcgcaccaactgccagtcaggccaactttgaccaagccgctgaaggcgatgtcgatatcgtcatctacgcgcacacgcaccagcccatcatgcgctacgcaaccacgggacagttgattctaaacgccgggacagttggtcttccgactgccattaatccccacctaacgccaaccacgagcaaactacttgcttctgacaattgatgagactggcctccagcatgctgattaccgcgccgtagatttcgagtggcagcgtgctatcacgattgcgcaaaatacccacttaccctacttcgaattctatgaacaaactttgcagactaatacttaccaatatgcaccgagtgcggtcgctgcttataatacgcaacatgacatggcccgagaagcgcgcaagattttacttgaaaatcgtcactgaaaatctcctaagaatcggtagaaaatagtttcatttttctaaaaattctgtatacttttaaaagtcgattactgcttcggcagtcaatcgctgttcaagagaggagctagaattatgtactttaaaaaagcgaccctcgatgatctcgatacgatcatcgacattctgagtgacggccgtaatcaacttgctgaagctggggtcaaccagtggcaaggcgactacccgtctcgcaaacaaatcacggccgacatcatgcaaggatcagcatacttattcaatgccgacgacaacgcaacggtcggcgctgtcgctgtcgtgccttcaccagacgaaacttacgatactgcgaaggccgaatggttaaataccacggcaccttacgtcgtgattcaccgagtcgcgattcattctagccatgcaggtcatggttatgccactcaattattcgaaaaaatcattgctcatattgctgcggatcatcctgaaatcaagagcatccgtatcgatactcatgccgacaatcaagcgatgcaacatctgattgcaaagatgaacttcaagcgagttggcgaaatggtcggtgtataccatgtcgatgacgtttgctacgtctatgaaaaaatgctctaattaatctgagaacctgaccacttgtggcaggttctttttttacgatcaaatccaatcagtcatgctaaatgactactcgtttgcggcagttgtcacagctaagtccttttgctcagcaaatacacaacgagtggctgtttgattcttataaccggcgcactagttgcagcccgattaagacaagcttggcttcatttttgtaacaaagtcgccagtgctgcataccgtttgcgccagtccaaaatagttagcgactcacagggttgcgttaatagccaatccaactgtgcttgccggtcaggctgatctaagaagacataactccgcggcgtaacaaagttttcaaactgacgacgtaactgtgccaacggaatgttaggtaaggttgtaaaagccgtaatcggtaacgccaatccggctttagcgccttcaaaataagccgcggtggttgtgggcgcgtcatgctgtaacaatgcgcccacaagcgctaattgttcaggcacgagttgcagaccctgatcacaacgcaaaaagagttgaattcccccattatcccccgttgtatagacaaatgcttgaaacggacgtgcaaaaaaacgccgacgatattccagaatcttggtgccattgataatcgcttgtgttggttctggatgcaacgaaaataataatgttggccgctttggcaagtaataatctttaatcgttggcatggtgccacccctccttcactaattagcactaagtataccccatttgcgagcgtgcgccaactaatcgtgattcgtgaaaacacgaactataaatagttaacaaacaatattattctgactttgtcctaaatttgctggatttaaaccctaatcagtcgtatattattcgtataaacaaaaaaggcggtattaatatgcattggttggcggatctattggcagcaatcggggtcgttttaaacgggatcccacaaggaattatggcgatgagtctcggttttgcggtctttccgactgcattttcattcggattagttggtttaatcaacggcgtggctagttcagttgcaccggtttcatttcaagcggaatccctcgcactagtcgggcacctgggacacgatttacgcgaacggtcgtcgattatctttttaggtgcgagtctgatgttcgtgattggcttgaccggtactctgccgctcatcgttcatagtctgggcaatcagcttatggcagcgatgatggcaggagttggcctgatgttggctaaaatcgcgttgcaaatggcgcacgaacaaccccaatttgggtggctgtcaatcggcttggcgggtgtgacttatttgatcagtaaagatttagtatggacaattgccgtttcagtgattggaaccagctgttacgcagcgacgacacattatcgcgtcgcactaccggaacatgtgacgacccgcaaattacaatttgtcaggccacagttcagttttaaaatcctgcgaggtgctctgagtctagcttgtcttaatatcggtgctaacctctcgtacggcttaattactggccaaatgacgggacaacaccccaacccggtcaatctaaatctactgactagtagtcaggcattagcagacctgggaactagccttctgggtggtgcgccagtagaaacgattatttccgcgacagccagcgcgcctgaaccagtaatcgcgggtatcctaatgatgttgatcatgatgctgattctattactgggatggctgccaaagctgggaaaagttgtgcctagcactgcaatcgccggttttttgtttatcttagggaccattgtcattttcccggaaaatgcaaccaccgctttgcacggctcgttaagtacggttgcaggcgtaacgctcgtcgtgaccgcccttgtcgatccattcgcggggctaatgaccggggcactcctaaaatttggtttaccattaattggattggggttataaatatgcaaacttatcagttaacattaggatcgctgacacggcagttaccattgattcgattaaatgccacgactagcatcgcctctttcgttctattgggcgacgctgagctgaccgactatgctgcccgtcagctcagtcaacggctaactaccactaaatttgattatttagtcacgatggaaagtaagggcattccgctagcccaggcactaagccaggccacaaaccaccctcgctttatcgttttacgtaagaatcgtaaggattacatgcagcacccgcttatcgaaccggtaagcgcaattacgaccagcaccccacaacagctagttttagatggtactgacgccgcactaatcaatcataagcgcgttatcattatcgacgacgtcattagcagtgggggctcgttgacagctgccaacgccctcctacaccaagctggcgcccaagtggtcaagcagatggcaattttagcagaaggcgccgccagcgaacgaacagatatcgattttttggcaccgttaccattatttgactagctgcggttcagaaacacattacaactcactagcgagtcacaaagcagaacaagcaccatggacttaaaccaactacttcagttatcaccgagtgcaacgagcaagttttagatggatggattcgttttaaagacctaccataatatgaaaagccctatgttagcatgatttatgctaatacagggcttttcgatgcttacgagactatttctacgttcatattcatgcaatgctaatattgtaaatttattctttgcaattggaaagttcacccaaaaatcattttgcctattttcgcatgattctaagaatacaaaaaagccgttatatcaacgatataacgacttcttaaaggtacttagagcttcctgaaaacctcttagtaccggcgatcggggtcgaaccgatactccctcaacgggaactggattttgagtccagcgcgtctgccaattccgccacgccggcaaaataataactagatggaacataaatctgatcaggattataaccttttcaggaaaggcggtaaccggatttgaaccggtgatgaaggttttgcagacctctgccttaccacttggctataccgccatcatttattgcccaaacccaactgggttagctggattcgaaccagcgcatgatggagtcaaagtccattgccttaccacttggctataacccaatcaaagggcggtaggtgggaatcgaacccacgcgtgccggagccacaatccggtgcgttaaccacttcgccactaccgccatcatggcagggatagtaggagttgaacccacaccgacggttttggagaccgttgttctaccattaaactatatccctataaagaatggaggggagtggattcgaaccaccgaacccgaaggagcggatttacagtccgccgcgtttagccagacttcgctacccctccataaatggcgcgggacggaatcgaaccgccgacacatggagcttcaatccattgctctaccgactgagctaccgagccatatcattcttcatgatggagtctattaaattattgatgagtaactctcatcagatggaggatacagggctcgaacctgtgaccctctgcttgtaaggcagacgctctcccaactgagctaatcctccataatgacccctacgggattcgaacccatgttactgccgtgaaagggcagtgtcttaaaccacttgaccaaggggtcatatttattatatctaactaacggagagtaagggattcgaacccttgaaacaggtataacccgtttacagcatttccaatgctgctccttcagccactcggacaactctccatggcttaccgtagataactccgacaggcgggctcgaa

SEQ ID NO: 53 - DNA, 21647 bp, Lactobacillus plantarum
  misc_feature (16857)..(16857): n is a, c, g, or t
ccggaggtcggaataggacacgtacatgctgacgaacgagtatccggggtcaattgccggcacctttcaacaacaattgatgaaaaacacggccataaaaaatgcccgactagttgactagtcggacgtatgggttaatcgaaaaattctttatataacgcaataacggcttgatcggcatcattgtcgtgtacaccgaacataatagaaatttcggaggcgccttgattgaccatgattaatttaatattgtcgttggctaatgcggtggcggcacgtgacatgatgccgacgcggttgcgcatgttttcgccaacgagcattaagattgagtagtcgtgcgtaaagtaaatttcatcgggattgatggccgctgagatttctgcaactaacgttttctctaattcgggcgtcaactgatgttcatcaaagatgatggtcaaatcatcgatcccagatggcatgtgttcataactaatatgatgattttctaaaatcgttagaattttacggcccagcccaacttctttgttgagcagatacttacgtaagtatagtgaacaaaaactagaagaactggcaatcccagtcaccgggtagtggggattgggttcgcgagttgactgaatcaaagttcccggggcctcgggatggttcgtattcttgacgttgacggtaatgttgccttcgattgctggaatcaacgcttcgtcgtgaaagacagaaaagccagcgtaagaaagttcgcgcatctcagtaaacgtcatttcactaatggccgctggttttgcgaccaaactaggattgaccgcgtaaattgcatcgacatcggtaaagttttcataacgttcagcatggacaccccgagcgatgattgcgccagtaatgtcggagccaccgcgtgaaaaggtacaaatttggccgttacgattgtaggcgaaaaatccggggataactaggatttgttcgctgttggcccacttagcgagctggtcataactactcttgataatctgagcatcatcaggaacgtccgtaacgaccattcccgcatctttagggtcaaggtagcgagcgttgaggccgctttgttgaaaaacagcggcgaccagttgcgcattgagacgttcgccgtgcgctttgaaagctgccatcaagtaggtgttgtcggcgtatgattgttttggtaagttgcgaattgtttcaaaaatcggagtcaattgtgcttcgggaacgttaaacccgtgaccgatttctgcataacggtcaatgatagctgcggtaacggcttgcgtatcttgatgatggatcgtttgacgggcatattgaataagtaaatcagtgactttggtgtcgccatcgaaccgtttaccaggtgccgatacaatcacatatttacgtttttgatcagcctcaacgatcgcgaggactttttgcagttgctgactactagcaagggaactgccaccaaatttaattactttcacattaaccgctccttaattttatcaataatgaaaagaatagcagacaaatcgcgacttggcaatgttaattgccactcacgagaatttaatttaatcgtgaaaataatcattttggcgaccataatctgaaaataaaaaaaacaataggacggaaagttgcgtcaatccggcctttcgcttattatttattacatatgcaaggaggaaacatgttgcaaactcagttagcaaaaggggtccaattgacgacggttcagagtcatcaatttaaaaccaaccagattattatcaattttcgggcaccgcttgcacgtgaaacaattactcagcggtcgctactatcgaatttattagaaacaagttctcgtgattatccagatcagcgagcgttagccaacgcattggctgttatgtatggtgctgcgtttggtgcgggtgttagtcgtaagggaccaacgcataacttgcaattagccatcaccgttgcgaatgaacggtatttggcaacggatcagccactgacaaatcaggccatccagtttttacaacaagtcgttttacagccgctagtggcggacggtcagtttgatcaagcgacgtttgaccgccaaaaaaagaatttggaagcggcgattatgtcggtcgctgatgataagcaatattatgctgcacagcagttaaatacggcgttgtttgcggacgaacctgcgcaacaagtgccaagttacggtacggcgagtgatttggcagccctcactgcggaaggtttgtacgactattatcaaatgatgatccaaaatgatcaaatcgatattatcgtgacgggtgacgttgatgaggcggccgttttagctcagtggcaacaagctggttttgaggatcgactgacggggcgcccacggccattttatcaacatcataatacaaaccagtacgtcgaagtgagtgaacaacaggcactcagccaagcaaagctaaatttaggttatgatttgccagtcttttatcgtggcaatcattattacgcggccttggttttcaacgaactatttggtgggtcaccgctgtctaaattgtttatgaatgtacgtgaaaaggcgagtctggcttactatgccagcagctcattggatactttccgtggggtgcttaaggtgcaagctgggattgatggcaaaaatcatgaccaagtgttagcaattattgcggcccaattaacggcgattcaagccggtgattttacggatgatttagttgaacagctgaagctgggcttgatcaacgattttgagtccagtttggatagtcaacggacattcgctgtgcaagccttgatcgatgatttaacgcaacaacgcgttacggatactgaatggctacggcagattcaaagtgtgacgcgtgaacagatcattgcagtcgcgaagatggtgacccttaataatgggttcttcttgagtggggtaaccgcatgaaagtaaaaaaatatgatcaatttaatgaaagttgttatcaagctcagttggataatgggctgacggtgacgttgttacctaaggccggttatcacaaaacgtacgcaacgtttacaacgaactatggctcgatcgacaatacctttgttccagccggaagtactgaaatgcaacgcttcccagatggaattgcccactttctggaacataaaatgtttgagaaggctgaccatgatgcgtttcaaatttttggtcagtacggggcgagcgcgaacgccttcactagcttcacgaagacgagctatttgttctcagctacccggcacctgcaggacaacctcatgaccctcttagattttgttcaagatccgtattttacgccagcgacagttgacaaggagaagggcattattgggcaagagattgagatgtacgatgatgatccaagttggcgcctgtatttcggaatgattggtaatctatatccgaaccacccactacaatatgatattgcggggacgactgagtcgattgctaagataacggctgatgacttgtacgccgcttatcggacgttctatcatcctgagaacatgacgttatttgtggttggtaattttgatccagacgaagtgttagggtggattacgactaatcaagcaactaaaaaatttgctgcctttcaaccgattgaacgtaagattcctgaaaccgcaacggatggacatgacattattccttatcggacgattgatatgccagtcaatcgggccaaatcaatcgttggtgtcaaaggcttgctgccgattgaagcgggggctgctgctttgaagtaccgtgcagcggttaacgttttattagaattattgtttggcgatacgtcagcagattatttgcgattatatgatcagggtatcatcgatgatacgtttggttatgatttcgaattacagtctggatttaattttgtcacttttagtggtgaaacggatgatccagcccagtttgatgcagccatcattgatgtgctagaaaactggcggacggctgtagttggtcaggaagcagcactcgcattagtcaagaaggaaatgattgggcgggtcgtcttcatggcgaactccttggaggcaatcgcgaaccggtatgatcaacggctattcgggacggcgacaatctttgatgaaccgggtataattgatcagttgacccttgcagacttgcagacggttgctgaacaattattgacttctcaggcaatcagtgaataccagattcgaccacaagcaaagagttaaggaaatctgaaatttaatggtcatggggctgctaaatttagttgctgtgatatactattaaccgtaagattttgaaaatagacttagggtggagaaaaagtcaatgagtgaaaataacgaagaaacaacaacgattggggcgcgcttaaaggctgcccggacagcgaaaggcctcacaattgatgatttgcaacaaatcaccaagattcagaaacgctatttgattgcaatcgaagatgaacagttcgataaacttcccggtgatttttacgttcgggcgtttgttaagcaatatgcggaaacagtcgatttagatggtaacgcgttgttagaagaatatcgagaccaattaccgagtgttcatactgaaaccatcgttgaaaatgttgatgaagttcaacctacccgggttgctagtcgcgaacaacctgcttcaccagcgagccgcgtgcgtaactatttaccaacgatcatcgtcactgccattgtggttttgattttgttatttatttggtttatggcggttcgcacgcacgctggttcaagctctagcacgagtgcggacagttcttctgtacaagtttcgagttctaagaagcaatcgagttcgtcgaaagctagttcatcagcaaagtctagttctaaagcgtcttctgccaaggaacaaacaatcaaggctaacggcagtagcgatacggcttatactttgacaaatggtgcggataagaacaaagtggtcatcaagtctactaaggctgcttggacttccgttacgactaacggtactcagacttggcaaggaacgctaaaggcggatggctcacatacattaacgttaccaagtaatgctacgacggttaagttccagtttgggaacgcaactgccacgaccgtaacaatcaatggtaaggcgttcaattttaatccgaagaacagtacgtcacaagttcggacgattaccttgaccatcaaataacgttgcggaggaggcgggtactttgaatttacctaataaattaacggtgtttcggattattctgattccagttttcattcttattatggtgttaccccttagttggggacaggttgtgtgggctggaacaacaattccagtcacccaagtggttgcaactgtcatttttgcggttgcgtcattaactgacttagcggacggcaagattgcccggggtcaacacttggttacgaattttgggaagtttgcggatccactggcagataagatgttagtaatgaccgcgttcatcatcttagttcggttaaatgcggcccctgattgggtcgttgccattatcatgtgtcgtgaactcgcggtaacggggttacgattattgattgttgaaaataatggtaaagtgatggctgctgctatgcccgggaagattaagacaacgacacaaatgattgccatcatcttcctgctgctgaacaatgtcttatttgcggcaatccacattccatttgcggcaattatgttatatatctgcttattcttcgttatttattctggcattgattattttgttcagaatcgtgacgtgtttgcagatggcttcaaataaaattaatcatgagcgtctcaccgagtcttgcattcggtgagacgtttttgtataccattaacgtgttgcccttattaattaatcatgactcctgtcagtcgataattttaacgatgagtcgcgttggcaggttatgtcaaatgaaggtatttgaaaatgctaatctttttaatggggtcgatcgtcattttcgtatatacttaatgtaggacgataatcatcgcgcccacactgagtgtaatcgataggattacggggaggcatatatggcatgcaagcagaaataatcgcggttggtaccgagattttactgggtcagattacgaacacgaacagtacgtacatcgcacgtggattggccgaattaggaattgatagctattatcaaacggtggttggtgataatcggcaacgtttgtcgaccgtcattgaaattgcggcccagcggaatgacttagttattttaacgggtggtttggggccgaccaaggatgacttgacgaagcagacgctcgcgcattatttgaatgttgccttggttgaagatcaggcagcaatgcaaaaaattacggcctggtttgccactaatgacaaagtaatgacggccaacaaccgattacaggcattgtatccggcaggcgcgcaaccgttgactaatcataacggaatggctgttggtgcgttttatcagtcagaaaatagtgctgatttcttgttattgccaggtccaccccgtgagttagccgtaatgtttgattctgaggcaaaaccgaaattggcagctgcatatggggaacaagcccaaatctattcgcgagtgatgcgtttttatggcatcagtgagtctgaattggcgacccggttgcaacccttgattgatgaacagcaggcggttacgattgcaccctatgccaagactaacgaggttaccctcagattaagtgcccaagctatgacggaaacggctgcaaggggaatgatcgacaaagttgaccaccagatcaaggctaccattgggccgtacttttacggttatggagacgataactcgttagttactactgttattaatcaaatgattgcggctaagctgagtattacagccgctgaaagcttaacagctgggctgtttcagagtaccatcggcagtgtgtccggggtctccgcaatctttccgggcggctttgtaacgtatgcgaatgaggccaaacatcagctagtgaacgttccacaagcaattattgacgcagagggcgtggtttcagaagcgaccgctaaggccatggcgagtggtgctaagcagcagctaaatactgatgttggtatcagttttacaggcgttgccggtccaggaaccttggaaggtcaaccggctggaacggtatggattggtcttgcttaccgtgatcgacccgtgaaggccaagcagtaccattttgctggtaatcgacaacaaattcgggaacgcagtgtgatggccgggttagacctattgagacatgcattgaatgaagatacggacttaaaaaaataatacgaacttttgttcgctttttgcttgcaattctaactttgaacagctatgatattaagagttagaaacgagcaccaaaggaggaaataatttggctgatgcacggaaagcagcactagatactgccctgaaaaagatcgaaaagaatttcggtaaaggggcgattatgcggatgggtgacgctgcccagacgactatttcaacgatttcaagtggatcgttggccttagatgacgcgttgggtgtcggcggctacccacgtggtcggatcgtggaaatctacggtcctgaaagttcaggtaaaacgaccgtggcactacatgcggttgctgaagttcaaaagcagggtggtacggcggcctatatcgatgctgaaaacgcactagaccccgtttatgcggaacacctaggggtcaacattgatgacctgttactttcgcaaccagatactggtgaacaagggcttgaaattgcagatgccttagtttccagtggtgcggtcgatattttagttgttgactcggtggcggccttagtgccacgtgccgaaattgaaggtgaaatgggtgacgcacacgttgggttacaagcgcggctgatgtcacaagcgctccggaagttatcagggacattgaacaaaaccaagacaatcgcgttatttatcaatcaaattcgtgaaaaagttggtgtgatgtttggtaatcctgaaacgactcctggtggtcgggccttgaaattttacgccacgattcgtttggaagtacggcgggcagaacagatcaaggaaggaaccaatattattggtaaccgtgtccggatcaaagtcgttaagaacaaggttgcaccgccatttaagcgtgccgaagtggatatcatgtatggtcaaggtatctcacaaactggtgaaattgttgatatggctgctgaaaaggatattgttaagaagagtggttcttggtattcatatggtgacgatcgcattggtcaaggccgtgaaaatgccaagaagtatttggacgagcatcctgatgtcatgacggagattcgccaaaaggttcgtgatgcatatggtatggatgcaactggtgaagaaacgtctgaaactgatgatcaggccaaagaagctaaggataagggaactgctaagaatggcagtaagggtcaaagtaagtccactaaagcgacaccagcggaaactgctctcgatctcggcgaccaaccaaccgaaaaatagacagtttgttatgcaacgcccaaaatatttattttgggcgttttttgtacatacttagcttgtttgcacgacaaaagtagcctgcagagagcggttgccataagactttaagttgacactattcgtttctaacattagaataacaagtgtgtaaataatcaaaatataacatctgaaaatttgtagttgattttatgttaactggattttggtggtgcggaggtggaaacatgaatgttttcggtataatcctcgcagtcatcgcaattgttgtcggttatgggattggttactatgtacgcaagaacgtccatgaaaaagaattggacgttgccaggaacacagccgaaggtattatttctgaggccaaacgggcagcggagactcataagaaagaaaaagtccttgaagctaaggaagagagtcatcgctaccgggctgaagttgaaacggagttaaagcaacgtcggaatgaagttcaaaagcaagaagaccggttgcttcaacgtgaagaaactttagatcacaaagagaatacttttgaaaagcgcgaggatgctttaggtaaaaaagaagataagattgccaatgagcaaaaacgcgttgaacaacagcaacaaagtgcagcttcactaatcacgcaacgtcaagctgagttagaacgggtcgccgccttgtcgcaagaacaagctcgcgatcagattttgacccaaacgcgcgaacaattaacgcatgaacgggccgtgttaattaaagaaaatacggacgaagtgaaagcgcagtctgaaaaagaagccaaaaacttaattgtccaagcgattcagcaaagtgctgccgatatggtttctgaaaccacggtttcggtcgtttctttgccgaatgacgacatgaaaggccggattattggtcgggaaggtcgtaacatccgaacgttggaaacgctgacgggaattgatttaattattgatgacacgccagaagccgtcgttttaagtggttacgatccgattcgtcgtgaaatcgcaaagatcgcgcttgaaaagctgattcaagatgggcggattcatccagctcgaattgaagaaatggttgaaaaagcgcgtaaggaaatggacgaaaagatccgtgaaactggtgaacaagctgtctttgatttaggattgcacgggatgcatcctgacttgatcaagcttgttggtcggctgaattatcggaccagttatggtcaaaatgttttgaatcactcaattgaagttgcgaagttagcgggcgttttagccgctgaacttggtgaagatgttacactcgcgaaacgcgcaggattattacacgatattggtaaggccgtcgatcatgaggtcgaaggttcccacgttgaaattggcgtggaattaacaacgaagtacaaagagagccccgtcgtgattaacacgattgcctcccatcatggtgatgtggaagctaagtcgattatcgcggtgttggttgcgacgtctgattcaatttcagccgcccggccaggtgctcggagtgagtcgctggagaattatattcatcggctcgagaagctggaagcgatcgctaataatgaggatggcgtcaagaagagctatgcgattcaagctggtcgtgaaattcgagtcatcgttaagccaaacgagatttctgatttacaggcaacggttttggcgcacgatgtcaaaaagcagattgaaaatgaacttgaatatcccggtcatattaaggttacggttattcgggaagttcgagcagtggattacgctaaataaccgggaaatgagtttaggtcttgacctaagctcatttttttagttgccagcagaattcaatcacgttttcaaggctaaataatgctaaaataattggtataacgttaaaacaagggagcaatctatgcgaattctatttgttggggatgtcatgggcaatgtcggccaaacggcggtcaccacgtacctacctaagttaaaacggcgctacaagccacaagttactattgttaatggggaaaatgccacccgcggccgcggcattaatcaggaagtgtataaggacatcttgactgcgggggctgatgtcattacgatgggcaaccacacctgggataataatgaaatttttgattttattaatggtgctaagaagttgattcgaccgttgaattttccgccagcgacgactccgggggttggttatacgatcgtgaaggtcaatacggtgaagttggccgtgattaatcttcaaggaaacgtctttatggggcaaaatttagcggatccttttacgactgtccaaccattggtcgagcaattgcgggaagagacacctaacatcttcatcgactttcacgctgaaacgacaagtgaaaaagaagccatggcgtggtatttggatggtcaggtgagtgcggtagttggcacccatacccatgtgcagacgagtgatgaacgcgtattgccaaatgggacggcctttttaagtgacgttggttttacgggtccgtataatggtattttaggaatgacccgtgagaatgttattcagcgtttcttggaacaaatgccgacccgtttcaacgtgcaagaggatagtccggcagtgttgtcgggttgtgtgatcgacgttgatggtcagagtggtcgggcgaaaaagattgcccggattttgattaatccggaccacccatattttgatgactaagatttacgatagaaagtaggattaagcgtgccacagaaaacaaaagatacaccgatgatgcgtcaatattttgcagttaaaaatcaatatcccgatgcgtttttattttaccgacttggtgatttttatgaaatgttttttgatgacgcgattaaaggtgctcagttattagagttgaccttaacgacgcggaatcattcggcggaaaaccccataccgatgtgtggggttccccatcgagccgtgcaaaattatattgatattttagtagataaaggttacaaagtcgctatttgtgaacagatggaagatcccaaattagccaagggcatggtcaaacgcgaagtgattcagctcgtgacacctggtacgacgttggaacggggcgcggaacaagctaagacgaacaattacttgactgcgctgattcagcgtgatcaacaatatggttttgcgtacgccgacttgtcgactggggaactaaaaacgagtgtcttaacgactaacgataccctaattaacgagttgaccagcttgcaaactaaagaaattgtggtcgacgactctgttgctagcgatttgcgcgatcaaattaagacgctaggaattctaatttcagaacagaataacgtcaccccccaggctgaattgagctacttgactcaggacttgacggtcgatttggaacaacaggtcgtggaacggttattgatgtatattacggtgactcaaaagcggagcctcgcgcacttacaaaaggcgatcgcttatgagccgtcatacttcctgaaactcgatcataattccaagtataatctggaattaatgaagtccatccgaactggtaaaaagcaaggaactctcctgtggctattagatgaaactaagacggcgatgggcggacgactattaaagcagtggatcgaccggccattgattgtgaaggccgatattgaaacgcgtcaaaataaggttgcgacgttattagatcattattttgaacgtagtaacttacaagaagagttgactaaagtttatgacttggagcgtttagctggccgggtggcttttggtagcgtgaatgggcgtgacttagtgcaactcaagacatccttgcgtcagattccaaagattcggtatatcttatcggaattagatacgcaggtatttaatgatgaagttaatcagctggatccagtcgaagacgttgcggatttgattgacgcggcaatcgttgaagacgcgcctttgtcagtaacggacggtggtgtgatcaaggatggttataacgagcaactcgatcaatatcgggatgctatgaataatgggaaaaaatggattgctgagttggaagcccaggaacgggcgacaaccggtatcaagaatcttaagatagggtttaaccgggttttcggctattatattgaagtcacgaaggccaacttggcccaattaccgaaggaccgctatgaacgtaagcaaacgttaacgaatgctgaacgctttagtactcctgaactgaaatcgcatgaaagcctgattttagaagctgagagccattctacggatcttgagtatcaactcttcacaaaggttcgtgaaacggttaaaaaggcaattcagcggctacaaacattggcgaaggcggtcgcagcaattgatgtcttgcaaagtttcgccgtcgttagtgaagattaccactttgttcgaccgaaattaactaaatcacatgatttgaagatcgttgatggtcgtcatccggtcgttgaaaaagtgatgggtaaccagagttacgtcccaaataacgtgacaatgtcacctgatgagacggtccttttgattactggtcctaacatgtccggtaaaagtacgtacatgcgtcaattagcattgacggtcatcatggcgcaaattggttgttttgtaccggctaaatcagcgcaacttccaatttttgaccaaatttttacacgtatcggtgccacggatgacttaatttccggtcaaagtacgtttatggtggagatgcaggaagccaataatgccttgcaacatgcgacagccaatagtctagtgttgtttgacgagattggccgggggacggcgacttacgatggcatggcgcttgcccaagcaattattgagtttgtgcataaccatattcatgccaagacactgttctcgacgcattatcatgagttgaccgcgttagatcaagaattatccgggttacgaaacgtgcatgtgggtgcgactgaacaggatggcgagctcgtcttcttgcataaagttgagcccggggccgccgataagtcctacggggtgcacgttgccaagttggctgggatgccaacgagtttattggaacgggccaataagattttaacgagtttggaaaatcaaacgagtacggtatcgacgacagcggcttcaatgccggttgaggccgccgatgagtcacagccagtagaatcggagaccccggttgccgaagctccggtcgctgaagccggtgatgaacagctgtcgttatttgctgagccggcggtgacggatgcgaagggtgaaaaggttttacaacagctgaagacgttgaacttgatggcgatgactccgatggatgtaatgaaccagctgtataaatggcaacaaaaattagacaagtaggcgcattttaactcatcataaatgagcgcaataagctgttatgatgggctattggtgcgtctgacggacaggtaggtcgacactagtcagttattgctagttgtggtaatcgaaaatgttcgtgcaggacacgagcttaattattttatgtgaaaggaccgatggaaatgggaaaaattcatgagttatcttctgtgctggccgaccagattgctgccggcgaagttgtggagcggcccgcctcggtcgttaaagaactggttgaaaatgctgttgatgcgcacgcgacgcaggttgatattttggtgcaagagtcgggtgttcagtcaattcgggttatcgatgacggtgacggtattgatgacgctgaagtcctgaccgcttttaaacggcatgcgacgagtaagatcacatcacgtgaagatttgtttcgcgtccattctttaggttttcgcggtgaggcgttgccaagtattgcgtcagtagcggacgtggtgatgaatacgagtaccggcgccactgggacgagtattcattatcgcggcggtaagctattacaacaatcgcccgctccgttgcggcaagggacggacattaccgtcaccgatttgttttttaatacacctgcgcgactaaaatatttgaagtccccccaaacggaattagcgaatattttagacgtggttaaccgcatcgcacttagctatccagcggtggcatttcggttagttcataatgcgaaagagctattaaaaacggctggtcgcggtgacttacaacaagtcattgctggtatttacggtgtccaaaatgcgcgcaagatggttgccattcaaggatcgaccactgattttaaattgagtggctttgtggctttacctgagctgacgcgggccagtcgccagtatattactgttctgattaatggtcgtgctatcaagaaccagcaattgaccaaagccgtcatcaaaggttacggttctaagttgatggtcggccgttatccaatcgcggtgatcgctttaacaatggatcctttattggtggacgtcaatgttcatcccacgaaacaagaagtccgtttgagtaaggaaccagaattagccaaactggtcagcaccacgattacggaccagttagtggatgtgaacttgattccgtcagcattgaccaatcttggcagccatcggcgtgaacatctaaatacagaccagctggcgatggatttgaacgccgtttcgtcacagtatcaagtagcggataagacaacgccggcatcgactgagcagtttgcagcctcgctggcagcggcaaccatgcagcccagctcggcaacgaccatggtaagtactacttcagcacagccatcagcggtaaaccgtgcagcagttagtgcggttgttccgtcagaatcagcggcaagttctgccaacccgccgattatgattagccatcgcgacgaactgacagctactccagttcaagcatttgaccagcgttaccagtcagaatcaggcgctttaccctttggtgaaactgctgaaccgttagaaaccagcacggctgcaagcgcgccgactagtgaagcgccggatacggaacgttttccacagttacgctatcttggtcagatgcacgggacttatctgttagctgaggcggatgatggtatgtacattttggatcagcatgcggcccaggagcgaatcaactatgaatattatcgccaagcgataggtgaggttagtgcggatcaacaaaatttattggttccgattattttagattacccgacgagcgatgttttaaagatcaaggaaaaattgccgttactagcagaattagggattcatctggaatcattcggcggcaacagcttcattgttcatgcccatccgacctggttcaaagctgggcaagaagaagatacgattcgtgaaatgattgattggctcttacaggatgataagttgacggtcgcccaatttcgggaaaagtcagctatcatgatgtcctgtaaacgggcaatcaaggccaatcaccatttggatgatcagcaggcccgcgcgttattagccaagttaccgacctgcgagaatccgttcaattgcccacatggccgcccggtgacggtacacttcacgaattcagacatggaacggatgttcaaacgaattcaggatagtcatgaagcacgtgattaaagtgattattggcggcgtactcgttactttagtatgattcgtaatcgatccgcattgtgcaagtaaatatttcatgaattatgattaaaacgtgccatttcttaagttcaaaagcagccagcttaagaccgctggaaaaagttcggactagcgtagacttgcttggtgtgtgcgccttacaccgacttccaggcatttctgccaattgccggaacgtggtgggcacagatttgagccgaaaaaccacgtctcaaatactggcctttcactaaccaagcacagaacgcttgctaagtgaactttcaccactgggcattgtcaaaaacgccttccagtcgggatagtattcgaatggcagacggtgaggtacccaacttttgatgaattggtcgttgcttttcataaacggtaattttgtcaatcaactgtcagactaaaaataatattgagatggctcactaatcctgaatcggtgtagtaggatttaatctcttgacagagtgcttaatgcacctagcgctttgtttaaacttccagcatcaaaatagtcagcgactaattgtaccaaattaggtggtcgttcatcagccattcgagcggtttcccgaccggaggggctgggtgacaatgctcagtagccaaattattcttagntccagtcgggatagcgttcgaatggctgacaaggatatacccaacttttgctgaatttgtcgttgtttttcataaacgttaattttatcaatcaactgtcagattgaaaaggtcttgtgataactcactatttctgaattaccgtagtaataattgaatatttcgaaaaagtggagaaggcactctgatatttaacttaaagggttcagtatcaaaatagccaacgacaaattgtactgagttcagtggccgttcatcagccattcgagcggcttaccgactggaggggctgggtgacaatgctcagtagccaaattattcttagtcggaagtgggttgcttccggcttagaataagactcgtatttgagaccgggcgggttgtgcacgggctcaaatcgacgtcggcttacgttccagcaattgtcacccagccccggaggccggaatcggacacgcattgctgacgaacaggaatccatctgtttggcacgttttaatcaaggctaatgctaaatagcggctagcataacgcataacgcgtaacaagtaaaaaattagtaacgaaagtgagtgatattttggacgtgcaagaaggatacatgccatttaatggttatcagacgtattatcgaatcgtaggggatcggcaatcaaataagacaccgttagttttgctacatggtggtccaggatcaacgcataattactttgaaggatttgatgacctggccgttcaaacgggacgaccaatcgtcatgtatgatcaattaggctgtgggcgttcatcgatacctgatgacgatcaattatggcaagccgcaacgtgggtggcagagttacaggcgttacgtacgtatttagacttacccgagattcacttactagggcagtcctggggtggtatgctagctattatttatggttgtgactatcgaccacaggggattaaaagtttgattttagccagtaccttgtcttcagcccgactgtgggctcaggaacagcatcggatgattcggttaatgtccccagcggatcagtcggctattgcgacagcagaacggttacaggatttcacaggtgctgcctacctgactgctaatcaacattttatgacgcaacatgcgtcgggcccgattactgctgatgatcctgaatttctacggcgatcaaaacgggtggggaccacggcttataatgtagcgtggggtcccaatgaatataatccgactggtacgttagcggattatgagtataccgaccgattacagtatttgcagatgccaactttagtcaccagtggaacggatgatttgtgtacgccattagtcgctaagaccatggtcgaccagttacctcatgcgacttggacgttatttccccgtagccgtcacatggcgtttatcgatgaaaccacggcctatatgacgcgattgcgtcactggctagcagcccatgattagagaaatgagcgtaatcatttcccgggaaatgatttgctgaatagctagattgagaagtttatcggtgtgatctgattttgtttggctgtcactataatggttattaaaaggtttaaagtagacaaaagcgcctgtggaagttagccttctgcgggcgctttggtgattgctgtgatgatgtttaatgttgatagataaagacgaatcgattagccgtcgagcgcttctcgtcaaattgataatcgggatggtcaaatgtgcgaatggccgtcacatcatcgatttgatgttcagccaaaaaacggaccatggccccacgtgccatcttagctaatgtggctttagtcttgagtttgccgtcgataaagcttgcaaagacaatatcaatcattgattgatgcggagccagataaggtgcaatggtcttagcatattcttgagaagcaagattgataattggttctggccgcggagtcagtgcctgatagaggcggtcgccccaaaacgcatagaggttcttggcttgaccaacagccaaccgtgcttgcatttctaaccgataaggaacgataccatcaaacggtcggagaatgccgtaaaagcctgacaagattcgtaagtttgcctgaatatagtcaagggctggctgggtaaagacgtccggggccatgtaacggtactgaataccgctgtaactgagaatagcgggagtcagattgcgggtcaggtcaattttttgaagccaatcataattaggttgggctagtttgtcactgcaatgccataaggtcttggcctcaggataggtgaggtgttgcagttgagccagtaattgttgcgtctgatcaagatagattggttcagttagggctggaaaggcatcttggtcgataatcatttttttcgcaggtgcaatgatgattttcataaggtcactactttcgaagcgttcagtttataaataatgttgatagcatttaaagcaaaaactaagctatagaaatatgatagcacattagacaaacgtacgttcctaaaactatcaattgcggtataatgaaattatgatactaattgagtaaaaggagtttgtcggtatggatatttcactattaaaacaagtggttcaatcaactaataagattgccctcagcacggccgtcaataatgaagcagatgttaaaattgttaactttgtctggtacgaagcacaaccagatacgctatacttctcatcagttaagacaagtcccgctttgaaggtttatgaccagaatccggatattgcattcattacgattcctaatgatggaacagcgggcaatccatatctacgagcccaacacgttaagttacaacggtcaactaagacgatgaccgacttgctaccccaatatttagaaacagttccgaattatcaacaagtctgggatgctattggatcgacactcgttgtttttgaattaaaactaactgatctttttgttgacgcgggtgttggtggcgagaagcaaacactgacttttaattaacactggattcctatactaaaagcgtttcaaggccggcttaggttaagctatggtcttgaaacgctttttggtcgggtaattttaggagcaactatgaggtgttacttcacatatgcggtccgataattggcggcaccgctgaaattattatagatgacgccctttaagtgcgacttaacgagcagatgggaacggccttcgtagagtggggtcacggcctgatcagttagcgccgttttagcggcttgaactaagtcttgatagcgcttggtcgcgttcaaagcatctggaccatcagcggcttgcattgcctggtcgtaagccttgctttgatagtggcccatgttggagttactgtcgccagtcaaaattgttaatgattgtgaagggtcggcaaaatccatactccagctagttaaattaagctggaaggttcccttggaaactttacctagcattgcggtaaatggcattgccttgattgttacctttagtccggggaggtgactggtcaattgtccctggatgaattcagcgacctgatgtgagttgtcatcatcaccacaagtaatcgttaacgttagcgattttttgcccaattgttgttgtgctttatgataagcggctcgagcctggttgagatgataattaacagtaccatcaacggtcgcatcattgacaaaatcggtaccagttttaggattcttagccatattgcgtacaccaaagcttttggctggaagcgaaccattttctagaactttgttggtcagttgcgaccggttgattgctaaggataaagcggtgcggagttcacggttggctgctacatggtcatggtgattgtattgaataaagctgatttgaccacccgcaagtgttttgagttcttgattatttttattctggacactctgctcgccattaagtgtcacactatctaacttattagattgatataaattataggcagtcgtattggacttaataacctgataattgatttggtgcagtttcaccagtttgtgatcgtaataagctggatttttctttaaggtccacgtattattagtcccggtccagccagtaagcgtaaatggcccgttgtagacggtcgtcgcggctgaagtcccgtacttcttcccgtatttgttaacagcattttgattgaccggataaaaggtcgaaacagctaaaatctttttaaagtaggcgacgggtttgcttaacgtgattgttaattgatagtcaccattagctttgacaccaagggttgatggctttttcttgccggctgcaatggcgtcggcatttttaatgtttgtgaagacataggtgaattcagatttattttttggatcaagagttcgtctccatgaatagacaaaatcgtgagcggtcaccttgttaccgttactccagcgcgcatcgtggcgtaattgaatggtataggtatgaccaccattggtgacagttgtcttagtagccaaagcgttgacgggttggctctgactgttcagccgatagagcccctcgtcaacttgggtgacttggctattagaaacgctgtccgtcattttagcgggatctaagctcataatttctgagccagctgatagattgataacttgtgattgtttagtcgtagctgggtgcgagtgggcgttgacggtaaacccgatgccgccaataatagccacgctgccgattgttaaaattaatttgtgtgttccggataaactcataattaaatcctccaaaaatataattgtattggtagattgtaaaattaa

SEQ ID NO: 54 - DNA, 25207 bp, Lactobacillus plantarum
acaagatattttacgctctcagtaaagtggatagctttctacatcagcagtaattccaattattgcataatggtgatctaagttctccaccttacgaaatactagtggatattttctaggcgtaatcgtaaccatttcattgtatgaaatttcataatcgaaatttctaccgaagtaattattataagattgataagttatggcagtacacataaatagtaatcctcctcgaaaataatatttagatttgataagccaataagcttacatctttttagtataatatcattgctgaaaaaataaagtttttttcatgaaatcatctctaaaataatttaatctattccaaacactttaagagtcaataatcaattgtaacccttatagccgatataacaatgctgttatacctacttatccttatctcgtgatttcttcaatagcctttgcaaccccatcatgttcattatcgacagttatttcatcagccacttgcttcacttcaggaatagcgttgcccatcgctactccatgtcctgcaaacttaatcatgctcaaatcattagcttcatcaccaattgccatcacattggcagcagtcaaacttaacttttcacagagtacttgcaaagcgttgcccttactaacaccattagtgttggcctcgtaataaaatggtgtacttttcgtgaaagtaacctgctttttcaacggttcaaatagtttttgctgtttaatggcagcgtctaaaacttcgggttcatcaacgtacatcgatttaatcagtttaatattccgcatctcttctggcgtccgatatgagatacccattgaaacgagattagcttcatagagtgtataatcaccaatattacggtcggccgtatacagccgatcctcagataccgcgtgaaaatgcaagcgtaacttacgtgctagggcttccaagtcaatataatcttcataactaatcggtcgttcatcaatcagttcgccactagttgtgtaggttgcagcaccgccaaaacaaacaacgtattgatcatcttgagcatcgagttccaactcctgcaacaatgctttaacacctgttaatggccgtcccgtgcagataaccactttaatcttcttttccttcgccattttaatcgcttgcttgactcgcaatgtcacctgcttttttgaattaactagtgtgccatcgatatcaatcgcaatcatcttaatattttccatcatagccatcctcattctttatcgaacacgaaatagaaaccgagcaacgccccgtttctatttcttcaataattattttaatttcagataagtattcacaacattagttacattaaagccatacttatcaagtaccaagtcaccaggtgccgaagtgccgaagcgatccacacctatcttagcaccatgatcgccagcatactgatcccagccaaatgttgatccagcttcaattgtcacccttcttgtgaccgcactcggaagcacactagcgcgatattttggtgattgttgcgcaaaccgatcaaagctcggaattgaaacgaccgcgacatcttgattatgctttgctaactgggctttggcctccaatgctaagttaacttcagaaccagtcgcaattagtaaaccatctggtatttctttttgagcagcactgaccacatagccacccttttcaacgccagcaaaggccgtatcaactgatacaggtaatgtcttcaaggcttgtcgactcaataccagaacggttggtttatcagttgttttcagtgcttgctcccacgcagctgaagtctcattaccatcagctggccgaatcacttgtacgttcggcatgcatcgtaaactagctaattgttcaatcggttcgtgggtcggcccatcctcgccgaccgcaattgaatcatgcgttaagacgtagataaccggtgcgtgttgtagtgcggacaaccggactgccgcacgtaagtaatcagtgaagacaaagaatgttcccccgaatacccgagtgccgccatgtaatacaattccgttcatcgcagccgccatgccaaattcacgtacaccaaaccagatattacgaccatcgtaggattctggctgaaagtctgatgtttccgcaatcattgttttgttcgaactcgacaaatcggctgcgccaccccataagctaggtattactttggcagcagcgttaatcgccttagcgcttgccgcccgactagccaatgcatctgttaattgatagtgcggtaaagtagatttcaagtcatcagaaaattgtccgttgaacgcttgcttaaaagactgcgcctgatctggatacttcgcctcatattcttcaaatagccgtttccattgctgctcagcacgcgcaccattttcctgaatagttacttcaaaccggtctgaaacagctgacggcacttcaaaatccgagtaattccagccatatactttttcagctgctttaatgccatccgcaccaattgggttaccatgaacagcattagtcccttgtttaggtgcgccataaccaatcaccgttttcacttcaatcaaagaaggacggtcagttgtcttttttgcaagttcgattgccgcgtcaattgcatcaagatcattcccatcttcaaccaccagatgctgccagccataagcagtgaacctgtcaccaacattttcagtaaacgcttgcgacgtcttaccatctaatgaaatgccgttcgaatcgtaaagtgcaattaactttcccagcttaagatgcccagctagtgaaccagcttcgtgcgaaattccttccattaagtcgccatcaccgacaattgtataagtgtaatgatcaacaattggaaaattaggtcggttatattgggcagctagatgtgcctccgccattgccattccaacggccataccgaagccttgtcccaacggaccagtagttacttcaacgccatcggtatgtccatactctggatgccccggagtccgactgtcccactgccgaaaatgcttgagatcatcaatcgaaacatcatacccggctaaatgtaacaggctgtataacatagctgaaccatgtccagctgaaagaatgaaacgatcacgattaacccaattcatatgtgtttgtgggttgacttttagatgttttgtccataacacataggccattggtgcggctcccatcggtaaccctggatgtccggaatttgctttttgaattgcttcgatacttaacgtccgaatagtattaacacccagctcgtcaactttatcaaacattatacttacctcctaagctgctattatgattacttttgcgttgcttgaaatgctttccaatccgaagcaaaactggccaaacctttgtccgttaatggatgagaccataacttaccgaaaactgcggctggaattgtggcaatatcagcgccagccaacgcagcttcttgaacatgttgtggcccccgaacactggcagcgataatttccgtcttgaatccataagtatccaaaacttgacgtaaatccttaactagctgaattccattgccaccaatatcatcaagacgtcctaagaatggtgaaatgtaagtagcaccggcctttgccgctaataagccttgcgaaactgagaatacaaggatcacatttgttttaatgccctcaccacttaatactttgaccgccttaagtccttcttcagtcatcggaatcttcaccacaatatttgaagcccacttaacttcattgcgagcctgggcaatcatctcttcggccttggttgccgttacctcagcggatactggacctgatacaatctgcgtaatttctttgataacggtttcaaaatcacgaccttcacgtgacaccaacgttggatttgttgttaccccatctactaaaccaagttccgcgaaatgtttaatatcttcagtattcgcagtatctaagaaaaatttcatgattagatttatctcctttattattagttttcgtaaattattgaaagtagtactcataattactgattacttagttccatcagtcatacgtttagcacgccgggtaagaaaaatactgcaaagaatcacaataattgtaaacaagataattcctgtaataactgctacacttccgtaactccctaattttcctaacaagattcctggaaccaaatagtcggtatctgcaaacgttgaagctgctaatttcaagcttcccaaaactggtaaaataaacaatggcaaccaactaatcaacaaactatttactgtagcgccaatgattgcaccacgccgaccaccagtagaattaccataaattgctgctgcagcaccacagaagaagtgccccactacacctggaataataacagtagttcctagcgcaatcatgataaacatacttagcgtcccaacaatgaaactgacaaagaatcctaataaaactgcatttggtgcgtatgggaaaataattggaacgtctaatgcaggcttagaattaggaaccaacttggtcgcaataccttgaaaagctggcacaatttcggccaaaatcatccgaacaccttgtaaaacaaccacgaaaccggcagcaaatgttcctgcttgtactaatgcataaacaatataattagtcccaccactcagtttcgattcaatgtaagctggacctgtcacaatcgccaaaataatgtagacaatactcatcaaaatcgtaattgaaactgtcgaatcacgcagaaagcccaaactcttagggatttctagatcctctgtagacttttctgcattaccaaaccatttacccatcaatcctgagagcgcatagccaatgttacccgtgtgtcccatagcaacatcatcgccacccgtgattttacgcataaatggttgtgtcaatgctggtgttaccgttaataatgtcccttcaaatagaccaccaagtacaatcgtttgccaacccgtgccaatgttagcgcttaccaatataactgcagttaaacaagaaacatataacattgcttgccctgtcaagaagatatacttaaagcgagtaaaacgagctaataaaatattaacaatcatcccaactaacataattagtgctgttgttgagccgtatttaaccagggcaattgcaacaactgcttcattactaggaacaactccttgcacatgtaacgcaaacttaaacatggaagcaaagggtgacaatgcattttgaagaattccggcaccaccagttaagactaagaaaccggcaaaggtcttaatagttccttgaacaacttccgtacttttctttttttgaagtagtagccctaacatcgcaattagcgctactaaaatagacggttgggtcacaataccaacaaataagttcaaaacagtcttcatgtgattctcctccttttcagcggctaatcatgttcaatattttcttgatccagaattgtattgacatggttccggacttcttgcttatcaatcaagctttttagtaacacaaccttattctcaggaatacttcctaatgcactttgaagcgttgattcaacaaagaagtaatctgctgaatcagcgccaacgctcccaacatcagaatgatccacttggatatcttctttaacattctcgtcctttaaaatactctgaatgttcatctgaaccataaaactacttcccagaccactttgacatacagctaaaaatttcataatagtatcctcctatttttgtaattcttgctcatgtgcaataacttctaaaatatcaacttcactagttgcatttaacatagctgtcaccgccgactcatcggttaacaactccattaactctttaataacggctaaatggctgttattatctaccgcggccaatacgaaccataaattgatggggtgttcatcattgactagactaatgctatgatttgtttttaagatagataatccgatttcatggacgttacccgctggtctagaatgtgcgagtgcgatttgtggtccgatattgatgtacgggccttctgattccaccacattgagcatttccttgatgtatccatcttcaatcgtcttattattaatcaatggttccgcagctaattcaattgcttgcttccaatctagccctgtgccttctgatacttgcacagtctgtttattcaataaatccaacagcatttttattcatcctcctttcttgatatcgctatttatctgacaatgaccagtataaacttgaataatagcgccacaagtgcaacaatgtttttgagaatagtgcaactttggcactttggtaccttaatgctttaattttttagtagacttaatacagggaggatactgaattgcgtgtaaatttcagcaaacgaaaacatggtaatgaattattagaaattctattaacgtcatcgggctacaccacagctaacttcttacaacaacatctacatatctcacgtcgtagcctattctatctaataaataaagtaaacgatgagcttgatcagcatgcagaatttccgattactaatgttaaaaaactaggatattaccttccaactgacacgatcaaatttctgcataaaatgacagaaaaagaaacttctagcaagatcatgaccaacaatgctaagcaacgccaactactaattgcatttagtatcctcaacactagtggttgctcgttagcggacctaacttaccaatttaatatttctaagaacacagttattagagatatcaaagtactacactcacaactagcgctatatcatttacaaatcaccaatacagaatccggtaaaataatcacgggttccccgacagcagttcgcaaatgggtgtacgatcatgctactcaactgaagacactcattgaacaaactaggcgggctaccattaagcccactaccataaacgaccagattaaactctttgaaagaataactggaaaatatttaaccgacgatgcaagtatcacaattcgactatttttatattggtacttaactaacattagagactgtaataaccaactaagtgatgttatatccgcacaaactgacttaacactggatcacatttgggctaaaagttttttgaacgattatcatatcgataactctaatgaggttgactacttagtcaagttgatcaattctagtcaatttgctcatgtcaattggaatgacgacttgattcaaaagttaaaaccattctcagttcgaatgatttctagttttacccacctctccggcgcacatgtttcaatcaagtcgattagtgacagtttaacggttcacttgctttcaacctactatcgtgctcaatataatatgccatttgaataccccgacttaaaaagtattcaacagcattatcaccacacttttgaaatcactcgtaaagttgtcgtaccatttgaacaatatattcatcacacactttctgatgatgaaatcgcattaattgccatttactttggtggtgctattcgtgagcaaaaaacaagcaccccaacacaaaatgaagtacttgtcgtttgttctagtggcatcggtaccagtcgtctattacttcaacaactagaaagccgttaccgcggtattcatttttctagtccaatgaatgtgcttcaatacgaaaactcagatctaagtaatgttcagcttgtcatcagtacaatcaaattaaacacccagcgcaacataccaataactaccgtatctgcttttccttccgagttggagtggaagatcatcgataatgctattattaaggctgggttggcaacttctgacacactcaagttatttaatgtggatacactattggatattgtaggcaactacgctatgataagaaatcctatgggtctgaaactcgcactcaacgactatttgacccagctaactcaggaaccactattagccgcaccccaagaaaatttatcagaattaatcaaactactgccgccagaacatgttggttttctaaatcatcaaaaatcttggaagcaggcggtgcgtacagcactgtcccccctacttgaagactatagtgttgaaaaaaattatatcgatcagatcattcatttaactgaaagtaacggaccatacatggttattgggtcaggcgttatgttggcgcacgctgctccacgtgatggcgttaataatctcggtgctactttctttttacttgataagccgctacctgttatgacaaatcaaaaaatggtccatgtaattattggtctagcccccatagattacgagaagcatctatcattcatcagtgacttgatgacacaattacaacaaaaggattggttaactaatctgtatcatttgaataataaaagggacttattcagatatttgtataaagataactagctcgtcttcatttcatttattaatgtatctaaaagcagaagccaagaaacgaaagttgctatcttggcctctgcttttagagttaaaaaggattttttattattaaataatgcgctctttccagtctaatctcatttacttactgaactattccaacgatatcattcggggtcttagcttgatatttcgcattattaaaatcgacattcggtaatgctccccatttagcaactacaaaatcaacgcctgcattctttgaagcctgcatatcaaagatactatcaccaacatacaacgtcctttcacgtgctaagttaaatctctctaatgtgtaggtaatcggctctccacttggctttggatttttagttaaatcagcagtagtcacaattggcatctttgcgataatcggaaaatgactgacttctttatcaaattgaacacgatccttagatgtaaccactcccactgtgagattcattgccaataaatcatctaacatttgttcaactcccacaaaatacgttatttcattcatattctcgttaaattcaattagatatctggctaatacattctgccaattttgaacaccaaattctctcaggatcatctcaccgggctggccaattctcttacgatattcttcaattggcatatcaacaccctcgcgaactgccccctccttcaataacttagcaattaagtctgctgaattaatcaaggtattatcaatatcgaacaagatattttgatacttcataaagaacccccctgctcccaaaaaagagcaccaagacaaatatctcagcgctctaaattaaggaggttataattttaatattctgtcattcaactacaattagtttagtctgctaaatctggatcatcaggattagaggcaatcataactttgagctctttaccggccatcattgcatcaaaagcgtcacgccagtgttcaagatcaaagaccttcgtaatcattgcatcttggttaatagcacccttgctttcaagatgtaaagcaatcgcccaatcataagggttttgtgaccgtgagccacgatacgtaatttcatgctgaataattgaacgttcatctaattcattcatcggctttgcaaaaagaccaacctgttggaaagttccacccttacggatcaatggtaatgcagagttaaccgctggtgttgcacctgaacagtcataaaccttggtaacaccaacgccatctgtcgcatccatcacgaccttggccaagtcttctttttgggtatctacaataatgtcagcacctaactttttagcaatttgtaaacgatcagcatccttagtgatcccagaaacaataacaaaggcaccaatttctttggcaatctgcaatgagagtagccccattggtcctggtcccataattaataaagtgtcatgtaacgtgaatggtgtcttttgatacatagcatgaacacaagatgctaaaggttccgacattgcagccatcttgtaggaaacgttatctggtaaaatgtgagcactttcctcacgagttagaacataatttgccattgaaccattagctttagttccgattcctacacggttaggacataaattatattctttatcttggcagtaaacacatgtgccatccgttgcaaaagtcgtttcactagtcacccgatcgccaggctttagcgttttaacatctggtcccacttcaacaacttcacctgaaaattcatggcccaaaacaagtggtgtcaccgcattggcatactgacccttaaatgtatgaatatcagtaccgcagatcccagtgtaggccacttttaataaaactttgtctcctgttacttcagggattggaatttgcttcagttccatattgtcgtaaccagattccgtcttaacgacagcctccatagttttagcgccctttaattcgtcagttttagttgtttttacagtatccataatccattttcctttctacggataatcctttaattaaataatggttgtactaactgtgatagtttcaaaattaaccagttcaagatgttaccacccgtatccaagttagtgacctctgatgcgccttttggaaaggcaacaataccgtgcatcattgatgtcaacgttggcccaaagtcagttgccatcaacaatgcaaataccattacgatagtagcagagagtacagagtggacgatatttcctttacgactaggaacaatcaaggcagcaaagaacggaattgttgctaaatcaccgaatggcaatacccggttaccaggtaaaataatggctaagaataacgtaattggtaccattaatagtccagttgccaaagtagctggtgacccggttgaaagagcagcatccattcctaagtaaatcttccggttcccgtacttctcttgaagtaacttttgagcaccttcttgaattggaattaacccttccattaagatcttaaccatacgcggcattaagaacatcacaccacccatggacattccaagcttcaaaatgttcggtacgctgtaaccacctaaggcagctagtaacatcccaatgacaatccccatgaccatgggttcaccaaagaccccaaaccgtttttgaattgtttgtggatccacatcccattttctgattccaggaattttgctgacaacccatccaattggaataccaagtaggccataagccgcagcagaaccagttggaaagctaatgccatccaagccataaaactcagcgacttttggcgcagttttatcagcaataattaagacagcgatttcatagataatcccgcaaagaattgcaaaccaccagtttttcgtcaccacataagccgtagccgcggccgcaatcatatgccagtaattccaaatatcgatatcaagtgttttagtaagatttaacaaaattaagccaacgttaacgactaaaataattggaatcatgatagctgagatcggctgtgcccatgtcccagcagaaacggcaggccatccagcatcaataatcgttaaatgaaacccaaaccgtttaaccatcgcctgcgcagcaggaccaacactagttgtcaacaaattgatgactaggttaatcccaatcataccgataccaacagtaatcccagatgtgagtgccttacccggtttaaccctaaagattaacccaacaataaagataataatgggaagcataacgctggggccgacattaatgatgctttgtacaacatcagataatactttcataatgcatcctcctgcttaaaaccctagctcttaattattgtgcttgaatttcgcgtgctttagtcaagatttcatcctgcaatttatcaacaccaagaccagttaaaaagcccattgctttaatcgctggaatcttatattcagttggtagtacagttgttgaaatcaacatatccgcgtcatcctgcttagaagcagcttcagcaatcttaatttgaatcaaattagcgtcaatattattttcggcaaacaaatcttcaacttttttcataacaaccgttgaagtggcaattccggcaccgcaagctactaatacatttaattttttcataataatctctcctcgtatttcttctatttatcttttatttgcttaacaactgatgaatttggttaaagttctcggcattttccaatgaatttactaatgaatcatcttgaataattcccattaatgcttgcagcatctctaactgagcatgtggtttattcagaccaagcacaaaaactaattttgcatcaaccttttgctctggatcatccatccgactaaaagcaattggagcatcattaacaaccacggcaacaaattctttgttgattgtatccgcgtcagtatgtggaattgcaacacctcgatgttccagttgcaagccagttggaaaagttgattctcgcttgattattttcggtaaaaattgatcagttacaaacccattttcctgtgccttcgcgttaatcgctgtaaataattccttcgacgttttaaaagaggtgtgtagaaaaataagttggtctctcaaataatcacttacttcaacaaggttctcactcaaaataagacgctcccttcgtatttatataaatgtaatcgctttcaacagtttaaattgtatcattttgcaaatcttttgcaatacttttctttaaaaaagtttttaacacccgtttgcaaagagtgctttgcaacgacataagcgttcgcaaaagcaagttaattatctcacaaagttcgacatagcgctctattaagcgcttacatgtaaaggatttagatagagatttcaatcactttacaaaattagattgcaaacaattgccaaatatgtgctatgattactaccgaaaaataaattttatttttacaaggaggccacctcatatggaagttatgcagcgtcaaaagtatattttagatcaattaaaccaacgtggtaccattagaatcgctgaaattagcaaggaaattaatgtttctcgtgagactatccgtaaagatatttacaaccttgataaacaaggactagtgcaggcaattcgcggtggtgctactaccccgcaaagtgtcaacgagacaaagtatggtaagcgtagacacgaagcagttgctgaaaaaaatgaaattgccaccaatgcactacgcttaattcatgatggggagtcaatttttcttgattacggtacaactgcttttcaaatcgccgaagaaattaaacatagccatctaaccaatctaaccgttatcactaactctactttcgttctcaactcgctacagtttgttaaaaatattcaaattgtactcttgggcggaacaatgcggactagtgaaggttctttgtccgggccaatcacacttgccaatatcaataatatctatgccgacattggtttctttggctgtggcggcgtcaaccttcaagcaggaatcaccaaccactatatagaagaagtggaagtttccaaaaagatgatgtctcattgtcgaatgaaagttatcttagctgatcacactaaattcgaaaaaaatgcactttacaagacagccgacgttaatgatgtggatgttatcatcaccgatgaacaattggacactcagattgccaaacaaattcgcttagccgacatctcattaattagtggcaaataaaaaaagacgattgggggaaaaccatgcccctaaccgtctttcttacttttaaatgccaggttcttaaattattttgccaatttcaccttgactttatgattgaaaccgttatcataataaccgtaatgataaataaaacaaaagtttgcaaaggagttgcaaaataatgagtgaagcaattaaatccaaaacagttgattattcttctgatgactatctaaaacgcgtcgatgcctattggcgcgctgctaactacatctcagttggtcaactctatctattaaataatccgttacttcgggaaccattaaaggcgaccgatgtaaaagtccatccaatcggtcattggggcacaattgccggccaaaactttatttatgcccatttgaaccgtgctattaacaagtatgggctcaacatgttctacatcgaaggtcctggtcatggtggccaagtaatggtttctaactcctacttagatggtacttatacggaaacgtatcctaaaatcacccaagacaaggccggaatgaagcgcttattcaagcaattctcattcccaggtggtgttgcctcccacgccgaccctaagacaccaggctcaatccacgaaggtggcgaacttggctactcaatcttgcatggtgctggtgcggtcttagataaccctggtttaattgctgctactgttgttggtgatggtgaatctgaaactggcccattggcaacttcttggcaagttaacaagttcctcaacccaattacagacgggacagtcttaccaatcttgaacttaaacggcttcaagatttctaacccaacagttctttcacgtgaatcacatgaagaacttgaagactactttaaaggtctaggctgggatccacactttgttgaaggtacagaccctgccaagatgcacaaaatcatggctgaagaattggataaagtcattgaagaaatccacgcaattcgtaagaacgccaaggataacaatgatgaatctcgtcctaagtggccaatgattgttttccgggcacctaagggctggaccggtcctaagagttgggacggcgaaccaattgaaggttcattccgggctcaccaaattccaattcctgtcgatcgcaatcacatggaacacgccgacaaattagttgactggctcaaatcatacaaaccagaagaattatttgatgaaaatggtactttaaaaccagaaattgccgcaatcatccctgaaggccaagctcgtatggctgctaatcccgtcactaacggcggcaagttaactaaagacttaattacaccaaatatcgatgattatgctttggacaacaaggatcacggtaaggaagacggttcagacatgactgaacttggtaagtatatccgtgatttaatcgaattaaacaaagataacaagaacttccgcggttggggtcctgatgaaactttatctaacaaattaggagctgcgtttgaagataccaagcgtcaatggatggaaccaatccacgaacctaacgatgctttgttagcacctcaaggccggattattgactccatgttgtcagaacatatggatgaaggcatgttggaagcttacaacttaactggtcgttacggcttctttgcaagttatgaatcattcctacgcgttgtggattcaatgttaacccaacatttcaagtggttacggaattctcacgaagaaacaccttggcgggttgatgtcccttcattaaacgtgattgcatcatcaactgccttccagcaagatcacaatggttactctcaccaagatccaggtatcatctcacacttggctgaaaagaagaccgaatatgttcgggcctatctcccaggtgacgctaacaccttgattgcaacttttgataaggcgatccaaagtaaacaattgattaacttgatcatcgccagcaagcatccccgtccacaatggtttacgatggacgaagctaagcatttagttcgtgatggcttaggtgtggttgattgggcaagtactgataatggtgaagaacccgacgttgtcttcgcaactgccggctctgaaccaacgactgaaagtttagcggccgtatcaatcttgcacgctcgcttccctgaaatgaagattcgcttcattaacgttgtcgatcttctgaagttgaagaaggacgacccacggggcttatcagatgctgaatttgatgccttcttcactaaagacaagccagttatctttgcataccatgcttacgatgacttagtaaagaccatcttcttcgaccgtcataaccataacttacacgttcatggctaccgcgaagaaggcgacattaccacgccattcgacatgcgtgttcgcaacgaactcgatcgtttccacttagttaaagctgccttattagcaacgccagcctatgccgaaaaaggtgcccatgtcatccaagagatgaacagcatcttaaacaagcatcatgactatatccgtgctgaaggtactgatcttccagaagttgaaaactggaaatggactgcattgaagtagaacgataaccatgtctaaatcgtattcataagaaatgaaagaagctataccaacagttgtgttggtatagcttctttcatttctgatctatttctatttggcaaaaactatgctattgtagcgttaacataaggaaaccatgatgggagccaaatctatgagtattgtaactactgtcgaggagtcgtatccgacactctcacgacaagaacgcaaagtcgccttaaaggtcattcaagagccgaaagaagtccaaaaaatgacgatttctagtctggctaagaacgttcacgttagtaatgcgaccattacccgttttgtcaaaaaaatgggctgtgaaaacttttacgccttcaaaattcaattagccgaagggccagttgtccctgcaacaaccactgacaaaaaagataccgttgcggaccaggtctatagttactacaagaaaatactgagtggaacgtgggaacgattatcccccgacgatctccatgccgccgttaatttaatctccaaggctcgccgagtctatctgtacggtctgggtagctcgggctataccgcacaagagatgacccagcgcttaattcgaatggggattgccgctttctcgatgaccgacacccatatcatgtacatcagcggtggcatcatgcaacctggtgatattatcttggccatttctcttactggtgctacagcagaagtcaacgactcagttgcgttagccaaaaagaagcaagccaaagttattgccattacgtctgatgaacgcagtcgcttagcagaactaagtgatcttacgattctcgtaaaaaacagcaaattcgtcaacaactcgcgctttgttaactcgcaatttgccataacctacgctcttgatattatcgccgccatgctattagagaatgcgaagtatcgtgatcgaatgaatcatacgatcgatttaattacagataataaattcggtaaacgctaaaaaactaccatcaagatttcagctaatcttgatggtagtttttccgatttatctctgagcaatttgtgggtatcgctgcaatatgtcaacttcagttcgattaagtgcatggtcagcgcacaggataatcgctgcactatctagattgtgatgataaaagtgactatttttgacagtaaacaaaatgctatactgattcgctagccgcatatagcgccccatgatatccatatctaattgaccgttcaacaaaagctgatagtctcttggttgccgcaataccggcactagtactgacgtaaagtcatacctcagagcctgcttaaatgaaatttgaagttcaactcgttcgtaaaaggtccctaaataacggtgttgttcatctggatgtagatccggtacaccaaacattccattttgcaaacgagtacccaatacttcctcattatcttgcattcgtcactcctatttaaagtccacttgcgtcaaatctaacatttcactcaaccaacttagcactaacggaacccagttcgccgcacgtggctcaatatcttctgggtaattatatcgactagtttcaactgtactcaagcacagaccgtgttttccatgtgtaaatgtatgaatatcatactcgacatgatgcctagctagtgcttctgcgtacaataaactattcattgttggcactaccgcatccgcacaagtattccataaaaacgttggcggtgtctgatcagtaactaggttctgactagcccaatattgttcatctggactaattttaaaggcctcttctcgacttttcggaaaacctgccgccaagtcgataaccgggtaacctaagacctgcaagcgtgacgtcaatgggctatcaccaaagccgtgagttttgaggtactcggtgttattccccatcgcgttagttaatgctgcgacgtgactgcccgccgagaagcccatcaaaatcgtcttattcgcatcaccataatgtggtggtccttgagttttagcatactttaaggcagtcaaaccgacatcaattgcgttgggataaactggcccgcgatccaatagattgtattccactaccattgtctgatagccctgtgcactaaaagccaaagcaatcggttctgcttcacgctctgtcatttgaataaatccactgcccggaaaaattagaaggattggccatctccgaggatcataatccattttaagttggtctttccaatagcaggttaatttaaattcaaaatgttgcggcgtcattaatctcaattgctcatatttcattttcacacccccctaaatttcagtactattcttgctagcatataatgtacgtaaccagcccaatgccattggaaaccagttttgaacccgtgggaccacatcttcagggtgatgatagcgagaatcagctaaatcaccaaatgccaatccgtggacaccggctgcatagatatggctctcaaatggaacattatgctcacctagcgctgctaaatagaccagactattcacaactggaacaagctcatcagtccgcgttgcccaaatgaaagtcggcggtgtttgactcgtgactaactcttgcgcatgccagtaagattcatccgtagtcacagccatcatctcatgatgactagttggaaaacccattgtcagatcaatcaccggatagcttaaaatttgcgcaaatggtactagctttgtctcttcaaagccatgattatttaagaattctgattgagcgccaagcgctgtcatcacggctaccaaatgtccacccgccgaaaagccactgacaacaacgtgatcagaatcagcattcaactcctgcgcatgccgtttaacgtagcttaatgccgctaatccaatcgtggcagctgttggataaaacgggccatccgacgtaagattatacttcactacggccgcctggtaaccctttgcaataaatttaagtgctacagcttcaacttcccgctcagagtagcccgcaaagccaccgccaggaaaaatcaacgctaatggccactgtcgatcatccggaaatagcgtgaattgatcatgttgatagatccacatcgtaaatggctgtccttcgggcgtttttaaagctagtgtgcgtatctccatttccataacctccttaaaatctgtgtcaataacttgccttgaaacagattgagcacaaaatctcgactatcctcatgtgaagacaatcgagatttcagatttacgtctacgtcttgtcctaaacatcatgggttagactaataaccaagcgatattaatacaagatcgtcggacattttaattcttcttcacgtatgtttcattaattgttgaaacagtcaatccagtcacatcatgattaccacctgggaagagtaggctaacaacgtagctcaagacaaaagctgaaatgaaggcaacgcaagcaaccaataatgaagagatgtttaatgattgtacccagaaggacaagccgacacttaacactagtccggttaacaccccaaccgtattagcacgcttcgtaaagatcccaacagcgaagattccggcaattggcacaccaaagataccagtgaccgacaagaataagttccaaatctgtgaagcgttacccatcaacagataaatcgcaacggctaatcctaacacgcctgcaatgataatgattccccgagccaaggtaacatcattactatttttgaacttatcgttaaagaaacgttgtttaaagtctgtaattacacacgaggagatcgcgttgagactagaagcaatcgttgattgcgcggccgcaaagattccagcaatcactaatcctgcaaccccagctggcatttgggtaatgacaaaatatggtaccaccgcactcgtattgaatcctgctggcaaggcagctgtgtgttgatagaaactgtaaagaatcgtacccattccaaaaaataatggaatggtaatcaatgctaaccagccattagtgtacatagatttattagtatctttaatcgtagctgtcgtctgataacgttgtacaacatcttgactaccagtatattgatacaaactattaaagatttgaccagctaagatcaacggcacaaacttagatagattgccaatattaaagtcgttaccagagataaacttatgattggtaacgacatcgttaaccaccgtaccgaaaccacccttgatataaaagattcctaaaacacaaattaacagagcactacctagaagcaagaatccttgaataacatcgctccaaataactccttcaatcccccctaagaatgtatagagaatgcaaaggccaccgacaacacaggcaattagaattggattgatgtttgaaaccgatgtaatagcaataatcggtaaatagatgacaatggccacccggctgatatgataaagtacgaacagcaaactactaatggcccgcatgactgggctaaaccgttcttccaagtattcataagctgtcgttactttcaatttgcggaaaaatggaatgtagaatttaactaaaattggaataataattagaatcgaaaaacttccgatagcgtatgcccagtcactcaaaaatgcttgttctggagttgacataaaggtaattgcgcttaaagtagttgcgtaaatactgaaccccgccgcccaagcaggaatatgcccttctgctttgaaaaatgaatccgtgtttttactagcttttctggtaaaataagctccgacacctagcattgccaataagtatgctcctaagacaacccaattcagaactccaaatccaactttactcatgatttcgcctcgcttgttttatttaaactaatatgtgatacagctcgtttaccatgttgaataaatgttttaagcattgatggcgcaataagtgtcgccataacagtcaccacaatcattgccgtatagtgattatgatcgattaagcccgccgagacagcgacattcgcgacaaccagtgccatctcacctcttgaaaccattccggcgcccacaatattggcctcattccaggtcaatccaaacaatttaccgccaatggcaccaccaatttgcttgcctaaaatcgcaagcactagtaacaatccgataaaaactagatcgttttgcattcccttaaaggtaatttcaagaccaatgctgacaaagaatgctggaataaagacggcatacccaattggttcaaccttagcaacaagttgcgccttaaagcgtgtttctgaaatcgctaaccccgcaatatatgcacccaagacatcgctcattcctaacttaacggctaagaacgaaaaaccaaaacagagcaccatcgccgctgtcgtaatattctcagatgcattaaccttattgaatcctctcagaaagagtgggacaaaccacttagcaagtgcgattacaacgacgaagaacagtactttcggcaaaaccattgccacaagcgattggttgtgcgcactagcagtgccaaacaggcttgtactgattcccaatagcaccacacagataatgtcgtccgctacggctgcgcctagaataattgcaccttcacgtgtatttaaataatccatttctttcaatacttgaacggtaatgcttacagaagttgcactcaaaataagcccgagaaaaattgaagtcgtcagtgagaaatcgaacattcccacacaaagtaggacggccgatgccgttggaaagatgacgcctaatgtcgcaacagttaaagctggcttccagtagcgaaaaagcaatttcaaatcgccctctagaccagcaataaacattaaaataatgaccccgatttcggcaaagtactgaataaaagtactatacgttaagatgtgaaagactgcgggtcccgctaaaattccgactaatagttccccaatcacacttggcaagttaaaggtagccgcaatatgcgcacctaactttgtcagtaataagattaaaactaattgcaaaagatagttcatattattgaacctcgctaacttaatgcttgtttaaccaaatcaatctgtcccgataaatctgcagctgcaatattatattccagaaatactgggatttcgggtgacaactgacctaatagactgtgccaatccgttgccccttgtcccaacatcaccgttgtttgatccttgatatccttcaaatgaaatacggtgattgctgacttcaatgctgcaaaggctggttcaggctgttgatcaatccaataccagtttccggaatcgaaagtgtaccctaatgacaacttttgtgacttaacccaagcaacatctgactcaaatgtcgccaaatcaccattcgcattaggttggttctcgatcgtaacttgtatgggggtagttgctaacagctgagttagcgcttccaagtcatgtgcttgcaatgttggttgcacaccaaagctatacttcaatgatttgatatgatatttggttgccagttctagatttgtcactagacttgcgttatagccatcactgctaaacagttcctctggaaccgaataatagagatcccagtgttgttcctcacaaagctgactgattgctaacagttccgccgatcgcgtctcgggtttgaagaattcaccgcgaacttcaactgcactaacatcaaaacgagttactaatgtttttaagcactccagttgagtggctcctgcctgaacttgtgactcataaattgcggtgttaattccgatcttcatgatttagtccacccttcactaatttcaaaataaaaaaccgctacttaaaatcttgcaaacatgcttagaaaactgggctttaacactcagtaggcactgcttgcactattttttagtagcggttgaactgttcgaatgattattacgttatcaacttatcacataatacgataattgtaaacgctttctttttaaataaaaataattatcgtatcaacagccctgccatcgccccatataactgggctttatcggctaattcagccgtggtaatttttgttttaattaaatctggcggtaatagtggcttcaacgcattggtcagtaaatcgaccaaatattgtccctgtaacgatactgcaccaccaatcaagagaatgtcgggatcaaacaataataggattgatgctaatcccgtcgcaacttctgctgcccaatcattaatgatggcgacatacgggaccgtaccacgcttagcttcttcaaacgcatccttaacactcatctgatattttgctaattgatactcaagcgttaatgttgatgctcgctgttcataatttgtcttggtaaggggggcatacaatgtatagccaatcgaattggctgtcgcatgggcacccgtcataagccgaccatcttcgacatacgcaccgccaatccccgtacccagtgccacacaatatgcagaagttgcgcccttggcaccacctgctaattgttcgcctagcaaagccgcatcgacatcgttaacaacaaataccggtagaccagtttgcgccattaaagcggctttaattggtgttccctgataatctgagatcgttggccctgcgtattgaatcgcaccatctgcacccacaattcccgctgtactaacgccaatcccagctaacgaatactctgcttggtagtccctggttacacgctgtagttgctttaagatcaggccatcataattatgctcagtcaggcacttgccttcatgacttagatgtaatacttcgtcaatgagaccgtacttaatggttgttcccccgatatcaaatactaaatattgtgttgtcataattatcatccttgcattattatttggtcgaatcgttaagatgaacggcctaacaataccacaataattatttttttatcaactaaaaaagaaatttaatatcaggaaagcaacgattgcgtaagcgttttctttatataataataataattaccaaaaaagcgtgttgcaataatttttattagaagctatagtatttcctgtaagcggttgaattttgagatgattattacaaatccatcaaaaaataaattttaaggagttttatacttatgagtaaaaaactattatatgcagcacaaatgacagccttcgacaaagacggtaatattaatttagatggcatccgtgctctcgttcgctacaacattgacgtcaataaggttgatggcttgtatgtttgtggtagtactggtgaagccttcatgctgaatactgacgaaaagaaacaagtcatggagaccgtctatgatgaagcaaacggtgcgattgacttggttgcccaagttggctcactaaatctaaaagaagctaaggaactcgctaagtttgcgactgatcttggctatccgaaattatcagccgtaacgcctttctattacaactttacttttgaacaaatcaaagactactacaacgaaatccttaaagatgttgacaacaaattattaatctattccatccctgctttaactggtgttgccttaacaaccgatcaatttgcggaactctttgaaaatccaaagatcatcggaatcaagtacaccaacgcagacttttacttacttgaacgggtacgcaatgcctttccagacaaactcatcttatctggatttgacgagatgcttttgcctgcccttgcattgaatgtcgacggttgcatcggctcaacgtataacttaaatgcaccacgtgttcgtgaggaaatggacgcttttgaagctggcgatattgacaaagcacgtcaactgcaaaacatcagtaacgatatgattactgatttaattgccaacgacatttatccaacgcttaaattggtcatgaaacatatgggtgttgatgccggttacgttaagaaaccaatgagccatccaacccctgaaatggaagcaggagctacggcaatttacgaaaaatacttcaagaactaatctaatttatactagggtccgtcttaaa

SEQ ID NO: 55 - DNA, 15810 bp, Lactobacillus plantarum
acttgattataaaacgcgcgaccgaaaattgattcagaactattacgcttattggcaagctaataattcaggttattatatcgaaacttttgctgaattattgaaacaaacctttgcataatttttacttatgaatgacccttgatttctgaatggttttggcatagaaaagttggtatcatgcttgatgtaaataaagaaagcgtggtaagaatgacggataaagaaataattattaaattgtatcgtgatgaaaatattgctatggttcagaaaaacctcagtcggttaaatgaaattttggcaccaactatgaagttaacccacatgacggggtatgtgcagtctaaattagagtggattgaccaaattcaaaatgaagaaatgcaatattttgcttcaaaagaagataccatcaaagctattcaaattgaaggtaaccgggcaagtttaattggtcagaaccaagttcaggcaagaatttggggtgggggtacgcatacttggcggttgcagatgcagatgttttatgagaagaagaatggtgattgggtcattagtgcgcagaaagccagtacctactaaagcgactagtgattagtggtcagtaaaacggacgcattaggaaaatagtatttgttggcttggctagactgtcaactaaaggcaacacgcctgtgctttgtgacaattcctgaatagaatatattaagcgaaccataatacctttaatttctgatgactgtggcatataacaattatggtgattaagaccaatgttcgatattatacatctaacgctactaatgaagagaaatacacaatgatggtgttaagcttaccatcaaaagacgtgtggtgacttgatgagtattcagcatggcgattttcgctaattctcggttagccaaaatgaacgagctgttgccgcacaataattaaggtcgggataaggatgcacatctgattcttatcctgattttttgtttgccagctatatgttttaaaatgatagttgtttcattcttgattacaattctactcaaattcatattaaacaagtcctagagtccgtttgtccggccaagtttttatgctaaaatagttgaataatctaaaaaaactaacggagaattaaccatgaaatcaatcaccttacacttagtcgttgctggagcaacgtactttaatcaacttgaccggttccagggttggagcggcacgccgttgacggcgactggcgagcaggcgacggccaaggttgcgcagcagttggcgtcgacaacgtttgataccgccttcgctagtgatacgagtcgggcgattcagactgcgcgcattatcttagactcacgagcacaacccgttaagttacgaacggtagtcgcgttacgtgcgccattctatggcggttttgaaggaactgaacgcgcggcggtttggtcagggtttgcgactaagttgggttatcagagcgtggccgcttttgctgcggatcagacccccagtgagttacagacattgttgcacgatcacgatgcggatggattggcggaaagtggccaggagttctgggatcgctatcagaaggggctacaacaggttatgacggcaacgcctgatcatggtcaggtcttgttggttgtggacggcgcaacgttgcgaatgatgcattacgtcgcaactggtcgtgcggcaacgagacaggcattggcaccaagtgtggtgacaacgatggtttacactggggataagttgattgtaccggtcacggaataagttatccactgtggacaactagcggcttgcggtttatacaaaagtgcgctactgtgaaaattgagtttaaaaattttaacgaggagcttttaaaatgcaagttaatgttattacgagtacggtggccggccaagagacggtcgcaactgcggatgtgcaagctttcatggccgccatggaaaaacaattgggcgcagatttcaacttcacgttagatacagattatggtcagagtttgacggaccatagcgcggacgtttacctagtttattttggctcccaagcgaacttatccccagaacaacggtcccaaatgatcatcttctattccgatgaagatgtggctaacttaacaatcggacgttttgtggatatgctacaacagttaaacaagcagtaggcactgcgttaatcacaagttaggaagtggccccatgcaattactgattttaggtgttattgcaattgttatctttatcttagaagagtacctgtttacggctagtcgctacttttgggtcggcggtatcgttccggttttatggacggtttttttggcgtaccttgtcgtggtcaatgccatgaacttaacggtgcgcgagtatgctttagcaattattgcggtcatcattccttatgtttgttggggtaacggctatcagcggcatcaaaggcggcagtcatgaaaatccaacccctagcggcagctcaaattccacgggatttactgttattagccgatccatcttgggcacaggtcacagcgtacttatcgacaggccaatgttatggttatcaacaaaatggacaagtggtgggtgttgtcgtgttgacaacgttcaaaacaggggtgtgggaagttaaaaatattgcggtggcgcccgcctatcaacatcgcggcattgctaaggccctactagcaacggcgattgcggtctgccaagcagcgccaacctgtgatgaactgcaaattggcactggtaattcatcgttgcggcaactagcgatttatcaacacgctggttttgagatgattgcggtgtgggtcaacttttttgtggataactatccagacccgatctatgaagctggcttgcagtgtaaaagtatggtgcgattgagtatgtcaacaaccggggaggtggcacaacgtgtggaaaacgagtcatttactaattagttggttttacggtgcaatcgccgtcttcattatcatgttttttacggcccgtcaggaagtcaatcggatcgtgttagaatttaatccgttcgtcatttacagtattatttgtgcgctcgtgctgtttccaattgtgaagtatcgttggccgcgggtgtttcaagtctggcgtaaacaacccaaggaaacaccgtcaacgcgaccagacgatgagcaaatcattcaggactctggccgaccatggtcagtagcagccaagcggacaaagcccaaacccgttccaaccgcattaacgccacaagtcgaggctaagagtgacttcatggatggttttatcaacttctttaagaatattttgatggcagtgattttggttcctttaagcccgattatttgtgggtattttggggtccgggattggcgtcagcgccaaaagtagtcgaaactgataatctgttcaggaaactgatcaaatgagtggaagacttatgcagatactgttgataacgacattgagttatcaactgtggataaaagtctggttaacgaaaaaaacgaatcaacaagttgttcataactttgttgattcgttttttttgttagttttgaaaatgattgatgtattgttgccgattctgcctaatgacgccaatgatcttacatcggcaataaatgaggacaatgtaaatacaaacgagtcatttgtataataaaaaagcaagtcgcagttaacgacttgctgataaggtgttcaaatcttaaggttggtagttattaatatattgtttgcggttctgccatggccatgctttgacgaccccaatcatcttgctcttaggaacgagcccccagtaacggccatcgttagaaacgctccggtgatcaccaaggacaaagtagtaacccttcggcaccgtattgttggtcacggacttggcccagccttgatcatggctcaaactattgagtgtccaaccagtgaacttgctgtgactattagccatgaaggacccagtcgtctgttgatacttatttttgagataggtttgcttgactaatttgttgttcacgtaaagtttaccggaacttgtgtagcggaccgtatccccaggcatcccaatgacccgcttaacataaacggcgtttttgtcggtttggttcggatcgagtccgtaggcgttgaagacgacgacagaacctgctttgattttgctagtcttaaaagctacgacgcgttcgttattttgtaaattcggttgcatcgaagtcccatcgactttgaccatagtaaaccagaactgacgaatcagtaaggcgatgatcaagccaatcgcaatcgggaccacccagctcataatgcttttaaatgttttcaatggttaaaactcccttaattgtgtgtatacctctcattataaacgataatgattttttcgcagtataaaaaagcttaaaagttcaacgatactcaaaatgggggcggttgctttcgagaatgcgtgttcatggtgataattgcgtgctatgctggtgaaagtaaaatgcgattgatgggaggaactgggagtatgaaaacacagaaagaacgaatgctggcgggtgagttgtacgttgctgatgatccagaattaggacgtgaaaatcatcgtgccaaacggttagtacgggaatttaatcaaacaaccgaagcccaaccagaagaacggcaacgattgttaacggcaatgttcaacaaaattggtgacgggggctatatcgaaccgccatttcataccgactatggaagcaacacgacaattggcaagcacttttacgccaattacgatgcgatttttattgatgtgggtcggattacgattggggacaacgtctttatggggccgcgggtcggcttatatacggcgggtcaccccattgacgccgccattcgtgctgaacaactcgaatatggttggccaattacgattggacacgatgtttggtttgggggcaacgtggtcgttaatccgggtgtcacgattgggagtaatgtcgtgattgggtctggttccgtggttactcatgatatcccggataacgtggttgcggtcggcaatccttgccatgtcttacgagaaatcaccaccgctgaccatgaatattgggctcggcaacgggccgcctattttgctgatcgtgatgatgattgatagaaattaattgtactgtgttcatgtcattaaagtttggattagaaataaggccgcgatatttttaataatagacattacaccccctcagccttaaaattaacttagaaacaggataagaaagaggcggtaagcgcaatgctaaaagatgatcagatcgtgtgggcaattcaccaaatggaagcagacatcggaccagcgggaccttccctggactcgcggacgccgtttcagtatttgatttcagtaattctgagcgctcaggcgaccgacgtctcggttaacaaggtgacgccggtactgtttgagaagtatccagaaccaaaggacttgatggctgccgatgttgcggatgtggaagcaattatcaagagcgtcggattatttcataataaggctcgcaacatcattaaaacggcgcgcattgtccatgaagaattagccgatgtcgtgcctaccgatcgtaaaggcatcatggcgttaccaggtgcgggccgcaaaactgccaacgtggtattgagtgacgtttttgaacaaccgacgtttgctgtcgatacacacgtctcggcaatctcgaaacgcttgcactttgtcgctcagaccgcgacgccgttacaagttgaacaaaaaatcgtgagtgtgttggcaccggcagaattacatcaagcccatcacacgatgattgaatatgggcggaagtattcgatgaagttgacgccagacaaagaagtttgtcaattgatcattgactgtgacaagttgaatgaggaaaatgaagcgttgatctagtagcgtggggcgacagcgagcatattttagccattggtagaactgcctgtaagtcttgctagacgtgtaatcaaagccaggttacgctaaacaacctcttttccgacaggccgaagttggctgcccttgatcttaactggcagtcctatttttaacataatacgtactgacgcgagcattaagacgagtggtggtcttgatgttcgcgttttttagtttgttcacggtcgtgtttttcgatgcgtctgaaaaataggctattcagaaagtaagtaaaaccgaacataaaaacaattagcattaaaacagtcgcaatggcttgggcaatcatagttggacctcctcggataacgggtgataacactggaattatcagtgtcagtgactgttgtcattgtacgggcaatgcgaggcaaaatgcaagcggtggcttaaatgctaaccgtgaatcttgaaaatacggtatgataatagtaaccgattacatataggaggctaaattatggcatacatcgaagtgcagcaggcaacgcgccagtttaaaaatggtgagcaggtcaccgttgctaatcgtgatatttcatttgaagttgaccagggtgcggtcgttgtgattttaggtccgagtggtgcgggtaagtccacgttactcaatattttaggtggcatggacagccctacgagcggccgtgtgctggtggatggtgtggacattgcgcaatttaactcacggcaattaacgacctatcgtcggcaagcggtcgggttcgtttttcaattctacaacctggttccgaacttgacggcgcgtgaaaacgtcgagttggcgtcgcaaatcaccaaggacgcacgcgacgttgatgagacgttggccttggtaggactgacgcaccgggcagataactttccagcccagttgtccggtggtgaacaacagcgggtcgcaattgcgcgggcagttgcgaagaatcccaaattattactctgtgatgaacccactggcgcgctcgactatcagacggggaagcaagtcttacaggtgattcaagatgcggctaagcagacgcagacaacggtcatcattgtgacgcataatagtgcgattgcgcagctgggtgaccaagtcattcgtatcaatgatgctcaagtgcagtcggttgagcataatgctcatccaacgcctttggctgagattgaatggtaggtgcagcgatgacagcagcttattttaaaacaattatgcgtgagatttggtcgtcgaaagcccgttttgcttcaatattactgatcattttcttaggggttgctttttatacgggaattcgggcgaccggtccggatatgtcacaggcagctaatgattattatgcgaagcaaaagctggcgaccaatagtgtccagtcgacaatggggctgactaaggccgatacacgagtactgaatcaacaccgctcacagctcacttaccaagcgacacgctacgctgatgttaatcagttgaacaatagtcaagtcgtgcgggtgatggcgttaccgacaacccaacgactgaatcggttacggatcgttaagggacggttaccgcggcatgccaatgagatcgtgttagacgcgcaagcacagcgattgcagccgaagctaaaagtcggttcaacgtatcgaattagcagtacggctaagcgcaatgcacagttcacgcggcgaacattcaaggtcgtggggtttgtcaattcaccaacgtatgttgaaaatacgaatcgtggtgtcaccaacattggtaaagggactttggactacttggtctatgtccgtccgcaggtgattaagtccagtgtgataacgcgcattgacgtgcaattcaaaaatttgcggggcgtcaccccctacacggcgaagtatcggcgcttgaatcgcgagaacaccgcgcaactcaaacgctggttaaaaccacaagcgcgtaagcggcagcaggcattacaagcccaggcccaggctaagctgaaaccattgcggcaggcgacccagcaacttgctagtcaagtgccagcgggaacggcacaactagtcaagttacaaagccaattaaaacgcgcgcaggcccaggtcgcggccatcacaatgccgacttatttgtacactgaccgtacggataatccgggttacacagaatatcacgaaaatacgcaacgagtcgtggcactgtcgactgtctttccgctgttctttattgcgattgccgcgttaatttgtctaacgacgatgacgcggatggttgaagaattgcggctacagatggggacgttaaaggccctcgggtatacgaataccgcggtcggtagcgagtttatgatttatggtggtttagccgcgctgattgggaccgcgctaggtgtcctgttcggcgtcaattttttcccgcggtttatcgcgcaggcctatggtagtatgtataatttgcccgcaatcaaccttcaatacatttggatggacattggtatcgccttagccattgcgttgttgtgcacgttggggacggcactggtcgtgctccgcgtggatttaaacagtttacccgcgcaactcttacagccacgagcacctaaggccggtaagactttgctattagaacgctggcaatggctatggcatcggctgagttttaatcataaaatcacacttcgtaatctatttcggtataagcaacggttgctgatgaccgtgctcggtattgcgggctgcatggcaatgatgattacggggtttggcttaaaggattccattggtgatattagcgtcaagcaatttaacgaattgtggcactacgatgcagtggtgacgcgtagtgggaacgaaacggaccaacaacggcaagcacttagtcgtggtcaactttaccaggctagtttgaaattacaggccaagcaggtgacggtcaaacagtccggggtagcagaacagacggctacgctcggtatcccagcaccccaccaatcgctaagcaagttcgtggtattacggcaccgacaaagtcatcaggccattcatatcggtaatcgcggtgcggtcatcgatgaaaaattagctaagttatatggcgttcatgcgggcgatgatttaacaatcaagttggccgggcaaaccaccaagcggattcacatcagtgcggtggctgaaaattacgtcaatcactttatctatatgagtccgacttattatcgacgtgtcttcaagcaggcaccagtatataacacgaactatgtccggtttaagcaggcaacgaaaaagcaagaaaatgcttatgcggatcggctattgaaacaggcgggggttcagaacgtgacactgatgagtacagagaaagccactaattttaaaatgctggatagcatgaacttagtcgtattgatctttgtcatctcggcgggggcactagcgctagtagtgctctataacttaacgaatattaatgtttctgaacggatccgggaattgtcgacaatcaaagtgttgggcttttacgatggtgaagtgacgatgtatattttccgtgaaaatctgatattgacggttttaggcattattgccggttgtttcttgggcaactggttgcacgcatatatcttgcaaacggctgaaacgaacgcgttaatgttttcaccaacgattcatccgttgagttacgtttacgcggcattattgaccctggcctttagtttattagtcatgggaatgatgcatcgtaagttaaagcgagtcaatatgctggatgcactgaaatctgtcgattaaacgtgtctgacaacggccaacggtagccgaagtggtataattaaattgattggaacagtttaattaaggatgactaggggatgaatggcatggcagaaacggcacagttagaagctgctgtacaggcattaagcgatattgtaaaaattaatacggtaaataaccatgagcaattggtggcggattatttggtcacacttttaaagcaacatggtattgaagcacaatcaatcgagtacgctcccgggcgggtgaacttggtggccgaaattggtgatggtcacggtccagtcgtcgcgttggatggtcatgaagatacggtggcgttgggtgatgcagataaatggcacacggacccgttggcagcaactatcaaagataatcggttgtatggtcgcggtgtgacggacatgaaggctggactaatggctgaagttttcgcgatgattgcattgcacgatcaagacgtcccactccatggcacggtgcggttactcgcaactgtgggagaagaagtcgaccatttaggtgctgaacaattgacggaactcggttacgccgatgatattcaaacgttgatctgtgcggaaccaagcggtgcggacaaacagcttttactgaccaagtcgattcaagccatgttaggtgttgacgacgatacggcgcaacggatggcggatgcgaatccgacgaccgaacaacacttcatcgaattagcgcataagggttcactgacttatacgattaaagcgcaaggggtggcggcccacagttcgatgccagcgattggtcaaaacgccatcgatatgttgatgacttactatcagaaacaaaccgcctattttgacagtttcaagactatcgttaatcccgtattgggcccaaccgtacctgtcgtgacgttaattagtggtggcgaacaggtcaacaccgtcccagccagtgccgaaatgtcagtaaaaattcggacgattccagaattacggaatgaccgcttgattaatgatttggaagccatcattgctgaatgcaatgcggatggtgccaatctaacgatggacatcgcaagttcgttctacccagtgcatacgccggaagatagccagttggtccagttggcgaagaaggttggggaacaagtcttacaacagcggctcccgtactttggtgctcctggtgggacggacgcatcgtcttatattgtaaagagtcctgatatgcaagtgatcgtcttcggacccggcaatattacagcgcaccaagttaatgaatatgttgatttggatatgtatgggcgcttcatcgagatttatcaaaaaatgattacggaattgctggcttaacggaaacgttaataatcgtgaattaaattatgctggaaaaggtttcaaaaaaagtaatagtcgtttcaagaattgattcttgaaatgactattacttttttgagcaaggcgactgaacctcggtgtatctaacttaataatgattgtggtgacggttgtgcgttattcaggttattcgtgatgcccaaaccgttgcaagtaactcgaaaaatcttcgtgatcctgggtaataccagcttccttttcttcataccaattaattttgtcgttgagaatctgtagatgatgctggacttcgttgaactggacgagaaagtcttctttaacgtgcttgagcagtgctaatcgcttgggaatcgtgtcgtcgccggctgcgcgccaggtaacgtattgctgcaattcgctaatactcatacccgttcctttaagatgtaataagaatttgacccagttaatatcggcagtctcataatagcgccggccattgtctaagcgatgtggttcaatcaagcccgctttttcgtagtagcgtagtgtgggggcgctgagaccaacggctttagcgaagtcaccgattgaataacgttctgtagtagtccttaccaattttaaaattctccttattctaacttttatttgaagtaactttagcaataacaataccacgaaatcctattttagcaagtttaaactttattgttgacttaaagtgtactttaagttgtaagctgtattcatcaatcagttagcaagcaaataattaaggagtgtttttaatatgacaacaactaataatagcggcctatttggattaggtgtaaagaatgaggcctaccaacaatactttatcggtcaaagttacctgaatgccttagccggtgatgagcaggtcgacgtgaatgtttccaacgtgacgtttgaacccggctgtcggaataattggcatatccatcataacggataccaaatcttattggtgacgagtggtgaaggttggtatcaagaggctggtaagccagcccagttattacatcccggcgacgtggtcacaattcatcctggtgtgaagcattggcatggtgcaacaaaggatagttggtttgcccacatcgcgattactaagggaactagcgaatggctcgaaccagttgacgatgaagcgtacgcaaaattataaaagttaaagcagttattgaaggagggaactaatatgacagttaaacaaaccgcaggacgcgacaatttaggcaaattagcaccacaatttgccgcgttaaatgatgatgtgttatttggtgaagtctggtcacgcgaaagcgcactaagtttacatgatcggagcatgattacgattgcatgcttaatgactagtggtgattttccacaattaaaggcgcattttaagatgggcaaggatcatggtatctcaaaggatgaagccgttgaaatcgttacccacttggctttctatgcggggtggcctaaggcgtggtcagcactggcgctgattaaagaagtttacggtgaataggaggaatagttagatgacagttaaaaacaaagtcgttgtgattacgggggcctcgtccggaattggggcgacgaccgctaagcaattagccagtaatggtgctaaagtcgtattgggcgcacggcgtgaagaacgcctggccgctttagttgatgaaatcaaggcagccggtggacaagcggcctatcaggtgacggatgtaacgaagtcggccgatgtacaagcactggttaagctagcgcaaacgcaattcggtgggcttgacgtgattttcaataatgctgggattatgccgacatcgccaatcagtgccttgcacacggatgaatgggaccagatgattgatattaacatcaaaggcgtcttgaacggggtggcagcggtcatgccaatctttaccgctcaaaaatcgggtcagattattacgacatcgtcagtggctgggattaagtcctttgctggctccggcgtgtacggtgctacgaagtttgcggttcgtaatttgatggaagtcattcggatggaaagtgcccaagaaggtaccaatattcgaacggtcagcttatatccagcagccatcaatacggaattattgcacacgattacggataagacggccaaacagaatatgactgatttttatcaacaagtgggaatcagtccagcagccgttgcgaacgtggttaactttgccattgaccaaccagaagatgttaacgttaatgaatttacgatttatccgacgaagcaggcttaacttgatttagctgttgttaacggttgtttgagctagttgccgataagtcgaaaatgtgaattcaaaaaatacaagcacccggtctagcgcataatggcgttgctagaccgggtgcttgctgttgttatattgtattaataatattcaattagtgggcttacttcaaccgtaagccacgctttaagttgccccagaaaccgagttcatccgtttgtaacattagcccaccatagattcggccgatgtagatcatacttccaatgattgttgcaatgagaatcaggagtgacacgattgcagcgggcatcgttgccatgccgttaatgaggcgcaatggcatgaagtatgatgagaagaacggaatatatgagaaaatcttaacgaagagattggtgggtgtgttctgaaaggctagggccatgaaaaacgctagcatactcagatagatgaccggttgtgctgccttgctagcatccgcgacccgggtcaccaaagcaccacagaaggccgatgctacggtgtagagtagtacggccagtaatgcaaacaacaagttgattgagaccaaattgtgaatcacttgattgatcagatcggtattctgttgccaaaaatcaattgtgagtgagctacgtttaacaaattgcatgacggcaaagccacccactaagtagacgagcagctgagtcacaatgactagtaagacaccgtaaattttaccattgaagtatttccgcggtgtcgtacttgagaagatgacttccataatcttggtgcctttgtccgcggcaatttcttgggctgtgattgctgaataagtggtcaaaatcaagtagacaaagaagacgacaatatagaaggagaccgttttagccgttttatctgaagcagcgtgtttctgtaattgttcagtaaatttgggctgtacagccaacgcctgagtctgcttggcacttagttgtgcgcgctgtacgttgcgttggctttgggcagtggctaagaactgctgaatcttggccttgtcaccgctgctgacagcattaggaccagtgaactgcgcttgcaactgttgattcttggttgttaaaacgaggtagccggcgatgtcattgcgcttcgttgccgccttagcgctggcgagtgtttggtatttattagcggtagccacatgactctgcttaatgaaacttgtgcgtaattgtgggctagtgctaacgaccgcgatgtcattcttactagcgctgggtgcagcaaaataagaaaaggcggccacgaacccgaagaacaagaagggcataaagacgagtgacaaaaagctccaggacttgatctgccgcaagtaggtttcaaaagtcacaatccaagtcttattcatggttaacacctcccgcttcagttcggaaaatctcatccagcgttggtggctgctgactgaactcttcaatgtaatgaccagcagtgacttgatcaaaaatcgctgggccaactgaagcatctgcaagttcgagtcggaatcggcgggcaccttgttgagtaacggtggcgactcctggtagatcggccagttgcgcttgtgaccagtcagtcgtcaagaagagacgggtacggccaaactgggcgcgaacatcttcaacggtacccttaaggactgcttcaccattacgtagcataacgagtgagtcacagatcgcttcgacattactcatatcatgactggaaaaaataatcgcggcgccccgttgcttagcatctaaaatagcttgcttgagcaggtcggcgttgaccgggtccaaaccactgaatggttcgtccaagataatcagtttgggatcatgaattaaagtacaaatcagctggaccttttgttggcttcctttagataacttatcaatcttatcggtcggctgccccttgaccgcaaagcgcttcatccatgcggcaattttgcccttggtcacccgtgccggctgatttttcaaacgggctaagtacacgatttgttgtgtgatggttaatttggacattaggctacgttcttcgggtaagtagccgatttgatcgtagtcatcagcggtcaacgattgcccattccaagtaatttgaccgtcgaatgatagaaaatttaagatactgtgaaacgtggttgatttccccgcgccattttgaccaatcaatcccatgatttccccgtcatggacgtcaaatgacacgtcatttaatgcttgaacagtcccgaaacgcttctgaatatgtgcgatggatagcattagtttgtcctccaaattcttgaaataaagtcattacgtgttgtgcgagctaattagtcatgaaataggattaaaacgtgccaagtttagattgttattcgtcagccggtgtgcgtcctatgccgacctccggggctggggggttgggtgccaattgctggaacgtaagccgacatcgatttgagc

SEQ ID NO: 56 - DNA, 15962 bp, Lactobacillus plantarum
cgcgcaccggctgacgaacagtaatttaactggcacgttttaatcacgattcatgctaagtaataactagtacaacgtctagcatggtattttatgaaacgatatctgaaaataaacttggtatactgtcaatcttgatgactagcattttgatgcattaaaaaacggattcttcagcgatgtgtggctgagggatccgtttgatgtattaaggcttaattgatttagtttaaggttgcggctgctttttgggcagcgaggttgatgatgttccaaggacggtcaaagcctggttggaagaagaagtccgtgtaagctaagtcagcaacagtcagtttagcttgaatagccactgagatggcgttgatgttagcagtaacatcgtacttcgacatgatttgcgcaccaagcacgcgaccatcagttgggtcaaaggttagtttgaaccaaactttggtgttgccagcatcttcagagacaaatttaggccgaatggtatcggtgactaacacggatgccgtcttaacgcccagcttgtcagccgtgccttctttaacaccagtggaagcaaagtggtagtcaaagacggaaagtgcggatgaaccagaaacagcaggcattggtacgttttcgccaagtaagttcttagcggcaatccgaccttgccgacgagcgttagtggctaacgcaatgcggttatccttgccagttggggcaaatgggactaaggtcgcgtccccgacggcgtaaatgtcagtgtcactcgtttggaggtggtcgttgatcttgatcaaaccgtgatcatctaagtcgacaacgcctttcaagaagccagttgctggccgaatcccggcggcagttacgaccaggtcagctggatattcgccttgatcggtcactactttggtgacgtggccgtcaacaccttcatacgctttaataccttggccaactgcagcatagatgccgtgatcggccatcgtcttagtcaagatatccgtgaattcttgatcaaggtaaagactaagtaaacgtggtaataggtcgataaccgtgacgtgcatgccagctttggcaaagacttcagccgcctcaatcccaatataaccggagccaatgacaaccacattcttaacgctagggtcaacggtcttggcctttaatttgatggcccagtcgcgtccacgcattgcgtagatgttggctaagtcatggccgggtactggtaggtcaaatggtaccgcgccgacacttaggactagtttgtcataagtttcatcacgttcgtcaccagtggcgtggtcaatgacgtgcacactgtgactagcagggtcgaccttactaatttcactatttacaaaaacgtggacgccttgggcttgcatgccagcaggagtggcatagctgacggagttaacgtctttaacggcaccttcgaggtataattgcatcccacatgagaggaatgacagaaaatcacctttttcataccattgaatttcagtatctggtcgagcggctaaaataccgcgaaccgtttcataaccaccatgagaagaaccaacgacaataactttcataattgtaaagcctccaaattttagtttagaactgttctaaatagaatataacacgaactaagtttgtcggcaagggcagtttgtaattattctaaattatcagtgaaaaatagctgtgcccgtcgacaccatttagtttagaaatattctagttagaatatagcactaaaataaattgttcacaactaaaacggttacaattagctgcaaaaaacacccaatcatcaaaaaattgatgactgggtgtcagtattaatagggatggacttaatgattattcaataatatcgaagaaacttagcaacttttctttggtcaattgggctttttcctcatcacgaacatcatacttaatctggccctgatcaaggacaatcaggcgattaccatagcgaagcgcatcgtctaaatggtgggtgatcatcagacacgttaacttttcctccgtgacccgttgattcgtttgtgtcattagttgagcgctggtcttaggatcgagtgcggctgtgtgttcatctagtaacaagagatcagggcgctgctcggtagccattaaaaagctcagagcctggcgctgccccccagataaattttctgttgccgtgttgagccgagctgaaagaccgttgccatccatcgtttccgttaaggcttgaaagtggggcaggtgctttttcaattggcgtaattttaacgtacgtcgcttaccacgttggctggcaagcagtaagttttcggcaacggtcatccggggtgcggtgcccatcttggggtcttggaaaacgcgcgccaggaaagcggtccgcttttcaacggatagtcgggtgatgtcctggtcacgtaactggatggtgccactatcaaccggcaactcgccactgatcgtgttgaagagggtcgacttaccagcaccatttgaaccaagtacggtaataaaatcaccatcatagacgtctaagttcaggccccgcaaaattttgacctcattcggggttcccgaattaactttggtcacgatattttttaatgataataatggggcactactgttcgtcataacgggccactcccttctttaaaacgtgattaagatgtagaactttactgaattgcggtaacattaagcagattgccagaattaaggcggataacaggttcatgtcgttggtgttgaagcccagttggaggactaacaggcgcacgaactgatacaaaatactgccgagggtaaccgcaacgagtcgttgattcaacgttaattcaccaaagacaacttcaccgatgatgatcgaggctagcgcaattacgatgattccgattcccatgctgacatcggcataaccgttattttgcgcaattaatgcgccgcccaggccaatgataccgttagagaccatcaatcccatgatggtcatgttatcggtgttaataccaattgaacgtgccatttcacgattgtcaccagtgacaatgaaggcttggccgaggttagtttgcaagaagacaatcagaagcacggtaatgatactgatcactactaggccaacaaagacgctgtcaaaatatttaggcagtgattccaaaaagtgattagaaaaaatagtttgtttgcctagcaatgaaacgttggaactgccgcccataatgcgcaaattgattgataagcacgcggtcatcactagaatcccggctaagagaatgggcactttacccttggtataaagtaggccggtgaccaggccggtaatcgcgcccgcaacgaaggctaacagggaagcggtaacggggcccattccatggctaatcgccatgacagcagtggccgcaccgagtggaaacgtcccttcgacggtcatatcaggaaaatcaagaattcgaaatgtcaaaaataatgcgacgcctaaggttgcccacaagaggccttggccgatactcgatacgatcatactcatttgtaaataacccctttcgctttggcttctttaaggacacttgctgggaacttgatgccgagctttttagcttcacttaaattgatggtcatcttacccttagtgatgactttgattgggtagtcgctagttgctttgccctttaaaacttgggctgccatttcaccagttagtttaccaagttgatactggtcaacggataaggttgcgagcccgcccgctttaaccatcgtatcaacggctggaatgactggtaccttagccttatttgtaacggagactagcgttttcatggcacttgcgacgccattatcttgcggcgcataaacggcgtcgacattggcggccatggtttcagccacttgctgcatatcgttggtgttagagatagtatataacttgtatttcacaccttcttgtttacaaatccgtgcaaactttttggcgttatattcaccaccatgatctgaagtggtgtaaataattccgattgttttagcgctgggaacgagcttccgcaacaagtctaagtgggatttcaatggagattcaccagaagtccccgtaatattggcaccgggatgttggtcgcttttaattaggccgctacccgatggatcagtaatacctgctaacataacagggttttgcttgttagccgcagaagcgagggcctgcgcggcgggggtggcaattccgactgttaacgcggcgttttcgttcatgaatttttggctcatggttttcaagttactttgatcgccctgggcattttgatagtcgattttgaccgtcttgccatcgacataaccatattcctttagaccagcgaccacgccacgatgaatcgcgtcgagtgcggggtgggtctggagttgaagaatgccgaccgtcggcactttctttgtactggtcgtcttcgtggcggtggttttgcctgtcatgacaaaggccactcccagaaagacgatcaaggcactaatgaatgcaatcatacgtttcaatctaatcacctcaaaaaatttcttaagctcgggcaagttcaaagccaataaaaaagggcaaaccagtaagctctggtttgccctttacggaaccgaagcctgctgtgttaaaacccatgcagacttctttgaatatcaaagtgagccggcacagatacaaactgtttgccagattgtatccgtgtggacggcattacaatctgaacggccggctttgccatgaactgttcaagttagtaactgactttgacatgcttggttcctcgctttcgttattgaatgagttcagtataggcaaagtcgaaaaaagtgtcaaggataaatttcaccaaatattaaaatttgtggtgaaaatcttgtgagatgcggatgcttggtcgtcggcatttgttcgttctagtccgacctccggggcggggtgccaatggctggaacgcagccgacgtcgatttaagcccgagcaaaacccgcctggtctcaagcctgtgaggggccacggttgaagccgaacattgtctagtaacggattaatacggttttgacattagtctgttggcgtagcaagcacagaatttagtggtaccgaacacgtttcgggaaaccgctcgaatggctgatgaacgaccaccgagcttagcgcaacttatcggtgcctattttgatactggcactttaaacaaagcgttaggttcattaaagcattctgttgagagattaaatcttactacaccgattcaggattagtgagctatctcaatatcactttcagtctgacagttgattgacaaaataactgttgataaaaagcaacgacgaattcatcaacagttgagtacatctttgtccgccattcgaatactatcccgactggaagacgttccggcaattggcagaaatgcctgtaagttggcttaggacgaaccagcaaagcatgtttacgctaactcgcacgttttccagcgggcctaagctggctgcttttgattttagttattcagcaagttttgaataagcattcaagtaaaacataacgaaaaacaataaaatgagttgacaatgaataaaggtggtgctaaattagctttaaattaaaaacagattaagacgttgaagagaagagtaatcgcatcactgatttgcagagagcttcgtaatggtgagagaagtattcaggagtgcggtgaagatgagcttggagtcatgatgcgggtcgtagtggctacgcatgcggtggcaaccgatatattgcggggtttcctagatttttcagggtactcgtcgaggttgtgatcgtgagatggcagcgaacaacggtggtaacgcgaaagctttcgtccgttagtttctaacatattagagactaatggatgggagctttttttttgtttcaatacaggtgagagggagcggttagatgacagtcacagcaaataatggattattagcggcccgtggagaatgggcgaacgcaacgtgtcaagaaagtcatcaggcacaacagattttaattttaaacttgatgccgactaaggtaacgacggagcggcagttcctaaagcgttttgcagccggtaacacagatgtggctgtgacgtttatgtatcccgcgagtcaccatttcaagagcctgccacaagcagtcgtcgcggcacattacgtgacgttggctgatattcaagatcagtattttgatggcttgatcgtcaccggcgcgccagttgagacgttaccgtttgaagcagtcgattactggaacgaattgttaacaatcattgattggtcacgacagcacgttagccagactttatttgaatgctgggcagcacaagcagggctatacgcacagtttggaatcgcaaagcgcgctgttgctcacaagatattcggtatttatagtgcgactagtactgatgttaagtcgccgctgattagtggactgaatgcaggaggtttgctaaaaatgccacagtcacggcatacagcactagtgatgccggaacgcttacccgctggattgcaggttgtcgctgacaatccgaaggtgggaccgctcgtcttatctgcccccaagctgcacgcggtctatgtgaccggtcatcctgaatacgagcgccgcacgcttgccgatgaatatttgcgcgaccgacgtaagcacttgccgattcagttacctgaacattactttgctactgaacaattaacaacagttgattacagttggcaaacttcaagcaatcaactgtatcaaaactggttagcaactttgaatttaacgaaagtaggttattaattatgacaacaacgaatcctgaaaattatcactttgaaacgttacaagtccatgcgggccagacggttgatgaaacgggcgcacgggccgtgccaatctatcaaacgacttcatacgtctttaaggatgccaagcaagccgcgggtcgctttgccctgactgatgccggcaatatttatacacgactgacgaacccaacgacggacgtggtcgacaaacgagtggccgccttggagcacgggacggctggggtaacgctcgcaacgggttctgctgcgataaccgcggcaattttaaacattgcgcaacagggggatgaaattgtggcggccaacaccttgtatggtgggacctatgacctgtttagcgtgacgttaaagaagttgggcatcacaacgcactttgttgatcctgacgaaccggcaaattttgagacggcaattaacgatcatactaaggccttgtacgttgaaagtatcggtaatcctggcattaacttagttgattttgaagccatcggaaaaatcgctcatgatcatggcattatttttattgttgataatacctttgggacaccatacctagttcgaccacttgaacatggggccgacgtggtcgtacattcagcaactaagtttatcggtggtcacgggacgaccatgggtggcgttattgttgaaggcggccaatttgactggcgtgcgagtggcaagtatccagatttcacaacgccagatccgcaatataacggcctcgtttttgccgatttgggtggggcagcctttacgactaaggtccgggcggaaacgctgcgagataccggtgcaactatcagtccctttaattccttcttgttgttgcaaggtctagaatccttgtcattgcgagtagaacgacacgtgaccaatacacgcaagattgttgccttcttaaaagcacatccaaaagttgcctggatcaattatccagaactggaagatagcccgtaccatgacttagcaactaagtacttcccgaatggggttggttcgatcttcaccctgggattgactggtggcgaggctgctggtaaggcattaattgaacatctacaactcttttcattgttagcaaacgtcgctgatgctaaatcattaattatccatcccgcttccaccacgcatgcgcaattaaatgaacaggaattgttagcagctggtgtaacgcctgacttgattcgaatttcagtaggtgtcgaaaatgccgatgatttaattgctgatttggatcaagcattggcacaggtttaataggtcggaatggtcgatgattgaaagtatgtgaaacggagggtgcgacaatgacaacgacaattgaagtgggcatgttagggttaggaactgtgggtagtggggtggttgaacggttgacccgctcggctgccaaaattgaacaaacgcagggtattcggttgcacctagcagcagttgccgttaatcatttgaacgcgcctcggactgttcagttaccgattgggacgcgcttgaccgattcattaacgaacgttgtttgtgaccgaaaaatccaactagtcattgaagtcatggggacggtcggaactgctaaaaaggccattgtggcagcacttaatcagggtaaggctgtcgtgaccgctaataaagacttaattgcaacggcgggacctgaattggctgcgttagccaaaaaacagggctgtgatttattttacgaggctagtgttgcggggggaattccgatcttgcggacattaacagatagttacgtgacggacaatgtgcaggcggtcagcggaatcatcaacgggacggctaattatatgctaagtgcaatggcaaccgggcaatcgtacgaacaagctttagctactgcacaagcagccgggtacgccgaagctaatccgactaatgatgttgcgggcattgatgcggcgtacaaattgatgatcctcagtcgctttgcttttgggcaagagttgagcctgccgcagattgcacccacgggaatcacgcatttaagcgcttcggtttgtcgattagcagctgaaaatggctggcagattaaattgctcgcgcagattcagcgacacggatctggtttgtattgtcgtgtggcgccagtggccgtgccggttgatcaacccctgagtcagatcaatggggtccaaaacgctgtagctgctcaaagtgaagccattggtaccagcttgtataccggaccgggtgcgggaagtacggcgacggctaatagtgttctaaatgacgtcttagtagcggccaagcaccttatcaatggttatcgaatgattcgtaaccagaaaagaagtgtctcgttaacggtcactcgatttgaccagttaccacaaacatacttaggcattggttcggtcgcaccagaagccgtgaaatattacgctaatgaagctgatttctcagtaaaaacgattgccgatgattgttatcagattactggattaagtgcggtgaaacgcaaaaagctgcgtgcgaacttgccactgactttgataccaattgccggtacaacggactggaagcaagtgaccgaaaattcaataacatctcccataaatgttgcaatttgaaaaagaacgctcaggtacagtatactgtatctgagtgtctttttttgatgctaagttcccatgggatacccatggctaagtggatgagctaattgaaatgagttagcgagacgtggcagttggttgactgacacgatgaggagtgaaattatgaaaattgcggtggtgaccgaaagctctgctaatttaaaagcgcaggcggtgaaagactaccaaattacggtggtgaacgacccgattatgttcggtaatcatgtttaccacgagaacgtagatatcacgacggatcaattttaccgattactaaaagttgaaaaagaaattccaacgatttctcaaatttcaatgccagagatgcaagtcgtttttgatcagctgcaagcggcgggctatgaccaaattctagttattgggttgagtagtggtatcagtggctggatcaataatttgaagacctatgcgccgtcagttgacggtattgacgtgcgggtgtttgattcacgaactgcttgcgcggggacggcgaacatggtgaagctggctgcggccatggcattggcggactacaccttagatgaaattattgcgcaactgacgcgcttgcgggcggctacgacgacggtcttaattgttaactcgatgcgccatctagttaaaaatggccggatttataacaatagtagtctggccggaacgatggtgttgcgcaataagccgattattacgttcaatgggcatgggaagattcaacttttaggtaaggaacggacgctcaaaaatgcacaacaggctgttcaagatgaatttagtcagtttgtgatgaacagtcaattaccagttcggctggacgtcatcagcgctaatgacgcgcagattgccgaagactgggcgagcgaactacgttatcagtttccagcagtccgggtcaagactggggttatcggtccagttttaggcgtcttgactggagaccatgcgctcggaatgatctggtcattagattggaagccattgttgacgaccctcaatcaggagcaaaaacaataggccgttggggttgcccgtgtgcggtttgctgatgatactgtcgtatacagacagctgggttttaaaaaagttttgcatcgaaggttgacattttactaaaatgatattatggttataacattaaaacttgatgaaaagctataatgctttaaggagtaactgacttgtgatgctcagaaagcgccgttgctgtgaaggtgtgatgacaagtgagtaaaagttaaaggattggcgtgaattttacgagattcactggtagcacccattattgtgcacgcgtttagttgttgtgaacgcgatgagtagccggatgtgagttcggttagcaataaggtggtaccgcgcgtaagcgccctttggataatttgatcgattattcaaagggcgctttttcgtcaagtgacacatagcattattttttagttaacacatagtagtcattatttaggtcgcgcatcgcggttaatcatcgtaaacacatagttgttcgacatcacgtgacagcacatagtagatcgtaagtacgggcccgtttattggaaaagcactgaagcgagcggggaacatatacacatagtgggcaagacgaaaggatggttttacttatgaaatatggcattattggcgcaggcgcaatgggatatcggtatggtgtaatgttacaagaaaacgccggtgttgacgttgattttatcgacacgtgggaaccaaacgtcgcaaaggtccgtgagcagggcggcgttgatgtggcgcgtgatcatcaaaatcaccatgtcgttccaatcaatatttattatcctgaagaatatcagggtcatccagatgtttggattgtttttaagaagcaaatgcagttagccgatgagctcaagcgcgatgcgtcgttatttcatgaggaccagtacgttttcgccgcaatgaacgggatggggcactttgaaaagattgcacaatatttcccagaaaatcacattattggtggtacggcgatgattgcaacggtcttgaatggtccgggtacggttgattttatggggcctaagggtagtgaggcgatgcatatgagtaagtatgcaggtcatattgatacgactaccaagcaagtgatggccgattttaaggcggctgatttaaatccgatttggtctgataattttatgggcatgtgcatgtccaaagttgtgtttaacgcggtcaccaatagtttgtgcacgatgttcgagattcagatgggccaattcatcgaatatccgggcgtcaaggatatggcgactcaaatgttcaacgaagcctatgatgcttgcgaaagggcaggcatcaaactcattgagacgcggcaagaagaaatcgactcggttgaaacggtcagtcgagcctataagtaccattatccatcaatgtatcaagacttctcaaagggacggccaaccgaagttgattatattaatggctatattgctaagattgggcgggaacatgactacgtttgtcgcgtgcatgagtttgtgactcacgaagtccatttagcagaaatgatgcggcaataccggcacccggaaatccccgttgctgaaaaataagattattaatgaaaaagttctgagtattttcagaactttttttgtgggcggaaaaacttaatttagtaaggttgaaatcggtttctttgacattggtctatacacttagatgaccttgtaaacttgcaatgaaaacatgttgtgataggatttataacgtgcttaaaaagagaacgaggagaaattggtatgaagacatattttcagaaaatcggtcagtcattgatgctaccgattgcaacgttgcccgcagcagcgattttggttgggattgggaattacttgccaaaacagtggttgtttgcaaattacttgattcagggtggtaacgttgtcctgaataacttagccttgctgtttgcagtcggcttagctatcgggatgtcagtcaataaggacggcgcggcagctattgctggtttgatcgcgtttgaagttccggtgatggtgttaaaaccagcgacattagcgacgatgctgaatgttaaagtgagtcagatcaatccagcatttagcgcgttagataacaatgtgctgattggaatcagtgctggactgattgcggctgcgctctataatcggttccacgaagtaaaattaccaatggcgctctcattctttagtggtaaacgcctagtgccaattatggctgcttttgtgatgctgattgtgacggcggtattgtaccttgtttggccgtttgtctacgatgccatcgtcctctttgcaacggggatttcaaaattaggtttcgtgggggctggtctatatggctttttcaatcgtttattgatcccgactggtttgcaccacgccttaaattccgtattctggtataacgttgcaggtatcaatgatattggcaatttctgggccagccatggtgttaaaggaatcacagggatgtatgaagctggattcttcccaattatgatgtttggcttgccagctggtgcgtatgcaatttatcgtaatgcacgaccggaccgaaaaaaagaagtgggttcattgatgttagcgggtgcgtttgcgtcgttctttacgggggtgaccgaaccgcttgaattttcattcatgttcgtggcatggccgctctacttattacatgccgtttttatggggctatcattaggattcgccgcgttaatgcactggaccgccagcttttcgtttagtggcgggttagtcgattatttattgagttttcggatgccgttagccaaccaaccctatatgttactggttcaagggctggtgatggccgtcatttattactttggttttgactttgcaatcaaacggtttaatttgaagacgcctggtcgtgaagttgtgtctgcagatgtcgatggggtgggtgcacctgctagtccagcggtggccgttgcagcaacggatgataagtatatgcgccaagcaaagcaaatttatgcggctattggtggtcatgacaatattagtgtgatcaacaattgtacgacgcggctgcggttacaacttaaggatacggaaaaagtcgatcagccggccgtaatggctgctggcgtgcctggtttgaacgtactggatgttcataacatccacattgtgatcggtacggaagtccagttcgtcgcggaggctttacaaaaattattttctggtcaggtggcgacgaccccggcatctgatgctgaatcaaaggccccgcttgaaccgcaaactgctactgtaacggaagcgccggtgacaacgattttgcgggcaccagcaacgggacaattaatgccgattagtgcggttgcggatgagacgtttgctggtaaactcttaggtgatggttacgctgttgaacccgaagatggtgaagtcgttgctccggttagtgggacagtgacaagtgtctttccgaccaaacacgctatcgggttgaagacgacgagtggtttagaagtcttattacacatggggatcaataccgtggaaatgaatggtacgccgttcaagttacacgtggcaacgggtgacgaaattgcggccggtactgcggtagcgacggttgacttggctgctatcaagtcaaccggtaaagcgacaaccatgatggtcgttatcaccaatatggatcacgttaacaaactaacccttaatccaactggtcatgtgactagcggtgatttgattggtgcagctgaataagttacgcgctgtcgacgttgggtttattgaaaaagtttcgtctaaatcttttcgatttaggcggaactttttttgtcgcattggttatcgaggcaacggatgacagcaaatgaacaacttgatgcggggacagtgcgtttgattgcttcccactgactcccacgatatactattggcattataggggggcggtaacatgattgacgaagtattagtattgaactcaacgccaacggggattttacagaattcagtttcaggaagcatggtgattgacgcggcacttgatgcacgactagtcaagcgactaatgcaggcgctaactcaatcgatgcttaaggtcagggttgcaaccgcggacgacttaccggtgaccgaccaccaattgctggtcgtcagtcgaccagtggcagccgtgttggacttacaagctagtgcgcgagttctgatttatccagaagaaacgggactgacagccgctggaatgacacagctagcagtgcagattgatcaacgattgactaaaatatccagataacgatcaaaaaacgcccagggcagttgttcgcaagttactgaacagttgccctgggcgtcttcgatgattagtctttgtggtgttttttaatgatagttactaatttcaatcaagttgttatcaggatcacgaacatacagtgacgtcaactttccgtgggcaccagttctttcaaccggcccggcaatcacatccacgaaataactctttaagtgatgctggatatcatcaatattatctttcgcaatcaagcaaagatctgcactgccgggtgtcggcttagccgcaatgggttggtgtggctggtcagtggtctgaaagttaattttttgtttacccactaagacagcttggcggtcaccatcgaaggtcacaatgggaaggtcaaatacttcatggtaaaaccgtaatgaccgtgcaatgtcagtaacggttagggtcaaatgatcgatatcgcgaatattcacaagctcaaatcccttcaaaaataattcattattaaacgtgtcgtactcatcagatttggcatgaaccatgattaaaatgtaccagttgtgtaagttcaaaagcagccagctttaggcccgctggaaaacgtgcgagttagcgtaaacatgctttgctggttcgtcctacgccgacttccaggcatttccgtcaattgctggaacgcggtggacacagatttaagccgcaacccacgtcttaaatactggtcttccactaaccaagcaaaggacgcttgctaagtggaatttcaccgctgagcattgaccgaaacgccttccagtcgggacagtattcgaatggctgacggagatgtacccaacctttgatggacttatcattgttcctcataaacggtaattttgttaattaactgtcagtctgaaagtgatattgtgggagatcactattcctcaagcggcatagtaataatcgaacgtctcgacaaagtggttaatggaaccctgacgtttcgtttgaggttccggtatcaaaatagtcagcgacaaattttaccaagttaagtggccgttaatctgccattcgagggggttcccaaaacgtgttcggtgccactaaagcctgtgcttgctacgccgacggacaaatgccaaaaccacattaatctgttggccaggcaatactcggcttcaacccgtggcccct

SEQ ID NO: 57 - DNA, 14601 bp, Lactobacillus plantarum
tgtccgccattcgaacactgttccgactggaaggcgttccagcaattggcagaaatgcctggaagtcggcgtaagacgcgccaactaagcaattttatgctaactcgaactttttccagcgggcctaagctggctgcttttgactttggaaatcagcacgtttcaatcataattaatacataacaatcatcgacctaatgcgtttagttgtattattccattcacgaataacatatctgcgcaatccgaattgaacccgcttacgagtggccgtatgatggtcttgtaaactttaagggagatgaatgaaatggcagaacaaccatgggatttgcgtcgcgtgcttgatgagatcaaggatgatccaaagaactatcatgaaactgacgtcgaagttgatccaaatgcggaactttctggtgtttatcggtatatcggtgctggtgggaccgttcaacggccaacgcaagagggtccagcaatgatgtttaacaacgttaaggggtttcctgatacgcgggtcttgactggattgatggcgagtcgccggcgcgttggtaagatgttccaccacgattatcagacgttagggcaatacttgaacgaagcagtctctaatccagtggcgccagaaacggttgctgaagcggatgcgccagctcacgatgttgtttataaagcgacggatgaaggctttgatattcggaagttagtggcagcaccaacgaatacgccccaagatgctggaccatatattacggtcggtgtggtgtttggctcaagcatggacaagtctaagagtgatgtgacgattcaccgaatggtccttgaagataaggataagttagggatttatatcatgcctggcggtcggcacattggtgcgtttgcggaagagtatgagaaagctaacaagccaatgccaattacaattaatattggtttggatccagctattacgattggtgcaactttcgaaccaccgaccacgccattcggttataacgaattaggtgttgctggtgcgattcggaaccaagctgttcaattagttgacggggtgaccgtcgatgaaaaggcgattgcgcgttctgaatatacgcttgaggggtacattatgcctaacgaacgtattcaggaagatatcaatacgcatacgggcaaggcgatgcctgaattcccgggttatgatggtgacgccaacccagctttacaagtgattaaggtgacggcggtgactcatcggaagaatgccatcatgcaaagcgtgattggaccatccgaagaacatgtcagcatggcgggaattccaactgaagctagtatcttacaattggttaaccgtgccattcctggtaaagtgacgaatgtttataatccgccggctggtggtggtaagttgatgaccatcatgcagattcacaaggataatgaagcggatgaaggaattcaacggcaagctgccttgcttgcgttctcagcctttaaggaattgaagactgttatcctggttgatgaagatgttgatatttttgatatgaatgatgtgatttggacgatgaatacccgtttccaagccgatcaggacttgatggtcttatcaggcatgcggaatcatccgttggacccatcggaacgcccacaatatgatccaaagtcgattcgtttccgtgggatgagttctaaactagtgattgatggcaccgtaccattcgatatgaaggaccaatttgaacgggcccaattcatgaaagtggctgactgggagaagtatttgaagtaacgtcatccattgcacttgatgagcgtatttttatcgcattgaaccaaaatttaatcttacaaagagccgccagaccaacggaagtgtgctggtcggggggctttttgctgtcaaaattgaagggagcatgtagctcgtgaacaagaaaacgattggctttttcagtggaatcgccgtatttgccattatttacttcttaccgattgccggcttgtcagctaaggggcagatggacttggcacttagtttgatgacggtcgtctggtgggccacccaaatcgcgcaacccgcgttcgttggtgggatttacttaatgttgctcattattatgaacgtggcgacaccgtcacaggtcttctcgtcggcgtggactggttcaattatgtggctcgtaattggggcgtacttgattgcgggagcggtcaatgaatctggtttgggtcaacgcatcgcgtacgcattcattatcaagtttgtgcggagttggaaagggattgtgatttcgatttttgccctgacctttatcctcgcactcctgattccccatccatggcctcgggcgttcatgattatgtccgtcattacggtggtcgcggaaacggcgaagatgcccaaacgcgatttggctaagctaggcctcgctgtctttgctgcgtcctgtccactatccggggtcttttatactggtgacacgtcactaaatccgttggcagtacaggcctctggtcaaagcgtcaactttgtctcttactttatctacatgggcgtgcccatgatcattgcggccatcttaaccatgtttctgttcttattcctcttcaagcctagtcaggaagtccacatcgatgtggaagcgttaaagcaacaacaagcccagttgggtggtatgacggggaaggaagttcgaacaattatttggctgatcattgcgattgcactctggttaacgagtgggatcaccggtttggacgttggttggttgacgttgatcgttgcgctgatgatgagtctcccggtagttggcgggatcttgacggccaaatcatgggaaggtgttcccgtgaacgtgctcgtgttcttgacttcggcaatcgcaatcgggaatgtcggtggtgtgactggcatgaataattggattgcgaagaccttgattccaagcaacttgccaactaatatttatttattagcgattgtgattactgtttttgccatgattatccatatgttcatgggttctgtcattgcggtgatggggattacgattccggccttcgtagcggccacggctcatatgggaatttcacccttggccgtatcgttactagtcttctcggtgacaaacttgcattatattttaccgttccacaacctcgctgtcttagttggaagcgaccccgatactggtgggggttacacacaaaaagacgtgatgcggttaggaatcccactgacggcggttgtctttgtcgttgcgttagttgagatgttctggttccacctcgttgggttggcataagcggataagtttaaaaaatacccttttcaaacggccggttggtcggatggaaagggtattttttaaacttgttgattttcctgggcagtcaccgtcaagtagtcaattaagtcggtgagtaactggttccccgttcgctggggatatacaaagttcagttgactgatgaacgggatggcgagtgagcgcatgaccacgtgttcagtcatgaacggaagtaccgattgtttaaataagaaagtcacgttattttgattgagaatgcccaggagcgtttcaatatgcgtactttcaaagaagaattggggcgtcatgccttgctgagcaaagagtgcgatgatcggttcgtaaacaccggagcccggtggtaacgttgcaattttctgccgcgctaagtcttgaatccgaatgactggctgggcagctagggggtgatcacgcggtaaaataattttgagttcgtcagcgagtagtggttgtttttgaaattcggtgggttgcaattgggtcgtctgagtatcgcgaatgatggccgcttgcagctcaccactcagtaaccgtttgacgatttggtcgccctcatcctcgatgattttgatttcagtatcaggatgctgagtatcaaaagtggcgatctttttggcaatgttatattgacctgagattggaatggcgccaatgatgagcttggcaaatgtcgttggccgattcggtgccaaatcgtgcatcatggtctcatagtctgtaatcattttatgcgcatgatgatagaacgtttcaccagctggcgtgatttgtagacggcgcttgttgtgtgtatctagtagtttaatgttcagttcgttctcaagggctcgcattcgtttggacaattccgattgtgataagtggagttctacggcagcgttagaaatgtggcgtaaatcgtacaccatcacgaatgcttggaggtcattaatggtcatagcagtcacacttttctttaggttaaattctattctaacaccgatggcgaggcccgcctaattaagtaacggtataaattagtatcaatattgtgaggccgctacggtaatcgaaatattagttattttttttattgagaatgggtcactaataaaatcatggtgcgggttaacatttgttagcggtgatgattattcgttaccgtttaattgtggatggggactcgtgttgagggaggcagtaatgacatctagatataattattttggtgatgtggatgaaagttgttgagtggttggtgattacaaatacgctgaatcactagctttccttgcttttgaaattgaatccggcaaaatgaaatagttccagcagtttcatattgatcatcatgctggtcatggctgggcaatactttttaaaaggggattagtttagtatgtcaaaagcgcttaagatagtgatgggaatcaccatgttaacagggggcatcatggcccagaaaatgacggtacatgcagccgaatctaacactcgaaccggtcaggcagtaaggatgaatggcacggtcagtttagcaagtcaggtcgaaaataacccagctgttaaggcggctcactaccaggtaacacaagcggtgcaagcattaaccatggctactacggcagtcaaaacggctatgagtgatctgcaagcggcgcaaaccacgttagacgctgccaacaaaacgttagccaagaatcaaaagattcagacgcatatgggcgtacttaagcaagcagccactgaccggcacgtcaaggcaacgaaagcactagatgaacaattggcaactaaaaagacaagccaaactgcggtaacgacggcgcaagcggcagtgactaagtcacaagctgctgttcaagtagcccagagcaacttcgataaggataacagtgcggccaacaaagtcacgttacaaactactcaggagaagctgaaaacggtgcaagagacgttaacagcggcacaagctaaccttgataagactaatgagcacgtgatgatggcagaagaagaactagccaacgccaaaattgaagtcagtggcacgagccgcgacttccaaatggcacaaagagattatgatattgttcagccccaagcagcagttaatcaggcgaaagcagcggtgacagctaagttgcagcgcgttgcgggtactcaagatcagatcgttactgcacagcgggaattgtcccaagctcaagctggattaacgaccgtgcgcgctcggaccttggcaaccttaacagcagcggccgaaaagccaatgactgaaaaaactgtgggcgaacgaccagtcgttagtcattcaactggcacgtcaaccagtactaatcagtcggcggcatcacaagcgaccccggccaagcccactcttaatcagtcaagttcagcttccgtcccaacagcgcagcgggttgttacgacgcagccacgacaagccacaacggtattgcggacgacgacgagtccggccatggctaagccagtgactcagcagacggtgccaacgaccgcaactaaaacggccatgttaccacagactggtgaacaaaccaatcgagttttgaccgtattgggcttcgtattattggccgcaactagcttatttggttttagtaagcaacaacggcgccataaaacaactgattaattaacaagtgtgtaggcacaattcggtttctcaatgattatttcgaagtgcaagactagtccagtcggttaatttagtctgagcgactaagttgacggcggaattaatggcgatttaaaaaagttctttcggagttttagttgttccggaaagaacttttttgctgggaatgattggtatcgtttagttaataataatatgctaagaacgcctgtttttcggccggaaatacttgcttgaaagtagctgctggactactataaacatggtttcaaagagcccaagaattttactaaataaggagttgagtttgtgatgatgatgacgggaatgatggttctatttgtattgttagttggtttagttttaagtgggattttcttccgatatatggatacaactgccggtatctcattcagctcactgaagttcgctgatttgcggatggaattgttaaacttggtactcgttattggactattgctgtgggcactggttttaattcgttaaagcgacaattaaacttatcaacttagctattattgcgagtccggttaacgccggacttttattttggcttgtgattgacgaattatgttagtgtggccgccaaaatacttgcgcttcaacgtggaacaccgctattatggataagtgattattatctagaagggaatgaataactatgacgcagtcgccatattggcaacggatcgcggccaaagctcaggccgcccagcgaccgttttttagtttagcaccgatggaagccgtgaccggctccgtttttcgccgggtcgtgatgcgcgctgcggcccccgatgtcttttatactgaatttacgaatgcgttaagcattacccacccgaaggctaagtttacaacgcggggacgactatatgttgatgaggccgagtcgccccgaccaatcgttcaactttggggcaatagtggtgaggactttacgaaagcggcccatgaagtgaagaatcaaggttatcaagccattgatcttaatatgggctgcccagatatggcggtcattaaaaatcatagtggtagtgatttaatccgacattttgatcgtgccaaagaagtgattgagggcgcacgtcaagcagagcttcccgttagtgttaagacgcggttgggctttgacgatgtgcatgagtacgagacttggattccatttttgttgcaacagcaggttcccgtgttaacggtccacgtgcgcacgaagatggagatgagcaaggtaccagcgcattatgagttaattgataatttagttcaaatgcgtgatactttggcaccagcgacgctattacaaattaacggggatatcctggattatcaggctggtctgaagcttgccaaagcccatccaggagtcgatggtatcatgattggccgcggtatttttcagaacccatacgcttttgaaccgattccccagcctcattcaacgcgtgacatgctagaattgttacggtatcaagtagatctgtatgatcaatttattggcttaggtctacaagggcatttcgcaccgcttcaacgcttctttaagatttatgttcgcggtatgcgtcatgcggccgaattgcgcaatgaattaatgcagacgaagacaacggatgatgtccgtgcgattattgatcgcttagaggctgagctaccagcggattaggtcgcgttattttaactaaaacggctatatttttgccatttagctatgcttgattaaaatggttttaatgtcgaacgtaccgcatctaaagtcaactgcaaattaaatgctagcctgtaagtgggccataaaataagctaggtccttcaagaagtcgatttcttggaggacctagcttattttgtggtctaaattattgtaaaccggtcatcgagtaaggtaacttgttcaggtgataagccaacgatttgaagctcacgttgtttagtcacaaaaatggcgccgtaaatatcgggtcgctgagttgcccaatcgggaatcggttggcccgcaaagaagagtcgcgtcgtttcgatttcaccatcaatggaagctttcgagaaaacggtgacactttcaaggtcgttttgtcggggataacccgtttgcgaatctaagatgtggtggtaggactggccgttaaattcaaggtgccgctcgtaaataccgctggtcacggccgagcaggggccaatcgtaacgctggcaatcgcgttaccgcggtcagtggtgggatcttggataccaacgcgccattgcccatccggatgaagtggggacgtccccaccattaacagattgccacctaggttgatcattccggcccgctgtccaaacgcttcccagtaatcttgaatgcggtcggcaatgtagcccttggcaattgcgcctagatccagctccattcccgtgaccttgagaagcacactgaaatcagcgtcattacaaatgacggcttcggggtcgatcaaggccaatcgttcgttaattgcagactgttcagggacgtgcgcgttagtaaaaccaatgtgccagagtttcacgagcgggccaatcaacgcattgaaaccaaaatgttgtcgactgagttcgacagcttgtcgaacgagtgtgtaggtggcggcgctcacttgaacggggtgttggcccgccgcctggttgattgccatgacctcggaaacagtccggttgacggtcaagcggtcttcatattggtcgataagatcgcaagcagtttgtaggtactggtcactatcactaccaaaaagggtcaaatcaatgtcggtaccgagcgcgtgatgagcttggtgccgacgctgctgagcgagtgcaggaattgctgtctcgccattataagctaaagttgtcataaaaccagtcctatctttcataaatatcaacgagttcagcaaactaaacatttattcccgctcagttagaagtaggcacaattaaatcagtttccctgcacagtgatctaattcgtgttgaataatttgtgctgtgaagtcgttgaatcgttgttgttgcggtttaaagtgttgatctttatatttcaccgtgatttggtgatagcggctagtcggacgttcaccaggtaaggacaggcagccttccttagtctcgtaagtgccgtgatgatcaatgatcttcggattgatcattgcaattgcaaagggaccgagttgcacgacaataatttgtttgttgaccccaatcatattcgcggccattccaacgcaattatcggtgtgtgcggcgagggtatccagtaaatcagtcaagacttgagtgtctgcaggggttgctaagtcagcagggacactaagcgcggcgggatcatgcacaattggtcgaatcatttgatgttcctccattgattagtcatattaatttaattatagagagcacggttgacagaagcaagccgttcgctagttgtcaggccctaaaaaaaacaccacactcacacaagtcaacgtgcaaatgtggtgtggccttcaattagtacgacaatttaaatgttggcgttaaggtgcccgcctttaaggcgtcattagttgtggtgggaacctggttgtgttcaggctgccaatttggatctttaatcagtgcgatattagtcccttgataattcatggtcatttgattagcgtcgttgagggtcagttttgcaacattgtgatcgattgtgaacgtggcacgtgtatcacttaacgttaacgttgcgcgactacgaatgggcgtatgtccgcgtcggaaccaagcaacttgatgattggtactgaggtacagactcattgctggtctagcgctgacccagcgacctaagaaatcccgagtcgtgactgagcgaacggcgctgacttttgatgttgctggttgaacggtgggcgtttgtgtgtcagtggcagaatggcatcctgtcagtagccctgtcaacaacaagccgacgattattcccctgcttttttgcataattattctctcctccaatgtccacatccctcaatgaggacttaatttcattatagcgaatccgccgcatgagttaaacaaaatagtcataagttaatcagtttacaacaacttggttgtgttcagcttaatttttaacgaattaaaattcggtttatggcgtgtgaaaaatattgaaagcaagccgtatcaaggttggttcggtagttaacgagattgattaaatattctgatattagataaaaaatagtatgaaaaatatttttgaaatattccaaagacgcactaaccggacgattaaagcgatttggtgtacacaactgaaggtgacagttaattttggcaatgggcaagttaatgaaaatgagctactatatatagtgttgattcaaacagaacgcactatcaattgtattcaatcaatgactttgaaaagtggggaattaaaatgctaacaacgacaactaacgatatattagaccaattacggccactgaccgtcacaaagcggggtggcgcacaaacgaaatttcatccgtataaaattgactttgtcctacgacagttgttagcgactgatgacgaggtacgggtcgtcaagcaggcccttgttgcccagtatcaagatgctgacaacattgatactcgggagctacgtagtaccatgatgcagattttgaatgcgcaaggcctgaccgcggcagctaaggcatatcaggattactttgaagctgaacagcagcagtttgcggcagcaactaatgttcaaggacggattgaaaagttgtttgagcgcgatgccagcgttgtgcatgaaaatgcaaataaggatagtacgatttttaacacgcaacgcgacttagaagccggtgctgcaagtcgcgccatgggcttgaagatgctaccagatgtcgtggctaaggcccatctgcgtggcgatatccattggcatgatctcgattattcaccagtcacgcctgaaacgaactgttgcttgattgattttgacggcatgttcaaaaatgggtataaaattgggaacgccgaagttgcctcacctcggtcgattcaaacggccacagcgcaaatggcgcagatcattgccaacgtggcttcattacagtatggtggctgttccgctaaccgtgtcgaccaattattggctccctatgcggcaatcaactatcaaaaacatatgactgatgcgaaaaagtgggtccctgccgatcagcgggaagcttatgcgaaagccaaaactaaaaaagatatctatgacgcgatgcaagcccttgagtatgaaatcaatacgttatattcgtcacagggccagacgccgtttaccacggtcaattttggtctaggaactagttggattgaacgagaaattcaaaaggcgattctccagattcgaatcaagggactcggtaaggagcaccgaactgcgatttttcctaaattgatcttcacgatgaagcgggggttaaatttaagtccgaatgatcccaattatgatattaaaatgctcgcgattgagtgttcgaccaagcggatgtatcccgaccttttaatgtatgacaagatcaaggaattaacggggagttttaagacgccgatggggtgccggtccttcttacaaggttggcgtgatgaaaatggtgtcgaggtaaactcgggccggatgaatttgggcgtggtgacagtcaacctgccacgaatcgcgttagccgcacatggagaccaacagttgttctgggaaatcttcgaggaacggatggcgacttgtcatgaagcactcgcgtatcgtatcgaacgaacgaaggaagctaagccggaaaatgcaccactcttatacatgtatggggcgtttggtaagcggctaccagcaggtggtaatgtcgatgagctcttcaaaaatcagcgggcgactatttcactgggatacattggaatttatgaagtctgcacgaccttctttggtccgaactgggaacaagacgagcacgcgttagcttttgcggagaccgtggtgaaagcgttacgggataagtgtgcgcagtgggcggctgaaagtggctatcattatagtctgtattcaacgccggctgaatcgttgacggatacgttctgtcgtgacgatattgcgaagtttggccggatcgcagatattacggataaggaatattacacgaatagttttcattatgatgtccgtaagcacccgacgcccttcgataaattaactttggaggaacgttttccacaatatgcgtcaggcggctttattcattattgtgaatatcctaatttgactcagaatcctaaagccttggaggccgtctgggactgggcctatgatcatgtcggctatttgggaacgaatacgtcgatcgaccagtgttttaagtgtgggtttaagggtgagttcaaggccactgcccgtgggttcgtctgtccagaatgtggcaatcacgaccctaaatactgtgatgttgttaagcggacgtgtgggtatctaggtaacccacaacaacgaccaatggtacatggtcgccacgttgaaatcgcgtcccgtgctaaaaatatgtctccggagatgattaagaatgccgcgcgctacgaaaggaccaaacaatccgatgcccaaagaatggctggcagaggacttaagtgaacaatatgttgctgattataaggcatttaactttgttgatggggaaggggtccgctgtagcttgtacttgagcggctgcccattccactgtccaggctgttataatgtggcggcacaaaattttcattatggacaaccgtattcacaagaattggaagatcagattattgaagaccttgggcaagattatgtgcaagggttgacgttgctaggtggtgaaccgtttctaaatactcaagtcggcattcggatttgtgaacgcattcgctccgaatttgaaaacacgaaggatatttggtcgtggtcaggttatacttgggaagaattgcaacaagactctgaggataaactgaagatgctatcattaattgatatcttggtagatgggcgctttttacaagataagatggatctctcgctacaatttcgggggagttccaatcaacgtattatcgacgttcctaagtcgctaacagctggtaaagtcgtcatctgggataagttggttaagtgaaattaagactggtaaaaagagcgttatgacgaggtcgtcacgacgttcttttttgttacggtcaatataacggttacatataacccttaataatttttttaattaaagtctgtaactatgtctcgatattttagttaaaagcggttatactttacaggagttgtcaatttatattgacataaagaaatcattaaaagcgaggcttcatgaatgtatcgtttttttgttcaaccccaagttgatcacagccatcgagctgtttttggttatgaattactgttacgtaaagagatgaatggtcactgggccgttccgaagtcgttcactgaattatcattagataaacaagctgaattattagaacaacttgctagtcaattgcagacgaaagcgactaatcaggtgttagcccttaatttaaaccggcaacaagctgaggacgacctgatgttagggacgatcatttacctaaaaaaaaggttgaatccggccgcgctgacgattgagttgacagaatgtccttcattaaacgagattcaaaaatatagtctctttttccaccaacatgatattaaattaagcattgatgacgtggggacgggcacgaacacgtttgagaatattcgccacgcactaccgtttgttgatcaaatcaagtttgcgatgcaaaacttacggatgagtgggcaagcggagcgcattcctcatgaattagcattttggcgtgatattgctcagtcttaccatctggaatttattctggaaggtgtcgaagaccagggtgatcaaaagatggccgaacaacaaggtattgaatggcaccagggttactattatgggaaaccgcggttagtcgatgatggtcggcaattggtcaacggcggatgctgagaaaggatccttacgatgacatggtctaattggcgaatttcgccgttcgtaacgagtattttctttatattaggtgttctaacactttactgggtcctctttaattggattacgacgtggtttcatgcccgtcacattaacattgacgatgataccgtcaatgcttggcacggtgtgatttacatgttggtctttgtgtttgtcatgcaactgtcggtcgtcggtaaagcagatagttgggagtttgttaactttcacttgattgccgtcgtgttctgctcgttttttttgaatattcgaatgccgtattattcattgttacctgtggtcatagtgtacatggttttcgaccagtcgattttttactgggaatcgtggagttacgccgtcgtgttcgtgctatttttctggagcatgaattatctacggctgtgggtacctaagcatcggtatccttggctatattactatggcgcggtcgctttttacggcggaatcttgtggggcctgatcaagcttaaatattcgctggattgggacaatactttacaagaatggtagattgtaaaatta

SEQ ID NO: 58 - DNA, 14540 bp, Lactobacillus plantarum
agtttaccagctaatggccggcgatttttgtaaggtgcaataatcacccctaatagtgcattctattctataattaagtcaaacatcatggacgttgctgacgaccacgtatcagccgtgacatgattattggggaggggaacagtatgaattatcgcaacttgctcgtattaccacttgccgtcttgttggtcggctgttcatcaccaacacaccaggattccaagtcaactagtcagacgaccacgagtgccaaggcaacggttagcagcacccaaaagaaggctaaggctaccagtagtactagtagtcggcctcaaaccgcagccacgcgctcgtctagaacagcgcgtgagcgggccgccagcgccgctaacaagtcggtcacccagcccacggctacgacccggctggcagcattgaatcaacaattgactaagacgttgggaaagcaggcgctcgttccacaagtcgatgggttaactagtggcagttcgaagttgaacatgcgctattcaggtgacgcagccaattacaccatcaattatagtgtgggacaacaggcccagccattcaacgcggcggccgtggtggatgaaacggcttatgcgactgtcactaagacgacctatgcgacaactaatgccgcggcccagcaggtgggttatcgtgataataaatccacagcagggctgccaaccgtcgatctcggtcatcaaatcaccgcgcatatcgacgcgggtgctggtcaacgatatatcatgtggaatgagggccgctggtcgttgaccgtgcatgcgaacatgatgcacgaagatgcgggcgtcgcgttagctaaacaggccgtcgctactttcgagcaggtctacttaccagcaccacagtcggtcggcgccatcacttttgacgcgatttcgtcaggctctggacctttagaccaagttatccaatggcaagctggtaaagtggtttatcaagtcaaggctcaagagatggcaacggctatcaaaatggctgccagtatgcaataatcaataactagtttctacgctcgttaaattaagcagtgagctgacaaacaaaagtagcagcgtaatcagccagagatggctagtacactgctacttttgttggttaggcgttattttcatctcattcgactgccagctggtgaatcgcgactattgatcagtcggagattggcgcagttgttgttcgatgggctgcgtcgcttttaagataagtgcttggtcactcagcgagatgatacggtggtgggtgatcacggcagaatcagttaatgcttggtaaacagccgctgcaaccacccaacaagtatcggtgtcgtaatcacgcgcatgcagtaaatcataaccgtcactcatatctaggtagacttgaaagccgatacctagccgcgcctgtaatcgtttcgcataacgttgataaagcgcgcgattggcctcagggtcgggggtcggcccgataatccgttcaccgagttgtaagtttggcactaagcgcacttgcatgtcggtgcctcctttgcgttgaaaattataatcctattttagtctaatccattcatgaaataaaggcactaatcagccgcagttaaggtgattagtgcctttatacgcattcagttaagctaagagacgtaatagtagccacccggcgacgccaattaacagggcgtaacccagacctggtagtagtgttttacgtaagatggcgccttcttgaccactcaggccaacgactgagctgacagcaacgatattatggacacagaccatattgccggctgccgcaccgacgagctgggctgccaagataatcgtgggcttcaaactcgcattggccgcaatatcagcttgaatttgcgcaaaagtcagtgtcgagaccgtggtactaccagttacgaacgcccctaattggcctaggaatggtgccatgatgacccaaacaccagctagataggtcgcgataaacttggcgatatacattggcatgctgggtaggttggcctgattcaagccagaattagtgaagacttgaaccatgatcagagtaacaccgagggcaattgcggtgttgcccatcgaacggatgaccgaatgggcagttggtagtaagggctttaatgaacgggcttgtactagtaacccaatgatggccgctaccgccaagattgtccctggcgaatagaggagttcccaatcagagttgatttgactataacctagaatgtgggaccacgataagttagcataacgggtcaaaacctgtttgattggtgtcacgacccggctagcgagtaatagcacaacgaccaacaggtaaggaaaccaagcggtcatcaggttcatcggactaggcgcaggcgtctgggctgccatcccgttcgtccgccatggcgtcaactggctcgactttggtaacaaccagtgcaatcggatcgtgatgatggcaataaccagcgttcccagcggtgcgatgattgaaacaaattcataacccactagccaagcactgaggagtgccagtagactgtaaacgaaaccgatcactaacgcccaaggtaagacggaaagccagcttttcaagcggtgtgccttagggccaaaccacatgatgagaattaaaatgagcaccgctggcattagcgcaccaacgaataaatcgagttgcgtgatgcgcaggccaatcaagttcaagacggatgctttttcggtcacattactcagtcccacggtcaatggtgttccaacggcgccgaacgctgcgggggtcgagtcagccactaaggccaagataacggccgccatgggtgaaaagccgagtgcaattagtaatggtgcagtgaccatcgctggggtcccgaagcccgagacaccttcaatcaagcccccaaataggaaggctaccaaaacggtttgtagccgcatgtcagcagacaaactttgaaagccctggttaatccggtcgattgcaccagtggcacgcaaacagttgagcatgagtaaggcgccaaataagatccataagatggggagggctttatgaatcgcctgcaaaattgaggcggtgaggaccgttggactaatctgccagaaaaagtagccggtaataatcaccaccagagcgctaatggtcattccacgggtcgcggataaattcaggcccccgagaagaatcagtggcaggatgattgcagcacttgcaataaaaatcatggtcgtaaagcctccttagatggtgcctagtcgtttgactgtgctcgtttgaaataatactgaccgtagagcgtgaccagcgtaacaatcagagaaatcgccgttaagggccaaaccatccctactagataagtgttcttcaaagcggttgaagctggattgaagaaattgagcaagtttaattgtcgaaaactgctaacaattactaagaggccgaagaaacacagttgacaaaacaggcccccataagtggaaaagcgatatttatgaataattgcgagatctggatcatcaacctcagtggcataaacgctagtattaatggctgggttttcaaaaccgacgtacaacgagatcaggagcaaaccggcaacatataaaacgggttgggccgtggcaactaacaaatggccgacaatcaagccaccgcgcgcaatcgtggtggcacgatgtaagtcatgccgtcccaataataaatatagtggccggccagtctcaaagcccaacaaatagatggcgaagaccaggtacatccccattttgccaaagacaaagacaccgaagaaactattaaacagtaggacaaaactcagtaaaaagccccgatcaacgatccgtagtttgttagccggcatggattgccaatcagcagctagttctagatttagtagaacaatggccacgacgataattcctaatacggccggtagtgcgatttgtaggctcgccttacgaagtaacgtcagtaaaccaatcgcagcaaagaagacgataaagaccacaacgcgccacggcttgatgggacgtacttgggccatttcgtgttgatcgtaaaatgcgagcgaaaactgactcaacaaacggccagcaggcaacgcaatgataaatagtagcgccagtaggataaaggcaagccggtaaccccagttcagcgcaaaatctagcacaaagagaatgccgagaactaagaaaattaaccagtaaattttctttaacttaaaatccgtctgcgcggacaagtgtaacttgatcgtcaagtaatagggccagatgttggcggatgtatatcctaagaatagggccccagccagcacggccacgatgttagccgtcaaactgaacaacaagctaccaagcgcacccagccagaggcaaatgagcaaataactactagccttgaggtttaggtgtttagtcccaaagacgctcgccgcccgggccacgtagaagaccacgatcgcagctaagtaattcgcgttgtgggtctgctgatacttaaagagaattagaacgtagggcaggacaataccgacgttagccaagaagttaagcgtcgcgacagagaagtccaacccagagtttcgtagacgagtcaaagataatcacaaccatttcgttagtttttctaggcctagtataccaattaatgcacataaatggtgttaaaaggtatgtttaggcacttttacctgtaaattgagcgccgggatacgtagatatatttaagccaatcgtataatcttactttaaccaaataaataaaaaaacaattcttaccaggaacgtcacacttctttcatatttattcacaaaaaacataaaattcttatttatcattatccacataatttaaataatgaatggggtcatgtagatatgatttatgcacaaatattagccggcggtaaaggaactcgtatgggcaatgttccgatgccaaagcaattcttgctgcttgccgacaaaccaatcttaatccataccatcgaaaaatttacacttgaaagtcgctttgatgccattttggtcgtctgtccagccgattgggtcagccatactgaagatatcattaaaaagtacatcaccgatgagcgcgttcacgttgtcgttggtggggccgaccgtaacgaaacactaatgagtggaatcaactatatccaagatcattacgggattcaagacgatgatgttgttgttacccatgacgcagttcggccgttcatcacacaacgtatcattaacgacaatatcgtcgccgttttagaaaataaagcagtcgatactgtcgtcccagcaatcgatacaatcgtccgcggtgctaatgatcaggtgaccgatattccggttcgttccgaaatgtatcagggtcaaacccctcaaagttttcacatcaaaacattgatcgactcatataacgcactcagctccgaacaaaaggcatcactgtctgattcatgcaaaatctgctcgctggctggtcaaaaggttagtttagtacgtggtgaaaattataattttaaaatcacaacgccgtttgacttacgcgttgcatcagcattagtagaaaagaggtcataagatgttaaatcaagtttatcgcttagtaagtccccgtcaatttgaagttgaaacggtcgccgaagaggtagacgccgatgatttgatcgtgcggccaaagttcttatcgatctgccatgctgacacgcgctatttctttggccaacgctcccaagccgcattacgtgctaagctaccaatggcgctgatccatgaggccgtgggtgaggtcgtttatgatcctcgaaatgagtataagcctgggacgctcgtcgcaatggtgcctaatacgcccgttaagaaggattcaatcattcaggaaaattatttaccttcttcaagattccgttcaagcggctacgacggctttatgcaagaatatgtttgtttacgacgcgaccgcgcaatcaccgtgccaagcgacttcgatccacacatggccgcattcattgagatggtctcggtcggcgttcaagcattaaccaagcttgaaagtaccatggatgaggaccaacgggttatcggtatttggggcgatggtaacttgggctatattacagcgactctggttaagcaaatttttccagacagtcagttgctggtattcggtcggcatcaatccaagttagattatttctcatttgcagacaaaacttacctggtcgatgacattccagccgatgtcaaggtcagtcaggccttagaatgtaccggcggccagggcagtgaagcagcgattcaacaaattatccagcatattcaaccgatgggaactgccattctaatgggcgtctctgaaaacccagtcggtatcgatacccggtctgtccttgcagaaggattgacgttacgaggcgtcagtcgcagcagccgtgaagattttaaacgtgccgttgatattttatcctccagtccagtcactcgcgaacggttgcaaaatttagttggctacgttcaaaaagtgagttccattcaagacattaccaacttctttgatagtgcacttactaattattggggcaaggaggtgatggaatgggacgtctaaagacggtaaagctcgtgttactacacacgagctttaatttattctatcaatttttttataaagtgtttggcccgaagaagggacggatcacacttgccacgatgcgcagcggtcaattaaacgacaatttggcagctcttgagcagggcctaaaaactgccaacgttaaaccggttactgtgttttgctatcattatgaccgcaccctggctggaaaagtgggcttcttgctcgcctccattaaagcgctatacgtgattgccagggctgacgtctttgtgatcgatgattacttttttccactttacgcaattcacaaacatgatgataatcaagtggtacaattatggcatgccattggttcattgaaaaagtttggcctcagcttaccgaatgctgatcagagcgtcatgaagccgcacacaaattatgattgggtcttgatcaatgcaaagtctgatcagcctgcttatctagatgccatggctatcaatcaagatcacgtcattgccactggatcgccaatggtcgactcgttgcttaatcgacaaccacaacaaccgcggctcgccgcccgtcgtattctatactcaccgacttatcggcaaggtgtccagggtaagcagcaagtcatgggatatgtcaacaacatgattgcggcctgtcagcagctgaccggtccatgggaactgtacatttcgctgcatccgtacttaaaactgtcagcgatgacgctaccatccaacgtgcatatcttccaagatgctgagcgggttaagacgctgatgccaacgattgatttatttataaccgattattcgtcattatcattgacgtttagttattttgaacgaccaatcattctgtatacgcctgattatgatgattatatgcaaacatctggattctatgtcgattactatcaatatttgcaagcaccgcacttcagcaaagcggcgcgagttgtcgattttattaatcaggaagttgatcatatggatctatcttatgtacatgaattaaagcaaaagacatttccacatcaagatgggcataataccgaacgggtcgttcaatttgttgaaaaattagcagggggagaacattagatgatacaacgactaaaacgaatcgcgcgtcgcatcgtatacggacggaatcaaccgcaatatactcgtaatcgtgaactggttgaggacgcacaaacgaccaaggaagacgttgattttctaaatacattgcgaattgagaaagatgccgaatcattgatcaaacgtcaagtgactaagctggaattcaacagttcttacttagtgattgagggaatggcgtggtttgaaaagtatcccgaacaagatactgaacgaattattaaaagcttaattttgactagcaagacgaatgaagaattagaaattccgttgatcaacgttcgtggtcaaaacgctgattttccatatgccgggtatcatggtgacatcaacttttcgacactcagtgagggtaaaccgctaacgccaggcacttatgaaatcaagatacaattaaaacagtatctaggtaatggttggattatcagacgaacctccattggtcaagtggtggaaacacagcaagacttaaattatacgactaaaatgacaagctattcagcgaaaagcaataagtcatacagtctaatttttcggtataatttagccgcccaagccttaaaggtcacttcatataaactgagtgatgtcaacccgcttgaaaatgagtttactgaagatgtcgggttagatagtgtagcgatgcgtgccattaaacgccgggcgctaaaactctggtatcggtggtactgccttcaaccgattcataagaaacaaatttcatttgtttccgatagtcgggtgacaatctccggtaatttcgagtttatctaccaggaattaaaacgtcgcaatactgattttaagatttcattctatttgaagccaagtattaaaaccaaaaaatcctggaaagaggttcgaacgttggctaaagcgttggctactagtcgctatgtgattttagatgacttttacccactagtttacccattgcatatccgggaaaatgcggatttgattcaggtatggcatgcggtcggtgcctttaaaacatttggttacagccggttggggatgcctggtggtcctaaggttcaatcgttaaatcatcgcaattacaccaaagccttggtttcttcgcataacatcgcggataaatacgcggaaggatttggaattgcgccggataagattcagccgctaggaattccgcggacggatatctttttcgatgagcccaagaaacaggcaatccgggaacggctcgcgcaagatttgccattcatcaagggcaaaaaagtcattctctttgccccaacatttcgtggcaatggtcagcaatcagcatactatccctttgaaatgttgaattttagagcaatctacgaagcgttacacgaagattacgtctttttactgaagattcatccgtttgtgcaaaacaaaccaacgttaccatatgaatattcggacttctattacgatgtttctgattatcgtgagatcaacgatttattactcgttgctgaccaattaatcactgactactcatcagtttgtttcgaatacgcactactgaaccggccaatgattttctttgcgccagacttagcggattacatgcaatcccggagcttttacttcaactactttgattttattcctggtagtttagcggaaaacacgggtgagttgatcaaccagttgcaacatccacaagttgaccaagctaaattggacggctttgtgaacttcttctttgatgatctagatggtaagtcgacagctcgtttcgtggatgcgcttgaaaatgacttcgaggatccgaacgcagctgagttagaaaataacgacggtctcgccattagtgaagatggtaagattatccctgattggggtaaaaaggctaaataatatgttaagataaagcagtcagtcacatcattagcgcatttacagcgttgattgtgtgaccgactgtttttgctaggaaactataggaggaattgatcatgtcacaaattacgacacggcggctcaccactgctgacgtgaacaaactacaacaaatcagtattgaaacctttaaggacacgtttggtgcacaaaacacctctgaaaatatggccgcatacttacaagatgcatataacttgcccaagttaacccatgaattagcggaacccgaatcacaattttattttgttgaacgagccggtgaatcattaggatacttgaaattaaacaccggtgcggcacaatcagaagcaatgggtccagacactttagaagtcgaacgaatctatatccgaaaagctttccaacaccaagggctcggtaatcaatttatgcaacaagcgattcaaattgctaaagctgatcataagcagaagatctggcttggtgtttgggagcataacgaacccgcgaagggcttctatgcgaagtggggctttgaacaattcagtgctcacgattttgtgatgggggacgatcgccaaaccgatttgctcatgatcaagtcactgacccaagactaagggcagtaaaggcttttgagtgaactgcttttacaagtttagaattagtcgctgtctgtggcgaccagcagattacaaatttatttaccccttgttttttacgggcaaggggcttatactgataatcaatcgcacacgattgaaaggagcatccgcatgacaccagaaattgaccttgctaatcaactttgttttagcatatacaatgccaatcggttatttaacaaattttatgtcgaagcgttaacaccattcaaactgacttacgcacagtatctcgtactaatggcattgtgggaacacgacgaccagtcattacacgagttaggtcaggttctgcgcttaagcagcaacaccttgacaccgcttttgcgacgcatggaagacgcagggtggttgcagcgcgagcgaccggcaacagatcggcgccagttactcattcatctcacgacgcagggtaagcaacaacaagcaccaatcgaagccgcgattgcaacttgtatcagtcgctaccacctgactgtcgatgaatatcaacaagcactggccctgaaccagaagattattaccgcattatcacaggatttggcctaaacgggcctttttattgaccgtttcaatcgcgtacgactgaaatataattttaggaggaatctctaatggcagattatgacacaatttttatcggtagcgggcacgcaacgtggcatgcggcagtggccctagcacatgcgcaacataaggtagcaatcattgaagaagataccatcgccgggacgtgcactaactttggctgtgatgctaagattctgttagacggtcccttcgagctgactgaacaactcaaacaatatcaagggattggcgtcaacacaacgcccaccatcgattggtcacagttgatggcctataagcaacaagtcattcaacctttatcggtacaaatgacggccgtcttcaaacaattggggattacaattattaccggtcatggtgagctgactgatacccacactgttcaagtagcggacagcacgtatacagcggataccatcgtcatcgggaccggacaacgaccagccaagctggctatcccgggtgcggacctgatgcatgacagtcgtgattttcttgacctaccaaccatgcctaaacggttgaccttaattggtgctggaatcatctcgctggaatttgccaacatggccgtgttactagggtcagaagtgcatattattgagtttgccgatcgagcactacccgcattttattcagaacacgttaaaaagatgatcacacatctacaggcagccggggtgcacttccactttggcgaagcgcttagccaagtgactaaaacggccacagggttaatggcaaccactgccagcggcctgaagattgagagtgatgatatcattgcggccactggtcggattccaaacatcgaacacttaggactaacgaaagttggcattaagaccgaccggcacggcattatcgtcaacgaccatttgcggacaagcattccaaacatttacgccagtggtgatgtcattagtaagactttgccgaagctaaccccgaccgcgatctttgaatctaactacattgccggccaactgcttggtagcactgccgccattgattatccggtcattccagcggtcgtctttacgctaccaagaatcgcccaagtcggtgtcagtgtcgaggctgcccagcatgatactgaacactttcacgttcaagcgctgccatatggtaaactgttagcctttcagtatcaaaacgaggtcgacgctgatttacaattagtctttgaccaagagaattacctcgtcggtgcctcaatctatggtaatggcgcaccagacctgattaacttactgaccatgattattgctgatcacgtctccgccacaacgttaagtcagaagatttttgcctttccaagtgcttcagtggggatcattgatatgttgacaccactactacaccatgactagttattaaaccaactaactaatttaaagatactgggtatgttgctgactacccagtatctttttgtcgtttcagattaactcactgactgaggacacctaataatttagcgagcaggaccatggcgccaccgagtgaccaaagaaagataccccagcttagccagctagcttgaacaaacaggctgatcagaataaaccaattcattccaaatagccaccagccgagcgtccttttcaaaatcgttgaccaagtatagggtgccgcataccgatttagcggcttaagcgcgattaataaggccggaataagcgcactctcaagcatcgccaaataatggtgcggatcactcgtataagcgattgctcccagcagaccatagcgactcggaatcgtcgttaatagggcccgttgcgcggtgtaaatgacgatcggttgtccaatcaataatgcgagtaatccccaagttgcttttttcatcaatctccgccgtccttattagttaataatactatcctaccaatttatgtacggcactaactaccgaataagtgtaaatttctcgtgaaaaagacgtaaagaataggcatgattcgttcactatgttttcataacataaataataggcattttaaaaaagtatgcgtataataccttcttaataagtttcgatgggggagttatgatgataataatcagagttgcaattatgatttcagttgttttttacttgtattttattattaacttattgttgatcaatcactatcgggagcccattcaaagctatgaaaaagggcccacaccctatgaattatttttggtcattccggtgctcaatgaagaacacgtgatctcgcgcacgattacgcaacttactgaatcactcgaacaattaccaccaaccgttcacgcccagatcattgccgtcgatgacgattcgactgatcacagtctactgttgttaactcagtcatcgtcgcgcttcttacaaatcctacaccgcacgggcaaccagcgtgcaggtaagggggccgtcctcaacactgccgtccagtatattcataagacgttagcgctaaaatctgatccgcaacggacgatcgtgggggtcctagatgcggacgcattcatgaatactgctgatttgacgcgggtactggcgcactttgaacaagaaccacagttggccatgattcaaacgagcgtgaatatctacaatcagcccaactggctgactaagatgcagaattttgaattcatgggggttaataatgctacccaacagttacgcaatcgccttggtcagggaattgcgtcaggtaatggtcagttcgtccggctagatttagcgttacagaatccgtgggggaatagcttacttgaagatctcgaattcactttgcggacctggctgctaggtggtacgcgaacggcctttgatcataccttggttgtccagcaagaggccgttgaacaactacgcccattttttcgtcaacgggtacgctggtgtcagggtgccgttcaatgcatgcgttatctaccagcactttggcgttcgggacgtctgaaccattttcaaaaattggacacgaccttttggattttgatgcctatcagtggttgtatcgtgccactgaccagtctaatcacgttagtcgtgcttgtgagccgtagcctacaacattggcaagttgggtggcatcacttggctatcgggacattactggtgattgctttttcggcttgcttggtattagcagcactgtatcaacgcaactgtgccgtcgtgaaacaacccgttggcttcttagatgctctcaagcagagtttgacctttcaagcattcctattgatcattagcctgacgccatacgtcgccatttaccgacagttacgtggtcaaacggggtgggccaaaacgcaccatggtgttacgacccgcgttgcaaaatatccagatactggcttaaaacgctcatattgagatgaaggtgcatgccgatgaagtggtgctataagatatttcaaattaccgttctcacgattgcagctgccttactcgggtggatgattgtcgccaactggcaagtcaacctgaaattacacctcgcaatcagtgcttggataggcgctggtttattcgtattgttcattggtgccacgattggccttggcagctggtggttgagccgccaccaaactagctggttagttgcagcactgatggggttagctatcttaaaatttccactagggactgtctgaaaac

SEQ ID NO: 59 - DNA, 21941 bp, Lactobacillus plantarum
acaagatattttacgctctcccaaaaattaaggcgagcaaaatcagaaaagctgggtttaacaatttaccgatcgtatcgacgatccgggtgggcctacgagctgcccagtaagtgatactgaagaaaatcaatgagtaagctaataaataccacggtgcctgtgccgaactcacatgactagcaataccaatttgaaacggcgtagtggctgtccgcggcgtcgcgaacaaggggcccaaagtcgcacaagtcagtaccataaaaatcgtcgcgtagcgtttgccaattggccgcgctagctcataaatcccactactgtgcgtcacactgatggcgataattcctaacagtggcaatagtgtccctgtcagcaagaatccccaaccagctgtcaaccaattggcccccgctagctgccctaagtgaattgggaaaatcaagttgccagccccaaaaaacatcccaaagagcattgatccaataatgatgtaatgtttgattgttaattttcgcgttatttgcatcgtcgtctctcctccgttaagcgtcgttctcatcaaccagtttgaacaatcactagtaggagcactcgatacaaaccaccatcactacttgttaagtgcattgtccccatcctctcaaaactgccatgagactaaaaaagcgtccttacaaaatcaattaatgattttgtaaggacgctaacgcgtggtaccaccttaattcgtcacgaaccgcagctcgtcacctttgcgcgtacggccaattgccaacactgatgacgggtttccccaaacagtaatgttaactgacgatacgttggcccgttaatgggggcacccagctaacactccagctcgtcgcattagcagttctcaggctactttccagccaggctcaccaccgcttcacaccatccagcggctcgcttaagattaccctgactttactctcctgatcatcacgtttagtctcatttatttttaatatttgcaatcataaactcattgcgtagtcttgtcaactgtttcgctaaaaataatcatccaagttaatccgataatgcccactgccgaatcgcagctgcgaccccgttcgcatcattagtagccgtcacgtgatcagcgtgtgccttagcaatatcactgccattgcccatcgcgacagctgttccggcgaaagcaaacattggcagatcattctgttcgtctcccagtgccatcacttcgtccggttgtatttccagagctgccgctaaatcctgaactgcctgccccttgttgacaccagtatgcatcagttccaagaagttagttgccgcacgtaccacgtacaggtcccgaccaaaagtcgtcttaacttgcgcttctacggcatcgagttgcgggccttcacctacaaagacccccttggcaacttgaaaatcagctggtaaatcgtcagggtctcgaatcaacagcccagctttgttttcccacgcctgtacaactgtgacccagctaacatcgcggtcagctgtatagatcgtactgtccgcatcgagcacgttaaagggcacgtgatgttgttttccaaacgcggttaattgccgatagtgcgcattatccactaaatgtttggcgacgatccggccagcaatgctctcgattacagcaccgttatacgtaatcacgtactggtcatcaccagcaatgcctaacgcatctaaataatgttgcgccccagcaagtggccgaccggtacacaaaaccaccttaatcccttggtcgcgggcttccttaactgccgcaatcgtacttggtaataattgcccctttgaatccagaagcgtgtcatcaatatcaatcgcaattaatttaattgtcatgggttttcgttcctttcaactgcgaatacggttacaattaagtcatgccaccgctcatcgcgaactataattctaatatagcatagcgcgtcagccatcaaggttgatttttgaaaggaagcggtgcgattttacaaaatcttgaagcgaggtttagtgatgaaaatcttacacgagacggtccagacaattccccgcctcccctttaaatattacgaacatgatccattgactgatatcaacgttgccccacactggcaccaagggattgagttaaattatctcgtcagcggtacgaccttaaaattcgtcaccgatggacagacgaatgaatatcggcctggtgacctttggactactaatcgacgcgtggttcacagcgctagtgggcccaccgaagttgactgggtagagttcggcctcatcattgacgacgatttcttacaaactcaaattccggcaagtgcgaactggcaattgacattgaacggcgcggcctcatcgaaaactcacccacaagcctacgccgatgtccgccaacaattagtcacgattcacgacctgttgacgacccccacgaccgatctactgagattacaaatcctcagccacttttaccagttacttgtcactctggggcaaacgtttaccgttcctctgactgcaacaacggtcagccctaacttgacgttaacggatacggtcatgactgccatcaatcgacattacgctgagcccatcgatggtaatacccttgccgagcaatttcacgtttcgttgaccactttgaatcagcaattcaatgcaaacgtccaactatccgttaaccgatacttacgactgatccgattgatgaacgcccgtcgcctcctgttagagaccgaccataagattgaatatattgccatgcaatgcggctttccgaatagtaagacgttcaatcggaattttaaatcttggaagggtatgacgcctactgactatcgtcaagcctatgcccggtatcaccgaattgatactagttgcctctaaaaatgtcccttcgtgatctgaatttcgtggtaagctacggctatcaattaaacgacgggagattttaaccatgattaaattaatggcaactgatatggatggcagctttttgcgtgacgacatgacttacgacgaagctcaatttgcactgctttatcaacaattacaactacggggcgtacggttcgtgattgcaagcggcaatcaatatttccaactcaagtccttcttcaaggactatcctgagatgatctaccttgctgaaaatggggcttatatccgcgatgccgaccacgtttacgcacttaacgcctttcagccagacgcaatccagacgattctgaataagattcaaaccatcccggatttaaagctattggtttgcggtgccaaaagtgcctacaccctaacgaccactaatcctgagcacgtggcgcaaatgcgacattattatcatcacttagccgtcgttgaaagttacgaccagcttgatgatgacattatgaagttcgccatcacatgtccaccagaacgcaccacagcgattgtgacgcaactacgcgagttactgacgggtatcgccgaaccaaccagcagtggtcatggcgacatcgacattatccaacccggcatgaataaggcggctggcttagcgcaactcggacaggttctcggaatcgacctcgcagacatggctgcatttggcgatgggggcaatgacctagaaatgctccgggaggtcggctgcggcgttgccatggcaaatgctcaaccagccgtggcagccgtagccaacgccacgacaggtacaaaccaagaacaaggcgtcttacagtggatcaaaaactggttggaggcgtaagccatgcaaccacggttgaccaccaccatcagtattcttagcctctccactgtaacaggcatcactaccgttattacaggaatcattccccagctcaagcgggcctttcccaccgtcccgactacgctgattgaatggctcgtcaccatcgccaactgtagcgcattgattactttgttactcaacccccgattaacaagccggtggggattacggccaatcgtgattagtggactcttgatcagcgccatcatgggactgattcccgctatcacgactaactttaccgtaatcatggtcagtcggctcggattaggattaggcgtcggcctcttttcaccacatgccatcagtttgttgacccacagctttaccggtgatttacgggctcgactgttaggttaccagacgggcctctcagccctaggtaacgcgatattgctaggattagcaggcctgctgatcagtctcagttggcacgccgtcttttggctatacgggctactggtgattgttgctgggggcgtggcgtggttcgtaccggaacccactgttccatcaacaacgactaatcacgcacgcactgaaaagacacaactaccacggcaccagtggacgttactaggacttacctttatcacctatctactcatctggggcgttcaattaaagctgccgagttactttagcgcccgtcattttggtaacgctgccactatcaacttaaccttagcagccatgaacatcggtggcttgctggctggtctcacctttggctatctataccgctatttacaccggttcaccttaaccttaggctatgccggagcagctatttcagtcttagtattatggttggcatccaatgcaactgtggctattggcgctgccgtgtttttcaactttatttactcgtacaccgggccatatttggtcttcactagcaatactggcctggataccattcaagtcaacgtcctgagtagctacctgacgattgccaccattatcagcgctttctttgcgccactggtctggaacagtctcggccaacttgggccacagacgctcaccgccaacgttctcatttggattatgctcattttaggtggcttagccttgattaccggcagccatcatccacgaaaggaagtttaattaatgaccaataataacgatcgtcttcatactggcgaactctacttacctaacgaccctgaacttgaaaaacgccaatttggctatctcgatcagctctatgatttcaaccaaactcggcccagcgaactaaccaagcgccaaattctacttagcaagatgttcgcagaaatcggcccgaagtgttacatcgaaccaccgtttcacagtaactttggtgggcaccatgtccactttggcaagggagtttacgccaattttaacctaacactggtagatgatacccatatttacgttggcgactatacgatgttcggccccaacgtgataattgcaaccgcgggccatccgattttgccatcattgcgcgaacaagcttatcagtacaatatgccagttcatatcggccgtaactgttggttcggcgcaggtgccatcgtactacccggtattacgattggcgacaatgtcgtcgtcggcgctggtagcatcgtgaccaaagacttacctgataacgtcgtcgccgtggggaatcccgcccatatcttgcgacacattaatgatcacgaccgtcagtactactttaaagaccgccagattgatcctagcttgttaaattagtggtttcaaaaaatcagtccatcgcattctctgcctttatcacggcagaatacgacggactgatttttaatatgcatcaaaataattaattctcgttcattttttgccaacaccttagcaacgttgatcgttggcaacgccacagttgggtattcatttgataactgctatcctcaacaacatagccttaagtttagaacagccattacaccacctaactatttatattatattcgagtaacccatcattactgattgttttatgatacgaacgtctgctcaacctgactacccgtaattaagatcactatctgagctgtagctcaaataaagtattattttacaatataaacttcaaaaatccttggcttaccaccaaccataaattgaacgacatccttttcccaaaagggtaaaatatcatcctcaaagctgtccattattaacctttttaatttaggatttttattcatgaaaaaatcatatttatttattattactgcaattttttgattgggtatccagctcaagtctgtcatccaatctgaataggcagcaaagcctgcataatctggcattttaaattttttacccataaaattcagatattgacgaaacgtgcgaacttttttgcctggtactgtaacaacaaaataatttaaatcattcaatcgttctttcaacgacacaagctcaactttatcgacaaatgaaattttattttccattattacctcacttaactttccgaatctaaaattaaagtgtaatacataaaagactaaccccccaaaaaccatcgaggcctatttcccctacccatactcaccttggaaacacggattaggcgtaaatccaaaccggtaaattcgcgattttatttccaaaagataatttatgcgattcttaattattactgaaatccaatccattcaagatgttttgaaccaatacgcatggtagacacttacttatcaggtatcatagatggttattttattaactgatccactatttaacgtacgtgttacacttgttttgagaacccggagtagaaaaattagtggctaatttgattataaaaatcgcctttaatttctaacattcaatgcgatatcttcatttttattttcagatagcagaataaggcttctaccaaattgctcaatcaatcctaactcactataaatataaaatttacatctatgctttctatcaggattatcgtcaatctccatatcaatctctatttttacacgcccagaattatcggccggtaaaaagcttaaagaaaatgctggtgtaaaatttccttctttttcaccaaattccacataaatttcttctttagcgtcgaaagaatatgcaataattttctcgccaatttcttttaaatctgtatcttgtacatagcacagttgatggattgttacaaattttgatttcgcattaatacttagttctaataaattattatcttcccaattttttgatatttctaaattactcatattttctcctctcgtattacttattctcacattggatgaaacgatacgacgaaaccgttgtccccatatgcgactcgatatacttttccattaatgttatagtccgcctatgctgtttacatacccctttaaaaataactttcagcaatatcaatgtcatgtgccatttctaatcctggaaactttttatccaatttccttaaacaatcaataaacttttgacttttcaaattggcagaaatatcctcaaaaacttcactgatccaatataagtccgtccgcatcacaatcttctaaatactttattgtaatatcctcattaagagacaaaagttcagtcactttgttccaacatttttcaataccacaatcatcatccacatttaattttttccttcaacctgtccaaacttgcggacttatcccaagtgacctgcgcaacggtctattttgcacatctcttactcaccaagagaatatggcactaacgagaatcggaatcagttaatttgacattttagataataactctgttataacaaactatagatcagatgctttttccttgaatttattatatattttcataaattcttctttttgagttctttatagatttgtacgtatttagcatttcatctaagtagttccagtattccccgggtgcgtctgtttttggaacaggattttcttctgagtctcttctagttccactaaaatctccatccgttaaatgatcagcaacattattatttacacttttcttttgagcaggcgtcaactcttcttcaatactttttggagttttatctccactcattttcttgacctcatataaacatcattaatacccaactagatccgttagaaatgatgcccttattttcataccagtaatcgtctaaaaagtccagaacgcgtaatttcatcaacattctggatcttcaaccgacttattttgtttgcttattgaatcgttgtcgtctccaaacaaacaacaggacatagataacggtaatcaccaaattaccaactaaactagttatcagttctcaaatgccgtcaccaagtacccgcacaaagactaaccggacgataaaataccaacatgtgttgttgcctccctcataactcaacttttctatgaaataaccgatactcggcaattagcccttgtcgaatatcggttattttaatctgactaattcatattacttatcggcccggtgcttcccccaaacaaataagccatagtaaatcaaactgaataacaagctaccgactaatgacgatactagcccatgtgtcgcagtttgtgtcatcacagctaagattgctcgaacggcaaaataagctactggaataatgacatctactaaattagtttgggtcctttttctcaaccaataactccataatcctaatcccagcgtaattcctatgatgactgctcaaataatgataatcattgtcattttttactatttttgaatacctttacgaggtccaacatcaccctttccattgccatacccatcactgtcttatccagcaaatcatggatatggtccagaacatttaaaagctgcaaattttgataatagctaagaattttcagacttgtcataagtgattagcacaatggtataccatactaatcgtggaacactggactaacaaaagccacagttgaaccagaaactcatacccaaggaccaatcgatgcgctcctgaaccatcactggtcttcaagttatccaaagccatctggaatgggctaatcagctaaaatcctgattaagaacgagttgaaagtattgtacttgatttaataactcagggattcttgtttttaaaatggatctttatttattatttcagctttaagacctttactagcaataattattggtgctgtgtcaaaatcttcagcattaatcttaaatatataatttccttcttctacttggtatttatcgatgactttccacatttctttgcctgctaccaactctataaatggcttagaattatttaagttccaatacagcaaactagacagataataaggtttcctgaaatcaatgttaatagcaaactcatcatatgaagtatctattctacctgctgcaacaatatctccaccatccacactagcaaattcaaaatccatccataaacatttttttaaataattgttaacctttaatatttctgaattgatttcttctatattcatatttctctactctttctctatttaccgacagggatatgggtattcttagcagctttaggattaaaatctggattaggcttaccacctttatggaactcttttagtacgctctcatgccaccaattctcatcaacatccatatattctacctcacttctttgctttcctgagacaggcacagagttcagggatgtccaagccacacctgctaagcataaacacttcttaccggtaacggcaactttccccgtaatcatggtataaatatcattatacctaactagattcgtcaaaaacgaaataatgcctttattaatacctgcaatagtctaaaaagtccagcacgcgtaatttcatcaacattctggatcttcagccgacctattttgtttgcttttgcttattgaatcgttgtcgtcccccaacaaacagtagggcataaacaacggtaatcaccaaattaccaactggtatgacactaccaactaaattcaacttattgcgtttccctaatgcataactccaatagcccaagccaatcgtgattacccccgtaatcaatccaatcacaataaataccaacatatgtcgttcctaccctcataactcaacttgtctaaacttttctataaaataaccgatactcggcaattaatccttatcgaatatcggttattttatttttatctgactaatccatattacttattagtccggtgcttcccccaagcaaataaaccatagtaaaccagactgaataacaagctaccgactaatgacgatactagcccacgtgtcatattttgtgtcgtcacagctaaaactgtccgaacgacaaagtaagctattggaatgatagtgccaacaaaattagattgatttctttttcccagtaaataactccagaatcctaagcccagcgtaattcctatgattactactccaatcattataatcgttaccatttttcaaccttcaatcaatttttgctattttcatactcttttacaatatctaaaaaatcatttctccaagaatattccttcgcatagtctaaacatgatttgccaaatccatctttcaaattgtaatctgatcctttattcagcagcaactgatacatttctttattgtccgaagttggcaaattatttattgtaatagcatatttcaatggaattgcattgtatttgtctgtcgcatttacattcattccatgtttaatgaaaagatttgttatttccatttcatattctatagtaggtcgcaaaacacaaaaataaaataaatgaagtgcatttcgtttttctttttgtgtagcataattcacatctattccttcagcaaataagaactttattatttgaagtttttcttctggatttttatcattagtaactgccatacataataaattcaaatccaagtttccactaatcacattaatatttccttcataaaaatttttaaagtcttgaaacgtgccatcccttactgcatcaaaaacatttaatattttcattgttttttcttctcctttttattgttcatatttatgatttctattagctgataggtatctcaaatccaaaattatttgggttagcttgaaactccttcaatattttcttaaaaaataaccggtactcggcaattatttctcatcggataccagttatttctactgactaattcattttacccattagccagacgctcctccaaataaataagtcatagtaaatcagggagtttattctataaggaaagtccgtgcatacaagccttaactatcactagaattcaaactatcaaagatgctttgaaatactggccacggcaaacacttgcccatcagccatcaatggatggctctacagatattaatcagcccactatttaagaatgactcgagggtgttacacttgatttgacaattcgagattgaactcaagtttaaaattcaggaaaatatcaattctcaaataagctagattcttaacattacttcatcaccactagctaccggagaccctaactaaaacagtgcgatgtatgttattttagttattcatcttcataaattactgttcctatgtaattaatacgatagttctcacctgtagcaattttcctaacaacttgttctttatcatagctataatcatacaacaaaataatcgcattataactatcctcttgatctttaaattgagaactcaactgattatcaaatgacattgtcacttactctattacttgatgaactgccgttaaccaattctgccaaacctcagtctgaatacgttggctgtgtggcagatacgctgccttccagagattacaactcaatttacgtacaggatgcgtatgcagtgcattgtccggaaattcaatttcaaaataatcccttaccattaagaaggccttcaaaatatctaatagctttttattaccagagcatctcgaaaacttccccttccaatagcgatattcttcattattttcactgatagctctattttgctgcaaaaaattacccaattcactatcatcactaacctgataataatgctgtaaaaatttcacaaacgcataatacgactgtgtcaagtccaccttttccagactgggccccatcggaatttctggtcgtggcgctggcaaaaccttggcaattggaaattgattttgccgaaaacccttttcctttggattaggcaatgattgccccgttttaagaaagggcgattcattgactggcacaacattcggattcgtaatccaattaacagctgcgacccaattttgccacacgggttcctgatttcgttgagattctgtcatctcacaaattattctaatgttatacgtcaagcttcctgatactggtgtcgttgctgcgatatccggcaaatactcattcacaaactgcttgacagcttgaaaactctcaaacacagtgtgattttcgttgctcacgtcgctaaagaaagcatgccagtcttccgcaattgcctgatcaaacaattccccatcatcactccaaagtgtgacactccccaatagacttccaagatcatcgtctctactagcccaatagtaggattccaaaaactcagacattgaaaagtaactttcctgttcacttaatctttttgtcaaggtaacttcactccattcttgatataccaagaaactttatgcattccatctttcatagcaggaactggtcgactattaataccaccatcagttattttaccatcgcggaccctaagcaaagtatcatcgtgtccccgtgaccaagttgtaaccggtagcggcatctttccccgtgatcatggtataaatatcattatacctaactagatccgttagacatgaaatgataccttgattaatactggtaacagtctaaaagtccagaacgcgtaatttcatcaacgttctggatcttcaaccgaactattttgtttgcttctgcttctacaagaagcggaagaaaatgagaaaaatgactcttctaatccataaaacactataaagaaagtcagtttgttggtgcccgaggaactcactaaatagctagcactttaacttgttcctcgagccttttcagcataacatgcccatcgtttgctttagcatttgaatctgttctttaaaatcttttctacttcgccctcaaaatctagcaaaatagcgtattaaaaacctaattccttcgttaaaagttgttttacctcacagaattaaccgattactctaattctaatacttttttattcaaatgaaatttgtactgtgttttcatttgtattctgttttacctgttgaataatttcttgtacttcagcttcggaaagcttttcatcttcatgtggcggttcccaattcttcatagaatctttgaatacaacaaattgacctcccactaacatttctccctctgccttcaccgcatactcattctccaaatcaaatttcacatgtgaactactacctgtaattttcatttaacttacttcctctcaaaaattattttttcaattcctgttttaggatcaatcgttgttattttcgttactttaggattattttttaatctaggtagctcaacgttttcccaaatattcccttttctcaactctgaaccaactaccgcacgaacttcaccagaaacttgttctgcatacgaaccagaagccaaatcccaagctttcattgactcaggtttattaaagtcccattctggcattttaatatttttatttcctattgttgattctaaagtaacgccacctttacttttagctacatcagccgctatgtcagctccaccaacgccatctgttctaccagaccaaaagaatgcagtatctggctctgtttttaatttgggatgaatttcgtcaatattaaaccctttagccccactggctttcttagccttatggtccttttttaccttattcttagcctttcgttttgtagtcttagctttagcacccttacgcttgcccggcttctttttagtaccgccctttttccgtgcatacgaagctttcctagccttgcccgcagcttttttcttgttatatcgcttctgctgcttcttggtcgttttatgcttcgtgccatgggaagtctttttgggctttgcctgttgatgcttagcttttttggcagtcttgacctttttagctttacgagccttctcagctgcctttttcgcagtctttttggcgggctttcgtttagctagtttctcggccgctcgctttgtcgccagtttagttgctcgggcggcccgtttgatccggccaccattcttcgcaactttctcggccttcttagcagttgccagaaccttcgcggcctttgctaacttagcgactttcgagacaggcacaaagttcaaggctgtccaagccgctcctaccaaccgcgagcgcttcttaccggtagcggcatcttttcccgtaatcatggtataaatatcattatacccaactagatccgtcaaaagcgaaatgatgcctttactgataccggtcttacgactaagcgtggcaattacagcactacctttggatgcatgctttttcgaagattttttcttgttagacttgccgtgcttcttagatgatttcttcttactggatttaccatgcttcttggaagatttcttcttattggacttgccgtgcttcttggaagatttcttcttgtgcgacttgccatgtttcttggaagacttcttcttactggacttgccatgtttcttggaagactttttcttattggacttgccgtgcttcttagaagacttcttcttgtgcgacttgccgtgtttcttggaagactttttcttattggacttgccgtgcttcttcgaagattttttcttgtgcgacttgccatgcttcttagaagacttcttcttgtgcggcttcttatgtttcctggccgctttcttcttgtgcgacttcttatgtttcttggccgctttcttcttgtgtgacttcttgtgcgacttcttatgtttcttagcggccttcttcttatgcgcctttttatgacgctttggcgtttttttcttatgccttaccgcaactttccgccgatgcggtgctttacggtggacgactctgcgcttagctttgcgatgtgcacgatgagacttcttggcgtgaccactagcgctatgtcgcaccttatgcttccgagtgtgggtcacaccacggcgatgtgcggagactgtgtcgaccgagctggaaaaagccgtgaaaactagaacaaacaccattaggccaatgaggatttttttaagaacctggcgtaattttatcatattagtcacgccctcgtttcttaataaccatcgtaatcgctaccgtgagtatcaataaacccactcctagccagaccaaccaggtcgcgaccgcggagttcgttttaggcaaaatttggttcaagattggatgttgcttcttgaacgccgatcgttgcttagcacgacttgccgccgcagcacttgctgaggttacacttggaactgacgcacttgccgtcgtagcccgcgactgccgtggcgctgtagaactggtagcggctacgacagttgctcggttagccttggtcgttggcgtggatgaagcctgcttcgtattagctttagttggtactgacgattgactagtgaccgtgctagagcctactgcttgactgctaccattaacactattcgactgagtttggctggaacgagctgcggcctgtttatccgcgtcagccgaatcaccggtcgtacttgagcttgatgagctttctgaacgactattttcacttgagctagttgaatgacttgattggctcgcatcactaatacttgccgaactagtcgaatggtcggccgcacttgaagctgtacggctactatcactactattagtgctcgactcactggcagcactctcagagctggtcgtcgcactacttgctggtgccgcagtcacatcattgttttcggctgcccacgcatagcctgaacccaatgtataggccattcccttatcaccatcataggtatctaggtaaaagccgtcaccatcggccccaccatcaacttcaacggttgtatctggcgacacataaaggttctgttccccttgatcagcctgcagcgttccttcatataacagtttgccattttgagtcagacgcgcccgggtattcgtagcttgcgcaaggggcgttgctgcgctgcttggattgttgttcggcgaaaccccttcatcattactgaataccggatcattgactggcacgccttcctcaaaagaagcgtcctcacccaagacaaccggcgtggaattgggttctgcaatcaatgcttgtaccgctgcactcgtatcactattgagactgctcgaagtttgggcgctgcccagtgcactacttgtgttttgatcctcagtaaatggtgacttgaaacccagtccactgtcagtagttgttccagtggtcgtatcatcggtattggttgtttcaccgtcagtagtttgactagtgctcgatgccgcactactatccgtctttgaatcagcacttgcactagtacccgactggcttgtagcctcagtgtcgccttgactattcgctgaacttgcatcgacactactggacgcgttcgttgcgttggtcgaactaccagctgttgattcattagtctcagtttggtcagtcgctgtcgtacttgtcgactgattactaccagactgactagtatcagtcgttgtcttggactcagtcgttgctgcttgactcggattgatttctttttgtgcggtaactttcaacccattcaacaatcctaagtcgtattgttcgccagtcaccattgatttcaacccgtcaaccgtgttggtctgctgactcttagtgccattcgcgttagtcaccgtggtcactgtcttaagctgaccacttttatcaaaagtcgtgaccgtttgctctgcgcctaacactctagtcgcagtcacttggccttgatcatcaaccttaaaagtgacagtctcattcttagataattcaaacgtatacttcgaattataatcaaagactaagctgttatcttgggtaccgtttgtatcactagccgcaatcgcaacttgagcagcatcctgattatatttgaccgtaaagccactatcgttggcataaatctgcgagacagaacggacattatgcttcgtatcttgtcgtactaaaacactactttgattaccaacgtcaacccactgcccagtcgttggttggtaataataattgaccgttgttggcttttccgttaccgttccctgggcattcgtcggtaagcgatcagtatcaactgtgtacaaatcttcgaaatcagttgcctcagtcgtgtaagtatcaccatatagaccagtgacatccaattcgtccagcttctgcccatccgttaacaagtaattgacatgaatgttgtatggcaacggatcataatacatcacggcttctttggtagtcttgctagcagtgccacgggtatgttcatccaatgtggcattacgcttatatccagttatcgttttgacctgcttagtaacatcataagctttcccgtaaccaactttgactgtttcatcaggagcaactttatcagtagaatcggtcatgtaatgatgtaccgtgatggtcgcttgattgtcaatggtattggtgacggtattcgacgtcttagtctgcttatctattgccgttttactcagttaatgaaagcatgaatttcaaccattactcacaaataaaaccgtgaggaccgttgtcaattccaacagtcctcacggtttatatcaaatcagtcataaaattatggcaatacattaaacaacagtgcgcctaacgcgccaccaaccaatggtccagcgattggcacccaactgtaggcccaatcagaagttcctttattggcgatgggcaataccgcgtgcgcaatgcggggacctaaatcccgggccgggttaattgcatacccggtcgttccacccagagacagcccgatagcgataatcagaattccgacaacaatcgggttcaatcccgccgtaaattggcctttcgtgaaggctaacaagccaaagactaggacgaacgttccaatcacttcactgataaagttccagaaatatcgccggataccaggaccggttgcaaaaatgccgagaatcgcgccagcatccttagttgcttgccagtgtgggtagtagtgcaaccaaaccacgaggccaccaatcaccccaccagcaatctgagccgcactatatggaatcacgtaggcccatgggaacttaccggccactgccattcctagtgagaccgctggattaagatgtgcggggctcataaagctggacgcatagacgcccatcgtgactgcaaatccccaacctaaggtaatcgcgacccagcccgcattttgcgctttggatttattgagcgttaccccagctacaaccccatcacctaacagaatcaagataaaggtcccgagaaattcccccaacaattgtagtgctaatggatctttcatcatgaccaccccattccttagccctgcttcagtgctgttaagtccgattcagcaatcgtctgattcaataattcggtttgtgctttgaccgttgcagcatcccaaccaaggtaatcggccattgtcgctatgacgccatcctttaagccatccagcgtatctcgcatgaataacaagtgattagtgcgccgcagcaagtagtcgactggcgtcagggtcatttcttcatccaaagcataacgtaagctaatcgtttcggctaaactcagaccatgcgtcggttcaactttaccaatcaaactaaagacccgcgcagcattggaaccgtacatatttgcaatccgcaacgcttcatcattcgtcaaaccattatccgtcccttgtttagcataaaatgcaatcgttgcatccacgttgtgcggatcaatatcgccaccagaaacggggaggttcttcgaattgatttcattaaagtgggcatcatacttatctgctaaaatcttggcaatcagcgccatggcacccgcagccattttacggtaatcagtaatcttcccaccagcaagggtcaacagcccgtctggactactagtcaacgaactaccgcgtgacaccgctgacggactgagtttgtcctctgccaaggaagtttccaagtcattcaggacactttcgacatcttcacgactggcttcctgactttcaaactgatcaacaaccttgataacttccttgaagctcttatcactgattttccctgaattaccaccgttataatcggaactaccgttagcggcaatcagtggccgcaatccggcccaactagcctcaatatcatctaaggtgattttagcagttggaaagcgacggttgacgatttccaacaagtagtcaacatcttcttgcgtaacggtcgggtgtttcagatcaccatgataatccgtatcagtcgttccgaaatacgtcttgttttcacgtggcaccacgaagatcatccggccatcttgatcaccagaatcaaaataggttggttgtggcactgggagtttctcagcgtcaacgactaaatgtacacccttggttggccgcatctgggattgatacttttcagtatggtccatcttacgaatcttgtctgaccatggaccggtcgtattgatgacgattcgggcatgaatctcgaacgatgcaccagtcaataagtcttcagcggtgataccattgatccggccatcatcatcatgtaagaggccggtcgccttcacatgacttgccataatcccaccattttcgtgagccttcttaatgttttcaatcactaggcgcgcatcattattccgaaaatcaaggtaaacaccgccaccaactaaatgtttagggttcagctgtggttcccgttgtaagacttcctcgcgtgaaagggtataattggtgaatttaggatctttaacttcggcgagcttatcatacagatccatcgccactttgacagaaaagaggtcgaaggtcgctcccgtctcatcataaatcggcaataacattgggtcgggcttaggaatgtgtggcgcaatcccctggacaaccgcccgttctttaacggtatcggcaactacccccacgtcaaacgtctttaagtagcgaatgcccccatggaccagtttcgtcgaccgtgatgaagtcccttctgcaaagtcttgcatatcgatcaacccggtcttcatgttcattgcagttgattgaatggcgacaccggcaccggtaatcccaccaccgataacgagtaaatctaacgtttcattttgtaagcgttcaatattttgttgacgcgtcgttgctgaaaatgccatgttgttgtcctcctctattttcctgcgtggtatggggtgtgcttaaagacttgggtcgctttgaccgctgcctgccatccctcgtataagttcgtccgttcagctggccccatctcagggtcaaaactcgtgccgggcttatacgacgcttttaattcttccaaatcctgccaataaccaacgctaagcccggctaagaaggcagcaccaagcgctgtcgtttccagattagcagcccgcataatttgcgtatccaagatatccgcctgaaattgcatcaaccagtcattacgagcagcgccaccgtcaacttttaatactggaatctcaataccggaatctttcttcattgtttcaaccacgtcccgcgtttggtaagccaatgcttgcaaggttgctttaataaaatcttcacgagtcgtgccacgcgtcaagccaaagactgagccacgtgcttcagagtcccaatatggtgcccctaaaccagtaaaggccggaaccacatagacttcattttcattatgcgattcgcgcgccgcccgttcagaatcaggagcgctttcaaccaggcgaatcccatcacgcaaccactgaatcgctgaaccggcaacgaaaattgacccttccaaggcgtagtacactttaccgttgatgccgtaaccgatcgtggtcaataggttattatcggataattggggtttttcaccggtgttcatcacgataaaagccccagtcccgtaagtattcttcacggttcccggttcaaacgccagttgaccaaacaaggccgcttgttgatcaccagccatcccactaattggaacttccgacccaaagaaatggtagtccttggtcttgccataaacttcagaattagtgcgaacttctggcaacatcgccgctggaatatttaataattgcaaaatctggtcgtcccacttcaaatcatgaatattgaagagcatcgtccgactggcattggaataatccgtcacgtgggtggccccaccggtaagtttccataggagccacgtatcgatcgttccaaagagtaattcacccttttcagctcgttcttgggcccccttcacgtggtctaagatccagcgaattttagttgccgagaagtaagcgtctgtgacgagtcccgtatgttgatgaatcaaatcaccatagccatctttaaccagcttctcagcaatcggcgcggtttgccgtgattgccacacgattgcgttatagattggcaagccagtttgcttgtcccaaacgatggttgtttcccgttgattcgtaattccaataccactaatttgagcgggtttgattcccgattcaatgaaggcattcgcaatagtagacaagacagcattccagatttcattggcattatgttcgacccagcccggctgcgggaaatattgtggaaattcccgttgtgagtcggccactttatggcccgcatggtcaaagataatggcgcgggtactggttgtcccttcgtcaattgccataatgtacttgtcggtcatggtgtgtcactccttagtcataacagttttatgaaaacgctatcataattgatgattgaatcataccatgtcgcgaccgttttgtgaatagatttgcataaattaaattttgcacaattgaatttacttggcaaattctataattaatc

SEQ ID NO: 60 - DNA, 21349 bp, Lactobacillus plantarum
caatctcgggggttcacttcacaagcgtaactttttttattactggtggatcactcagccatggtcggcaagcctagccaccaacttctgagacaatgtgaattaaaaaaatcacgcatttgtctctgaaaaaggttccaaccgttagtcaaatctggctaacgattggaacctttactttaacgtcgattattcaatcgtatcggcagcgccaccatgtgaagtcatgccattcaaatgatgcccaccagtcttactggacgctaagcgtcattacccgacgcgggcgcttcgtcagccgatttttggcggtaaaccttacgtggcttactcccctccgaagggcccaccacgccgcgttcctccatttcgtcgacgatccgtgctgcccggttatacccgatacggaagcgtcgttggagcatcgagacactggcggactgttgatcagtcaccaattcaacggcttcggcataatactcatcctcaccgtcacgagggtccccactaccagcggcatccgtctcgtcatccttgaccagcatactatcgtcataatcagccgtctgttgggctttgataaagttgacaacttcttcaacatcatggtcagaaatataagcaccctgcacgcgcagtggcttattcatgcccattggctgatacagcatgtccccacgaccaagtagcttttcagcaccgttactatcaataattgtccgcgaatccgtcccacttgaaacggcaaatgccatccgtgacggtacattggctttaattaatccggtaataacatctaccgacggccgttgtgttgccaagatcatatgaataccggccgcccgggccatttgacccaagcgaataatggcatcctccacttcgctcgaagtgaccatcattaaatcggctaattcatcgacgaccaccacaatatatggtaagacgggccgtgactgcccatcagccgcattttgttgacggatatattggttgtacccctgcatgttacgctgcttggaatccgcgaacaattcatagcgtcgctccatctcggcaacgaccttatgcaacgcccgggccgccttcttcggttccgtgactacgggcgtcaacagatgtggaatcccattgtaaacccctaattcaacctttttagggtcaatcagcataaacttaacttgacttggtttcgtgttcatcagtagccccgtgatcatcacgttaatggcaaccgacttcccactcccagttgaaccagcaatcagtaggtgcggcattttagacaagtcggcaacgactaaattaccagaaacatcacggccgagcggtacggccaacggtttggtcgggtgcgctggttgggcctcaacgatatcccgaaatgacactgttgaaatctgtttatttggcacttcgattccaatcaatgatttaccgggaatgggcgcttcgattcgaagatccttcgctgccagcgccaacgctaagtcgtccgctaaattgacgaccttgctgaccttgaccccaacagctggatgtaactcatacttcgttacggatggccctaagctgacattcttcacttcaacttgaacaccgaaactcgccaacgtggttgttagcttctgcgagttactctcaatcgttgcgtactcagcactctgatccgtttttggaatcttcgtcaatagtgttgactctggcaactggtagtccgcatcatccatcacttcagtcccttggagttcttgttcatgatcaaccgtagcagctgaagttggggattttatgggcgaggcttcacgatcactagccaccgtgatattcaagtcggcaggcgagctcgtaactgcactggctgctgagtccggcgccgaagtcccgctcgttgtctcagcaggggctgctgactgtggtacggttgacgttggctgcttctcagtacttgccgcttgattggcgcgcacttgttggtgaacccgccaacgggcaatttgaacccggagcacgtgcgtcagccattcataaccggatcgcagttgctggcccaattgcatcaaggcctgacgcaacgcttgcatcgtcttatggaacggcaaatcaaaggtaatgtagatactggcaaccatcaggatcagtgcgatcaaaattgtcccgacattagccaatagtggataagtgacactatagccagcagcgccgactaatccgccaccaagattactggccatgccccccttggcaaaatcatttttgatcagattccacgtcaacgaccaaaaatcggtatggtgattcaattgattaaacatcgggatctctaatagcaataagtaactgaagaaaaacaagttaccaccgacccaccaccgccaagtcagtcgtggccaccgaccaaaaatcatcaaatatcccatgacgaggagtgttagcccggcaaaaatctggtaggcattcccagcaatggctcggaaaaactctgcgaataccatgcccactaaccccaccttcaataaggcgagaatcgtgaccaatagtccaatcaggccaatgacattccccgtcatctgccgcttagccgcaaccgtcggcttcttcttgcgcgtcgaggtccggcgcttttttgttgttgcttgtctacgcgccacgcttcgttcatcctttctcaattaatactgtcttcattataacaaactcaagttcccccgtccccatcaaaaaacgcaccctaacgtttagcgctagtgcacgttctgttggttacttcaacttatcattttcatagtggtgcgaccgttcaaggtttgggaattgttgttgccgcagggcttcataaatcacaatcgcagccgaattcgataaattcaaggctcgaatatgtgaatcatcttggggaatccgaatggccttttcgggatatttgcgcataaatggttctggtaaccccgtcgtttccttaccaaataagaaatagtgatccttacccgtatcactataatcaacatccgtatagtcatgttcagcaaacttagacactaagtacaactgatttaaatcaggaatactagctaaaaaatcttgcaagtcagcatgataagtaatatcgacactatcccagtagtccaagccagcccgttttaagtgcttatcatcaattttgaagcccaacggttcaatcagatgcaaggccgtatccgttccggcacacgtcctggcaatattaccagtattcgctggcattaacggttcaaataacgcaatgtgatttgtcaaaataatcgtcctcattcatattagtctctacgccatgttcattcatagcaatcctattaatcataccatgtctatggttcaacagcgaactttgaaactaaaaaacgctttgttcgcattcttaaccaatctttcctatactaatcaccgtacgcgccggagggcggaacaggacgcacactggctgacgaacaccaatctaaacctgacacgttgtcatcatgattcatgccggattaacacgtacaaggcagcattcgaatcattttataactcgaggaggaattatctatgaaaattatgattattggcgcaaccggaatggctggctcagccatcaccaaactagcacttgaacggaaccacaccgtcgtggccatcggacgttctgaagaaaagctagccgctctaccggctaacccaaatttgcagaccaaagctaaagacgctttcgatctcacactatctgagctacaggcggttgacgtggtcattgacgcaatggcgactagtcctgataaggcttaccgacacgtggatctggcaactaagctgattgctcagctccgcgaacaacagcggccacgtctcctcttcatcttaggggccggtagtttaacaactggtgatgatcaacacctcttcgtgcacgacattgaaagtaatcccgccaatgctgccttcgtcgctattccgcaaaaccaactggccgaactgaccttcttacgaaccgtcaccaacgtcgattgggttggaatttccccggccgccaatttcacagcaggtcctgctaccccggcccagtacggccatgacacattactgacgaacactactggtgaatcagtgaccaatagtggcacgatggcggtagccgttttaaacgaactggaaacgcccaaacatcatcaagaacgctttacagtcgctaaccagtaaacgtcttgcctagcagcgctaaaatatcgagtggcagccaaaccacaagccgagcgctacttgagcaatttagttaactgtgacgcgctttaaataagaccaattaatcccgccagaatctgacgggatttttgtggcgtcgcaattgctggcagtatttaacagctaagtgctgccaccgccccatctctcctcattgcgacagtcgtagccaacattgtcactaaccagttggttgcattacaccgccagttaacgccctcaccgacctttaattaattcttcaccaaagcatgctaaactattgccatgattatttgaaagtggggataccatgaataaccgtttatcaggacggaatttactcttcatcggcaccatgttatttggactatttttcggtgctggtaacttgatttttccaatttttctgggccagcaagccggccaacacgttggtgcggccattatcggactattgatcaccgggattggacttccattactaggcgtgatcggcatggggctgacgcgcagtcagggcgtatttgacctggcaacaaacgttagccgatcatacgcgtatgtcttcaccgtactgctttactttaccctcgggccactttttgcaatgccacgattagcaactacggcctttcagattggactggcccccttcttaaccaccaaattacaacccgtggtgctattgggcttctccgttgcttttttcgtcgtcacttggttactggctcgtaatcccggtaagattatgacctatgttggtaagtggctgacacccatctttttgctattattaggtgccttaatgcttgtcgctatcattaagccactgggatcacttaacgtcgcggcgagtggcgcctatgtcagccatccagttctaactggttttactgaaggctacaacacgatggatgcgttagcctcgctagcttttggcatcgtcgtgattgatgtgattcgcgacctcggtgtccgtgatccggggcaaatcgcaactgataccattaaagcaggcctaatcagcatgagtttaatggcagtcatctatggtctgctggcgattatgggtaccatgagcttaggtcgcttttctccagctgccaatggggggattaccttagctcaaattgccgatgcctactttggccgattcggtaatgttttactagctctaattgtcatcatcgcttgcttaaaaactgccattggcctcacttctgctttcggtgatacgttgcatggcatgtttcctaagatttcctaccattggctgatcaccatcgcttgtctcattccagccattcttgctaacgttgggctaactgaaatgattacttattcaaccccagtgctgatgtttctctacccgctcgcaatcgtgttaatcatactggcagtactggcaccatggcttgggatgtcccgctggttatatggaatgacaactgtctggaccatgattccggccattcttgccggcattaacgctatgccatccgcctgggtacaagcatcctggttgcaagctttgcttcatctcaacgcgtggctaccgcttgccaatctagggttaggctggagtgtacccgcactgctaggttttggtttagggtggttgatcagccgtaaacaaccatctgcttctaaattgcattaatatagcgtcacatataaaatagcggaccttctgatagccatccacgacttttcagaaggtccgctttaaattacgagagccatgccaattgactggttgccattgaacctcaccggtgaatcatggcattattcaggactggtatgaatgcaatagcaacacatggtcacacctcaccgtcagcttttgaagacacaaaaaaacgtagtatttcggtgtgggcacggcgaaacgctacgttaatgaagtacaactcggtagtcaccaacgacatgtcgatgttaactaccaaacgatttctcaaaggttatcttaacaccggcgtttcaatcatgcaagcacccgcgctaacctttttgcatcgttaataaactcacatcaacggtaatcttagttaacccctgccgtttagcggttgcgagctgctcagcatccgcaccccagtgcagcggtgtcatgactaataagtcgttaaagtcaatgttatcaagcgcaacttggtattgaattcgttgccgcttagcagtgggatagtgctgggcaaacagatctaacacccgttgattatcatactgatactgtcgatcagtcggtttaaatagtaaatgacgcagttcaactaagtactcaggatttggcacgatcttcaataactgtccaccgggcgcaaggacccgttcaaactcttggtaagcggatggtgagaagacatccataatggccgtgaatgccccatcggtaaagggtaattgggccaaatcggccacacaataataagcagtcgtcgtcaattgggtcgctaagttaaccccatccttactaatgtcaaaaccaatccccacgtcttcagaattggcatgcattgtcaacaaatcagctaggggggtgccttcaccgctaccaatatctaagattcgttgcgccgtttttggcaatgccgcattaatggcttggacaatggggccgaaaaaaccagcttgcaaaactcggcgccgcgctgccagcatgttagcatcgtactcgctagcgacttgatgcgttagaaaatacaacgtccctttttttgaaaaatctacttgatgcccattaggacaacataagctgtggccgtcaattgtcacgtatgcttgattacaaactaagcatcgaaagcgatcgatatttgcctgaacaaactggatgccgcggtcaatttttttcacaggtgtcaccttaccttggttaattttatcattaggcgtcccatatccaagcgatgctttccagcttacctgaaactatggattcacgatgacaacatcgtgtaaaggacgtatgttcaatcataccatatcggggcggacaaaatagtagctgttacgatttaggtgtggtatcttattaactgttctaaaggctgacttaaattgtcaaaatgaatttgctaccgaatggcatgaatttaatgacataaaggagactcattcagatggcaaagaaatcaaaaattgcgaaagaaaaacgcatcgaagcaaccgtggctaagtatgccgaacgacgccaagcacttaaagctgctggcaactataccgaattggcaaaattaccacgtaatgcttcacccgtgcgtattcatcggcgcgactcacttgacggtcgaccacatgcttacctacgtaagttcggcatgtcgcgccttaactttcgtcgcttagcgcacgctggtcaaattccaggtgttaaaaaagcaagctggtaaagtgacaactggcgtgatattcactaatgattagtaacatcaccattcagttaaattaaaaaggttccacagaattgtcatcagacttctgtggaacctttttaatttggcgttattggtttaatcgcgtttcagcgccatctgagtagccaacaattaccttacttgttagtttgatcagttgatggggttgcttcagcctcatacaatcccgaagaccgtcgataccagtcaaacagatgtgtccacaaaactttcaagatcgcatagcctggaatcccgaaaataacccccatcaacccgaagattttaccagccgctaataggacgactaaaatcgtaatcggatgaatagctaagctactccctaagactaacggtgagataaagcggccttcaatcgtttgttcaatgacgaagacaatcagaacttggaccaacatccatggtgaggtgactaacgcaatgaccactgaaggcaccattgcgagaaaagaccctaaatatggaatcaaatttaagattccagccgcaattcccaacgtcagcgcaaatttcaagccaataatactgtaaccaaccgcaaacatcacggcaacaaagaacgccacggtcaattgaccacgaatataattactgacctgtgaattgatttctgtcaaaacttctaagaatcctgagcgcgctttggtaggtacaaacttagccatatacttcggtagttgatgaccatcgcgcaataggtaaaaaagaataaacggcattgttatcaacccaatgatgacggtcgttacggtactaaatacgcctgtaagtgaagtcaccgtcccggtcaaatacttcgaaaagcggccactcactagcttactgagatccgtgttccaactttcaagttggtcacggatactactgagttgcggatcattgagccagcgattaacttcagtactggcatttttccaataattgggccagtcattgataattgataaagtttgatcgcgaatcgttgggataatcgcaataatgcctaacgccaacagcgcgacaaccacaataaacaaaccaatgatcgtccaggttcgtcgtacgcgaaaacgcttttctagccagtcaacaagtggattaagcaagtagtacagcacaccggccaaaataatcggcaaacccacgatgctaaaaaattgccggaccggatctaatagccaatcgacttgcttgcccataaagaagatcgtcaatactaataaaataacgaccaaaatccgaatgagccgttgcgctgaccaccgttgtttctgtgaatcaggtttcaaacaatccctccttcctaagcctgatacgtaataacgctaccgaccttgattgttggtaactggtttggtgtcaaataaatgccgttttccattggtttggcaggtactggtttgaagtacaacgtcgcgtgcccaattgacgttaaattagcttccactagtccccctgcaaaggccaccgtataagtttgtcgatcgatcgtaatggtgctaccagcaactaacgacagactcgcgatgggctgctcaaatttctgaatcaccgcgatttgctgtaatggtgccgtggccgtttcatcgaataaaactaaaattggttccttggaatcgatagcattcgcaccaatcgattgtactgttgcagttattgtcatattgagacccccatcggttaattaattgctttaattgtagcatagtcctaatcacagacgccaatttgtcatcgcttacacgggccatatctatgctatacttgaattatctatcaaggaggtttgttatcatgcaagaacgcattttattcggaacatatacgaaaaaaacaagccaagggatttaccaaggaacccttgacaccactgccaaaaccttaaccaacgatggcttactggcagccactcaaaatcccacctatttggccctctcagctaaggattgcctatacagtgtcgataaggaagatgacgagggcggtatcgctgcttggcaaatcgacgggcaaactgctcacaaactaaacaccgttgtcgcacctggcaccccaccagcttacgttgctgtcgatgaggcccggcaactcgtctacagtgccaactatcataagggaacggccgaagtcatgaaaattgctgctgatggcgcgctgactttgaccgatactgttcaacatagtggccatggccctcgtcctgaacaagacggctcccatattcattacaccgacctcacgccagataatcgcttagccgtaatcgatttaggtagcgataaggtctatgtctataacgtcagcgacgccggtcagttaagtgaacaatccctgctcactatggaagctggctttggaccacgtcacctcgtgttcagtccagacggccaatacgccttcttagctggtgaattatcgagtcagattgcgagcttaaaatatgacgcccaaactggtgcctttacgcagcttggcattgtgaagaccattcctgccgactacacggcgcacaacggtgccgcagccatccgcttaagtcacgacggtcattttctctacgtctccaatcgtggctacaatacgttagctgtctttgcagtaaccgccgacggtcatttgaccctgattcagcaaatcagtacggaaggtgacttcccccgtgattttgatttagatccaactgaagcctttgtcgtggtcgttaatcaaaacactgataatgccactttgtatgcacgcgacttaacgagtggtaaactaagtctattacaaaaggacgttactgtgcctgaaggcgtttgcgtccgtttctagtaaaggatgaaactcatgttattaaaagaagtctgtgttgaaaattacactaacattcccgcagccattgcggccggtgccaatcggatcgaactcaacgataacctatccgttggcggtacaacggtcagtcgtggtgtaatgtctgaggcagccaagtataccagtgaacatcacgtgcccctagtgaccatgattcgcccccgtggtggcaatttcgtttataatgatacggaattaaaaatcatggaagcggacctgctacaggctcaatcattaggtgttgatggtgtcgcatttggtgctttgactgcggataatcagcttgacgaagaagccttagcgttattaattggtgcagccggtggcatgtcgatcaccttccacatggcttttgacgccatccctgaaaatcaacaagccgcggcaattgactggttagtagaccatgacgtcgatcgcattttgacacatggcggcccacttgatcagccgattgctgactgtgtcccccacttgcaaacgacgatcaaacaggccgctggccgaattcagatcctacctggtggtggcattaccaccgccaatgtcgccgacatcaccacaacactcggcgtcaaacaggcccatgggaccaagattattaattactaagaactgccaaaaaggcgcatctcattttttgagatgcgccttttgattggcgaagtaaactaaaaaattagaccattaatcacggttattcaatggtctaatattggcacaagcgcccgcactaagccaacttgccctgagccctcttccgcgaacaaattggtcattgtcaacgctgatcaattggctcgtgttcatcatcaatcatgctaattaggataaacataaaacagaccaaatcttaatggtcactttatgaattggcacgttgattatgaataattaaacggttaagatcagccggtaatggtgcaaaggtcgtgagggtctggctaatgaatggatcatcaaattccagttgcatgcagtgcagtgcttggcgctgaatccacgggtcacgaggaccgccataaagggcatcaccgatcaatggatgaccgctagctgcaaagtgcacccgaatctgatgcgttcggccggtatgcagccgtacccggacgactgtcatgttacgcagccgcttaaccacccagtactcggttaaagacggcttaccgtcgggacgggtcgttcgtttgataaatgaatcagcggcacgaccaatgggcgcatctagccacccgtggtcagtcgtcaattcaccactgacgacggctaagtacattttgcgcatcgcatgggccttcaattgatgatcaataatcgaatgggcaaaatggtgcttagcgaagagaacgataccgctcgtatcccgatccaaacgcgtggtgatatgcacaacctcattatcataatgggccgcttgataataaccttttacccgattcgctaaggtattgtcaggtaaggcatgcgccggtactgaggccactcctgctggtttattcacaatcaggtagtcacgatcctcatataagatatcgatcggcaacgtcgagacgcctaagtggtcattaccaatttcagcaggtgtgaccatcgtcacagtctcaccgcctgtcagcatatgaatcgctaataccggtcgttcatcaacgagaattgccccaccatgaaacttaacttttttcaacaaactacgtgtcacaccatgttgtgccaagagtgtcttaactttcatcgggttcgtctcatggttgatccaagtaaacctcattgctcgtccaacccgatgaaggatgtcccgacccgttgccagaagcgattatgacgatgctgagcaaatgcaattcgacgattagcaattgaataacgaatttgttcaattggccgcggctgcgtatccatttgatcagctgtaaagacaaagtgtgactgctgttgtggccgaatcgttattgtttcatacggcgctacgatgactggcgagcctaatgttcggaagactcggttgttgatcgacgcaatctcggccatttgtaaagcgtccaagcgcggatgaatgacagcaccaccaactgacttattataagccgtcgaaccagttggagtggagacgcataacccatcgccacgaaaacgttcaaatagttcatcttgaatataaacatcggcaaccatggtactcccaagcttcttaagcgttgactcgttcaacgccaaataatgatcagtcgcatccgtatccgcataagtaatatctacagctagcaagggataggtcacactctggccgttgtcttccagtaaaccgttgatcagttggtcgatttcataatctcgccagtccgtatagaagcctaaatggccagtatgcacgccaacaaagcgaacttggtcaaccatgtgactatagtggtgaaacgccgctaaaagcgtcccatctcctcctaccgacaaaacaatgtctgggtgctcatcatcaatttcaaacccggcagccagcagtttagtatgtaactcacccgctactttcttggtcttggcactcgcatttgcaaaaatcgttactttcatgaattttgatcttcctttgtcgtgtcaggctcatcgttgcccggccccttcccatacgagaacaagctctgagcttcttgaatttcctcacgaatttctgacatttctttatccaaactaaaggcggcttccgcagcccgttgtaatcgttgactcaagttttcagggaaatccccttgatatttatagttaagcgaatgttcaatggtcgcccagaaattcatggcaagtgtccggacttggatttcggccaaaattttcttttcaccaccgaccatttggaccggatattcaatcacgatatgatacgaacggtaaccagatggcttttcattactaatgtaatcgcgttcttccagaattgtcatatccgtccgttttcgcaataaatcaacgacctgatagatatcctcaacgaattgacacataatccgcaaaccagcaatatcctgcatatcttgttctaggcgatcttcttgtactttacgtcgggtcatcttttccttaatgctatcaacgggtttgacccgccccgttacaaattcaatcggttcatgctgattcaaatcacgaaattgtttgcgcattccccgcaatttaactttaagctcatcaacggcttgctgataaggcagtaaaaaatgattccaatcttccatcggggcacctccgtttcaatccataccctaaaattttaccataaatcgtcggaataaaaagttaacgttctcgagattgaaccctaagttcactttttttccaaactgtaatcctagaaacaaaatactttacgaatttagcaaatcggtgcatgattacgggtgaaggtttaagctaagtaacgagtgattttctgcattaaaaaatttatgaaatgaaaaacttgcaaatacctcgtttgattggtattctgcactatgacgcgaatagagaaagtggaggaattataacgtgttagaagtgtatttatttgtaaatccgttggcaaaccaatgcgtacgtgatgagcaaaacgtgttacggttggcaaacgactcagacaagcaaatccaatttcaattcgtaccattactcaatattaatgtgattcaacgggctctaaagtgccaaggaatcaaggcatccgactggcatgctcaaaatcaacagtctcaaacattgtaccgagttattttggattataaagccgccctttttcaaggcaaaaaacgggggcgtaactttttaattgccttgcaatctgcaatgctcaaggctggtcaacactattcggaagagctcgtcaaaacggttgcaactaactgtcagattgacttagacatgttcatggaagatcgggacagtgacttggcgaaacaggcctttcatgctgatcagcggcttgcatctgaaatgaacattaccgaagcatcgtcggccgtcgtttttgattgcgaccaatatgattatggtgtcttgctagaacattttaattacacgactctttttgacttagtcaatggcaatctggatccttttcaagatgcaactcgggcaaccaatgccagcggtgctagccttgccaacgcacaattacacgttttataattccagtaattgcaattattcaactggtcctaccagtcaaaagcacccgacgatcattttcgccgggtgcttttgactgtatttaccttttatagctgccagaataagccttctggactcggcagctaacaccctaactgataagcgggtcaggtctaaaataagcgtcgggaccgaacatcctgacgctcattgtgcttgcttttataactggttaatcttgggtgaccaactgttcaaattcatttaatcgttcttcaaatacctcgaaagctgcatcaagataatcaggcttggtcatatcaactccagctcggtgcatgacatcgattgggaaagcagatgaaccagctttcaagtaaccgagataatccgcaacagcatctgtctgttgcgtactaatacggtcagccaacgttgaggccgctgcaaaacccgtggcatactgataaacataataattgtaataaaaatgcgggatacgggaccattcgtcggcaatttgcggatcactgacgacggcgtcaccatagtagcgttggttcaactgcaaataatgttttgacaagcgatcggcagtcaaagcctgaccttcttgatcttgctcatgaagccactgttcaaactcagcaaattgcgtctgccggaaaacggtgcctttaaatccatctaagtagtaattcaagacatacgcccgcatttttggatcttgttcagtcgctaagaaatagttcgtcaacaagttttcattagtcgttgatgcaatttccgccacgaaaattgaatagtcaccatactgataaggctgatgatgtgtcgtgaagtaagagtgcatactgtgtcccatttcgtgcaccaacgtatataaattatcaatattatcctgccagttcaacagcatgtatggcgcggtatcatacattcctgacgaatacgccccgctacgtttgccttgattttccaccacatcaatccaccgtgaagcaaacgctgttttgacgtgtttgagataatcaggacccaaaattttgagcgcttgtaaagcagttgcttgagcctgctggtaggaatagttggtcgtcggcttgggtgccaatggcgtgtacatatcatacatatgcaactgatcaactccgagcagttgtttccgtaacgcaacataccggtgcaataagtccaaatgcttgtcaacggacgtgactaaagaatcgtaaaccgccgtcggaatctgattggcagcaagtgctgccgtccgcgcatctggataatgatgagcctgggcaacaaaattgtgtaccttgacttggctagctaaagtcgaagcaagtgttcgccggaactggccgtatactttatacagtgcttcaaacgcctctcgccgaacagccggatgaacggactcaagtaacaccccataaattccttgtgacaatttgacagggttgccgtcgtcatcctttaccgttggaaattgaaagtcagcgttattcagtacaccaaaagttttcgcagaagcaccaaaaatatcactagcgcctgcgagtaaagcttcttcgctttcagacagaacgtgtcccttttgcaaccggatcgtatccaacaaatgccgataatcacgtaaatcgacgttttcatcaaggtacgtatccaattggcccggcgttaattccaagattgctggttcgaaccaggcagtcgctgcggataccttggcagtcaaactactagcttgatcgtctaaagccgcattggtactattgccagtatcctggtcacttttcagacttgcgtataccgccactttctctaaccgacgatacagcgctaaaacagcctggatgccagccagcaccgtgtcggccgagcttgtaaacgtttctttaagcgcagtgacggtggggattgcagctttgacttgtgcaatatccgcctcatacgcggcctgatctgcataaatgggcgtcaaatcccacgtcagttcttcaggaacggccgaacgggtcggcaattgtttggttactaccatgcaaattcctccaattatttcaatatagcactagattaccacagattgcgcctatcgcggtagcatctgttccggaatcaatgtttgcgccatcgaagctggccggaattcacatgccactcagttttctgccagtttatcacttgctgctcgctaagcatcgtaatcatggtcgttatcagttgttgtattaacgtgcctcgtgcttgcaggcaggcacgccgggcaagtaatggccgtaattgggcccagatcaatgcctctaattgtggcccagtaagccgtccggactgttgccgcagtgcaaaaaagacgtgggcgtgccagaccagatatggtcccgataacagcggtagttgcggcacagtgggcatcgtccacgtcggtaactgggcaatcgttcccccgcgttgatagcaagccacttgtaacgcatcaaaaccacgttgatgtcgaagccgtgccaacattagctgttgataataatgccgtaaatgcgtgtccggcaaagttggggtgttaatttttggagccaattggcgaaaatgtaacaccgactggctgcgcatatccagtcgaatcgtttgataggtcagcggttccgtatccaatgtcaagacgtgatgcaataaacgaacactagtactttgagtgtccaaaaaaagtagaaacaggccccaccgttgctggtactgcaaaaacttcaaagccttgctattgaggtgcaattgtcgctgataggggcgtcccaacaaccataacacttgatagccatgctgacgatagccctgcgtccgagctgcgagtcgctccactgacaagggtgaacactgaaattctaacgcgagtggttgcgctgtacctcgtcgaaccaagatatccgggcgctgatgtatctctggcaaaccagcctctaagcgcaccgtataaccactggcagcgaaccaggtcgctaattgttgtttaccacgaagatggtccgttgtttccccttcagagaaagcatcacaatccgtggcatggacgtgggcaaaatgtggcacgatcactgcccccccgtttcaatcgcaccggctgcacacatcctggacagtaatattctatttggcgatcagccgtcgccgcattaacgagttgatgctgggcatccatcgcgatcaacatgatggtccctcctttcaacaactaattacgtcattaaagccaattctcacgtaaacccatcatcatttattgaccccgagcagcacccgtcttttggcaaagcgtccggcaggcagattgtttatccgtggatacaaaaaagccttaacattacgaataaacgttatgttgaggcaattaactgctatttaaaatagtgccggatggtttccaaagcagcattagacatgatcttttcaccatgttcaagtagtacgtcagctgaaatattagctaaatgggcatattccaaggctactgcgacatcatctttgatagtggccgttgatgattgatcgacaaagaaaaccagttctagataatattggtcgcgatacttgaataagttagacgcgagtccctctggccggaataattgtgccaatgaaacaagatcctcaaattgatcgaatttcaacacgtattccttagttggtgtatcaggatcatccaaatacggatcgagatcattagtgtccttagttggattatgtgcaataccttgtccatcttcaacctgattcgtatccgtctgcatcagtttacgcttcaaataatctgaaacatcatcttgtgagtcgctatcatccgattggtcgggtgactgagttgctttagcaatcgtatcttgtaaattatcactgtttttgctaataaataattctaaaccatttcggtttggtaatacttggaaagttacggcatcattgtcctgaaattgatgatcaacatcaacttcctccaagatgctatagaagaaactttcaatttgcttatgattccctagtaaatctagtacgcgaataccgcgttcattgagatcatcatttccaataacgacgcgaatcgtatcttcgttgatgcgttccatctccattacagatccacccctttctaagtgtcaagggccataatcactatcacaattctaacttatttcagtttattgtaaagtaatctatctgaaaatacaaaaattggccaattagttaagctaactagccaatgataatcacatatttgctaattgttgtgcccgtaataattctaatgtccgaattttgcgtggcaagaagcggcgaatctcgtcctcattgtaaccaacttgcagccgcttctcatcaagcataattggtcgacgtaacagactaggatcatgagtaatcatgtcaaacaattcattgagtgacaaatcattaatatcaacgttcagttgttgaaaggcctttgagcgagtggaaataatttcttccgtccctgattcagtcagttgtaggatctgcttgattttttcaattgaaagcggttcggtaaacagattgtgttcttgaaaatcaatgtcgtgtgtctgtaaccaagccttggctttgcgacatgaggtacaacttggtgcggtatataaaataaccatcctgggtcctccttggcatcgttaatcaattttataacataattcattatacgctactcacttttaattgtgaataggtttaacaaaattaatttatttaaaactaataatctaaaatacaattattcgatatatgtattttttctattgaataaaccgcttttatagtcattcttgttattaattaattcgtatacaatttaattatgacttatgatatcaataatctattaacggtaaactgacagaaaaagcttagcaaaatgatttgctaagccctatcatactagccaagattcaattgtaaaaacttttgagcaactgtcacttgaatgtcattaccggcggctgcttgtgcttcttgttggagttgtgtaaatgagacatcttgtggcaagtgtgtgagcaataattttttgacgcgggcatctttggcaattttaccagactgtgccgacgtcatatgccacattttaccagttttatctgcggcaaaattcgtatcagtcatcaataactgtgccccggctgcgaaagtcgctaattctggcaaataagccgtatcggcggaaaagacaagttcttgccccgtcgctcgctcgaccaacttaacggcataggctggaactggatgtttagtcggtaaaaagctcacatcaaacggcccaatctgattgacagcagccggatcataggcccgaccttctgtggcattcgcccaggtcaaggcaccaaagttaagtggatcagcggtgtgcccgtaaatcggcagcacgggcgtcttccgttcaccagcacgcaactgccagtaatattgtaagaccccaacgtccgccgtatgatcgtgatgataatgagttaggagcacactatcgagctgtaaggggtctaaaatctcttctaaggcgtttagcgcccccgacccacaatcgagcaataaatggtaatcaccggctgtaatcaggtaagaactcgtacccacgccatcgtatggataaccaccatagtaaccaagaactgttagtttcattattgaccatcccttcatttctctgtccacttctattttaatatagcaccaagaaaaaatgaaaccaacaacttaacatattttcaattattttgaaaaacacgtataataatagatgtaataaataaggagtgatattgatgagtggaaagattgcagcaacatttgggacacgtaaaattctaaccatgatccaacaacaaaatgctgatcgtgacttgttattaatgcaggccaacgccactgaagatcgctatatgctactcgatttaaccggcgaaaaaaccgttttttcaagccccgtaacgtatgacgttttactttcaaaaggatcagctgactggcatggaatgacaagtttcatcttcattgatttaccggaagaagaacaaaaagtctttaaatctaagtttagtagtttccgacacgattataataagccagatgggctgaaacatttttggatcttacgtgagtccaaaaataattcagccttcgtgattgtcacaaattggcatagcgactccgaatatgctgtttggctgcgaagcgcttcattcaagccatttgccaagtacatcacctcagattacggctaccacgaaagtcgctattcatttgtacgttcattaaaatcataatcatccggtattggatatttcaagtcgctgcagtgattgaactgcaacgacttttttcatgaatattacttttactcaacactgctaaatctcatcagttgatatataagcctcgttcacaacatcacattgcagtcagaaccaacatatgtcccgatcagtgtgatcctaaagaatctgccgtcagctttagttgagcaatcgtgagcccaatcagccatctgttgaatgacacccaccctatttactgattacagtgcgcacctctttaggtgatctcgtcaaacagttaatattctgaaaacacaaaaaaacgtcattcatcaacgaatgacgtttgtgacggtccgtacgagactcgaa

SEQ ID NO: 61 - DNA, 38204 bp, Lactobacillus plantarum
ttttaagacggaccctagttaaaaatcagtcctaagcccatgaaaacgataaatgaaagacaaatcaacgttgcgtttttaattgaaatcgtgaaagtttctcgtttgacctgtttgtgcaagaagacccgcgtatttttccaaactggaataatactgagcaacgttagtaaactaaactttggcagcacacccatcaagaccgcgatcaccagacaagcataaccagcaacgtaactccatgcaaatacctgaagcatcaccggtttgccaagataatacaaaatcgtgtgtcggcctaacgcaatgtcctcgtccatatcacaaatattattagctaacataatgttagaaattgcaaaaatggccagacctgacgcaattaaaacagccagcgttgactgccaagtaatggctgccgtgtcatacgtattaataaagacggcaatccagaagatcataaagcccatcgtaaagcccgagaaaaattcaccaaacgggccttgtgaaattggcttcggaccgccagcgtaaaagtaaccgaccgcatatgaatatagccccatccacaacaacggcaacccggtttgtgttactaaccatagtccgataatcaatgagattccggctaaaccaaacgtaatcgtccgggcctgaccaatggaaatctggttaacaccgaccacattagtctcttgcaaaaattcttgattgtcgtcattacgtggcgcgtgtaggaagtcttggtaattatcattcgcattagtcgccatatgaaaaagtgaagatgcaatgaaaaatagcaataaataaccaagatgtaactgatgataattataataggcgtacatactccccaaaacgaacggtaacacgctcgcaattaatgatttaatttcaacaaattcaagaaacacttttggtttcaatgatttacaccatccttttgtttgacaacgaaacaagttatttgtacctttaatatagattgtattttagaatgtgactggctgcaagtgttggcgtcaaaacgtcccggagccatctctcaaataaagcggggtattttgattatgatgcaaaccatttggcaaccggaaagtcttgtcgcaaaggagctagcagcgctgaagccgtatctagctactaacgtaaaaattgataacgccgccattaatgaccgcgtacacgacttactcgctgcgggtggtaagtttttacgcccgggcttcttttacttgtttagtcaatttggaccggatcataacacggcccggttacgtgctggcgcagcggctatggaactactacacgtggcaacactgattcacgatgatgtaattgatgaatcgccagaacgccgccatgtgacaacgatccaccaagactacggtcaacgtaatgctatttacgccggtgatctgttgtttacctgctatttcgatcaagtcctgattgctgccaagacagctgacgacgttaaaatcaatactgcggcgatgcgagccatcctccaaggcgaactggatcaaatggcacataacttcgatccgacgaccacggtcgatgactacttagcaattgctcgtggcaaaacggcccgtctgttcagcctcagttgtgaacaaggtgcccacttcgcgggtgccgacgcaagcgtcgttaaactagcgcaacagattggtgaaaggatggggttagcctaccagatgttagatgacgtccttgactacgccggtgatgaggccttaactcaaaagccggtgcttaatgacttacgggacggcgtttattcactgccacttatctacgccctgaccgctgaaccacaattggccgaacaattaccccaacccggcgaccacatcagtaatgaacagctactgacaattcgcgatcaggtcattgctttggggggcgttacccaggcacaacaattggctactcactataccaaaaccgcactgaacctaatcgatcagctaccaactggtgaaacacaacaaactttacgccggctagtgactgaattactggttcgcaaccactaatacacaaattaaatcagcgcgtcaaagtaacctattactctgacgcgctgatttttcagctacaaccattactcaccctacaccgccgcgatttagtcaaaattgttatccattccgccgagataaatagtattatagtgtttgtataaaaattgtaataacggggctatttttactaggaggggtttcatgaaaaagattgttaattggttgctggggagcgtactaatgatcgcagcggtcacaatgctaagttcagtatctgcgaatgccagcacttactatcatcgcacgccaacgcgggcaacggctagaaaggcctattatacgaccgataccaaatcacatacctttagggctaatggtaattataatcgttggacattcagggccaatcatgatttgaagaactatcgcaacaccgtctggacaacgactcagcaaactgatattatcatgcacggcaaaaaggttcgttactactgggttcacaatagcaagaatggggccactggctggatttggagtggctacttaaagccagttaaagccaaagctgccaccccatccgaagcaacactcgtctccagaatgcgcgtgtccaaaaaggctcagcaaatcgtgacggtcattcaaaatggctcatccacggccactcttaaactttggcaaaaaaccaatcgcggctggaagaatacactaacttccgcaagtcgcatcggggccgctggcatcggcaattctcacgaaggcagcagtaccacacccaaaggcgtttatcacttaagcttcgcatttggtaaagctgccagtgcaagaactagtggtatggcctatcgacagatcaaccggaaatcttactggattgaagatccacatgaccggcaatataacacttggcagaaccgaaactgggccaataataagaacgagcatctgatcgattacacgaaggccgcgccccacaatcagtatcaattagcgattgtgatggacaatcacggtcagcataatggctcgggcttctttattcacgtcaagaatcaatgggcaacggctggttgcgtctcaatcaattacaatgatgtacggaccttactcagccgcttaggcacgaaagcctacgtggtcgacgttcagaatcgggcacaattacaaaattactaacaggttaaatcataacctggcgattaattgcatataaaaaggacttggtcacagcgaccaagtcctttttacgctctaaatcggcggtgtaatcagtaatggtcatcatgaccactacattcgtaggctgaatacccattcagcgcagtaattaaaagtctgtttcacaagcccaaggtgcacgtgaagactgctatcaaccggattaccgatcattgttcgcatcatcacgcccttgatccaaatcataaaggcgtttaaaccgaggtgcgttcgcatacaattcgctcggcgtaccggccatatcgaattgaccatcttccaagaagcgaacttggtcgacatggttgaccccggccaaatggtgcgtgacccacagaatcgtcttatcatgcaagacccggaacaccgtggtcagcaaatgggcctcggtaatcggatcaagactaactgtcggttcatctaaaatgatgatgggcgcatcttgtaataagatgcgggctagcgcgagccgttgtcgttcgccaccagaaaagcgcgcaccgccctcttctacaactgtctcgtaaccatcggggagcgtgtcgatcaagggcgctaactcgactgctgctagtgcggctttaacttgttcgtcagtcgcttgcaagttacccatccgcacattgttcataatcgtggtattgaacaagtacggctgctgatccaagacgccgaataactgggcgcgctcattttgtaaccgtgtgatgggcacatcattcaattgaaccgtcccactatccggtgtcaggtcacctaaaatcagcttgagcaaggtactctttcccgttccggaaggtcctagcagggctaacttttcaccggcttttaaagtcagattcaaaccgtcaaaaatcgcgtgaccaccttccgcatatttaaagtcaaggtccgcaatacgcaatacttgaaatggctccgttaagactgtctgatcgtgttcatcttcaggcgtggtgtctaaggcgttgactcgtttgattgaccgttgataacttggccactcactaacaccctgactaacagactgcatggcatcgaccaacgggaatacggagaggacaaacgccgcaatccaattggaactagccgcattcgttgtccagtaaaaactactccagatcaagagcgccaaacaaatcaccccgaaaatgatctgaatcgtaaaatctcgccaccactgaaagcgatggtcctgtttacgaagtgccgcaattgcttcgataggctgggtttgccgctcatagaaatccgtttgacgtccggcaatcaaccaatcaccgagccccattaccgaatcagtcagctgcgtataaaagccctgttgaatctgacgactgcgtgattcacgagcaccattcagtaagaccgaccatagcggcattaccacaacgaccaatcctaacatcaacaacatcaatagcccgaaccaccagctaaagtagcccagaccaatcacaatcactagcgtcatcaaccaggcaatcaccgttggaaaaacggtccgtaaatataaattttcaatatggtcaatatcgtcagctaaaatgctcaggacatcaccagtctggaaattttggcgaatcgctacggcgtgcttggcgacggattggtacagtttcttacgaaaatctgacacgatccgtagcacccagttatgactcgtaattcgctccgcatagcgaaaggcaggccgaccaatcccaaacgctctcgttagaacgattggcacataaatcatcagaatattatacgggtgtcgtgcggctttactgatcaagtagcccgagttgaacatcagcgctgaaccacagaagaatgtcattagacccaaaaacagcgtcagggctagtaactttttatacttgcgcaaatacggcatgacccaagtatcatttttaaaagttgccaaaaaatctttcattagatcgcacctaccatttcatcacgtaaccgaacgtacgccccgtcatgcgcggccaattccgtcggtgtcccttgttcaacgatttccccatgatccatcactaacacgtaatccatctgattaatccagtgtaaccggtgagtcgcaaagaaaactaagtgattatcaagtacaggtaaaatcgtcgttttcagttccgcttcagtttcaatatccaagtgggcagttggttcatcaaataacagaactcgccgcgagtcgtcaagaaaggcccgcgccaaagcaatccgttgcgcctgaccaccactgacaccacgggagccttcaccaatcgccgtatccaaccccgctggtaacgttgcaatccaggccgttaatccagcgttttcagcagctcgttcaatcgcttgacgtgaagcgtctggctgataaaaagcgatattctctgctaacgttgcatggaacagatatgggttttgcggaatgtagaaaaagctctgctgccaggcgtcttggctcaaatgcgagactgtttgcccgttgacttgaattttaccctgatcagcgaccggggttagaaagccacctaacaaattgatcaaagttgatttgccggagccggatgccccaataatcccgatccgttggtaaccatgcacatcaatattaatgtgttttaaggccagctgatcatcatcatacttaaaatcaacgtcatgtaagcttaacgtactatcactttgccattgcacaggctgagtaccgagctgttgacgttcagttggcaccggcaaagctagcatcttctggacatccgcaaacgcattcttgccatttaaagtggcatgataatcattagcaaatgttcgtaatggcaagaaatagtctggcgataagaccaaaataaccaacgctggtagcaacgtaatcgtgccgttaatcaaaccaaaaccaaggaagaccgcgacaaccgcaatcgataaggtcgtgaagaaatccaaggcgaaagtcgataacatcgcaatcttgatgaccgccatcgtttgcttacgataaccttcactaacctgataaacgttgtcagcgtaccgtttgctcagtcctaactgcttcaaggtcggtaaaccgcgcagtgtatcaatgaagtgattagacatccgttgatagcccacgtactgcttatccgctttagcttgagcggcatagcccaaaataatcataaatagaataattaatggaaaaattgccagtagaaaaagggcctcacgccaacgcaaccacgcgatgtaaattaaaatgatccacgggatcaccatcatgtcgattactttaatcacaaccaacattaagtatgtctgaactttatcgatgccttcaagcgctgtcgtcaccacgttaccagtcccagtcttagccacataacttgggccgagccggtataacttctgcatcactttacgccgcaggtcacccgtcgtctgttcgactaacggatacatcacacgatttttaataacgaccagtaactgccgtccgacccaagctaatgcgaaccatagcatgggctgactgatcgacgccaatgaatgcaagtgccacagtccaacaatcgccactgatagatagtaggcctgaaagacaatacaaataccctcgacgatggccagtaaccctaaaatcgtggctgctcggcgcatccctggtagtttaaataatgccggatcaaacacattcgatcactccctacttaaaatgaacggggtcgcaccctggcacttggccaaggtcgcgaccccgttggtgctgttaaattaattgtaccaccgcaccagtgatactgtcgtcatctgcatttgaattacgatgccaaccgtttatagaagacccagtaactccaaataaagtagatcaacataatcggtaataccgataatgagattacagtcatcagatgcaacgtatatggtgaattagacgcatctttaatcagaatgctgtatgcagaattgttcgccaccatgacacgtgggaatagtccattgaacaggagcacgaccacgtcgatcagtgagagaccactgctaataaatgagagccattcatgatttccataaacaccccaagttgccaagaccgtcaaagccactaaggcgaccactaaaatcgtggttgagatgggtttcttggtaaagaaatcggtgttaaagaacagcagaattgcgaagacaacttcaccggcaaacaggacccagtataacggtttggcccactgaagcgcccgttcacgcaacgtcccggtcgtcttcagacgaataaagtttaacccgtgcaaatagcagagtaacgttacggcaaccccaccaacgattgagaacaagttcacgtaatcggtgaagtgggcagtcatatcgccattggcattgattggcatccctttgaccaaagcagtaaacatcatcccaaataggaaggcagcaaagaaactacctagggctgcggcccattcccagaaattccggccggcgtcactttccatccggcttctaaattcaaatgagacccctcgcataatgagggccactagaatcaacaataagataagatagaatccggagaataaggaagcataccacattgggaacgacgcaaacatcgccccaccagcagtgatcaaccacacttcattggcatcccaatgtgggccaatcgtatgaatcacaacatcgcgctcagcgcgtgtttgggctaagctcttaatcgtcatcccaaccccgaagtcaaaaccttcaaggaagaagaaaccactaaatagaacgcccaccagaataaaccataagaattgtagattactcatgactgaacgcctccttaccataaggatcgtacggtgcgtcatcgctagcttgtaacaaatcatcaggtccttggtgtaaggcacgccgtgataagacgatcatgacaatgcctaagccactgaacaagcagaagtacacgatgttagagatcagcaacgaagcgacactaacatttggtgaaacggcatctgcaatcgtcagtaaaccataaacaacccatggataacgacctaattcagtaatcagccacccggccgtgtttgcggcgaatggtaagaacgtacagattcctagtacccacaggaaccagcgctgccgctcaatcagcgttgactttgcacggttgaagtatagaccgataatggcaatcagtgcgaagagcccaccagctaccgtcatgacccggaagctccagaaaagcgtctttgttggcacgtagtagttcatgtccttaccaaatttcttgtcatacttggcatgaagttccttgttaagggtattttgtcccttcacattaccggacaacttatgatagcttaaaatatccaacacatacgggatttcaatcgaccagttggccttatggttcttagtatccatcccttcaataactgcccatgaagctggcgagccggaatccttatataagccttccgttgcggcaaacttcatcggttgttctttaatgatgtaacgcgtctgtaaatctcccattccaatcacaccgatggaagcaaccaggccaacgattaaactgaccttgatcgatttgcggaagaacgtgacgtttttctttttgagtaacgcaaacgccgccatcccagcaaccacaaatgagccggtaacaaacgccccaaacaacacatgtggtaattcataccagagctgttcgttcttgacgactgctgcaaagctcgtcatctgtgcacgaccagtcttggtattgatcatgaaaccaactggattttgcatgaaactgttcgctgctaaaatccacatcgcggaaatcatcgtcccaatcgacgttagccagataaacgcacagtggagcttggcattaaaccgatcccaaccaaacatccataacccaataaacgtggattccataaagaaggcaactaacgcttcaatcgctagtggcgccccaaaaatgtcacccataaaccgtgaataatcagaccagttcatcccaaattggaattcttgtataatccctgtcacgacaccaacggcaaagctaagtaagaaaatgcggccccaaaattgtgccatgtgcttgtacatgatgtcttttttgacaacatacaccgtttccatgatggcaacaaccaaggctaagccgattgataatggcacaaagaagaaatgaaacaccgtggtcatcgcgaactgaaagcgcgccaaggataaaatacttaatccgagattcataatggtcccccctttattaatttattccctacgaaagcggaaacactttattcacctttcataatagcaagtgataagtgaaatttcaatcaatctcaacttttattcccaaaatagtcaaagccgctaattttcaaggccactattagtacgcttattcgtttgtaagttcacattttgcaatctggcatctgctggtaaaatcacgcgtgactcccgcgaataactgagcttgtcgcatcataaaaatcaatcatcgtactcaatcagttaacaaattagttcatacaataaacaactgatgccgttattaaaaaagtacctcatttaacaagtttagcccgcgaaaacgcaaacaagcctgggttgtcgtgctatattttaaaacgtgcaatagaataaaacgttacgaggagtaaatataatgaaaaggaattcacaacaatcaaccaccgttgatcattataaaatgttcaaagatggcaaacattgggtttacgcggggattaccattgcggggctcggtagtacgttaatgctgacgactaacgccttagcagcaacggctacccccgttagtgccacgaccacttctgcggccaacgccccagctagcgttgctagtcaactcagccaagccgccggggcaacggcaaccgagtcaaccacgacaagtagcatgactactggtgaagacagtaataccacgtcaaataccgacagcagcgctaccactgacaccaatcaaattacgactagtactaacgctactgagactagcgcgactgaacaagccacaagtgcagcgtcagctaccgaccaagctagtgaggttgctaacagtgcgagtggcacagtaactagtcagacgaccagcgctactaattcgatggcagccaataccataagtggtaacgaacaggccgctagctcagcgacgagtgacgctactcaagtcacggatatggcgacagccacgacaaaatcaacgaccgattcagctattgattcaactgatgatacgagtaccaacaccaattcgaccgctacggcaacgccaactagtgtggcgacgaccagcgcggctagtgacagcggtcatggcttaatctacgaaaccaacgacacgactggcaatcaaaagagtacggtcaccattacacaaagtggcccttacagtgtgacctggaaaaaagttactacctctgataagacggacaccaccacggtcacgttagatgccagtgatattgtggctgtcgttaatacgatcaaggacttagcaaatcaagcagcgaccccgtctggccaagaacaattagcagcagccaaagccaaactgacgacaattcttgacgagttgaaagaactccccacagatatcgccagcacgatcgtgggtaatgtactctacccaatcgtcttcacgggaactggctcagaagccctctctaatttacgtactgaaatgaaccagcaccgctatgacatctccaatacgtggaccggcctcgatccagtcgcttatgctgctgaccgggctgcggccgaagaatattatccgacaacggttacttggtgggataacgttaccaaagaaaactggaccctgcctgaatacaatgacccgacgcagtctgtccgtgcttactatattcaaaacggtgattccaccaagaccgtcatcatcggccaaggttggacggaacacgttgattggatcggctacgtttcaaaaatttggtatgacatgggttataacgtcctcatgccgagtcaacgtgggcagttcctaagtgacggtgataacttaacgtttggttatcaggacaagtatgactggctgaattgggttaagatggtcgacgaacgcaatggcgccgacagtcaagtcgtcttttatggtcaatcattaggtgccgacaccgtgttagaagcagcctcagttcctggactttcaaaatccgttaaagcagttgtgtcggacgccgggtacgcgaccttaccagaactaggtagttcgctatacaacaaagccatcaccgccgtttcaaacgcacttcaatccgttggtctgccagccatcacgagcctgcccttcttatcctatgataaaatcgtggtcgcgatgaacgctcgtttgatcaaggaacaaggtttcagtgtcgatgacttatcagcaaccgatgcagctagcaaaatcactatcccgttactcttgatccacacgcaagacgacgccttcattccatatactcaatcattggaattagcggccgccaatcattctgccaaccaagaagtttggatcttaccagggactgtcggtggtcacgctgcggctaataacgcgatcctacaataccgccaacacttgttagctttcttaacaccattgctatccgtagcggatgctgaagatgaagcagttgatgttgatcaagtaacggataatcgtaatcagggagcggctgacaacggtacaacgaccgattccacagcacaggacaatgttaccgatgaaacgacggctgatgaggccatcagtgaccatcaaactatcgtggataacacgaccactgacactaccgacataactagtgatacaacaccggacacgaccaatcatgcgaaacctaatgatgattcaacgactagttacgttgacttgaacgacacggataacgcagtggatagtgattccgacacggcggttgacgcaacacgtgcgacgaccactgtgaaccagacaagcactatcgatcagagcagcgtgattaagggccaattcagtgattcaattatggtcagttcaaccgccatgactaacactgactggttagttaatcacgatgacagcggttcggccgtcacggctagtctgcttcaagattatagtgaccaggaaacaagtgtgacgacgccagccacggtatctgccacaacaactaatactgacagtgccgacttagttgccgtctcctcaccagcatccaaagccacaactgagctcccgcagaccgacgaaacaactcagtcatggctcgcaacgctgggtaccagtctcttagccctagcaacggggatttgggcccaagttcggcgacgttttaattagtgaacttttacctgttacgtccactggtgtgttatccttaataaaactatcgtgcgaaaagaggcatcatcatggatattggaacacaagtgacgttcattttggaaggccagacttataccgggaccattgcgaaaagttacactaattcgtatttaatcacctttacaagtcctgatccagccatcgttgataagtatcacaacaaagtaattattagtcagaaacaagttcaagccgttaaatagcgatttaaaacagccacccttgaaattcaggagatttcaagggtggctgttttaaatttgaattgattcaagctagctgtcactttaacgacttattttttaaaacgtagtaatggtgtcccgatcagtggtgtgagaattccagctaaaatcgcttccggaatcccattcgaggccacgatcgttaacaagtacggcattagtttgctcaaattaacttgataaaagccggctgcttgatgactatagagtagcccaatcaaacctaagactagaatcgtgttcgttaatgccccggccacgcccgccagcgtcatccccaacactttttgatgccgcttctgaaaccaaataaagacccaaccggctatcaaaccgacgagaatccggggtatcaccgaaatcaatggattggtaaatacgattggtgctaagggactcgtcggtgcgacgaacgcccgtatccacgcaataattccccatgcgcccccaataattgccccatcacgcggtcccaagaccacggcggccaggataaccgtcacgtgaattgtcgtaatactcaatcctggtaatggaatgtacccaaaaaacggaacaatattctgaatgatcacgattgccattagtaccgctaatacactgatatgataggcgtttgaacgtctctgcatcatcagccacctcaactctctttaccttatgaattatgcgcttaattatagcatatcccaaagcttagtagccgcgaaaagaatgggtgcttacccgccccggtaagcacccactattaattacgattttgattctttggcacgtaaccctgctcgaatacgggagtgccgataactataggcaaagtaaatcacgatgccaataaccagccaaataccaaacatatgccacgtaaatgcctgcaaattaagcatcaggtagacacatgcgaggaacgagacaactggtaacactggataaaatggtactttaaatgaactgttgatttgttgtagcgtttcgtgtcgacgcaggaagacaacaccgatggacaccatagcgaatgcaaatagcgttccaatattaactaactccgcaattttatctaatggaatcacagccgcaaatacactggcaataatgccaaaaatccaagtactcttaaccggcactttggtatggggactgaccgtccgaaagacttttggtaacaacccatcccggctaatcgcaaacagtaaccgggtcccaccatataacatgacaatcaaaacggtcgtcatgccgacaacggcacccagtgacacaatccccgccgcccagttttgatgaatgacggctaaggcatacgccacgggatcacccacgttaagcttactgtaatgcacgaccccgaccagaacggcggccattgccacgtataaaatcgatgctacgactaacgaaccgacaattccgattggcatattacgcttaggatttttcacttcttctgaagcagtcgacaccgcatcaaacccaatatacgcgtagaatgctaacgacgcgcctttgaccaggccgctaacaccatggggcatgaacggatgataattggcaggtttaacaaagaaaattgccacgccaatgaagagaacaatcactaggatcttaacgattaccataattgaattgacccgtgttgactcttgtagcccaccgaccaataacagtgagacggccaaaaccacgacaaaggcaattaagttaaatccagcaccgctgacaccggcagtgccagctgcagcggtcagaaatgttggtagttttagcccaaagccgctcattaaattctgaaaatacgatgaccaacttacggccactgaggataccgcgaataaatattctgagatcagagaccaaccaagaatccacgctaaaaattccccaaaaacggtataaacgtaagtataggcactccccgccaagggaatggttgaagaaaattcagcgtaacataatgcggccaacgaacacacgaccgcagcaatcacaaatgagagcatggcagccggaccggcatacttagcggcgataattccgggtgtgataaaaatcccagaacccacgattgcgccaacacccatcatggttaaactaaatgcgctcaacgtcttttcgaggccacccttattaaaattagctggattgactgattttttaaccagcaatcgttgtgatgctttcatccggtacgcctcctaatcaaaatcttaataatgcaacgttgttaattctattaatttttgtgcaattagtcaagtaaatctaacaatttcgatcaattcctaattgaatcctttcaagacagtgctttacagcattagttgttttaaacaaatttattaataatccataagattcactaattttaatttaaccgcattattatgggtcacgacttaaccaaattttgtcaaccgtcgctgaaaaccgggctgaccagtccacagtcatacgtcccgacttaaatttgtttctatcatattcatctgcttaaacgtaatcgccacaagcttgtatcttcaagcactcctttcgcaaaaaattaaggtcggtcagctgaaagaattcgactgatcgaccttaattttgacctttaacatattttaatcgggttcaactcaagcagttttgatcaaaaaaagaagcattccgtctctctcaaccggaatgcttctaaataagctttagatatattgaatcaaggtcatcaagactggcacaaccacgatgaacaacacggtactcgttgtcacgatgttagtggcgtattccacgtcaccatgtgcttcgttagccaagattggtaacacggctagcattggcgttgctgattgaacgatcaaggtttgcgatgctaaggttgggaaacttgcaccgaggttaccagcaaccatcaagacaagaatcatgatgattggtgacaagatgaagcgaccaatcaacgcaacaatcgtatcacggtcaaagcgaatactcttcagaccagcgtcggctaacacgatcccgatataaatcaaggaaagtggtgttactaagttcccaacgtaagtcaacgttgaactgacaaatgataccttcatgattggaatatttagcagtaagaaaattaatgcaactaagaaaccaaccaatggcattggaataactttcttccaatcaatcttattatgcgtcttttccttggatttcgtcgggtcgtcgtttgaaatcaagaagaccccaaatgcccatgtcgaaacggtattaacaatatagtaaacaagaaaatacgtcatactcttgtcaccgaacaacgcaatgttcaaaggtaacccaatgaaaatcgtgttggcgttgacgatcgcattgatgaaaatccccttacgacctggacgaacccgcataattttaactagcgcaaaggcaatcaagtagccaataatcacggctagaaatgcataagccaagtaacccgcaaatgatcctaactgcccacgagttagtcggctcagcacagatacgaaaatcgatgctggcaaagcgatatttttgataaatttggaaattgttccagcaaacttatcatcaaaccaacctgctcgtcgtaggacgaaacctaatatcatgatcaaaacgacaactaagacgctttgaattgaattccataaaactcccatgtgctcttataccctcttacaattctcttattttaccgacactatttgctgatggcccggtattctgggacccacttcatatcagcaaccgcttgtttagcatctgcaattggttctttgttgagcttctgatcgataacactttgtgccacaacttcagctaatttttgtgaaaattcagtaattttcgcaactggtggcaataccgcggcacccggcttcgacgtatcaacgattccacctaatgcgtggcaggctgctgacaaggtttcagcgttcagcaccttggctgttgaagcaatcaaaccaaatcctaaaccagggtacatcaaggcgttgtttccttgaccgatttggtaagtgacacctttgtattcaacatcatcagctggaatcccagtcgcaactaaggcccggccatccgtccatttgattaaatcttccgctttagcttctgctaacttggttgggttagaaagtgggaagatgattggccgttccgtgtgcgccgccatttccttgatgatgctttcagtaaaggtaccaggctgagtcgatgtcccaatcataacggttgggtgaacggctttaacaacggcttccaagttggttaattcgtcagcgttgctaaattcactccgtttgcgcgtgaaggctttttgggctggggttaaaccttccgtgtcgtcaaatagtaaaccttgcttatcaacagcgtagaagtgttgcttagcttcttcttctgttaaaccagcttgcatcaattcatccaagatttggttggcaattcccataccggccgttccggcaccaaatgataagattttttggtccttgatgctttcctttgaaatgttcaatgcacctaagataccagctaaaacaaccatcccggttccttggatatcatcgttaaaggttgcgatttgatccttgtacttgtccaagattacttgcgcattgtcgcgaccgaaatcttcaaagtgtaacaatgaatctgggaataattgttgttcagcagcaacgaacttgtcgatcacatcatagtattgttcgccggaaacacgcttgtgccggttaccaagatacaatggatcatctaataatttctggttgtttgttccagcatcgatgctaactggcagtacttgtgatgggtcaatgccggcagcggcggtgtaaaccattaatttaccaatggcaatatcaacaccgttaacaccccagtcacccataccaagaataccttcagcatccgtaacaacgactaaccgaatatcacggccgtccgctgcattcttcaaagttgcttcaatatcttcaggtgcatctacggaaacaaaggccgcattttgtgggtccaagaacaattcattatattgttcaatggaatcggcaacgacgggatcataaacgattggcataaattcaaccacgtgttcatccatcaaatggaagaatagtgtccggttttcgttaaagagattcattaagaaaatccgttgttccaaacgactaggcttgctcttgaattgggcataagcttgcgtcgcctgttcatcaattgtttgaaccttgcttggtaacgtccccgtcaagccaagtgcttgacgttcctctttggtaaaggcagtgcctttatttaagaatgggttatttaaaatttcacttgcagtttttgtcattactgcggcctcctaattaatttacattttcatcaattttcattgctaggaaaaacgtcctatcaatttacaagtaatactgtaacgccagtaaaatgttatagtcaaaactatgatatgatataaatatattaaataaggtcgctacaaaagctgatttagaaaggaataaaaatgaacacaaaagacttagcttatttcgatgaattaatttctcaaaagaatttttcaaaagttgcgaaaacattcggtgtgagccaaccaactgtgaccaccgcaatcaaacgcctggagtctgaattcggggcaccactcgtgattcgtgaccgtgttaaaaatacgttacacgtcactgctagtggggcgcaacttgctgaacacgctaaaatcgttttacatgagttacgcctcgcccaccaagaaatcgacaatctatcccaaaatcgactgattttaggattaccgccaattattgaaaaccattattttccaaaaatcggtgcccgattggccgcggaagggctattagccggtctcgaaaccattgaggggggctcgatctggctacgtaacgctgtgcgggacggtcgcggtgacatgaccctgcttggttcggtggagccgctcgcttaccaaacgttgattgccgaagaatttgaccgtcagcccttctgtatctacgtgtccaaacaacatccgttagcacaacgtaaacgggtctactttaacgaactacgacgtgaaaaatttgttttctttaatagtaatttcatccataatacggccttcaacaaactcacgcgccggaatcactttcgccccaacatcgtctttcgttccaacgatactcacgttttaatgaaattgattggtgaaaatgtcggcatcggtttctttaccaaaatcgtcgatcactaccgtactgacgtcgtacgactggacttgatggacattgaaccccctgaattcatcacaagcatcgtctaccgaacaacccatattctgacccccgtgcagcaacagctactgaccattttgcacgaaacattagcggttgacactgatcagaccgattaagcaaaactgcaccacccttacagaatagtctgtgagggtggtgcagttttcgtaatcaagacaaattgcgatatatccaaatgaaacaatcgtgaagacacgtcaatctcaaagtaaaagttgaaccactcaaggaatcgtgctgttcacttagacagatggctcagtcgcgacgtttaaatcttcattttaagtaattgatcaataaaccgttgttcatcagtggttggtaaatacccggcccgtgtgaccaccgagatattgaagctgaccggcaattgatctttgatctccaaacatacgacgccatcatccgctttaaccacatcacgaaccagtaagctaatgcccaagttggctttaactaaggctttgacccatgagatatcgggggtccggtagataacttctggatgtaccccggcaaagtcacaataggctcggaaggcttgtgggtgcacgtatttgccatccaatccaatgaactgtgcctgaccgagattcttaaaactaacggcggcttgtttcgccaaactattttgaggactcacgataatactgaatggccgtgcccctaagtgaaccgcacgaactgtcggcaaatcaaatggtaagtacgaccctaataacgcgatgttgatctcaccatgcactaacttacgcaatagctcatctgagcccgtttccgttatttttaactgttgcagtaacccgttctgaagtaacttttccgcaatttgagggaaatataaagtgccaataattggtggtaagccaaaacgaatatcagtctgtaacgtactctgaatttcgcgatgagcaagttgcaaactggcctggatctggcgtgcattcttgtaaagcagctgaccggcccgggtaatatttgtctgttgatggcgacggtcttgaatcaccagtttgactgcaaactctttttccaaccgatgaattgcttgagtcactgccggttgtgagaccgcaaactgcttggcgaccatcgtataattttggcaatcaactaacgcccgaaaataatctaaatcacgtgtattcatccgcgttcaccaaattccttcatgtacatcgccgcaatcttttgctgtagctcagccactgaatgccgccgtgaacgcgcgcaatccttggcttcacggtgacataataagcaacgacgcttcggcagccccaaatccgtccgcgacagcgcgcgctgtgaacccgcttgtaagatgtcaatatcatataagcgacctaacggatcgtgttcttcaaaagcgaccgccagccgtttgctagtcgcaaagtcagtcgtcagaatcaagaaccgctcattacccgccggatgattccaatcagctgccaccgtgtatgtcgacaactcagcttcaaaccgctggacaccggccaaaaacaaccgtcgtagtgcagcgttattcttaatcggtcctgggatattcaacttgatcgccgcaatcgtggcccgggggttagtcgttgtcaactgttgctgatacgcgacccgttgatcacgggctgctagcattgccgtgattgtttgcggttcaccggttgtaaaaatcgtcgccatgcttgtcactttcttcctatatatttgttatatttccagcttaaccgaaattagttgatttttaaactaatttctttggtctctaactacagcccaaatcaaaaatagcccacgcaccgattactcaagcgcatggactattgatttgggttagtcaaaataacttattgtaaatatttgaacatttgttgtccggcttgacggccaaagattaccgtttcagcgattgaattaccaccaatccggttattgccgtggagaccgccgaccacttcaccggctgcaaacaggccggcaatcggtcgttcgtcctgattcaacacttgggttgctggattaatggcaatcccacccatcgtgtagtgaacagctggcgcaatgtgaattgagtagaacggtcccgccgcaatatcgcgatccatcccagtcgtccggttaaaggccgcatcattatggttagcgactgcctgattccagtcagccaccgtctgtttaagcgtcgcagcgtctaagccggtcgcagtcgccagtgtttccagatcagcgccagtctttaccaggccaatgtgatcgtaaaattcaaccgccttgacccggtcacgaatgccgcggtcaaagatcaagtaagcaccagtaccacccagttggtcgatggcggccgtcacgttcttacgggtgtcaagttcattgacgaaacgagccccttgattattgaccaaaatcgcaccttcgccccgaaccgcttcaccgattaaataggcgtgatccgtatcctgttggaccgttggatgaacttggacttggtccatatcaaccaacttagccccaatagcttgtgccaacagaatcccatctccagtcgcgcccggctgattggtcgtctgatagtttttaagatcatcacgatactggcctaacaaggtcttattcgcaccgaagccaccggttgctaacaagacggctccagccgtaatcgtgacagctccatctggggttgttgccttgacgccactaattttgccggcttcgacgagtagttcatcgactttgacatctgtgaagagtggtaactggtcagccgccacttgtttcaacaactcagtgactaagaaaccaccaatgggagccatggaacttggccgatgagtccgcatcacactcatcccaccagtaatcgtcaaatcatccaacttaatgccgtggtctgctaaccagtcaattgcgagcgcactgtgttccgtgaagaatttcaacagtgcttggttattcataccgccaccacctttaagggtttcgccgtagaaatcgccaaaactatcaacaatatggtgatgcaattggacgttcgtctccgccgcattcataccggatgaagcccgggtggtgttaccaccgattttcgacattttttctaaaataaccgggttcaggcccaattcatgtgcctggattgccgcagtcaaacccgcgccccccgatccaataatcactacgtcatagttcggttttagatccgctaaggcggttggtgtaaatgtaaacttttcagccattgattgccacttctcctctcaattcgtccggggtattccccaggatggaaccaaaatctcatttattattgtcgttaactggacacgggccaccattccaagtctaggaacaatgacccgtgccaccttgatccacgttaacggttcaacgccaatcaatacttattttagcttaatcatcaatattcgtcatatccagtggaaccatccattcatcgaattgttccgcggttactttgccagacttgatggctgcttcacgcaatgtcgtccccgctttttcagctgcttgagcaatcatcgcactatcatgatagccaatatgtggtgacaatgccgtaaccgtcatcaaggaactgtcgactaactctgccatccggtcttggttgaccgtcaaaccagcaatcattcggtcagtgaagccggtaatcgttccagctaacaattcagcagattcaaggaaggcatcaatcaaaacggtcttgtaaacgttcatttcaaaattaccttggctagaagctaaatcgacgaccacgtcattccccataactcgtaccgctgccatagtgatggcttcagcttgggttgggttaactttcccaggcatgattgatgagccgggttcgttagccggaatgtttaattcgtcataaccggcccgtggaccgcttgccaagaaccgcacatcattggcaatcttcatcaaatcggctgctagggtcttgatggccccgtgaaccacgtttaagccagaatgatgggccaaaccatagaacttattggaatcagccgtaaattcaatcccatacaatttgctcatcgccgcagcaatattttcagcaaaatgaggggcagcgtttagaccagtcccaacggcggtcccacccattgcaagctcgcctaacgttgaattcaactgttttaagtaggcaatatcatgttcaatcgcactggcccaaccactcacttcttggccaaaagttaatggcgttgcatcttgaagatgggtccggccgatctttactacccgccagtacttcttttgtttgatcttcaattccgctaataagtgttccgctgcggcaatcagcttatccacggcaactgcggccgtaatgttcatcgccgttgggaagatatcgttagagctttgaccatggttaacatcgtcgttcggcaagatttcaatatcaggattgatcttaccagccatgtgtgcgaccacttcattaacgttcatattcgtttgcgtccccgaaccagtttggtaaacaaccagcggaaagtccttacgcaaatcttcatcgtcgagcgctaataacttatcaatggcagccacgattaaatcagctttttcagcagtcattgcttcaacttctttattcgcaatcgctgcggcccgcttaatttgaagtaatgcccgaatcatttccaacggcatcttcgtaccagtcggaaagttatggcgactccgttctgtctgagcaccccataaggcgttcgcaggaattttaacttcgcctaaagtatctgattcaactcgatattctgtcatgttgataacctccaattaatgtgttggtaagcgcttactaagtgtgtgaaaaaaataacatttagtttataaacctagtttagcgcccccatatagctatagtcaaactcagttttagctataagtattagttatgaggttgatataacagtcgtttggcgctgaaagtttgcggtaactgcgtgtttgataaagatgtttatttattcacatgttccgatttatttctgttgaccaattttactcgtaatcgtcattttttgcttacttcatcggcttaaattttcccaatcacaaaatatcgagtcatgattaaacgagatcaaaccagcttaaacccgctggaaaaaattcgaattagggtaaatatgcttagccagttcgtcctacaccgacttccaggcagaaaatgacattgtgatagcttactatttcggaatcaccatagtagtaatcgaacgtttcaacaaagtggttaatgtaaccctaacatctcgtttaaagtcccagtatcaaaatagtcagcgataaattgcactaagttcggtagtcgttcatctgccattcgagtgaatttccgaaacatgtttggtgccactgaagcttgtgcctgagactggaggggctgggtgacaatgctcagtagccaaattattcttagctggaagtggtctgcttccggcttagaataagactcgtatttgagatgacgcgggttatgcgttagctcaaatcgacgtcggctgcgttccagcaattgtcacccagccccggaagtcggaataggacacacaccggctgacaaatagcatcgctaattaagactcactttcattataaaaccaaaattttgtcacacttgcaatagaactgccctgcttaactcatttcaattcaccataaataaaaatgacccagttagtaataaaccgggtcatttttgtcatcaatatactttagtccttcaccgctttaatcgtatcaataatcgtgccatcgcgatattcaatcaaggcaacggtgcgatctgtaaattcaagtggttggggttggccgactttcttttcggctaattgttgtaattcttcaatcgtatagaccggcacacctgggacatgactgagtgctttaactaggtcttgacgccgggggttgattgcaatcccgtattccgtcacaaccacgtcaatggagtcccccggcgttacaacggttgttacttctggcacaatcgtcgctaaccgaccacggacaagtggtgcagagataatggtcagtttggccgtagccgcgtcttgatgtccaccaatggcgccacgaatcacgccatccgaaccggacatgacgttgacattgaagtgcgtatcaatttccaacgcactcagaatggcaacatccaattgatcaaccatcgctcctttattatcagggtcagcgtaccatgatgcgtcaatttcttgttgattaggattggcgtgcatcgatgctgccgcccctttgtcaaagtcttgaacatccatgactttgtcaactaacccttcttcgagcaaatcagtggttggtttcgtaataccaccaagtgcaaatgaggctttgatttgattatcgagcattgcttgccgcaagtaccgagtgacagctaacgcagcaccgccggaaccagtttggaatgagaagccgtttttaaagtatggtgagttcacgatcacatcattaacggtctgggcaatcttcaattcctttgggtccttggtgaagcgcgtcgcacctgaaccaatcttgtcagggtcaccaacttggtcgacttgcacgacgtaatcgacttgtgtctgtttaattgaggccggtgtatttggataagccacaatattatcggtcaataagacaacttggttggcgtattgcgcatccatcagggcgtaacctaaggaaccaaagactgctttaccagccatcccgttcgcatttcctagtcggtcagcattcggcacacctagaaaggcgacatcaattttaatatcaccatgttcaatggcccgggcccgattaccatgagaacggaagattacggggttctttaaaccaccgtgtgaaacgaagtccccaagagagccccgcatccccgagctagtaatattcgtaatcgttccggccttaattgcttcgatcaccatatcgttcatcacgcccgttaaggaggatggcgccaaggtcaaatctttaataccggcatcaataatggcccgcatcacttgattgaagacgaaatccccattacgaaaatggtggtgaaatgaaatcgtcataccatctttgacagtggcttttaccacgtcagcaacggaatcaacgactttgttgtcccctgttgaaacgtgaactttgggggccacccgttgaatttcaggatgtccgatttcggttgactcaaaaccttggtaatttaacttcgtcattgattctgctggtaattcgcggtctacactatttttcaatgtaattgccctcctcgtcgagtaagttggaaactttggctaagctcatcacacgttgagcccgcaaaacaacgggccggtctaccatttggccattcatggaaataacaccagaacccttgatccgggcttcctcaatcgcggcgatgactttttgggccttaataacttcatccttggttggttcatagactgaattgaccattgcaatctgtcgagggttgaccaatgatttaccgtcaaatcctaattgatgaatatgccgcgtctcacggtagaagccatcggaatcggccatgtttgtaaagaccgtatcgaacgcggcgattccagcggcacgagcagcatgaagcaccatgttacgggcaaattccagttccgcgccatcaggataacggtgggtcttcatgtccgtcgtataatcttctgctgacaaggcaatcccaatcattcgatccgaggctgccgcgattgccggggcattaagcacgcccttagcgctttcaattgcggccatcaaatgagtcgtaccgactggaatatcaaattcagcttcagctgccgcgacatccttttccaacgtttgaatcatggcagccgattcgacttttggtaaacggataacgtcaataccagccttgaccatcgctttgacatcatcagcgtaatacttggtgtctaagccattgatccggacgaccaattcagccttgccatagtcctgcgtttttaacgcttcgtaaaccagcacctgggccgcgtccttttcagccattgagacggcatcttccaagtcaaacatgatcgagtccgcaccgtaaatcccggcatccttcaccatggctggattattaccaggtacaaacatcattgtccgccgtaagcgttcttcattttcagccattataatacctcccatgctggtgtcgtggtttctaacgcccgttgtgctgccgtaatagtccgcgctttaatgacgcagtccaacgcccctttatcgacagcgcgcaccttcacattatcgatattcaattgttgaagcgtcgtcgtgatcacgtgctttatttgtgccccgaactgtttgataacatctgattcaaggtcgatttgaatgccgttgtctcccgccattaacataatttgaatatcagatgattccaaggttccggcgactgccgttgtcttaatttccatcaattttcattcctttctgaattcgcgcttgtaatgttgttaggttattttttataaactgggccgttgttgccggtaccagttggtttaactcagttaagttgccgctttgaatccgttgccgaacagtccgcgccgaaattggttgattagccaccgtcgttcgcgatatcactcgtacagcaactgccggtggtaattcacgctgcaaaactcggttataaatcgcagtcgtccgcgacgtcggttcactaccaacgaaccgggtcgtaatgtgcagtgctggtgcaagttgctgcttaaagatccgggcgtccaacgtcgtctgcgcctcaattgcgctcgccgctgaatccaagaagtaggctggaaaggtcgctgcactcacgagatagtcctgcccgctgacgacccgaacgttggccaagtcggctgtcccttgttgaaccagcttaacgcgctcggccgtacggaatagactcgcatctgtcgcaacgacgaagacgtaaactaaatcactgaccgccgcggcttgttccactaaatagcggtgtccccgcgtaaacgggttcgcattcatgacaatcgcgctgacacgctgttgtgcttggttgggaatcatcggcaactgtttgacaaaatccgtcatatccggtgcgccgttttctaatacggccgcttcatccgaatgagctaattctttaaagcctacgtgttgaaaactcgctgaatacttggccttggtaaataccatcatatgaaagatctgtgcttgaaacagccgattgaccagtgcactcacgatttgattaaaccgggcccccggctgactattcttattacagacacccacatatttaagcacgttgccagctaacgatccggtcccaacaagttggccatcctcgatcaatcctaaggtcacatcaatatgttcaacctcttgcgggctaaaattagtaatccctaatgacgttaagaattgttgccactgggcatgctcgtgcggattatttaattgcatttcaacaacttgtgctgccatcagacaacctcctatgattaatgctgtgcttgcgcgtacgctgcaacggccgccgtcacgttcggtaccacttgtgaatcaaagacgctcggcacaatcgtcgtcgcagttgggttcgacacggtcttagccaaagcctgagccacttggatctgcaacgcattatcaacttgcttgaccccatttgtgagtaagcccttgaagagccccgggaaagccagaatattattgacctggtttggatactggctagaacctgttgcaatgactgtggccccagccttctcagctactgctggattgatttctggcactggattagcgagtgcaaagacgattggatcatgattcatcaagtggacggcccctgctgataagacgttggcgtctgacaagccaatgaagacgtcctggtcggccatgaccttcgccagtggttgcccctttagttgtgcaggtgttcccaactgtttggcaagatgccgttgatactggttgtaccgctgatcatccgctgtaacgaccccgtaaacatcgaccaaggtcagttgtttgacaccgaccgctgctaataaccgagctgtagctaacccggatgcgccgacgccgttgacaacgatgcgcatctgccgtaaggacttaccgactacgtgagcggcattgatcagtcccgccaacacgacaattgcggtgccttcctgatcgtcatgataaaccggaatatcaagctcatctttcaaggccgcttctagttcaaaacacttaggcgccgtaatatcttccagatgaatgcccgcaaatgagagcgacatgtttttgattgtcgccaccattgctggcacgctgacctgatttaacgccagcggaatcgcattaatccctgcgaggttcttgtataggagtgccttaccttctacgaccggcaaaccacccgcgggaccaatattgccgaggcccagtactgctgacccatccgtgatcaacgctactaatttaccactcatcgtgtattttgcctttaattccggatgcgccgcaatcagcttggaaatcaccgcaacaccaggtgtatatgctttacctaaatcagccttatcggtcactgcaaggtctgaatgaatgtccaaaacccccgtatgggcggcgtgcaactttaaaatctcatcttgttctaccatcaatatctgccttctcttctcaaaataataccgttcactttgttatccccagtgtacgaccattttttaaaaatatcaaatttagattggatttttataatttttaaaaagtcagcttttctggtataataaacttaaaatattataaacgagttttaaaattttaaatcttaggttgataaagaggtcatcgatatggacgatatgaatcatcgccgcctgttgattggaattgcacatgattattacttatccaaaatcaacatcgctgaaatttcaaagaaataccaagtcagtcgttatctaatttcaaaatacttagacgaagccatggcaaccggcctagtcaaaattaacattaacacccccatcgaacgaaatagtgagctggaggctaaatttaagcatcgttttccaattgaacatatttatattatcaaagacgcggataccacgagtgacgatgaacgccacgtaatcgagtttgccgccgaaacaatccagcgccagattattcaaagtaacgtgattggggtggcatggggtggcactgtccttagcgtcatcgataattttcaaacgagcactcgtgatgacttactgttcacccagtttatgggtgataacctgaaaacgaacgcagcgaacggctcaacaccgttggttcaaaaagccgccgctaagttcggcgcacagtacgtcaccatcccggcaccactctacttgtttaatgatcaagcacaccaagcattggctcaagaaccagccattacaccggccatcagtaactttgaccgaatggacatgctatttgccggaattggcaccttagcatccattgactcgattcccgtctggcatcaacatcgccaagccattctgggtggcgctgatccgcaggcggtggtcggcctgttatacggtcggccatacgacatcaatggtcacattctgaacgccgaccacgacaaactctttggcgctaaaatgcccgccattctcaaagtgccgcgtcgtttcggcatcatcaaaagtaagttcaagagcgaagccttacttggcgccctccgcggacaattactcactgacatcatcattgatgaagccgtcgcgaatcgggttctccaagaagatcaagccacaccactatccaaataatccgcttcttcgaaaacaggtaccaacgctgaccgttgccggcagcttggtacctgtttttatgcttaaaatcagactaccaaataccaatcactttcatccagagggcgccaatgccaccccaaacgactaggtagaagagacctaaaataaagtttaactgccaccattttccctgagtaacatatccagaaccgaagagaacactcgccgggccgttcgcataatgcgtcgtcgaagcgaagatcgaaccagtaaagccaagtatcagtgcagcaaaggttgctggcgctcccgcggaaaccgcgaccccaagtaaggcaccgtacattgcggaaacgtgggcagtcccactagcaaacaagtagtgactgtagaagtagaacaagacgagtgccgctaaaacaatgccccaactgaagcctttcaaggcaccaccaatcgcgccagacaaccatggaataaagccgagtttgttcaactcattagccatgaagatcaaaattgagaaccacaccaaggtattccaagcaccagtttcgtgtagcacgtcatctaccgatagaaccccagcaacgagtagcaaggagacggccataaaggcaactaatgaagcttcgagaccgataaagctggataacatccataagactaaggctagcaagaagacgccacccatgattttttctggaagactcatcttacccatctttgccagctcatcatccgcccattgcttggcattgggcgtatctttaatttctggtggatacattttataaattaaatatggcacaaccaataaacaaataagtcctgggacaatcccggctaagaaccattgcatccacgataacgtgatgtgtaaactcttggctaacgtgacagcaactaagttaggcgccatcgccgtcatgaacatcgtactggtgattaaatcaccgtgaaattctgcgaacactaagaatgaaccgattttactttgtgtgccatccttgggatcagagccaaacgtttcagctaacgactgaatgattggataaacaatcccaccagcacgggccgtattacttggcgttgcgggtgctgttactaaatcgacgccaatcagtgcgtatgccaaacccaacgttcgtttcccaaacagccgtacaaataccaacgcgacacgtcgacctaaaccagtattgatgaaaccacgtgacataaaatacgccatcgcaatcatccataccgtactgctcccaaatccggcaaccgctgtatccataggcacgatgcccaataacacggttagtgtcaacccaatgattgcgaccccggcgattggtaacggccgcgtaatacaaccaataatggttgccacaaaaattgccagaatatgccatgcgttcatcgaaacactggctggtttgataggactacttaaccaaatgatcaggcccaccaataacggtgcaataaaatcacgatacttgaccttatttagtgtcatctcaattcctcctcatacttactcatcatttttatgatgccacattcatcatggtcagcatcttggctgcgaaatgttgcatccgggcacgctcatcatctgatagctcagcttcgatcactttttggagcccattgcgattaataatggcgggtgaccccaagtacaaatcgttaatgccatattgaccagacaaagcggcggagacaatcaactcagcattttcatcgttcaaaattgctcggcagatttgcatcaaactaacggcgaccccatagaacgtggcccccttctgactaatgatttgaccacctttaccacgaacagcttgctcgatttcagctttgaactgatcatcgaccgttgtgaccgtctttaagggctgagcattgatcataatttcatcaaaattaacgatggaactatcaccatgttctccaagtaccgcagcatcaactgcagtggtggcaacattcaacttctgagccaaggcgacccgtaaccgcgccgtatccaaggaagtcccggtaccaatgacccgatgccgtggaaaaccggataaacgttgcgtcatcgaagtcaaaatatcgacgggattacttgagataacgaagcaaccattaaaaccactcgcaaccactggtttgacgatggattccagaatcttcgtattgcggttaatcaaatctaaacgactctcaccaggcttacgaggcacaccagccgtaatgacaacgatgtcagcatcacgcgcatccgcatattcaccggtatgaatgttggtcgcattcgtaaaggcggcaacatcttccaaatccttaacgtccccctctgcgtgcgttttaaccaagtcaacgataacgagttcatctagggcgcaattttggaccaatgaaaaggcaaatgatgaacccaccgagccatcaccaacaattacgactttgcgttgcttcttatccatgtcaatatccttctttcatcaaaaatgtgtgctgcacatgtggttccaactgcttagttacttaactcacaagtattataacgcaaatgctttcatttttgctaattttttaaaaataaattatttttttgaaaaatttaaatataattgttgtttaaaacgcctgcgtagcagcatttaaaattattttgattgtgaactatttctaaagtgtcggcttgtgaaatcattttcgtaagcggttacaatcctgcgtttaaattgcctgattggcgtcaattcgaaacatctgcgcaagttacaaaactttttacccgccaaccgatcttgaaacagttaaaacctgattagcgtggtatattagaagtacgactcaaactagagaggactaatacattggataatgaaactttaaaagactatctcgcaaacaactcccaagttattaccatttttatggagaaagcaaccgattttctgaatcgaaaaaatgaggaccgggcgccagcacgccgctataacgatgctgaaatcgcccgacaagcggataagatgctcgatgatgtgattgccaatattcatgataaaatcgtcccccatacccgcgaacaaacaccggctgcctgggaacaatttctgagtgaaaacgacgtacttgatgatctggaactatcaatgacggaattgtcattcgaatcggaagactaaactagcagttcaaaataaagaaaggaccgtggaagatttaacttccacggtcctttttagaacaaacttatatcacatgacatcaacacaaccgaattatagacccaagtactacaaccgagtcagcccagcataaatcttatcaagattccacttcaacattgagtagtacgtatcacccggtttgcctttagctgccagcgaatcggtaaaaatcgtactagcaacggggattcccgtctcctgtgaaagcttattcatcgatttcggtgatacggatgattcgacaaacaaacttcgaacctgggttccttcaattttcttcaacgccgtccgcatctgagctggcgtgccttgcgattccgtattcacttcccaaatataagcagcgggcacatggtaggccgccgagaaatacttaaaggcgccttcggatgtcactaataatcgttgactcgtcgggatctgcttgaatttggtttgagcgctctcatgcagttttgttagttttgccacgtagcgatccgtattcttttgataaacagcggcgtgcttaggatccttggcctgcaacgtccggttgatgttcttgagatattgaatcccgttggcgagatctaaccaagcatgggggtccggctcattaacgttcgtcgttaaatatttgaccttaattcccttactggccgcaaaaacatcgtggtcaaagtcctttttggaagccgtcactaactttttaaaccagccattaccgccagtttcaaggtttaagccattataaaaaatcacgtcagcttcggcagttgccgcaatatcagtgggccgtggttcatactcatgcgggtcagtgccgcgcttcacaatactgtaattttggacgtactgcccacccacatttttcaccatatcatctagaatcgagttcgtacttacgacccggattttggcactagtggtcgtcgctttggcactttgctggcgttgattcagaaatactgccatcccggtaaccatcgcgatgactccaatcagtgcaattaatttcgttttcatgctgtcacccgtcgcgctgctgcttgccctttccaaagcgtcggcaacaaggcctgcttaggtgagatgatgaaagaaataccgaagaaaatagccgctactagcacgatggccggaccagaagcccagttcaacgtgtagctgagatataagcccaccactgaggacaagaccccaattaaggctgacagtccaagcatgactgccagtcgttctgtccatagaaaggacgtcgcagccggtgtaatcaacatcgcgaccactaaaatgatcccgacggtttgtagcgctgaaacggtcactagcgttaagaccagcattaacgcgtaatgtaacagttggaccttgagaccataagtcttcgcaaaggtcggatcaaatgacgtaatcagtaattccttgtagaagaagaccacgaataaaatcactagtcctaacacgaccgtcgtcgtcatcatatcagtatcactcacagcgaggatgttaccgaataagatgtggtgcaagttcgtcgaactttcagctaatgaaattaggataaaaccgagtgcgtaaaacgcactgaagacaatcccaattgaggtgtcagtcttaatcttactacggctcgcaacgaatccgatcaagctagcggctagaattccaaaaaccgaagcaccaattaggacgttgataccgagcatataagctaccgcaacaccaggtaaaacggcatgcgagatggcatcgcccatcatcgacatgcctcgtaaaataataaagctaccaataattcctgacatgaccccgaccataatagccgtaattagcgcactttgtaagaaatcatacttccccaaagcagccataaaggtcgtaattgattgcatcatcgcgtttcctccttcgtaaacaggacggccgaaagatcagcactaaacgtccgttcaatgtttgcgggtgtgtagaccgcgtccacgggaccataatcaacgataccgtgatttaaaatcacgagatcatcaaagtagcgtgaaactttgttcaaatcatgatgcacgacaataatcattttgccggcatcacgccactgatgcaagatcgtcatgatagccgtctcactctgtaaatcaatgccgacgaaaggttcatcaagaataatgatatcggcttcttggactaaggctcgagccacaaagacccgttgtaattgtcctccagagagctgactaatttggcgctgtgctaaatcggctaactcaagttgctcaagtgcatcttggcaacgctgacgatccgccttgcttggttcgcggaaaagtccgagtttgccataggtcccagtcaaaacgacgtcaaaaacattgattggaaaggttaagtcgagatctttacgttgctcgacatatgcaatctgtttttgaaattgttttagcgcacgaccttcatattcgacggttcccgtttgggatttgatcagaccaagcattgccttgatcatcgttgattttcccgcaccgttgggaccaatgattccagtaattttgccggcgttaaagttaacggcaacatcagtaaagactggtgtgtcactgtatgccacggtgaggttttgtacttttaacatcacatttcctccgttcatcgcggtagtcggttttctacatcgtcataagcataactgataattagcgctaatgcaaataattgttaggtacagttaacttttttataatcggtattaaattttcgttcattctaatactatttctgcttaaccaaggcgttacaaccaacatactaaatgcttaatccagaacctactgaaacgactttcgatgccatcaccactaaaaagcactgaccactcatcaactaagcattgcaatcgtcatttaatttccattaatatttggtattaaaaaagtgtcgtcacctacaatcacgacactcattattaagctaatatatctgtctgcaatccaataaaaatcgtcaaaatcaacaaatcggccgaaccacctaaactatagttatggtcgacaaaaatctgattcaattcgcgtaaaaacgccattccagcttcactgcggcttccccctaaatcgaagtagcggtgtgcttggtcgtggacccagtcaatgacgtgcgggtcgtgtgcccgttttaccagattggtatcgaccgtcgcctggacaatcgccatcagtgtgtctaataaccgctgattaatcgtgccacgactacgtctcaatgcgggtagtgccacttgcatcacggtcggataacccgcctcggcttcaccacgaattcccttgatgccatatgttaagtattgacgttctccagcagttaaggtcgttggctccttcgtgtttaaatcattaaaatcatttgccgttaaccccgccagcattgtgcgcacaatcgttgctaagtcgacgtcggggtgctgcaactgatacgccgccgctgtcactagcacgcccagtgagaacaccgcccctttatgggtattcacgcccttggtcgccgcaaacatggtttgttccgcttgaacaccaatgccccgaatttgcttgaacaaacccgtcaaatcgacagccgtatacgcgacgcccgccgctgcacaagcattaaagtagggggctagactcaaagcactatcaataaacataaaagcgttcatgtctggatggggacccgccgacaacgggtcgaccagcccgggcttagggttgaccgtcacttcgtataaaagcgctcgtagcgcatgattgacaattatcttcgtatccactatttctccaccatttcatccttagtctaacaacgatgatgtgcctgggtcactttcagtcttgattaagcgtgaccacaaccaacattcagttaccattacttatatttccatcataactgatactagggactgtctgaaaa

SEQ ID NO: 62 - DNA, 13170 bp, Lactobacillus plantarum
accaacaccatggactattcttatgcacccgtaaagttgggcaacaacgtaatcgttatcatgaatacgaacaaacggcgcgaattggcggattcaaaatataatgaacgccgctccgaatgtgaagaagcattacgccgattacaagctaagttagacatcaaatcacttggcgatttaactaatgaccagtttgacgaagcggcctacttaatcaatgatgaaactttaatcaagcgcgcccggcatgccgttttcgaaaatcaacgggccattcgcgcaactaaggccttggcagacgatgatttgacgacctttggcgaattagtgacggcttcccacgtttcgctacactttgactatgaagtgactgggaaagaattggatacgttggccgaaacagcttggaaacaaccaggcgtgcttggtgcgcggatgactggtgctggctttggtggctgtggtattgccatcgttgataaggaccaagttgatgcctttaaggaaaacgtcggtaaagtttatcgcgacacgattggttacgacgccgatttctacattgctgaaatcgcagacggccctaaggaactttaataaaacaattgatttaaaatacaaattagcagtaagcattgagaaatattgaggaggaattagaatggcagttttagttttaggtggtgccggctacatcggttcacacgcagttgatcggttggttgcaaaggggtatgacgtggcggttgttgataacctagtcacggggcaccgggcagcagtcaatgaacacgcgcgtttttatgaaggtgatgtccgggatacggcgttcatgaataccgtgtttgaccaagaaaacgttgaaggtgtcattcattttgcagctttctcagttgttcctgaatcgatgaaggatccgctcaagtactttgataacaacacggcagggatggtcaagttactcgaagtgatggctaagcacgatgtgaagaaaatcgtcttctcatcgaccgcagcaacttatggtgaacctaagcaggtgccaatcaaggaatcggacccacaagtgccaactaacccatacggcgaaagtaaattagcgatggaaaagatcatgcactggtcagatgtggcttacgggattaagttcgtggccttacgttactttaacgtggcgggggctaagcctgacggcagcatcggcgaagatcacgcaccagaaacgcatctcgtcccaattattttacaagtagctgctggtgaacgggatcaattacaaatcttcggtgacgactatccaactccagacgggaccaatgttcgggactatgttcacgttgtcgatttagctgatgcacatatcttagccttggaatacctaaagcaggggcacgatagcgatgcgtttaacttgggttcttcaacgggcttctccaacaaacaaatgttggacgctgctcgtgaagtcactggtaagccaattctagcagtcatggcaccacgccgcgctggtgacccaagcacattggttgccgctagcgacaaggcacgtaccgttttaggttggacacctcagtatgatgatgtgaaagaaattatcaagacggcttggacttggaaagaaagtcatccggccggctatgatgatcggggaggccaagcataatgacgagtttggatcaatttgtcacggcggtgatcgcgtcgccttcgcaatatactgaattagatcgaatctatgtgcataaccgggttcttggtttggtcggcgagggtgatccgattgcggcaagcgatgaccaattaacaagtttaaccgatgccttggttaaaacggcgattcaaaatggcaagatcgaagcgacccaatcggatgaagatatcttagcggatcaattgatggatcttgtgaccccgttaccatccgtattaaaccaacgtttttgggataagtatcaggttagtccgcaaacggcaaccgactatttctttaacttaagcaaagctaatgattatatcaagacgcgggccattgcgaaaaacgtggtctttccagcaaaaacgccgtttggtgactttgagatcaccatcaacttatcaaagcctgaaaaggatcctaaagcgattgcggcagcgcgtaaccaaccgcaagatggttatccactttgccaactatgtatgcaaaatgaaggctatctaggccgactcggttacccagcacggagcaatcaccgaattattcggttaacacttggcggcaatacttggggtttccaatattctccatatgcttactttaatgaacactcgattttcttggatcaagagcaccggccaatggtcattaaccggcaaacttttaccaacttacttgaaattgttcagcaatttccacattactttgtgggcagtaatgcggacttgccaattgttggtggttccatgctgtcacacgagcattaccaaggtggtcggcacgaatttccaatgatgaaagcgccaattgcacgcacgattgacttaggtatcgcgggtgttaaggctgggattgttaaatggccgatgtcgacgattcggctgacgagtcaggacctggttgcattaacggatgccgctgtgaagattcatgagacgtggaagaattattcggacgagagtgtggatgttcgtgcttatacggatggcacacgtcatcatacaacgacaccgattgcacgcaaagttggcgatgactacgtattagatatcgttttacgtgataatcagacgtctgctgaatttccagatggtatcttccatccacatcaggatgttcaacatatcaagaaggaaaatattggcttgattgaagtgatgggccgggccattttaccagcccggttgaagaccgaattagctgaagtcggcaaatacttgttggatcagcctaatcaaatggtcgcgatgcatcaagcatgggctgatcaattgaaggccactaataccatcaccgctgacaatgtgacgactgtcattgatacggcggtcggcaacgtctttgcccgggttctggccgatgctggggtctttaagtgggatgacgctggtgaggcagcctttgatcgttttgtcgcagcaatgcacgattaagttgttaatcaaatgaagacgtggggcaacggggtgttgcagacgcgatttaccgatgagtcatggttggtgaatagtgttacgcccagttgccccacgtttgttattcagtgctaattaagagaaaagaggaatgacgatggccgtaacgttaaaagatattgcgcaacgagcagatgtctcattggcgacggtatcgcgggtcttaaattatgacaagacactatcagtgagcgagcagacacgcaagcgcgtgtttacgattgctggcgagctgcggtacagtaagcgtaaacgtcagcatataaaggcgctaatgcggaaaaatatcgctgtgattcagtggtattctaagactcaagaacatgatgacttatattatttagcaattcgtaaaggaattgagcatcaagctcaagtgtgtggttttacgacgactagtatctttcagaataatttaggtcaggttggcgatgatattgatgcaatcgtggcggtggggaaatttagtcctgtccaagtacaacagttgagtcgtttgtcaaaccagcttgtttttgttgatgacgatcactttgctcagggatttagcagtgtggtgactgattttacgtttgctactaaccgtgtcgttgattatttttggcggcgtggtatccaggatatcggcatgatttatggcaaagagtggtccactgatcagcaggtggagattcccaatcaacgtcagcaaagctttgaacaggcgttgcagcggcatcatgcctatcatgctgagtatgtattagctggtgattacactagtcaatctggttatctgatgatgaaacgggccattgcaatgttaggtgatcgcttaccacacgccttctttatcgctaatgatccgatggcagccggtgcactcaaagcgttacagcaagctgatattgctgtgccacagcgggtcaagttgtttagcttcaataacacgacgctggccgaatatgtgtatccagagattagctcggtcaatgttgagactgaactgatgggaaagacggccatcgatttgttggtgagccggttccaagatgatcgtcaagcagcccagcgcattgaactgggaacgacgttggtagaacgtgaaagcaccaaatgaaatcatcgagtgttcgtgaaatttagcagaaatatcgtaattaattaatgtgtcacccgattgctaaaaagtggtgcatgactttaatggggtactgtttggtattgaatagcgcgcgtgaatgggttgattggtcatactgctgctttctgattagttggtctgttttgctaaggtgtgaggccacagcaacgacaattatacccttcaagggtataattgtgagtgaggtgatgaaaatgaaaacaaccgccacaatccttaaggagattcggcaacattaccaaattagtcaggcaaagctggcaaagttactcaacacctcggttagaacggtgcagcactgggaacaagcggactaccaaccaagtggcaccgcggtacgtttgattcagattttggctacggacgatgcggtgtataccgcactgacaaacctcgaggaggagaatacgattatgtatttagaacacgatgatcagaagttcaccatcatgggtgtgcagtttcggaatcaagaggaataccgggcgaccatgaatgcaattatcagtaacatgtatgaaggttttgaaccgactaaggaagatatccaagatgctcgtcgtttctatgacgaaggcccgattagtgcccaagagatgctagcaaagatatgtacttcgaccaataggaaagctgaatgaaaaaagtatgggcggattacctacaaccaaatggaactttgaaaaatcgcttgggcattactgaagcgactactttgcagaaaatcgagtacaaagtgagtacgcaacgacaacagcaattagctcgcaaccattatcttctaccggactctcgataattgacgggacgtcaaattggagaattgaaactgattaatgcatttttgctcggcgaagtttacgactgggcgggtcactatcgcgaagttgatttcaacaagactgcgaatggcgtggtgacgtttttccacccggtggctttatttggtaatgctgaaatggatatttaacgccaactcgataattttgcgatgttaccgaatgaccgggaacagcttgcacaggcgttgggacaagttgtcaccaaaatcaacatgtttcatccgtttcgggaaggtaatggccgcacgacgcggctgtttactgaggttttggcttggcagcatggttttgacatcaactatacccaggcacagcaggacgcttacatgcaagcgtcaattcaagatgatgctgagatgatggcacaggtgttcctggaagtactaaccaaatagatcaattattgttagtcgtgatactaagaatggtcttaaagtaaaacaacaagtgtactcggaaatttctaatctgagtgcacttgttgttttactttagtgagatatatgacgtttgtcgcagcggtcaattttactgcttgagtgggccactaacttttcgtttatattcggatggggtggtctttaggtattttttaaacagacgaaagagtgatgaggtgttttgatatccgatgatgtcgcaaatgtcagcgagtgtacagttagtcttgatcatcagattttgggcagcagaaattcggcggcggtcaacaagttctttaaaggtcttgcccgtcgcttcttttaatttgttacccagataatttgtattataagagaacttggcgctgacatcacgtaatgtcacgctggcgaaattctgattgatgtactgaatgattggcaaaagattgtcgtccgtattgtcagaaaagttaatgtattcttgctcaatcgattgcgataattcaagaattaatgtagatagcagcaggcccattgatttattacgttggcggctctttgtaaggcccttgataattaaactttcaactagattgatggcaacttcttggtgtgttaagtcaaacagaataaagttgttgtgcaacgtattgatgtgggatgcattatataaaaattgagtgatttcattggttgaaacggcaatatagtcgaaaagttggttcatcgttgagtcattcttgagcaagatgttaatcaaaatatcattactgcccgttgattcaatttgctgaacaatgtctttatccatcaaaattaggttgtgctgatggagggtcactttttcgccattaatatactgagtacaagtgccagcatacatataattaagctcaataaagctatgcgtgtgagctggaacataggaaaagcgattatttttggtaacagcaatatcaccgtgcttaaaaaaatctgagcggggcatctggggaatcggattattcacataatctaagtccatgtagttaacgttaccatgtgattggcgttgctttagctcaaccggtgtcagagcaaataattcgtaattgagaaatttactagtcattaatactaaccttctttaatatttatcgtttagtggaacctgtgattttgcacgatcattcatgtagtcgagatatggtaccccttacagtaatcgcttacaatattcgtataaataaagggaggttcttcatatgaataacggcgagacgtcaacttcaatggtgaaaaaatatcggccattagcagtagctgcaggaattggttccattctaggatcaggaattatcgttggcttatccgcgactattacagtgtggcagaacggactaggtcttactaacagtcaagttggtattatttcaggtgcactaacttttgcaattgcaattggatccttattagcaggacagataacaaaatcttttggtctagttaaatcgtttaattggttaaacctgatttatgcgattggcgccttgatctgtgttttctcgaataattatatcatgcttttgattggcgtcatcattaccgggttagcttcgggtgctgatttaccaattagtttaaccgtagtttcgcatgatgcaccggatgataagacctcggctagtttagtatcgtcgacgcaaatcttctggcaaattggagtttttatgtcttatgtttgtgcttttattgtttctaaaatggccggtgcttccggtgctcggattgttttttcgattttagcaatttttgccttgattacttgggcatggcggactttttcaactaagttccgagcatttcatgaagaaggtgaacaacggcgtattgatcgcgaagcagcttcacagacaacagaaaaggtctcgattaagacggttttcgctggtgccaacaagggacgctttatggcattcttcttcagtattttaatcttctatgtttgctggaatctactggccaatacgttcggacagtttcaaacgtttacgctggttcaagcacatgcgagtcaaagtttcgcaactggtgctgggatagtcctaaactttatctcgttgttggcaaccatggcttttgcatcagtcgctgggggtaagtatcgtaataagttcttcttagttgggattaccgttcaatttttggcaatgctcggactagcgatgagtagtcattcgttatggccaattgtcatcacgattggctgttacaacattgggaataatattgctggtgaagcgatgtataaagtttggacacaggaagcatttccagttgaagttcgggcatcagttcaaggatttatcaatggcttttcacgggtatgttgtggcctatttgccttaattacacctgcgttagttgtgccatcagcaattcgtaacacgatgtttgggttcgctgccattgtctttattagctttgtagcagggctgacgatgatgcgattggaaaagaagcatggtattaataacttttaaacaaagtatttagaaagcgagtggaagagatggcgtttacttttcaaatcaataatgatgttcaatttcagcataatcaagcattattagacaagtcggcaagctatcggccaatactgaaagaaaccaaagctaaggcggcatcgattgtggcgctcgagcgtgatacgcaataccttgaaggatggtgtgttaaacaaattgcacctattgaacgattatcaagttatgagttgaaacgtgatgaccaaattatcatagattttggcgatcatcaggttggtcaatttagtattaatattaacgctgttggttcaccaatggatgcaccactatgttttaagattaagtttgcggaaatgcctgcagaattagcacgcaagagtgaagattacgacggttggttgagcaaatcttggattcaagaagaaactgttcacttagatgtgctgccaaccacgctgacgttaccacgacgctatagttttcgttatgctgagatcacagttgttgatacgtcaccaaaatggcgagctgtttttagcaatccagtggtcacggcgacaagtgcggtagacactgcgacagtgcatcaaccggaattagccgatgtacaattacaacggatttatgaggttggcttgaaaacattagctgattgtatgcaggatgtctttgaagatggaccaaagcgcgatcggcgattatggattggtgatcttcggctacaagcattggccaattatgcaacgttcaaagatacagatctggtcaagcggtgtctgtatttgttcggtgcgatgcctacaacggctggccggattcctgccaatgtttttactaaaccaacggcagttccagatgacaccttcttgtttgattacagtctattctttatttcaattttggctgattatgaggcgtttagttctgataaaacagttttgaatgatttatatcgtgttgctaaaaagcaaatggatttggcgttggaacaagttacttctgaaggtaaattgaaattgactgaagaaaatccggttttcatcgactggtcaaatgattttgacaaagaaacggctgggcaggccattattatttatacgctaaaacaatttattacgcttgcggaactggttaatgatacaagcttagagacctatacagcgatactgcgtaaattaaaccagtacgctaaaactcaattgtttgattcgcaatcggggttatttgtctcaggggatcagcgtgaagttaatgtggcaagccaagtgtggatgacactagcacatgttttggatcctgagcaaaccacggtgcttatgcaaacgaccgtcacgaaactgtttccaattactggtattgcaacgccgtatatgtatcaccatattacggaagcattatttgaagcaggcttaaagcaagaggccgtccaattaatgaaagattattggggcaaaatggttacgctaggtgcggatacttattgggaagcatttgatcctaatcaacctgattattcgccgtatgggagtcccattttaaatagttattgtcatgcttggagctgtacaccggtgtacttgattaataagtacctcgtttaggaggagtatctgcgatggttgacgaaaaagtaaagctgagtaaagcaaacgtactcttaataattgttgctggtctagcttcctatatggatgcagcgttgctcgttagtctgggagtagcgctacctatctggacaaaatatttagcactgaatagctggatggtcggactactaagtactatgctgacggtcgcggttgcaattggttcatttgtgggcggctggctgtcggataaatttggccgggtcgcggtgtttaatgctgatatcttttttgtcgcgattggttcgtttattattgcaattgcacaaaatacgacgatattgattattggtgttgtgattgctggtttggcctctggtgctgatttaccaacgtcattggcggttatttcggaacggatgtctagtaaagtttatggtcgggcaatttcttcaactcagattttttggacgatgggcattttgttgtcacagtttattggttttataactgctaacagtggtatgggaagcccggcagccttatttggttggattggattagtggcaattattaattggtgcgtgcgggtcttttcaaagcgttttaaacagattgaaacagacttagttgaccatgaacatgtggactgtgcatctaacggtcaatcggttaagaagtatcgattaggtcagctattgcgaacaggtggtttgttagtaccaatgattctactaactgttttttatctattttggaatttgccggccaatacgtgggggtcatttgttaactatttcttagtgactgttgatggccgtacgcaagcctattcgacaatcgtggcattaattgccaatattgtgtgtctgttagttaacctgatctatttaaaggtttcagacactaggtatcgctaccgagtgatgtatttaggtattgccgtagcattgctttcctttgtgactgcagggatctttagtaatgactggaagattttcaccgttgtttatattttctactctggtagcacagtattatgtggtgaggccctttataaaatttggagtcagactttctatccagtggatgcacgggcaacgatgacgggcttttcttatggcttagttcgggtgctgaccgctgctttctcgctagtaacgccaacattaatgggatattcgccgcaactcttattatggattatggttggatgtacggtgctattcggtgcctgtgcagtgatcattgtcgctattattaagaagaccggtttaaaagacccaacgatgaaaacggtttctgaataaactgattaatattactaagaattaaaaatgtaagccgggcattgccgggcttatttatttaaaatcaaggaggataatgctcatgtcaaaagaggctgtttggttatggtatcctggtgattttgaaatccaccaagggatgttacaaaattttaaacgtgaagaacgtgggatgggttggcctgcctattggtatattgatgattgcaaccgtaatgttaattttaaacggcactatgatttaaaagaatccacacaatttacagtactcgccaaaggaacgggctatgttgatattaatggcactaagtatcgcttaaatcatgcgattaattgtgatgcgggtgcgactgatattcaagtgtttgttggtaacgttcagggattgccgacaatttatattgttggtgagattatcaaatctgatagtggttggctagctagcaattttgtcaccacattacccgctggtcacgatattctctacactgactgtaaccaggatcctaatgtgattgaatatcggacagaaaaagtagtggccaaagcacaacaagcagttgatggtggcgttttatatgattttggtcgcgctgtgaatggaactgtcacagtcaaaacgaatgggccagttacgctatgttacggggagtccgaaactgaagcacgggatgttgagatgtgttattacaagcagtcggacgttacagctacaacaaaggttcgtaaacgtgcgtttcgatatgtctttgtgcctcattgtcagttaggtgacattgaattaactgctatgcacgaatatattcctaaaaataatccctccagttttacctctgataataagttgatcaatcaaatttggaatgtagcgacggaaacgttaaacctttgcagtgacttgttctttatcgatgggatcaaacgtgatcggtggatttgggctggtgacgcgtaccaagctaattttatcaatcaatattctttcttcaacgaagatattgataaacggacgttatcagcgttgcgtgggcaagatgatattaagcaacatatgaatacaattgtcgactattccatgttgtgggtgattggtgttctaaatcattaccagatgacgggtgaccgtgaatttctcaaaattatttaccctaagttagagagtatggtgcaatactttattcaacagacaaatgagcatgggtttatttatggtcggaaaaatgactggatctttgtcgattggtcagaaatggataaacagggtaccgtggcggctgaacaaatcttattgcttgaagactacaagacaattatgacttgtggtgaggtcttaggcaaagatgtggcgggctaccaagcgaagtatgaccagttgtttaagaacttaatgaaatatttttgggatgatgaacaaggagcatttattgatagttatgaatcgggtaagcggcacgttactcgtcatgctaatatttttgccattctgtttgacgttgttgatgagaacaaacaacaattaattttaaagaatgttttgttgaataatgcgattactcaaattaccacgccgtattttaaattttttgaacaagatgctttatgtaagctgggggaacaacaccgtgtttaccaagttttattagactattggggcggtatgttagatcgcggggccgtgaccttctgggaagaattcgatccgtcacagcatggcaaggatatgtatgccatgtatggtgatccctatggtaagagcttgtgccatgcctggggagccagtccgatatatttattgggtcgtcattttgtaggattacggcccacggctccaggataccagacttttgagatcaagcctgagttatcagaatttcatcatttacacaccgtgttacccattaaaggcggtaccgtgactgtcgtaaaagatcaacaccaactatcagtcactgctagccgagctggtgggacattgattgtggatgggcaaagacaatctttggaacctaatagaactgcggtggtcccagtgtgatttatgaagttgaagtgagctatatgtagagtgattggatcaatagcttcaaaacaaaacgagtatcccagacggctttgtcaggatactcgttttgttttgaagagacataaatttttgtgttagcgtttcatcggtacttccatgccagtg

SEQ ID NO: 63 - DNA, 16422 bp, Lactobacillus plantarum
gccacttaacttggtacaatttgtcgttggctattttgatattggaactttaggtgaaatatcagagtgccttcttcactttgccaaaacgttcagttgttactacggcgattcagaataacgagctatcacaatatcatttttagcctaacagttgattgacaaaattactgtttataagaaacaacgacaaagccatcaaaaactgagtacgcacatgtccgccattcgaatactgtcccgactggaaggcgtttcggccaatgctcagcactgcaagagtgtgaggttcagacggggtgagactgaggattagcctagctagggcgttaagcggtgaatttccgcttgacgtcatagcatagctaaccggaagtctcagtctgacccgagcacgtttcaccaatatggcattaaagcgtggaagaccagtatttaagacgtggtcttcggcttaaatctgtgtccaccgcgttccagcaattggcagaaatgcctggaagtcggcgtaggacgaactaactaagcaagtttacgctaactcgaactgtttccagcgaacctaaactggctgattttgaactcaaaaaatggcacgttttaatcatgattcataacagtttaactagtacaataggaattactaaatattcatgacgcattttaaaggaggcactatgtcacaatttgaaaagtatcatcccattctaacgccacactatacgttcgattggttaacaaaggtgcgcgttatcgacgttttcaacttatatcagaccagcaatgcgacagccactatggaaacaaccgctgcacaaattaaccacaccatgcgcgagatttttcatgaccaccagcttgtttggggcgtaacggatcgagacacgaacgcgttcgtcggtcaggtcggctttgccccaatcgatacggctaagcatgaagcaactctcagtgttgacctgactgctacttatcagcaagtaactacgctcagggaaatcttagaacggttggtggcatttggtaccgttgagttaaagttgaaccgactcacattgattttaccaaagcacgatgacctaatggcacaaatactggctggcattaactttagtaccaccgaccacttaacattcaattatcaccaataaacaaataacgcgatgctaccttcatgaagcaaggtaagcatcgcgttattttaacttattattcagtgacagcttcggccgcatgggcaatcgctgcttgaccaagtaagttcaaatagttaaatggccggtcgtaaattggttggaagaacatatctacgaaccctaagtcgtcaatggtattgtgattttgaatcatcactgaaatcacattggctgattgtgaaacatcatgttcactcatgaattgtgcacctaggatttcgcgagtttcaggattgtaaaccaattgcattaaaacaggcttagtggttggcataaattctggccggtagttgtcttcaaaagtgacagcggctgccggaacattttcggcctgtgcatgttctagggtcatcccagatgaaacgatggtttggccgaacaacattaacccagaagttgattgtgtccccatgtacttccgcgttggcttgaagatgttcaaaccaactaaggttccttggcgaaccgcattcgttgctaatgggatataagcatctttcttagttggattatagtgaacagcaaccgagtcaccagcaccgtaaatgtctggatcagaagtttgcatgtagtcattggtcttgatcgagccattagcgttcatatcgaccttacccttgagtaagccggtatttggccggaagccaacacaaagaatcgccatgtcggctgtgtagctgcccttgtcagtcttgaccgtaacttctttaccatcatcactgaagccttgcaccatttgattcaaagccatcttgataccgtgatcaacaaagtcttgttcaacccggtcagtgaattctttgtctaagtatttatttaaaatccgtggtaaaccatcaattagtgtgacttccttaccttgcttctggtaagcttcaactaattcagtaccgatataaccgccaccgatcacaatgacccgcttagctggtttggctgcttcccataaattctgagcgtgcgtccagttcttgcataagtagacattgggactatcgatgccgtcaattggtggaataacaggccatgaaccagtagtgacaactaacttgtcatagtgatcagtcttagattcaccagtctttaagtcagtaaccgtaatttcatgtttgtcagtattcacatccgtcacatcatgttgcatatgaacagttgcgcctaacttagctaactgttcaggactggaataaaataggccttgaggatcagcaacttggccgccaaggtaaagtgcgatcccacaggataggaacgagacattgtcatttctttcataaatcgtcacttcagtatctggatttgatgctaaaatctgattaacggcagcagtgccggcatgggtacaaccaattacaataactttcatttttaaatcgctccttaaatgtgtttatattcacaatcatgcttgtgcaacatgtatttggtaacaattacattgtactaaagtaaaaggaaaacgcaaccaaaaacacgtaaaaagtgtaaatacttcactaatcacacgataaacaaatgccttgattacaacgttctcagtcattcaggctgattattcattcacttaactgtggtaattaaaattattattatctttaaccattatggctaataactagaaagcaaaagcactcacaatcttgcgtgtgagtgcttttgattctcttataccaacccgatcattacttaggtgcatctgttaacgtccacgtaatatcccccgtgtaagaacccggagtagctcccgcattgctttgatataaaatgcctgacttattcgtccagtctgccaagacatcataatcatcgttatcactagtagccgtgtgactgtcaatcaccgtacccgcagaattcagcgtggtcgtctgctcgccgtcgcggaaaatcacgtcgcccgccaaattctgaccaccggttgttttaaaattagtcgcactagcttgtagttgccaactagagcccttaccacgactatcccgtacaactagttgccaatcgtcttcccggtctgtcgtttgagccgaaccatctaaagtaatggttttaaacgtgctgcttttggcaaccgtcttaaaaccaagttcacctgcagtaacaataatctgcgctttatcaactggtgagacgttctcgtaacggtcagatgcccatagttcaatctcattgtcatcaccgacgtgtaaatcctctgctttgaccttgtagtagaagtaaccttgttcgtcatcatccgacatttgaaccgttggcatttccttgccattaagcgttgggtgtagtgtcacttgaccgttagttaattgttccgaatcctcggctgcaacaatccctctgatgatcacgtcttccccattggcgacagtatacggactattacgaattttaaggtatagcggctgatcgactgtaatcatataatccggtgcttccgtcgttgtttcaaacaccttatttttaaatgtcgccgtcgttgcagttgtctgttcattgacaacgacattctcggccgtcccattgagcgtgatcgtcgcggtcggttgactagccgatactgctttatctagagtatagtcaactttagtatcactactcgttggcgccgtcaaagtctgctcactaccatccgcatacgttaccttggcactgtcaaacgtaatatgctgtggtagattgagttcagccgtaatgttatcccagtcaatttgaccaccttggtaagtcaattgatagtcgtactgaactttatgctgagctttgagctggccgcctgtcttgatttcacgattcttggtcttatccgtaaccttaaccgccgcctgtacgtcaactaaattcggcgcgctttcaatcacgaccatgttattaccagaattactaccagtcgcccccatgaatccccagcgaaccaggccatcactactgttgaattggctagtatctaacacttcactctgagtaaagccgctacccgtcgccgacccatctggattgatgtcattataagtgtacgtcatcgttttagtcgccgcatgccagtccatcaccaggtggtgccacttgctatctcctaatgacatattcgtcactaggttggtatgtttttgcgtaaagtagtaccgggttgaccaaattatcccggtaacgtctaaactcctgacagactgattttcatactgactagccagcccaggatacccggtcgcaatgtgttgtttcttaataccatcatcaaacgaatcacccttaccagcattactatagctagttgaagtattggtataggtatcaaactctaaggcccaactattttggatgaccattttcgcaaattcttcgccgtccttcaatttattatccgtatcaacaccccaaacaccgagtgtctcaccaataatgctggacgaactgacttgtgcggatgcggcagtaccatttggatcattttgtaagacaaaagccatcccatcgccggccttactagtactcgtggatgttcccaaatacacccacattttaaacgtagcatctttatttaaatctaggcgattggcgtcgttcgaccaaaagccacccacttgcttcttgccgttaataacctgaacggcctgcgtatttggcgagcttgcattggtcacattcccaatattcgcactattactaatgccactactgaatgccgctggtagcgtaaagagtttatccaactgattcaggccagacggtgccgttgccaacgtcgcttcgtcagcagcctgaatttgggcggtcccggcccataatcccattaatgcagttaatgcaactagtatttgtttcggtcccttccacatgttgaaaactcctctcgctagttagtcctgacgacggcggtttttcaatagtagccagataattgcgcctaataggacaacaatcagtgcgcccaacgcaacaaaccaccagaaatagttcgattgtttttctgtaacagctgtatcatttaaagtctgagcttctttatcagtaatggtaaagttctttgtaaattgccacttacccttatcagccgttgccgttaaatgtaaagtgtacttgcccgccttcaattgttgcgtcccgtcaccaactgcaaagtcaaaattactattcggcgccattgacatgttttccttagtcgtcgtcaataattttctagacgaaccagctttagtcacgtagcttttgatctttaagccatgcataataacgggctggttgttttgcagattagccgtaacgtaattacgatagttacgttgcttggcttttactgcgtgcaacttcatcacaggtttgattccgcttggatcagattcacgtaactgcaagccaatcacgtacgcatattgattattgatggccatgccactactagattgtttcgccttggtactgagttcctggatgatattgattccacccagcgccacgcccgcaaactttttctcgggtaccgtcaatttaatagtgacttttttgcttgacttagcgggaacggtcacgacctgtgactttgaaagtgctgtcttgatgttaaacttcaaggagtcatcggccttagcctttgcttggctgtaatcgatgataccgttattatttgtaaccgccagattaggtgataccgtgtatcgatgttctttactatcactatttttaatggttaaagtgagattttgcgtttgccctggtgtgaccttcaagtcaaaataggacactttttgattaatttggttatcaggcaaatcagcctggaccgtgtaattgaggtcatccgctctagcagtcattgtcaaacctgccataacgatgctcacaacggcaattaactgccaaaatatttttttcataggctttacccttcctttattcaacggtaagtgacgagctatgtatgattgaagctgccattctttacaagtagcagcttcacatcaaaccatttaattaactaggtgcgttcgttaatgaccaagccagcgtacccgtgtagtcgccagcacgcaattggcgatcatggacttcaagttccgtgggtacctgcccgcgattcagaacgaccagccaagtacctagaccagtattaggcggggcaatcacgacattattcgctaaaccagcaactaattcaccagtattaacaacgttaggtgcagtactaacattgccagcaccgggccgtaattggactgcgcctaattttaaagacgtcgttaaggtctgctgaccactttgcaacccgcttggcgtgacctgtaacgtccatccagcagccgtggcgcggcgatcagttatttgaatcatcgcccgctcattcttggcagtcgtcttaaacggcccacccgcggtcgtaattgcattgaatttcaaattactgacgaaatcaatggttaactttccccgtgagcccgtaccagcgacattgtcttcatcgaccgggtcacccgggtatggtttactgggatcatcagggtcgaccggagaaactgcattgtcatcatccgagggggtcatttctacctgcacctgtgactgtgtcgttgcagcttgcgttgcgataaaccagccccagttactaatgatgagacaacctatcacagtcattaataaccgacctgttaccaacaatccctttttcatcggtcacacctcagttctcctctggcgcattaactggttagctaggggcgttacctaatgtccatgtcaaggttgaagtgtaagcgccagccgcgttaccagcagggatcaacaggctaacttcattggttgcatacttactcgtaaacttaccgatcccttcattagcttctgcgtccatgataatttgattttggtcagtgatatccactttataagcttttgctttagagatgttattagcatcatccgcagttgcattaacttgtgcaaaagttaacgcggcgccccgtaattcacgagtatcatctgcattcatgaacttcgaacctttaacttgtactaaccatccgtccgtattcccagggttggtcactttcaagtcgccagtaacgttcttagcatcataggttttactgtcattagtgattttttcggtcccaaagctaacaccaggtgcttgatccaaggtaatatctttattagtgtcatcctggattaattcaacttcagctttggtcgttgtctccgtatctgcagcttggccaacaagtggtaatcctgccattagtgtcatgcctgcaacgagagttccgagatattttttcattttggttgctcctttattgtttgacggttgcgccaccagattagaattaataatattaataaactaagtccacatacgccgataccgaacagaatccattgctgggtcccattcatttgcggtaatacaccttgtagcgggctcgcaattttatcggccgccgcattgccacctgaattagaagtgatcgttaagtggtaagtgcctgattgcgtatcagctactagtggtaacttgactagctgactaatacctaagtcttgaaagctgcccatccaattaatatgaccacatcctttccagatattgacttaagcttagtatcattattaacgcttagtaccaatagtgaatcgttgtgagtaaccctatcagcaacgaaaatatatcatggttttggaatcgctgtcaattgatgacaccccttaactattgattaaaattcctattttaacggacttctgagccatttttaatattatagtgattacaaatattttaatataaactactgtaatcagtttaacggcaagctttcctactgctttcatttatccgattaggtccaactagttggcgtgttcaactaaacaagccgtcaacattatattatcgttagactttgatgaggccacacataagttaaaaattttgataattataaatattgaaatcctatatatatttagaatatcgttgtaacagcaagctattacataaattatcttcaatttataaaattatgtaatcgatttaatgtggaaatcttttatcaattttaaagtgcaacacaatcaactaattaaaatcggctttaaaaacagtaaaagccccctaatcaaataatttcaaacgttaatattcatttaccaaacaatgaagtgtgctgtggtatacttaaaacacttatttttaaccagaaaggcggttcgaatcatgcccgctaaaaagacatttcaagacgatcaagttatcgaaaaaatcatgcacttattttggcagcaaggctattatcatacttccatggacgaaatcgtaataactagtggcgtcaagaagcaaagtttatataacgctatcggggacaagcacacactttacctgcgtgcactccagcgctatcaccaacaaactttaatgcgttgtacccaagcaatgcaacgcttagagcaggatggtgccgcccccttagctatcctgagtatactctttagccacgatttaacgacatccgaacaaacagccggtgacctaatggctaacgccgtcgctgaatttggtactactgatactgatgttcagcaagccgtcagctggttttatgacgactacctgaccctcatggctgcggtcatcctcaaaggtcaagctaacgagcaaattatcaataatcagtccagtatgacattagctcaggcactgctagaagcccgcattggccttcaaacgcgactccgtcaaggcagtcagccagatattcaagcgcagcaacaagcctggatggcttttctagcacgtcgttgaacctaaagcagttaatcagcgcataaaataagcaagcttctcccgaacattttgggaaaagcttgctttattttttcatctatatataagtcacagtcatacttttgggtcataactagcgattgacttataaatatttttgcactaaccagtgctgtgctgagctcgtcaattgactaccataatgttgtcgcaaccgttgcacacccgcgtaatggtcaaattcaaattgacttgtcagcgtctcactagctagcaacgccttagcaaactgtaaatcgtcaatcgtaatctgttgtcggtaagccaaatcttcatcggctatgattcgttgccactgatccgttaagatggcactggcccgctgataacgacggtcatgggtcaacaaggattgcatatcatctggattaagtggtgtccccatattattcatcctccaagttcaaattaactacatgaccgattgctggctcaatcgacaatcgatcttcagcccgcgctaacaaccaaatcacatttgtaaaacggtgtgactcgacgtgccgttcaccacggccatccgttaagatcagcgccaaggtcgtcgcattcgtcttatgatgtgttagtaaatcatcaaaaatactttgataaacggttccaccaccgccacggcgcgtaaagcgaatctgctgtggcaaactcacctgatacgtttgaccaggctgtacgattgcatcaaacggcttaacggtgatggttgctgcaaataatcgggttaaagtagccacctgtgccagtaatcgttgcagcatcagatcactgatagaacctgaattatcaacataaacttgcaagtccaagcgcgtatcgccaatttgaccgggtatttccatccgcgcgggttgccgtcgattaaagcgcgcgtgcgaggccttagtaccgctcggaatctgacccaggccccgaactagtaattgtcgccaatcaagctgggccggctgcgtcattacagtgagctgagctcgaacattgccggccactaaccctcggccagcttcatttgtttgctgccaagcatctttcgccaactgttttaaacgggcagttgccaaattgggattcgttaactgttcagaggctgaccagccacttggatcatcgatcaactgttgcgacttttggtcgccagacccttttgctggctgccgctggtccttatttcgcgaagtggcggtgggcgcgccattcggctgaagttgcgaccgcgactgctgctgtaataatttcaaataacagccagaatctgctcgtcgcggtagctgggcatcgactaacggctggacagtcgttaaactgaccgcatctttaggcagaccgtcgacatattggttaacggccaggtcggtcgccaacgtcactaactccggttgctgcttgacctgatcacgataccgaacggggtgttgccagacaatgtgtagtgccacgtgttttaaccccgcttgtaagtaagaaaactgtgaaaaagctcgagcaattactgttggcgcatattgtaagaccaactgattattctgccaagctaagataaacggcgtcgttaacgtcgtatttaactgtctgggaagtcgggtcagcaactcgccataaaattgatcggtggctagtaactcaataatggcccgatcaatcatggtcgcacctgcctggatcgtgtctgctgttggcgtcactaacatcgcttgttgccaacgtgtgtactcattggcattgttaatcatgatgactcactgctttcttactgatttgaccaactggcgacctgttgtaaatactgatacaaagcggtcacatacggactttgcttggcaacatttgctgtatataattgctttaataagtcgcgttcatggccgatttgttgaaccaatgcaaactgaccatcttgaccgagtgtttgtaggagttgcatgaaccgaccagcgtgctgatcgtccgtcaacggatacgtggttgttagagccaaacagcttgccaaaaccgttcgcttttgaatttcattcatcgccgtaaactgcttaagaatcagtgccggcaccacggcccccactggttgactgtcataaatcatcgctggtgtcagatgaatggcttgttgttccaagaattgctcgaatacaagccctagctcagtacccacatctccttgaaagatatccagtgccacagccgtttgttgatgcacaggaagtttttcaatctcatataaattagccgaaacacgcgcccacgcacgtggcgtcgctgttaaatcagcctggacatcagcctgattaagccgcgttacatcttcactaataaactgctggacgagtggatgaatgtttggtcggttcatgtgctcatccacttgtttggcccaagcaagccagtctgccgcatctgctcgcataactagacgcacggtacgatctttgatggccgcatcgccggcagtaacgccatacgtactactttcgaatccagtcatactagcatctggattttcagcaatgatcaattgcacctgttctggcaatttcaatgtgttaatcgtccgttgcaagaccagattcatcaattcactttgaacagcctgcgtcccacgattaaattcgtctaaaaaccacagaattggctgctgaggatgctgctcagcatactgaataatttcaatcaacgtgtgtgcatagccgaattgcacgtcagccaactggccatagcgcttcgtttgaataaatgagtcgctcgttagtggtgggactgggatcgctaaatcccccttttcggacaggctcacaacggtcgtgtataattgcgcccccatccgcttagcaacctcggctaccaaggccgactttccaatcccggcttcaccgacaatgttcggtacgttccccgcttttaaaacgaccggaactgctgttaatagagcttgatatgataacgccattaattaaaccttcctttactgttccacgtgaaacaaatttaattcgttttcaaaaacatcagcttacttgtcctaaccattataaaacagaagccaccattatcgacaattagcgttcacagtcacgttagatcacacaccaatcatactgactactatcaatagtgactatgcaaaaataaaatttttatttattatagttttaacaatccacaactgccataaaacgtttttataccaacgttttaccagtatcttatcaattaatataattataaaaatcttatcagaaatattcacaaatcaaacaaattccgtcgttttcacgagcaggtattgtaaaataggttaagttagcaattattcaaaaagagagtgtgcaactatgcgcaagtatctcgccgaatttctcggcacatttatgttagttttcttagggactgcaaccgttgtgattgctaagggtgacgtcctcgctattgggttagccttcgggttagcgattaccgtttcggcctatgcctttggtggtatttctggtggtcactttaaccccgccgttacgactgcgatgttaatcaaccgtcgaatcgatgccgccgatgccattggctatatcatcgcccaaatcattggggccatcgttgcttccgcagcagttaagtcgtttgtcagtgcattaggcttatccgcaacatcgcttggtcaaaccgattttccaaaaatcggcagtggtatggccttctttgtagaagcactagtcacattcttattcttaatggttattctgaacgttactagtaatgaccatggtaacgcagactttgctggtttgaccattggggtgaccttagcattcttgattattgtcgctctcaacttaacgggcggttctttgaaccctgcccgttcaatcggccccgctatttttgctggtggtagcgccttatcacatctatgggtctacatcttagcaccagaagtcggcgccatcttggccgcattctgtgctcgggttatgggatcagaagactagttagcaattgacagtcgtaccattaaccacgatcaatttgatactgaaacatgattaataaaacagcggtaccgtgatgattttatggcttggaatcatcacggtaccgctgtttttcgtatgcttatattttaggcagtctcaattagacgaatctacgttgccaacttctcatgacgcatggccctatagcctaaccctacgccaagttttacttgcgtcgccaatgcgtgtaccaggaatggagcgttccaatcaataggccaataatgacgacaactgctgaaacatagccaaaaataccaatgtttgtaatccaactattatcaggatggctttgaactagtagtgatgatccaacaatcagcgctgccagaataacggacagtacaatcttattgaccatcgaatcaatccgatcaataaacatcttgcggtgtgcaaagaccaagttgacccgcgtctgaccattctcaaacgtatctagagctgataataagcgtgacggaaccttcggggcatcacgcaggctttgaaggctagccaacatgccatcttccagttcattgcgccaattaaaattctcgcggatgtacttgcgcgcaaacggccgcgccacgtccatcattgataaggtcgggtcgagcgtctccacaataccttcgatcgttccaaacgccttacctaacatggtaaccgctggattcatttgaatattattactgcgacaaaccttgaccatttcaaacaacaagccttgaaaatcaatgtcgcccagtcccgaattataatactgacttaaaaatggtgctagctcactaaagaacgcttcttcatcaaccacgccagttcggtttgaaatcgctaagattgctttgccgacttgatgtgtatcttcggttgtcactgccacgacaacattagcaattcccgccatcaaagctggactgatctcacccatcatgccaaaatccagataaactaaacggtatggtggtagctgccgtttgccaatcttcccgccatgcttgggaaccgtatcgtgatacccaatatcatctggttgcaattcccgcaataagatattccctggatgaggatcagcgtgaaaaaagccatcttcaaaaacctgcttcaagaaattttgcaccaagacatgggccaaatagcggcgttcgtcatcatactggtgatttccgtcttcatcggccgcaagcatttgcgccataaaatgctgaatcgtcgttcccggcatatactggttaacaagcactttttgcgtactatacttcgcataaacccggggcacccgaataatatcgtccgcattattcagtcggtaaaaccgtgatccattttttacctcaatactggtatccaattcattgaatagtgaccgtttgatttcaccaaccatttcgcgcaaatcaacaactgaagactccggaatatatcgcaataggggtaacgcccgctcaaataacgaaatatctagggccacctcggcgtcaatacccggatgctgcaccttcaccacgaccttctgcccattgagcagtgtcgcatggtgcgtctggcccattgatgctgatgcaaacggtcgctcgtcaaactgggcaaacatttcattgattggcttccctgtctgctgctcgatcgtttgcttgaccacactaaaatcatcggcccggacattattttgcaattttttgaattcgttagcaaattctggcttaacgatatctgtacgtgaagaaagaatctggccaattttaataaacgtcggtccaagttcttcaaacgccgcgcgcacttgatcaggatttttctgacgtgcaaggttgctcaaaacgttatagcgccgcaagacactgacaatcgtccgaaaacgggtatggcggttctgattcacttgccattggggcttttcctcattgttgttggtcatcagcggaccctcctcacaaatttccttattacagctattatccatctttatttaagaatccgcactagctaactaactttttttgaaaaaagattgacaaatactaatcgcggttgtaaattagaaccacattaaaaatcgattaacaaacacgccgatgaacaaagtaaaccttctggaaatgcctagagagtgtcagtttggtgcaatgacatcatgaccagatcgttgaaaatcagttctgagtggcagtgacgagcttgatgttagttgctgttggttgctcccattattgagccgaagtatcgcaagtggccggccacttgccgtactttttaaggtgattcgtcgtaaggcagtcacaaagctaaggtggtaacacgtgttcaaacgtcctggtttctgagtctaactcagatatcaggacgttttttggttaatcgcaacttttatttaatgattattgtctcaatcaaataagggagtgctgttgatatgttaaatcgagttcaaaagcgaaacttaaccaaacgtgattacgtcaccttaagttcaatgattttcgccttattcttcggggctggcaacctcatttttccacttcacttgggtcaactagcgggcggtcactgggggattgctgcggccggctttctcatcacggcggttttgttgcccttactatctgttttagccgtctgtgtcactaaatccaagggagtttatgacattggtaagccactaggcgcaacctttgccgttgtcttcatggttctcatccactttacaattggccccttctttggaacaccacggacggccaccgtatcattcaccgttggtctggcaccgtttttcccagcaaagtatcaatcactcgcattactgctgttttccgccgcatttttcggactcgcctactacttgtccgttgaacagagcaaaattatggctcgggtcggcaaattattaaatccattatttttgctattattagtcgccatcttcgccgtagctttcagcagtccgctagctcatgccggtagcaccagtgcaactgctgcctatcagaccgcaggctttaccaatggtttcttgcaaggctacaacacgatggacgccttagctgggttggcgttaggcgtcactatcgtcactgccgttaacttcatgggtcaaaccgacccgaacaaagccgcgtgggtgaccgcccgagctggcttcttctcaatggcctttgaaggcttgatctacgtgctcttaatcttgttaggcgcgcaatcgttaggtcaatttaaattatccgataacggcggggtcgcctttgaccaaatcgttaaccactacatgggtagtgtcggacaagccattttagccgtgttgatcattaccacttgtttgaccaccgctatcgggctcgtcgccgccttcgctcaggacttccataagcacttcggtttcttgagttacaaa

SEQ ID NO: 64 - DNA, 12552 bp, Lactobacillus plantarum
ttaaatttgcaatctaccataaaagaggggtttcatcatgaaattaggattgattggcttaggtaaaatgggaatgaacttagcgttgaacatgcaggataacgggcacacgccagtgggaatggatcttaaccccactaatcttagtaccgccagtgctcacgggttggcgacggccacggatctcaccaatttgcttgaccagttgccaacaccacggatcgtgtggatcatggtacccgctggtaaggcaaccaacagcgttatcgaacagttagcccagactttaagtgcaggtgacatcgtcctcgatggcggtaattcgcactatcaagatagtatccgccacggcgaattactggcaagtcaccacatcaacttcttagacgtcgggacgtcgggcggtcaagctggtgcacgccacgacggcaattttatgattggtggcgacctcgccactttccaagtcgtcgaaccactatttaaagcgattgccgctcccgatgggtatttgtacaccggccctgttggcagtggtcattacctgaagatggtccacaacggaattgagtatggtatgatggcagcaataggtgaaggctttgacgttttacagcatagtcagttcacttacgacaacgcggccgtcgccaaaatgtggaataacggctcagtcattcgcagctggttaatgggcttagctcaagatgcattcagcaaggatggtaatctagatgacatcaagggtgttatgcattcatccggtgaaggtcgctggaccttagacacggccctagaccaacaagtcgccaccccggtcattgcgatggccttgatgatgcgctaccgttcagaaaccgatgacacattcactggtaaagttgttgccgccctgcgtaacgagtttggtggccacgctgtcgatcacgaataggaggaacgaagcaccatgacttaccttattggaactgatttaggaaccacaagtaccaaatccgtcttgtacgaccaccagggtcacgtaattgcgagtgccaacgttggctacccactctatcatgatactgtgaccacggccgaagaggacccgcaagaaatctggcaggcagtccaagcgaccatccatcaagtaagtgctggcattgatcccgaagacatcgaaggaatcgccttttcatccgcaatgcacagcttgatcctacttgacagtcagaaacaaccgctgacccgggtcatcacttgggcagataaccgggccgcacaagacgccgctgaattgaaaagtcaacccctgggcgatcgcctataccacctcacgggaacgccgattcacccgatgagtcccctggttaagcttcactggcttgcccatcattcaccggaattactagcacaaacctgtcacgtggtcggaattaaagaatacttgatttacaaaatgacgggccaacttcaaatggattattcaatggccaacgccactggcctattcaacctttataacttcgattgggaacctgtcgcgctcgactatgcacacatcacccgcacgcagctaccaccattggtcgataccgacgccgtgatcgatggactgacaccagtcgcagcatcaaccctgggactcgcacccacaacgaaaattatcatgggtgcaagtgacggtgccctttcaaacttgggggtgggggctgatgaaccaggagttgcggccattacgattggcacttccggtgctgtacgggtgatgacgaaacaaccatacttggatcctgaaggccgactattttgttactacgtcgcgccgcaccactggattgttggtgggccaatcaataacggtggtcaagtcttccggtgggtccgcgatgaactcttcactactgaaagccaaaccgcccgtgcgaatcaacaagatccatacgaccaattgacagtgcttgccgcaaccgttcccgtcggtgcccacggactcttatttcacccctacttaagtggtgaacgcgcgcctctctggaatgcggatgcccgcggttcactgctgggcgtcaccacgaccacgaccaaagccgatattgcacgtgcggtcttagagggtatcgtgatgaacctgaatactgtcctacaattgacggcagccgccgaaccagttcatgcgattcgggccactggtggctttgcccgttcaagtttatggcggcaaattttgactgacgtattgggacaacccattacgattccagcgagcttcgaaagttcctgtctagcagcggccgtgattggactcaaggcactggggcatattgatgatttaaccgcgattcacgccatgattggtgcaaccgaaacttatcaacccaacgccgccaaccaccagttatatcatcaacaccaagtcgtttttgaccacgtaacggtgcaattggcaccgttatatcacgaaattgctactctaaatcgttaggagtgtccactatgccatttgttgttcttacactcggcatcctactactattactattaattattaaattcaagctgaatacttatattgcactgattgttacggccgtcgtcgtcggaatcggactagggatgccattaactaagattgctactagtattcagaacgggattggcagtcaactgggtgagttagcactagtcttcggcttcggtgccatgctcggccgcttagtagccgatgctggtggtgcttacacgatttccacgacactattggatattttcgggcgcaaacggctacaaattgccatcgtagtcgcctcatttatcatcgggattgccctcttcttcgaagttgggatcgtcttgttgattccaatcgtctttgccattgcgatcgaagcacaagttcccgttctctatctggggattcccatgggcgccgcattatctgtcactcacggattcttaccaccgcacccggcaccaactgcaattgcgacgacgctaaatgcgaacgtgggtcatgtgctactattcgggatcattattgcgattccaactgtttatatcgcaggaccgctcttttcacgctgggcgcaaaagatggttcctgacgcattcaccggtaaaccacacctgccacttagcagtaacaaacgtcaattcaaagtatctgaagcacccgggtttggactcagtgtcttaacggcgctcttccccgtgattctgatgacaatcaccaccgtctacgaattagtcgttgatcacggtgtgacacctaaaaacccgtcgacccttgaccaaatcattcgtttgattggggcacccggaattgccatgttaatttcactattattcgccctctggtcaatggggattcaccaacacaagaccaataaggccatcacggccaccatcgaagatgccactaagtcaattgccatgttattactaatcatcggtgggggtggcgccttcaaacagatcttaattgatgggggtgttggtaaggccgtggcccagttgttcagtggcagcagcatctcaccactgattcttggctggctagtcgctgtcatcttacgggtctcactcggctccgctaccgtagcggccctcacggcagccggcctagttgcgccgttaatgacgcaagctggtatcgaccccgccctgatggtaattgccatcggctctgggagtgtcgccgcttctcacgtgaacgacgctggtttctggatgttccgggaatacttcgacctgaccgtcaagcaaacgctgcttacatggacgatgttagaaacgatcatcgctgtctgcggtctcggaggcgtgttggcgctcaacgccatcttccattaagccctttgaactggctgaatgctaactataatccgcatcgaaccagtccatggtcatttaggcgtgacttactaataactgttaattaaaacaccgctgttacgcagcttgaagttgcgggtaacggcggtgttttgtgactgataaatcctagcttagtggttaatccttggattgcatccctaaatcgtgcttgatacgcgtcgatgagatgccttcagtacggggcaaatagaccacctcgcagtagtcttttagaaaatcaaacttgccgcgccaatcgtcacccatcacgaaaatatcaatatcgttatcaacgacatcccggattttttgatcccagcttttctcaggtaacacttcatcgacatagcgaatggcttgcaaaatatacttacgatcctcatacgaggtgtacgcatgcttacccttctcagcattgaattcgtcggtcgagacgcaaacggtcaaatgatcgcccaaggcccgtgcacgcttaagcaaccgaatatggcctttatgcaacaaatcgaatgtcccatacgtaattactttcttcaaaaaatcactccttatgccacgttcaagcttaattcaccaattatagcacagactacttttttgatttagtggtcgtcgtcaagtctgctttagtcgccttagcaggttgcggctgatagaccgtcgtttgcttacgcaagtgctcctcatttcgtaactcgacaatattatagaggtaaataaccacggtccggaccacagcatagaacggaatcgctaaaatcatgccaagaattccggcaatatttcccgctgctagtaataaaataatgatcgttaacgggtggattttgagtgtccgcccaataatgttgggatagattaagttcccatcaacctgttgaacaatcacgactacgataatcacgtacactacctgcatcggtgacttggtgaaggccacgatgagtgatggcgcgatcccaatgtaaggtcctacgtacggaataatgttcgtcaatccagcaatcacgccaagcaataacccgtatggttgcgagatcaacatgtagccaatcgccgtaaacgtccccacgaagagacactcaataacctgaccgctgatataactagaaatcgtgtcgcccatcttttgtagtaaaccaatgacttcaggccgctgtttcttcggtaagaaccgactgatagctggaatgaatttctcactatccttcaacatatagaacaatacgactggaatcgtaattgccatgatcgtcacactcgtaatcgtggaaatcaccgtaacaacactacttgataatgatgacaaaaagttctgagaatacttactgatttcaccattgaattgcttggtgtacgagctaatatcaattcttttcagtaccgaactattattgatcagcttagtagcggctttttgcatctcagtggcaatacttggtaggttataaatcagttgtgtcacctgactgactaaccgtggcaacagggaaaccgctccccacaccagtaacccgaataatagcacaaatacgatagccacagctccggttcgagaaatccgaaacttcttgtaatgaaccttagtcaacaacttgaccaagggattcaacatataaaataaaaatcctgaaatcaaaattggcatgaacacgacacttaaaaacgtgccgattggctgaaacaaaaaaccaatgttcgtgcagacccagatcaaggtcgccacaatcaaaatttcaagtgaccaaaataacaaggccgaatcttttaggcgcttaaacactcgcgctcctccctttcttggtgcaactattaatgcgttaattataccctatttcacttagtccgaatacgatttcgatatttctcacaaaatctatttaaaatcaatgagaataatggtaatttaattaatgaacgataaactttcaaaggagcgctacattatgtcacgtaaaattgccattatcggaatgggacacgtcggttcaaccgccgctcactacatcgtcgccaatggctttgccgatgaccttgtcctcatcgatacgaacaccagcaaagttgaagcagacgcgcttgattttcaggatgcaatgcctaatttaccttatcacacgaatatcattatcaatgactatagcagcctcattgatgccgatgtcattatctcagctatcgggaatattaagttacaagattcaccaactaatgaccgcttcctagaattaccctttaccagcacacaagtcaaagacgtcgctgctaaaatcaaagccagtggtttcaacggaattctagtcgtcattactaatcccgtggacgtcatcacatcgatctaccaagcggttaccgggttgccaaagaatcatgtgatcgggacggggacactactggactctgcacgaatgaaacgagcggtcgccagtgcactacacctggattcacggtccgtggccggctacaacctgggtgaacacggcaattcccaatttacagcttggtcaacggtacgcgtgttaggtcaaccaattaccaaattagccgctgaccgcggtttagatttgaccaaactagacgccgaatcacgcgacggtggcttccgggtcttccatggcaaaaaatatacaagttatggcgtggcaacggccgcggtgcgcttagccaacacggtcttgaatgacgccctcaccgaactccccgtttcaaatttccgggaagaatacggcgtatacctttcatatccagccgtcgttggtcgtgacgggatcgtcgaacaagttcaattggatctcacggacgaagaattgaaaaaattacaagtttcagctgattatatcaagaccaagtacgctgaaagtcagaccgactaatcagcactcaaacgtcaacgaactaacactttcaaaaaggcaccaccgacatgattatgtcggtggtgcctttagcttattggactaagcgaaccttgactggcacgattagttctttgttattatttaactgaattccatgtcatgatgattcgttttggctaattggctgacaatctgcaaccagtctttcatactaaccattaccgctgaatcttgggtactgggattttccacctcaatggtatcgtggccttgattaacaatcgttaacaactggttgatattcttttttgctaatgcggtagtaacttttttcatacgcccatctcccaatccgttccataattgttgccattgtgcaccattcattcaaacccgtcaagcgctgctagcaattattcaagtaactgagcaatattttacactaagcaggtcccagttgcacctaaaagaaccgagttttacttaaaattaaagtcgtggggtcttgaacatcgacttcaagacgtttctgataattttcatttgttcattagtaatcggctggccgtcgtattcaaactggtttttcttgttttcaatcacttttttaagatcaacagcagcggcattggtcgccttagctgtcggttctttatccttaccaaccaatttggtataactcgtaccgagcacttgagcaacttccttaagcgtaccgactgacggcgtgtgctttttccaactatagatggcactcgcacttaagcctgctaaggtcgctacttccgctaaggtcaatccattcttcttggcaaattgccgaatattcttaagtaattcaccgttatcaatcttcaaaaaagccaagttcgtcactcctatcggtcaagatctaatcaattattgttaatccactcaaactgtagacattacttaatcgaaccgcaactcatttgcaacaactttgttacaatgagcgcttatgatggggtcagcgttattgaatgagatggacatggggattttcggggaggaaatacatatgaaacaacgtcttatcacactgattgttgctattttaggcctcacggtggagctttggcaagcaccaaacgtcgatgccagctcaacgaatcgcgtcattaaaaccactaatcttactaaaagcgcctacctgacgaagaatactcagggcggcttctataacatgagtggtgccgcaaataatcttaaaatccagagtcggggaacgcttcgacaatatggtaataccacttggtttgtcacccaacaacggcaaattcgcttagctaataataccacggctaattattattttgtaacgagtgctaatacccgtgttcgtggctgggtcaagaccggctccctcaagaagagcaccagatctttcactaacctctataacgtggccaaatccaaacttggccatcgctatgtctatggtgcggtcggtccgaacacgttcgactgttccggttacactaagtatgtcttccagcaagctgcgcagaaaaccttaccacgtgtggcccaagctcagtaccgacaatatcccaaaatttccaaacagcgcgcccaaaaaggcgatttagtcttctttggtagtggcacaggttcgatatcacacgtcggtatttatgttggtggtggaaagatgattgacgctcaggacaatggtgtcaaaaatgaaaaagtctacgttccgtggtggcacgcggttggctattcgcggccagtcaactttggcgcttaaaagtgtaattcctattttcacccgacccacagaggcgacttgtgggccgctttttattgtcctaattatcatgacttgtgtcaaccatgacggctggtaatcatctcttattattcaatgtcgagacgcaaccagaacacaaaagggagcaccccagcacggagtcactccctttgtactttaattacgccgctgacagaccgtcagcagagctattgccgacgtgataattcttgatagcgactataccagatatcaatgtagtcttgtgaaaacgggccttttttgtttttgatccaatcaactaagactttcacatttgcttttaaaatgcgatcagtatcagccgaataacgccattgggcaccgtgttcttcgtactcatcaacatccaacaaccgccgctcaccatcgggaaagactttgacatccaaatcatagtcgatgtacttcaaagcctctttatctaacacgtatggtgatgctaagttgcaatagtatgaaacgccgttatcgcgaatcatcgccacgatattaaaccaataatgcttatgaaaataaacgattgcaggttcccgcgtcacccaccggcgaccatcatcctcggtgactagtgtgtgatcgttacaaccaattagtacgttctcgcttgttttgagtaccattgtatcgcgccaagttcgatgtaaacttccgtcgtgcttatagcttttgatcgtaatgaagtcgccttccttaggtcccttagcctcgcgcgccatattaacccaactttctaaaatgagggtaaattttcatcgaatttcattaaacattataccagatttttatggcgtgcgggcaggtaattcaaccttttcattcatcagcaacttgttcgtcgataaatcgattgatatcgtccatcatgaagcccttttgaaacaggctgcgtttcgtgcgcatcatgcgttcacgaaacgcatacttgcgattgcgttgccacaactttgccccctgtgcaacgagggcttcccactgttcatcttcgtcgggttctaatgccaaactcgcaatcgcggccgtaatcgtgtcattatcaaagcccttcgtcatcataccttggcgaactttctgttgcatggtcttaaaagcttggcggtgataccgttttgccagtttacgcgcaagttcactggcattatcgatctgctcttcagcactaaactgcccggccagcgcgtcatcaatcagctgctcgcccacacccttttgtcgtaagttctgccgaatcacccgtggccccttgtcactggtccgtttggccgtccgcacaaaggcatccgcatactgttggtcgttcaataaccgcaactcacgtaattgttgcatcgtcgcgtcgataaccgactcgtcaatttcttcatcccgtaacttgtcatgaacttctttttcggtacgcaattgatgtgagagataatcaagcgcgcgcgtatacgccttggagacatcgtccgccgcaatcatcgccgcttgcagttgttcatcaacttccatgcccttaaaaacgcggaacttgatcatcaccgactcactgattggaaaagcgtactgctcgtctaaataaatgttataacgtccagctcgcttttgcgcgacaatcttcgtgactttcttagtcaacgacaccaactcccatcatttaatctttactcctatagtttaccgaaaaatcgccgcgtcaaacaactaatttctccaggaagtgctaagatgccaaagtgctttaagacttggtcagtatacgactgcatcatctcgtgatccgtgtccgccattgaaggtaccgattgatcgggcactaatcgccggcgatgatgttcctgtagcgctgcttgtaattgaccagccttcgcaagttggcgagtggccacgcgctcgctcatatccacttgaatcgtaatttgaccatcataaactaaggccgtcataaatccttgagcctcaatatgcttcaaataatgccgattgtaccagctggttgttccccgtttggccgtacttaacggcatcaggatcgcatcaccgtgaatcacaggtaacttgtgtttcgataaaccgagttcaccggcgagttgcttgatcaactgtgtcccagataaccccagacgaccagcgtaattcatcatgatctggcgcgtcgtcagttttgtcttgatcaatccccgttgacgatcaaagattagcgtattttcaacacatgtcaggtgttttatgtcaagtagaaaaagtgtctccagcacgtcgattgtggcaagttctgagcgttgcgcgatgactaataatcgttgtggctgtcgggtgtcccaagtaccagcgtggcactgccaaaaagtgttaacgtgatgcggaacgtcaatattttggttcatagatggaaaatccccctcaaagtcggtatttatctctaacattcaccagccgagcccccgctgtccgcggttattttagattaatcacatcataacaattacgtacaatctaggaaagtggttggtctgtgatctatccaaatctcattggaacattaataatgaaaataaatcgtcacttttcagtccattttcacgacctgcgtcagttgcgactgctcgctacactgatatcaaccttggccaaggaaatcgctcataaatggggttatttagatgcacgctgaccgttttgataatcaaattgctttcgatttactcgcccgacccgagcaccaacggttactatacggcgctttaaaagccgcccaagtcaccaaataccacccgcaattcgaagattgtgtaaccgtggcccacctgacttggctgtctgcttaccagaactacgcgcccgaattgcccgctaacttaccagattttcgtaaatttgcatttcgccgtatcaagtggcgaactgtcgactatctacgtaaacaaactttgcgcacccagtcacaagtcaacttagaacacgcactacccattaccattgatcccatgaccgaacaagagacccattggcaattaaccgccctcttaacagaactccttgttcaatgtcggccaggtgagcggatttatctcaccgaattctttttcgaagaacagaccgttagcagtatcatgcggcgccaccaggtcagccgccgaacagtctacaactggcgggccagtctgctcgtcaaggcccacaagctttaccagcaacaaaccaccaattaaccaacaagactgtcgcagtctgaaaggaactcacgatgcatatttggatgaacacacatgtactgctcacagtaactgattctaatcaacgccaattccaccaacactggttagcagatcgcgaactgaccgacagcgaccttactagcttgattaccattctgaccccactattcgctgagaagctcatcagtattaccgttcgaaccatcaccgagtttgcggattaaatggggctagtcaaaaaagtttaggcaacccttgcacaaatcgtcaggctcaaccgtctgtattaatgtaagctggccagcctaccaccacaaaattcaaggaggaactcatcatgactaaaacttggttaaaagcaaccctgactgttcaaacaactacggaattggacgaacaacgtaagcaaacctttaacgcaatcgcccaagacgcaactgacgaacaacttgccgcttttggcaagatcgtcgaagtcttgacgggcgaccagttcacggccgctaacttggccaacgcctaccgctacgatccacaacccatcgcttaacacgcccataataataggaggaatcgcccatgaaaactttagacttaagctttaagactagcacaaacaaggttcaccacttgaagttacactacgccaacgacaacttgagtaaagacgttgttagtaaggcaatggcggacctcgctgccaccaagctattcgtgaaggatggcgaaaacttagtcgccgaaccgcttgccgctaagtacgtcgaaaccatcgagacaccaatcgtcactgcaccaaaggcttagaacgtgtttagaatct

SEQ ID NO: 65 - DNA, 15202 bp, Lactobacillus plantarum
ttttccattgtgattgatatagaaatctatgtcgtgcttgttaaatagcactgatccattaatgacgtgacctgctaagccgttcttcgtccaacctgcaaacgttccctctgatacatccgaatacgccgccgcattcttcttgcgtaaccactgctgactagcacccacatcacgcttagcctgactgattgaatccgtagttagctggtatacgaagtcgcgtagtgcctgcgcctgttcatcacttaataacaccttaatcggttctgtaattatcctcaccgcctttcaatgacttgtagcacccgcataaaaggtgtgaatcgcattcccagctaattcatccgattatcgggcaagttaaccgaagcacctttcaatccttatcaataagattccattgtcagcggcactaatttcatctatttgacggatgctttagctggcaattgcaactcaatacggtaaatcacgccttgaatctgcaaagcttgcttgatttgctggtagtccagtttcatttcaagtagcgttctgatctgctgtttaacccgcttgactgcatccgcctcactagcgcttaaatagtgggtaatagcttccgtcttaggaatattacgagctttacgcaactcattcacgttaactcctaacgcctgtttgtataccagcttattaatattgatatacaaatggccgtgttcacccaatgccggactttcactaatagcagcgtgcaagctctttgagaactctttacccagctcaaacttggcttgtcgtagaatcaactcacgtttcattaccgaaaattgcttaatcagggcttttttgaatagtctgactggcttggtgtttcctaaataagtaattaatagcatggcttgatcttcatttaagtgccagaccttacgaggtcgcccgccaatactcccactactgggtttaagcatttgaaatgccaataccccaaactcttctaggtctgcatgatactgattaatcaactggttaacggcatgatgtgtaatttccgcatagtccgcaatcacatccccagtcgtatatatttccgcgtccaatcgctgtgatgtcagtgttactaaatcactcatagctcacattcctttacttagtgactgtttgagctctgcaatcgccttttcaacacgggctttacgctcggcatcaagtggcattcgtaaccatttcgaaaacgttgtatcagcaatacctactttaaaagcaacttgccagtattttaaatggttctcttgaatcaataatctgatttctgagttcataggttgaagctcctttcacatagttgtaaatcaaatattcactttttatggtttttaagaatatatcatttacaaaaacaatattacactcgaataaccagttgtcaagaacaagaacaacatgtatcattaaattgcatatatggtttgcacacaaaaggaggataaaccatgatcagtattaatctaaaacaatatgtaaataaagaaaaaataagtatcaataagctttcaaaggtaacagggataacacgcccaacactgacaaatatgtataatggtaaagctacagggatacagtttgatactcttgaagttctatgctcatacttttctattcagttatccgatctacttacacaactaattagtaaaaacgacataggaattacatttgttgcggatactcccaataagtcaaaaagtatttttagtttcagctacactcggcactttaagacagaaacgatcacgaaaaaggcattattttcatgttcctttagcgatacaagaaatttagataacaaagattatctaacaaattttgcattctctcaaaaaaacacacaacttcctgattataattttgctatagatttattttcttctgatgaaatcaacgaattgcaaaaaagacagattattcctactactagctcagaccaatttttcagctacaatgaaactcttcagctctttagaagttttagtagtaacactcaggcatatatatctggagaaataatagccgcttttttcgcgcactttaaagtccaattaaacgcaaaaagacattatctaatcaacgtacaatggttgatgggattgttaacaggagaagaatcagcatttaatttcactgttaataacgataaaatgctagctagccagctccctaagcacgctggtattgaattgattggtctttagaataacttccctacatacttgcccgccagctggtatgaaaggaataatcaatatggcaactattaagcagtataaaaagaagaacggtactaaagcatgggagtttagtgtttatttaggaattgatccattaacggggaaagatattcgtactactcgtcgtggtttcgttaacaagaaattagcgcaattagagttatcccgtttacagcttgaatttcaagaacatggcctccgtaaaattgttatcagcacgtataacgatgtctaccagctatgggtagtagagtacaagaacacagttaaagaaagcacctacgttaaaacagttggttattttaagcatcacattttaccggcattcggtaacttgcagattaaacgtattaccgtggcttactgccaaaaggtcattgatggctggttcaaacaatttaaaaaatatcaaactattatgaactatgcggcacttgtatttaagtatgcagtcaagcacagcattattgagcgtaacccgattgacttaatcacctacccacggcgtaaagcagtcattggcgccgacaagtgggaaaacttttacgacaaaaaggaactacgccaatttttgagtgctttagataacgaagacgctcatcaaggaaactacaaagcggatgccttatttcgcatgctggcgtttactggtatgcgcaaaggcgaggcattagcgttaacgtggcatgacgtagattttaagcaacgcactatcaatatcaataaagggctgacgcgtggtgaaaacgctcggttatatgtacagacgcctaaaacaaaaaactctactcgtatcatcgatattgacgacaatacaattagagttttaaagcaatggcagatacgccagcgccaagaattatttatgtgtggttacaatgtgaacgagcatccgcaatcacagcttctctttagcaacacaaaaaatgagtatttgacgccctcacggcttagaacatggctagtacgcctgattaataagtatcacctaaaatatatcacggtgcacggatttcgtcacacacacgcttcattactgtttgaggccggtgcttctttgaaacaagtacaagaacgtttaggtcactctgatattaaaacaaccatgaacgtttacgctcatgtctcacaacatgctaaaaaagatactgttgaaaaatttatgaagtaccttgaattatgatcgttgtttcaactgaaaatagccaaataaaaactaaaccgtagtcaaaatcgtagtcaaaaagtaattacaccacatataaagggacacaaacactggtatgcaagcatttatgaacatagggggttcgatactcgccatctccattactgagtttcaaagtgatgtaataagctccagaacacttgttatatcaatattcattaaagctatcctaacgggatagctttttttgtcctattttgattagcgtgctacttcagtaaaaagcccttttccaaattggaaagggctttttttaccgataatacaaccatggttaacctgatcaaccaaaatctgtccaataattataaacgccacagccaacggtgttaaagtggattgcaaccagtctgttaaaataataagcgctcacggcactaatccagctgcgttagcatgcggccatttagaccgtaccgacccgctggcggttaaacccaacctgtactaagatccgatacaataacggcacaatgatgacacatgccaccgcattaatggtcgctgctaataaactcgtgaaggacccaatcatggcgaccttgagcgttgtccccaccattaaggcttcaatcacgcctgtacaccacgaagtgacaatttttgtgagccctgcgactaacgatacccagtaaagccggccaatacgatcttcacgatagccgattgacttgaaactcaggttgaccatcgcggccagaataattgcttcaataattgttaaccacgaagttgcggcatacccattcagaatatcaaacaagccaagccccactgcaccagccgtagcaccatagcaaaaaccaagcaacatcactgcgagcactgtcaaaatattaccaaaatgaataaatggccgcccaacaatcgcgggcaacggaattcgtaatacactgataccaataaaaataatggcggcaaataaccctgccaagacgagcttttttaattgttcagaccttcccattcaattccctccaattttgcacatctatttatcattatattctaatataagtgtgaatcaattgatagtcctagtctatttttttcgtgacggtaactgaataatagtcgctcgtgcgggcgtctcaacacttacttcatacgcaactgctaacaaatcataagcagctcggggcattttgtattgatgacacactaaataataacctagatcaacagcgatttggtgcgcgatagcaatactgtcaccactacgattaagccggcgacgagcccgcgcaactaacctggtcaacacaacatcgcttcgaatctcaattgccatgctggcaagtgctagttgggcacttaatcgttcattcggttgggtcgtacgtgcttttgcctttgccatttttttcaactcctcagtgtaatcataggagtttcactttggcttcgcaacgaatgacaccctcaaagccgcgtcatcactgagctcgtttaactttcacaaaaaatattattgaatcatttcaattcaaattcagcaacagcgcccacatcactagtccattccatataagtaaatttaacttacgatttaatttatatctgccaccgatacttaatcatccgtctcttgattcggtaacccgaatagcaataccccaacaccgagtaagagtacggccacgaacaccataaaaattgccggaatgccaaatccaattgccatcagcgcaccaactaaaaatgggccgatggttgcgccaatgcgaccaattgactgggcaacgcccataccaattccccgtaccgcgggcgcaaattgccccggtgtgaaagcaatcataattccccaagcccctagcgtaaagaacgacaaccatgcaccactaatcagaatcatcgttggattattggccgtcccaaaagctgcggcactgacgaccgtcccaatcagataagttgccaataccgccttacgcttgacgacgccgatcaaccacgcagctagataatagccgggaagttgcgccaagctcatcaacatcgtatagccaaacccatgtactaatgaaaatccgcgcaacaccaaaacgcttggaagccataaaaacataccgtaataggcaaacataatcacaaaccatagaatgctgaggcaaatcgtagctcgtcgatatttagcggaccacacttgccgcaatgcctgtctaaaatcaactttttgtggccgattagcctcctgttctgcaggtaagtgtcggcgtaacagcaacgcatacaaccccattaaggcggtgattaagaccgtcatccgccaaccaatgtgtggcatcactaaaaaggccaataacgatgctgcaatccaaccaaacgcccaaaaactatctaccaggactagcatgcgtgagcgctgtgttcccgtataatgatcagcaatcattgtcgcagcaaccggtagttcaccccccagaccaatgccagtcaacaaccgaacgactaagaaccactcgacgttcggggtaatcgtcaataacaaattaccaagcgaaaagagcagtagcgtcccaatgaggaccggcttacgccccaatttatccgctaaatagccgcataccagggccccaatcatcatgccaagcgtggtgatcgcactgactgctcccaactgtcctgcagttagctgccaactttctttaataaccggcatcacaaatgatagcagggccacgtctaacgcatcaaaaagccaggccgtcccgatgacccataatagcttagcactatttcttttactttcgaccattccaatactctcccaaatttcctaattagccttccgctaatttaggtattttttacctttatggtgctataaacgtagcataccgacttggacgtgtcaaatgaactactttagccggtataccttagcggggcgtccagaagagccaggtcgggctgtccccacctctgtaaataaatgaacgtgggttttacgaaagtttgaattgtcgatggttgccactggctgccgccacaaaatcgcatacagctggcgcgcctgtttgagtgtgaactgctcacctaacactaataagatcgtaggagcatagtccaggcgattgcgcacacgttgtagggcgtttcttaagatcaggccatgatcggcggttaacaactgcttggcgattcgttgataaaactcccgctccgtctgcgaatcgggaacaccagcaaatgccaaaccatcagcgaccagatcatcacgatccacccgcggcgtaatggcaaaccacttgacatcgcgcgcaccataccccggaactagttccggcttgactggcaaataaaccatatacgtcaacgccagtgagcgttcacccggcacgcgatcgaccgcggtaaacgtccctaactgttctgtatggaattgggcaagctggacacccaacttctcacgaactaatcgcaatgcggcttcatccgcactctcatccgttctcaaatacgtcgtcggtaatccccaggtattctcaaaaggagcgtgatcacgctgaataagcaggaccagcagttgcttggtcactgcatcgaaactccagattacgttcgtaatactgattaatggccgataactgacttcatgcgccattcaaatcgtcctcctacaaaaacggccactggcaaatgccgtggccgttgtttattttttaattcattgcttgtagcgcttgaaccgtccacccgttaatggctgacttttcaataattgctttttttatttcccagacatccgctttgatatagcgatgtcgggcggtcattaagggaatatcagtgtagacctcttgaccgcgattaatggtaacgcgcattgaattacatcctttcctaatgctcaggaaatctgtaaataattctaatactcaatactggggcaagtacatgatactaaaaattaatttatccaaaatctgaggtaaatttaatccggcagcgtgaagtccaccgaactaacaattaactttatcatatttttgaagttatcgctaacagaatgctctttctttgacttaatttaaatttagccctaataatgaagacgtttgcattgtgtaaaaacagattccgatttacactaaaggtaattttataagggaggtttttacatgcgcaattataaatatgccgtatatggcggtatctcagttgtttatttaattaccctatatgcgttgtaccaccttattcgaacggcttatattctattctttctctagcccagaccaacccgctgacttcaggataacgatcatcaaacaagctcatctgacctgactaaggccggatgagcttgtttgattttgattctaattgcgtaacgtgactgactcacaatcccaaaccaactactgattagcagagccccagtcatatcatcgatgccataaaaagcggtcaactgccagtgctaccttagcattttcatgtaactggctgtgctgcgcatgggccccataaaagtctttttcggtgtaatcgacatcccgcccacgcaataaatacttgatggaacgggccgacacgttggtgaccaagctgtccgaatgactaccatcgttcaaggttcccacgatattcaatagttgcacatttttaggaaaattgttccgcttggctgccaataattcataggctgcatgcaaatatttcggttgcccagaagtcagaaacgagttctgattagcaacatcatcttccccgaccaccccatcaaacgggccagcgatcgttactaacttattgatcttcggaaaagtcgtcgtttgttgcgtcatcagcatattaacgctagcgacacagcccgcagaatgggcgacgatattataatgtttaaacgcgtgctgttgttgaaccgtggtaatcaccttagccagccaagcactctgttggtcatactgggccagattgttcttgaacacgacttgaattatcgggttacgcacccgaccacgccatttacccgtcaacgtcacttgaccactggtactgaccgttgccaccaaaactttgtgagcatgagcagtcttttcagcatgcgcaatcagggtattcgttgacttcgcactcccctgaaacccgtggacgtaaaatgtgggggtctgttgattcacatacggcgatatttttttagtacttgccgcctgttgcgttgcttgtttcttagtggtttgagaaccacaaccggttaagccaacgactaataagactgccaacagccaccatttaatttgtttcactttatccgccccattaatattttgaaatattctactctaattaaatctaagtcaattgaactcacattaccaatttcgtttgacagcgaccaactcatcttgtaaataagtgcttgctaaccgcaagtatgtcacgtgtttgccaggcgtgggtgcatgtaatagccagccatcaccggcatatagggcaacgtggtgtaccgcaccgttcccatgattatgagcaaagaaacacagatccccaagctgggcatttgctatgtcgaccgccactccttgcttgatctgatcctgagcatcgcgcggtaagcgaatacctagactgcgatgcaaggtatagacgaatccagaacaatcgaaaccataagcactgatgccaccccataggtagcgtaaatccaagaattcttcaccgagtcgaacgagtgtcgctcccggtgtcaagcgcgcggttctaaatgcaaactgcgtcgcacgttttgcaatttttccctttccgagtggggtctggaccgtataataacgatgatctttgctactaataacgggtagttccgttccaaggctaagatttaagaacgtacggccatctaagcatagtaacggcgtaaaaccacgccgtatcgtaatcatcggcccagtttgaaccggcaatgggacggtcgacaattgcgccgcccatacccatcctggatacccctgtggatgccgggagtcggcctgattaacaacgtaaccataggcccagccattgacaaactgttcgactaaaaagacgtcgttaaataacgcctgcgtcacgatgcgattgtcgcgttccaaagccacagtatcttcatctgataactgcgccaaccatggttgtaagccgacatttgctagtgccggagtatcgatggacgtattgttcggctgccgccacacgttcgcaacggccgcaataatccgtgttgattgcattctagtcacctcattttttcagtttaccatatctccggaaccacgtctggcttcctgatcaaaccttgaagtgattttaactttaatcgatcgccccccaccgccgtggcacctcggcacgttaagaagctatcctttcagtagaaactttacactaaatattaaaaatcactgtgaaagtatgctatgatactaataattacttaggaggcgttttaacgatggataaaaccgatttgaagattttgaacgccttgcaggccgacgcgcgaatctccttaaaagctctcgccgatcaatgcttcatttcttcgcccgcaatttccgctcgcatcactcgtctgaaaaagagtggcataattcgtgactatcaagcaaatcttaactttgaaaagctcaattaccacataaaagcctatattcaactccaacttgaaccaacgcaaaaggagcgcttttacccatttgttgccggcattcctaatattctggaatgtgactgtgtcacgggtgaatactctcaaattttgaaagtgattttcgaatcaacgcaggcattagacgagtttgtcaaccaattacaaacatttggaaaaacgagtacccagatcgtcttttcaacaagtgtccctaaccgtggcctcacgttgccagatgatcacgacatgtctaaaattagtcattaatccgcatgcacagggaaactgtagcttaataggcgcaccgagaaaccatgttagtttctcggtgcgcctatttaatgaattccaattgcaatgtcagagatcggtagcccgcttcaaatcaaacccaactatcagttatgggcacctcaggaccaattcaataacctaaaaatcgcttgtggtgtcgtcacttgataatgacgcttgagaacttctaagccaatattacagcctaccaatagactcccacctaaagccacgcccacccataattgtggtcccaaccaatgaatggcaactaaactacacaaaaataacaccgcaccaacaatcattcctagcgtgtaactcacaaaccatcgtctcattgggcacctccacgacacaaactaattacgcgaatcggttcatcacataaattgcaccaagtccaattccccataaaactaacagcggtagtaaaacgagcatgccgaactggtaccaacctaataccatcataaataaaatctcaacactatggccgaacactaataattgaaagtattcacgaaaataccactgcacgccgataccaatcaagaaactaatcaagatcacaccatagaacgtttcatgcagcattttacaaactcctttttattgcgtttgctatctaaccttacatggtaagtatgccgtattgaggcctaaatcatcatcatatttatgtaaagactaggttatttttcagtaaagactgtttgatgatttttaaattattgcaaactgctgttaacagttacctgcgtaacgtgttatgattaaaggacaaattaattaaacgcaacaattatgggggcgcactgtgttacatctacttacgctatcgagcttaggccgagatctttttaatatcaaaatgctaattgtcattctcattacaattggcctgatcaccctaatgaccattctgacctacctcctagagcaacaggtccatcgtcgtcaaaatcgacattggactattggggcccatggtgccgaggctttaagtgtcctcattagtatgatcctattacgacaaatattcattacgctgaattcaggtagcattatcagttggacctacgcaacggttcaattaacgattcttctgttcagccttaacaccatgcgcaacctggccgttgaaattattaacctgttaatgccattgtccatttatggtcaggccatctggttgggccacagcacgcagtacctgccagtttttctggccatggccattatcttgattagtacaatcgtctatattactcataactatcaagaattacacgctactcaatggaagtatctcctgttccaaatactatatagtggcacttggtggggcgttatttggtcagttcatccgttcaaattgagccatacactcgtcatcattctagcctttgtcctttacatgtggttgattcgtttagcagtcaatcgcgtccaaaagtttttcaatgaagtgctcacctttgatcaacaagtcaattacgatgaattaaccggtattcgtaaccgcgccagctttgacacgcatgcgcgtgaagtgtttgccgcgtatcagcaccatcaaatggggcccgtcactatggtcatgttcgatattgaccactttaaagcctttaacgatcagtacggccatctggctggcgacgccgtactccgacacgtggcgcattttgttgaacttgaacttaatcagcgtagcactcacggtcagatcttccgctatggcggtgaagaattcgtcatcatttttcgtggcatctcagcgcttgaagctggtcaaataatgcgtacgattcagcgtaaactgaaaacagtaccaatcaaatttaacgctcaaacgttgaacgtgaccgtttcaattggcatttcagaattgcaaccaaccgaccagactttcactgattggttcgtccgcgttgacgactacctctatcagtccaagcaggccggtcgcgaccagaccacggttgaaagtcaattactaacggattaataattgttcccaaaaggccgttaatttgtaaattcgttcccgatttacaaattaacggcctttttgggtttagcgattaccgatggggacaatggcgcgctgacggtccaataattactgaatcgccagcagtccattttcaaattaactagtcagctaaaaataattttctcctaatcaggacatccaaaaacagtccatgcttgaatgtctgtccacagacaagcccaagcatggactgctattaaaaaggataagaattagccttgtcgttctttcaaactgagtttctcgacgttcaattccttgtcaacccagccattcacaaaactgctctcatgactaaccaagattagattaccttggaaagcctgtaatgcacgcttgaggccttctttagtttcatcgtccaaatggttcgttggttcgtccataattaagaagttacttggaaccaattcaagcaaggctaatttaaccttagtctgttcgcccccactgagtaagtgcattggcttcatcgcattcgccgcattaatcccacacttagccaacttagtccgaattgtcttcggtaacatcgtagggtattcattttgaatcgtctgtaacggtgtcaactgtgggttatcccattccaaatcttgattgaaataattgattttagcagatggcgaaaaatctgacttaccacttaacgctggaattacacctaaaattgacttgatcaaagttgatttaccaaccccattaaagcccttaaacgctaatttttcaccgttggtcatcgtaaaagtcacgggttccaacaacggctttccgtacccaacagacagcttcgtcacactcaatgcattttgagaacccgtatcaaggtatggaaaggcaaacttagcgtgttcattttcactcggtggatcaacccgatccaaatgcgatagcatcttttcccgtgacttcgccatcgttgactttgaaccggccttgttcttgcgaatgaacttttcggctttttcaatcacaacttgttgcttttcaaacgccttcagttgggcttccttacgtgcttctttttgccgcatagccgctttaaaatcgccccggtacttaataattttaccgaatgccacgtcacaaatacagtttgtgacctgttgcaagaaatcatagtcatgagagatcaccataacggccccttcaaagccgttcaaataatcttccaaccaactgatatgcgccgtatcgaggtagttcgtcggttcatcaagaataatcacatccgggttttccagcaatagtttagccaagatgatcttcgaccgttgaccaccagacatctcactgatgacgtgatcccgaccgatttcatctaatcctagtccggtaattacccgttccatttctgtctcaatatcataaaaattattggcttccaaggtctcctgaatcctacctgcacgttccaataactggtcatccatcttttcagcataatccgcataaagttgttgcatctgcgcatctaaatcatacaagcgttgaaaagccgttttcaaaaaggcgtatagcgtcatgccggctggaatatcggcgtattgatccagatagccagttcgaacgttgcgctgccacttgatctgaccagataatggtaagatctggccagttaaaatcttaattagggtactcttacccgccccattttgaccaacgatacccatatgatccgctcgttccagcgtaaaattcgcatcgtcatataatttacggtccgcaaagctttgcgataaatccgttacttctagtaaagccatgttgttttcaacctacactttcattttgacccgtattaaaacgggccccgtcatatcacgaggcccgttgcgatagccctgatactaagctagcaccaagtctttatctagttcatattgcatatggaagtacatccgatcaccgataggcttaattcctaccgattcgtaatgataacggtcatagagcttcttagctcctaaattagccatgtcaacgttcaaaccaatccgcttttgaccagcttgtcgcgcgtatcttggcagggcggcgagtaacttcccgccaatcccatgaccctgataattcgggtcgaccgcaatcgaatccaggtaccattcgtgctcataactttcagcttcagcttcaaatgctgaaccaaacgcatcattattcgcagtaactcgtgctaacacgtcgtccaccgcgtcctcatttttgtcaggataaccaaacgctaccccgaccacttgaccatcggcctcggccactaccgtcgttgccttaccagacaaataatcaggtgtccggtaagcggcagtaatggcctgctctaagtcaggttcaggaatgtcgtctagttcctcaagttgcatttcatcaaaaatcatattaattagcggtgctatctggcccgcgtcgtcttgatcggctggtcgaattgttatcacgaatagccctccttcttatagtaacacctacattactatgaaaagcaagcattgtcaaaagtcgcgtccggtgtgaacggttacagttgttattttttgagttgcttcccaaatactgtcatatccgtcccattatcaatcgtggtatactgaataacaccgtcttatactcattattattggcatgaatcatgattaaaacgtaccagttagattgctgttcgtcagccgttgcgcgtcctatgccgacctccggggctgggtgccaattgc

SEQ ID NO: 66 - DNA, 12418 bp, Lactobacillus plantarum
ttaaatttgcaatctaccataaagaatgatgatgccgtctcatggttattaactaaagagcgacaggttagactcatatcgtgtaagtctagcttgtcgctctttaattaacaaaaaatcttagatatagcttactactcgaccatccttttattaataatgtgatcccctgtattaccatctagacgactcaacaatgcattgaactttagtcgccgaactggtcgtggaataaattggcgaatatcatcttcattaaagccaacttgaattttactatcactaatgatgataggccgacgtaacaacttcggatgatcacacaacaatttaagtgcctcattcaatggcatttcgggtaacttaggcgcaatttcaggatagtctttagatcgagctgagataatatcgtctacaccatgttcggttaaactcaaaatacgttttagatcttgcaccgtgggcgaatcaacactaaaatttttctccttgaactcaatcccatgtgcttccaaccattgccgtgcaactctagaagaatgacagcttgattgtgtatataacctaatcattcctaatctgcccctctctcgttaaaattcatcacagcgtattgatcgacattaacttctgcctgtcacaacatcctttaaactaaacgcattcgttactgtcatgaccaatccaataccccgtgaacacatctttattataggctctgaacaagggacataccgaccgttttaagacgaataatctgaggataatcgttttaagtacacttttaaacggtttaggaaagaacgaacccagtacacgtaatgctaacaaatatcactgcaatttctaatcgaataacgctgaattttcatcgcgtagcacataaaaagtcgcctactaatttaacaggcgacttccttggaactattatgactttttagcaagccatttagctagataacgattagcttgtgcagaacaaagcactttttcaccatttgtcatggttaatcgtcgcaagtgcttgtccaatgacttaatgcgtttcaagttaacaacatatgacttatgacacctatagaaattaggactcaaatcaggaacgtcctttaacagtccatagtattctaattcaccatcatccaaatggactacgattttatggggactggttgaactttcaaaaaatataatgcttttaacattaattgatctgaccgtctcaccaatttttatttgaacatagtcgtcttggtcattttcatcggtttgaaaacgatcttgcgccacgtgtaaaaccttgctaaatcgctcatacaaggaatctggaaaatccttaagaataaaatctaatgcctcaacttgatattgaaacaccatcaaagataactccgtgtgtgtcgtgataaaaataatcttgctgcgacggcccatgtcacgaatctggctagctagttgaataccattaatatctgaattaagggcaatatctaacacatagattgccttttgaggctgctgtgcattaaccttgtctaacaattcgtggggatcttggcatgctaaacagatactcatgtctagctgttgatcgacgattaccttagtaatgatttgccgtatttgttgtaattgtttcggatcatcttcgcaaatgtagacactaatcattctgagatactcgcttcaccgtcaagcgttgtaagaataccgctcctaagactctggtttcgagtatcatgttctcattgcgattaacaatcttacttaaactattcaatccaatcccccgattcttgcccttagtggaataacctgcctctttcagcttccataagggtggtaactgttcaaaaacattgttttgaatcaagaacaccgtactatttttttcgataaaaatggcactcataatctctccatcagcatgtcctaccgatgcttcgattgcattatccaacataatccctaatgcaatgtctaaatccaattcattaacagtaatgtcaattaatggttcctttaaatcaaaatgaacttcaatctcttgcgattgtgcatagctcaacttactaaataggatactcttaatcgacttcactttgacccgactcaaatcttcaagattatatttttcttttaacacccgatttgaaaccggtgcaagattcttttgataatattcttgtaaaccttctaaatcatcagttttcaaatattcatctatcgaaatcaacatattctgatagtcatgtctgaaacgtcgcaactcattatagtgagcttcgatttcattcatatagcgagtatcattttgtatttgtattctttgcttttggacttcatatttggctcttacattttttaaatattcgttataaatcaccaatactaaccccattacaactgacaatataattaaattacttaatataacctggaactgattttccagaccttcactcaacataatatacaagtatattatcattaataatagtgcggttatgcgatttaagctctgattactaaacgtgggactgaaattcgtgcgatccattacaatattaagaaaaattaagcttacgacactcaatatgacaaacactaccacatacccattaggaactttcattaaacgagttaatatatcacaaatatggtcaaccataatcgaccatatgaacacttgaaatgttatacatagtgcaccgcttagaactcgtacataccaccaagtgaaaaatataaacatcattaacattaaaaaagaaaaactaattcctaactttgctaaaaaaatataactcatcagcatacagacggataagaatataacatcaaaaagtctcacaaaaaatatatttctcaacaaagatttaattatcaaatagatagataattcttggaagacaatcattaacatatatctacactaatccttgctttttaattcatcaggaattttagtttcgaataatatcccatggcagcacataaccaactgtttagtacctacgtattgaaaaagatggctaagtactttatacattttttctttcataattttccctcctttcatagggcattagtaataaagcggctaatgccatcgcaattaaaatgattgtgccaaaataattattactaactatttgtaacaaactcaaaattaatgacaatccaattgcccgtcgctttaatttttttctcaatgacttcgatgtaataggattctttaccgtatcagctggagcaaaaatacttatgattattacaaatattaaacttaataacaatctgtatacttcagaaataccagtttcaatcacatacggcacacccacaaacacaaagatagttaatatcgtacataacaaatccgatttcaagtgacgtccataggcaaagccacgcaaaactaaaaaactacccataaaaactaacactgggaccaactcgtgtagcagcaacgctaagataatagtaattatcagcttaggaataacatttaatacagtatcaatgcctagtttaactagtaatgcctgccgtctttctagttgaagattcttttgaatcgcagcgaataaccgatcgcttaatttataaagcaatagtttttgttctggcttttccatatcccactcctataatgctcaaatacatacctgtatcaacagtttaaaacagtattaattaattgaaaagaatacataaatatattaattattcaatattgttttaagactagaaataaacatttaaagatacatcagtttaattattcatacgaaactaaagtttcatgtaaaaagatcgttaatataaatcagtttcatcgatactcccccttaatttttccttagattacaagtcaaactagacttaatttcactaattcacattactcaatagattaatatcaaatggtgaaaatcaacgaaaagaggagatctatcaagcaatctcctcttacataaagttatttatgaacactgatttaagctaagctgccgatatcacaatctcagcatccactaaatcagccttcaagtttttgacatctaagtggtcaaggtagaaatccgttaccttgtcacgaatttgttgttcaattactcgccgtaatggccgcgcacccatcgcttcatcatagccttgttccatcagccaatctttggccgctttagttacctcaagtttgatggattttttggctaacgttttttgtacatccgccaacatcaaatcgacaatttgacttaagtcttgcttagtcagatgtgaaaattccacgattccattaaaacggttcagaaattctgggcggaaaaatggtgctaacttatccattaatgactgatctcgttgcttgtcaccacttaatgcttcattaccaaagccagcattagaagtagcgataataatcgtatttttgaaattaatgacattgccttgtccatccgttaagcgcccatcatccatcacttgtaacagtaacgttaatacttgtggatcagccttttcaatttcatctaataatacaatggaatatggattacgccgaacccgttcggttagagtattagcattatcttcatagcctacgtatccagccgaggtaccaattaatttcgacacagctgtacgatcagcatattcactcatatctagccgaataatcgcatttttatttccaaacatatctaaggctaattgcttagctaattcagtctttcctacgccagttgggcccacaaacagaaaacttccaattggctgatcaccctctgaaaagcccgcacggttacgccgaattgccttcgctaccatttcaaccgcttcatcttgaccgattaccttacttttcagacgcttatcaagatttttcaagtgctcaatatcattagcgcccatatcagcaactggtataccagttaaacgttcaaccgattgtgccacatcatcaatcgtggcagtgattttttctttttgatccgtttttttaattttttgcttggtttcctcgatcgacttcttgatatcagcggcttttgtaaagtcctccgatttaacggcggcctccttagttgcctctaattttttaacgcgttgatccaatgtctcaacatcagtttgcgaatttttagccgctaaatgagccgcagtcatgtcgatcaaatcgatagctttatctggcaaagtgcgttgtggtatatattggattgaataatccacagccgccttcaaaacatcatctggtaatacaacatgatgatgcttttcgtacagctttttaacaccttgtaatatacgtaaagtgtcagcggccgtcggttcattaatcacaacatcattgaatcgccgtgccaaagccgcatttttcaaaatagtattgcgatattcatcttgagtcgtagccccgattacagtcagctcgccacgtgacaaagcaggtttaatgatatcagccaatcctttgccaccatcttcaccaccagtggcgcccgtgccgataatctgatgaatttcatcgaagaatagaataatattaccagctgctttaacttcctttactagctgtttaatattttcttcaaaagaaccgcgatattgagttcctgcttccaaagacgataaatcaatcgaatagatttctttatcttgaatcgtttctggaactttaccagccacaattgcttgtgccagaccttcgacgactgcagttttacctacaccagcatcaccaactaagattggattatttttcgtcctacgactcaaaatttctgcagtttcttgaatctcattctcacgtccaatcactggatctagtaatccatcacgagcctgttccgtcaaattagtccctaacttttctaaaatccccccttttttaacagcctgtttaccatctttagatacttctattgttttattattttggggtagcttaccagttgatcggtattgagcaaactcatccggtgtcagcgattgtccattaactaaataccgtgcacgctccgaattttgattatccatgcgccgaaataattgattgaaaacatcatccatatcattgttgaaaaaaggatcatttccgtagaaatttgccatattacaacacctccataaaaatttatatgtgtaacttagtgaccataatatcctttaaaactacaactgaatcgtatcacgatttttatgtatcgttaagtaaagtgcttatagaatcaattagaaataattagaataattttgtttaaacaaaagagaaatcaatttcataaaatgaattgatttccctacaaggttccctatttaatagcccttgataaagaacttgaattaacaagttactttccagaccaattttaatttaagagactgcgactcaaaaagcacacccagtatcaagttaaggccaactagttatcgttaatattgccacttaaatatcaatactagcaatcatgatacacgtgtaaaatcataaaccaaaacatattacatgacgtaacggcggtcttgggactgtaaactcacagtaatgattctattgagttggataaggtgccgatgaccagtaattgccataaatgcaattgctttcggtacaatcgtagtgacatagccaactgtctcggccatctgcccatttgttttataaaaccgtaatgagactcgacatttttgatcatgcgcttgttgtaatttacaataattattttcaacactcaaattaaagtctcccgttcaaagaattcaggtttatttattcgtcagtgaatctatgtgtttgtttttctcattgttgacggcgtaagtccacattaaggagtcagctattcagtaaaaactaaataactagtattcatgttcagctcagtataatatgcattgatggttactaatcaaaaatcgatctctaaatatcctaattactatgaaactttgaagttaatttatgagaaaaataactcacaacaaaactcatgattacaaccttgtcatcataactagattatgaaacattcagcctcctaaataaaactggtatgcgcgcatgtgcgcatgtgtacagtatactattgccaggtatgtctgaataaccgttttaagacttgaaaaactcagctgggtgctttaggacgctttttgtgcattttaagacaatatcctaacttcaacgccggcatagcttcaattcgtcaatcagtgtcttagttcccgctagttgcatatcgatcaacagctcatcattaaggtgactcactacggaagcgacaccctgcgcaccacccaatgctaatccatagataatcggccgagcaagtgccaccagatctgcaccattggctaacgccttaaagacatgggagccacgccgaacaccgctatcaaaaattgttgggacgcgcccattaacggcttgcgcaatctcgtgtaaaacatcaaaggaagctggaccaccatttaattgccgaccgccatggtttgaaacatagataccttgagcaccagccccgattgctaacaaggcatcttctggttactgaatccccttcacaataactggtaaattcgtatattctgtaatacgccgaacatcagctgggctaatcttttgcgccgcagcagcatagatttctatgatacctttccctttaccatccccttcgctgaacttagtcaagttagccattgggattggaaactggaaattgttgataatatcagcttcacgatacccgtcaactgttgcatcaacagtcaaaatgattgccttagcaccagccttcactgcttcatccaataaactctgattgaaattccaatccttgctcatatataattggaaaaattggggcgcacctttaccagctgcggcagtatccgcaattgacgttgaagaataagtactctgagccatgagtgccccaacttgagccatcccttcagcagtcgcagcttcaccccgtgcatgtgccaatccttgagcggccgctggagccatcataataggcgttttgagatctatgccaaaagcctgagtctgtgtgcttggctgttccatatccgtcaatgctcgtggcacaatttgaacatggttaaaggccattgtattctgctttaaagtccattcgtcttctgacccaccactaatatagccaaagcctccgctcgggatgatctttttagcagctgcttccaatgatggtaaatttaaaatcgttaacttttgctcacgatcactctgttcatatccattaataactgtcattatactaatctcctttacataaccctttataattcatttaataattggctaagtgccggttgatccgcttcagcgataccatatcgttcacgatacttagcaatcgtatctgcatcaaagttttctggatctactggaacaaaactagtatcaattggatcaacatttttaatttttgcatcaatcacaattggtagttgattaccattctgctgtagttgagtaactttctgaaacgttgctttcaactctttaaggttagtcactttaaaaccaatcgcacccatgttgtctgccatcttggcccaatcagcaccaatcaagtcaatcccatacggcgcctgattagcgagtaacttttcatgttgaataaagcctaatactttgttttctaaaaccacgttaatgactggcaaatgatatttaacttccgttagtaagtctggcatcaccatggcataaccaccatcaccagaaatactccaaacctgcttcttaggataattcaattgggcggccaaacctgctggcaaaccaaaacccatcgtgccataccaagccgacatcgtaaaagtctgttgcttattcaatggtaactgtcggattgcccattccgtattattcccaacatccagaccaaagacggcatcatcagtagcattgtctttaatagcttctagcaccccttcagccgtcaaccctccttgatcatcagtagcaattgtcttgagccaccggttccagttttgcttatcacgttgagcagctttcaagaacttagttggcttaattgtcacttcggattgaagtaatgcttggaaaaattcttttgcatctgcaagaacagtaatatcagcatcatgttgtttgcctaaatctgctaaattattattgacttgaataaacttaattccttgtggcaagtaacgtgcaaatggaaagttagtaccaacaaacaaaactagatctgccgcttgcgagacttcaaaggcgggtttagttcctagtcgaccgcgagagcccatgaaattaggatggtcagttggcataataccagttgctggagccgtcgacaaaaccggcaaactaaatttttcagaaactgcgataacttcttgacgcgcattataggcacccttgccaatccataaaacagggtgttgagcagctttcaaagccgctatcgtctgctgaacgtcatctaatttcggcattaagacctgttgactgccgctaagtgaagccgttttaaaaccatcaaactcaatatcttgaccagacaaatcatctggaataataacaacagaaaccgaacgggtcgcgtatgctgatctaattgcttcatcaaccacgtatggaatctgttcagccgttgtcacttgtttatgaaattcggctacatctgcaaaaattggatcttggttcatttcttgaaagaagttcgtattcataatggatgttgctgattgaccgactaaagctagcaccggtacgtgatccatcttggcatcgtataatccgttcaagagatgaacggcgcccggtcctgctgaaccaaagctaacaccaatcgtcccagttaatttagcatctgccgcggcagctaaagcaccaacttcttcatgacgtacttgaatatacttcaagtggtctttctcttggtagaacccatctaccgtgttattaatcgagtcagctgtaataccatagatatgatcaatgttccagtcgactaacacttgtgccaatgcttgtcctgctttaattttagtcatttccattaccctctttttgttgttacttttttgagcacaactatatcctaaataaaaacttgacccttgtcaagtctttatcttaaattatgcttgttgttgaacagcgctaatgtcatcaataatatcttgcagcgtcactcgcgacatacgtgcctcagcactattctgaatatcacaatagtatttttccatcactcgcggaattaccgacccgaccggacacgtctccgaagtattatgatcaacgtttaaaaaattacgcttagccaccactgctacatagatatctttcaaggtaatatcattgggcgaacaagctaatgttggtctagcaacgccacgaaccgaagttaacaagcctgcttttcttaacttactcatcattcttctgaccatggtaggatccgtatttaaactactagcaatatgctcacttttcagctggtcatcagtatgcaacgcaatatatgccataatatgcgtcgcatcacttaattgtgtattagccatctagacacctcccatatccatctctattgttacttattttagcacatctaacatgaacataaaagcgattaaggaaataagttaggcttctttccctaatcgcaacataagattatttgataatctccattaattcaatcaaacttattcaagacatcgatagtagctgaatttaaaacccaccctgtccaatttgatgttgcaaatcatctaagccaaattgttttaaataagttgaaagtggttgtaaatcttgagcttcataccgttgtttaaatgcttcaatatcagctgccgaactcgttgccgaatctaaacgaagcttttcagcaggcagtggccgatctcctgtaatcaccgcatcaatcagaactggttcatgctgagcgattgctttggcttgttcaaaaacatcaggtaattgctcaatcttattaactcgaaaagcttgcatgtgcacgccatcggcaatcttactaaaatcaatatcattgaattcaacgccaataaaatcattctgattagtatcttcctgctcatctttgataaatccatattggcagttggtgaaaacaacattaatcactggtaaatggtattgaacttgcgtcgccaaatcttgcatggtcatcgaagcgccaccatcaccggccagattaaacacctgccgctcaggataattaagtttggcagcaattgctcccggaataccaactcccatcgtagcaaataagttagaagtaatgtgccgattggacggcgttaatttcaaatgtcgattcgcattcaaattgatatcaccaacatcaatcgaatagattgcatcaggctccgcaattttattaaccgcacgtagcacttgatatgcttgtaaaggcccttcctgcttatcttctaatgaagctagataagcccgccaatttttaacattggctaaattggcttgccaccaaggtgtcgactcccgttcagatacctgtgctaaaattgcagccagcgttttttgtgcatcagcaagtaccgcaatatctgttttatgtcgtttacctaacttagctggatcaatatcaatttgtaagaaataacgcgtatttttaaacgctttggaaacttctgcaaacggataattattaccaacaaataaaacaacgtcggcttgcgcaagtgcctcattcgccggtttttgtgccacccgattagcagaacccaaataggctggataacgatccgcgacaatacccttagctggatacgtactcattaatggaattttcaacgttttactcaattgttcgagttctttaccagccttacgagctccaatgccatagtaaataagtggccgttcagctgcgagtaaagtctgtgtcaatctcgtcactgcttgaacgtcgggttctggtaataacggcgtttgataactattagcggaagcataccaatcttcagctggaatctgttgccatggtaaatcgactggaatttgcacaaccgcaacaccttggtgcgcgtaggcgcgtcgaattgcttcgtcaataacatgtggcaacgtggcagcattgacggctgttacattataatctgcaacgtccgcataaatcggattctcattcatttcttggaacgtatccatgttcatcccagtagttccaaattgaccaataagtgctagaacagggacatggtcttcacgcgcatcatataacccattcataagatgagtgccaccaggtcccgctgagccgaagcaaaccccgattttacccgttagcttagcatcagcagcggcggccattgcaccaacttcttcatgccgtacggtagattgtaaaattaatcc

SEQ ID NO: 67 - DNA, 12036 bp, Lactobacillus plantarum
taaatttgcaatctaccttatatgttccatcaaatgggctataacgtcctcttgcccgacgatcgcggccatgggcaaagtgccggcaagtacattagctttgggtggcaggatcgccgcgactatttaggctggatcgataaagtcgtccgtatcaatggtcgtcacacggatatcatcctttttggtgtcagcatgggtggtgcgaccgttgaaatgatgagcggcgaagaccttccatcacaagttaaggccatcattgccgattgtggttattcgagtatcgaggaagaactcgcttacttattaaagcgacagtttcacttaccaaagtatccgtttgtgcccatcgttagttttattaaccgccaccgtatgggctattatttaagcgacgtcagttctgtcgaacagctcaaacataaccatctaccgatcttctttattcacggtgataaggatgtctacgtcccaagttggatgctcaaagaaaattatcaggccgctaagggccccaagcagatgtggcaggttcccaacgccactcacgccgagagtttttggatcgatcctgccgagtatcaacgacatgttacagcctttttaaatcactatgttcctgataaataaaattcagtcgaaaaaccgtatgcgctattcactacgcatacggtttttttgaccgcttaagttgttttatgactggctaatgattcgggctaagcggtccgccatccgttccagattggctggtccctgcgccatggcttgatctaaggtcatgacttgatcgacaatcggtaaaacggccgtgaccccctgtttggcaaatgtttcatttgcacctttctgccgaccaactaataaatagcaaggcttgccggccgcttgggctaactgactgagctgaattggtaccttgcccataaaactctgatcgtcgacttggccttcaccagagataactagattcgcttgggccactttcgttttaagattgctcatttcagctaacaattgaaaaccagagcaaacgcgggcgtgtaaaaagtaacgtaatgcaaacccaataccaccggcagccccatcgccttcgtgggcactcaccgcaccagctgcgaccgtcatatagtgagctaaagcggcatcgtgaacctgaatttgagcaaccggtaatcctttttgtgggccaaaaatcttagctgcgccgttcggtcccgttagtggattcgtcacgtccgctgcactaatgaacgagacttcagctaattgtggcaacacatgtcgatcgtcaatcttagtgacccgacttaaatcagcgccagtcatggctaactcttgaccatcggcagcccaaaaacgataaccgagcgcacgtaggattccggcaccaccgtcgaccgttccgctaccgcctaagcccagaataatctgccgagcgccacgctcaatcgcatctttaatcagtagcccggtcccataggtattcgttgctaacggcgtcaaggtcgtcgtgacaaactggattccggatgcagccgcaatctcaatcactgccattttttcagtggcaaagtagccatacgttgcagtcactggccgttgcgccagatccaccgttgatgccgtaatagcttgtccaccagcatggttagccagccacgccgccaccgttccttcaccaccatcggcaatcgcaacttgagtagcggtgattccgtgagccgcaaatcgtttagccactattcggttggcctgaatgctcgtgatggaatttttaaatgaatcaattgcgatcaaagcgtgcatattaacgtctccctattgacataattactttcagtataatcattacagcgggcgcgagcaattcatatcagttgtcaggtttcttaaaactcgttaagcttaagttaccaaaattttaatggaggctgataaatcatgacaaacaaatacgattacgatgtgttatacattggtgcgggtcacgccacgtttgatggcgccgcaccactcgccaagactggtgttcgcgtcggtgtgattgagagtggtctgattgggggcacctgccctaatcgtggttgtaacgccaaaatcactcttgatgaacctgtcaaattaacgcgggaaacagcacgcctcaatgatattttgagcagtgcaccaaccattaattggacggccaacgtggcccataaacaagagattattgatcccttaccagcaggcctgacagctcgtttggaagatggtggtgcaacgatcattcatggtcatgccacgttcaaggacgctcacaccgttgtcgttgatgatcagcaaaccattaccgctgaaaaaatcgttattgcgactggtttaaagccccatcgtttagatattccggggaccaagctcgcccacgatagtagtgattttatgaaccttaaacggttaccacaaagtatcgtcatcattggcgcaggctatattggtatggaatttgccaccatcgctaacgcagccggtgcccaagtgacagtcatgttacatggcgaccaggccctccgtgatttttaccaaccattcgttgcacaagtggttgacgacttaaccgaacgtggggtgaccttcatcaaaaatgccaacgtgcaagcatttaccaaacaggatgaccagttccaagttagttatggcgaccaccagcaattaacgaccgactggatcctagatgcgactggtcgaattccaaacttagatggcttaggcttagaccggattggcgtcaaatatgaccgccacggcgtttatgtcaacgaccacttacaaaccaacgttcctaacatctatgcagccggtgatgtccttgccaatgacttgccaaaggtcacacctgcagcctactttgagtccaaatacttgatgcgtttgttctctggtcaaaccagtgctcccattgactatccggtaattccatcggtcgtctttacttcaccacgaattgcgcaagctggcatgaaaataccggccgctgaaaaggccggcttaaccgttagtgataacgatttagcagattactggtattatcaagtctccaaggaaccgattgccgctagcaaacaggtccatgaccaagacggccatctcgttggcgtgactgaaatcagtgatcaagctgaagatgccgtcaacgcactactgccagctatcgaatatcaattagaccgcgaacaaatcgaccgtttgattggtattttcccaaccatcggctacgcagcttggcaccgggcttaaaacagaaaacactgctgcgaccgccgcttgattaatcccttattaataaccagagccgccaatgacccccactcattggcggctctggttatgttcgttccattactttagaaaccaactcgggcctgcacatcaagcatactgaccatgctataattgcgcctatctcaacgattgaaaggttggtcctaacaatggatgtggatgctcaaaaattatttaccttagtagatgctgcttataatcagccgattaccaatcaaccatccgattcctaccgccaagcgctactggcagctgcaatcgacctgaataacaacgtttcgccacagcaagtaaccattcagctatatcaagcctattatcgtaactatatggtcccaatgactctaccacgccggcatcgtgacctctaccaatacgttcacacccaattacagcgcctcacgcgcaaagaacagcgtcatatggcacttgggtatggtctgattgcgacgcacctaacatttggtcccttgaactgaaattaagttacttacacgcattgcgctagttattgtttagtatgaagcatgattaaaccgtgccattatcaagctcaaaaatagccattaatcgtccccagccccggaggtcgaaataggacgcgcatcggctgacgaataaacagcccatctttttagcacgttttaatcataataaaagccccagcgattactcatcgctggggcttcatcgtttttaaattaatcgtctaatcccaatcgtttgaaaatatcatcaacgtggcgaagatggtaatgatagtcaaacgcatcatcaatcgcagcctggtccaaatgttcacgaatctcggcgttaccttcaataagtggcttgaattgtaactgttcatcccatgacttagccgtcagtggttgaacgaggtcataagcactttcacgagacatccccgtatcaatcaacttgagcaagacacgttgactgtagatcaacccgtaagtcgcatccatgttttgcttcatccgttctgggaacaccgtcagcgtcttaataatcttattgattcgagttaagatataatccactaaaatcgtggtatctggtaagatgatccgctccgcagaagagtgggaaatatcccgttcatgccacaacggcacatcttcataggcggtcatcatgtggccgcgaataacccgtgccaaccccgtcacgttctcagaaccgatgggattacgcttgtggggcattgctgatgagcctttctgacctttattaaagaattcttcaacttcatgagtttcagatttttgcaaaccacgaatttcggttgcaaacacttcaacgcttgttgcaatcaaggccaaactagcaatgtattcggcatgtaagtcccgtggtaaaacttgcgtcgaaatttcttgtgcgcgcaatccaagttgtttgcagacaaattcttcaacaaatggtggaatgttcgcaaaagtcccaacggctccactgattttacccgcttcaacgcccgcggccgcgtgttcaaaacgctcgatatcccgattaatttcagaataccaccgggcaatcttcaatccaaacgtggttggttcagcgtggacgccgtgtgtccgccccatttcaaccgtatatttatattttttcgcttgttgtgctagtgtcgcccgtaaatcttgtaagtcttggcgaataatcgcgttagcctgcttcaaccggtaaccttgcgccgtgtcgacaacgtcagtactggtcagcccatagtgaacccacttacgttctgcacccaacgactcggaaacatcgcgcgtaaaagcaaccacatcatgatgcgttacggcttcaatctccgcgatccggtcaacatcaaacttggcattctctcgaattttagcaacatcacttgctggaatcttccctaattcagcccaggcctcgtcggcagcaatctctacctccaaccatgcttggtactgattttctaacgaccatactttgcccatcgcgggacgcgtataacgatcaatcattgctaatcctcatttctttttaggtattcactaacaaaacacgaacattattatagcatacccctcgagtaattaatagagacgaacaatgaaaaaatactgttatttttcactttgtttccatattaaggacttgttttcgaactaattcaccttaattatgaacgattatttgcgctcgaaacaagaacattcggtttttgggttgcgttttgacgttaaagttgctatactctttcctgttggagtggtgaacgtttaactactctttaggattaattattcataattaaactatttaatgaggtggaagaatatggcatcagtcgtagtagtaggtagccagtggggcgatgaaggtaaaggaaagatcacggactttttgagtcaggaagcagatgtggtatcacgttaccaaggcggcgataacgccggccacaccatcgtatttaatgggcaaactttcaaattacggctgattccatcagggattttcttccatgataagttagctgtcattgggaacggcgtggtcttaaatcccaagtcattagttgaagaattacaatacttgcgggacaagggcgttaatcctgacaaccttagaatctctaaccgtgcacacgtcatcttgccttaccacatcacattagatggcgctcaagaaaaagctaaagccggtggcaagattgggacgactaataagggaatcggcccagcctacatggataaggctgaacgaattgggattcgcgtagccgacctgcttgataaggacacctttgcggcgttactcaagcgcaacttagctgaaaagaaccaaattattaccaagctttatgacttagaaccactgaaatttgaagatatttttgatgactattacgcttatggtcaaactttgaaaccattcgtcaccgatacttccgttgtcattaatgatgcgttagataacggtcaacgcgtcctatttgaaggtgctcagggagtcatgctggatattgaccaagggacttacccttacgttacttcatctaacccagttgccggtggtgttactattgggagcggtgttggcccatctaaaatcgataactgtgttggggtcttaaaagcttacacttcccgcgtcggtgacggcccattcccaactgaactctttgacgaagtcggtgatttcattcgtgaaacggcccatgaatatgggaccgttactaaacgtcctcggcggattggttggttcgatagcgttgtattacggcatgctaaacgagtttctgggtttactcatcttagtttgaactgcttagacgtcttgacgggcttaaagaccatcaaggtatgtaccgcttatgacttaaacggcgaaaccatctatcactaccctgctagtctgaaggaattagaagcttgcaaacctatctatgaagaacttcctggctgggacgaagacattactggcgttaaaacctttgaggaactgccaactaatgcacagaactacttgcgtaaattagaagaactcgtcggcgttaaaattgccaccttctctgttggtcccgatcgcgaacaaactaacgttatcgatcacaacatttggggctaattgaacgcgacaccgtgaattaacttaaaggagttttgcatcatgggcatggagatttttgattacgaagatattcaactaattccgaacaagtgtgtcattaatagtcgttcggaagccgatacgaccgtagaattgggtggccgtcgttttaagattccagtggtgcctgccaatatggcaaccgtcatcaacgacgagattgccaagtggctcgccactaacgactacttctacattatgcaccgcttcgcccccgagacccgccgtgcttttattgaaacgatgcatgccgcgcaactgtacgcatctatttcggtcggtgttaagtccagcgagtatgactttatcgacgacctggctgctaatcaaatcgtgccagaatatatcacgattgatatcgcacatggtcatgctgacagtgtcattgcaatgatcaagcacatcaaagacgtccttccggatagtttcgtaattgccggaaatgtggccacaccagctgccgttcgcgaccttgaaaatgctggtgccgatgcaactaaggttggcgttggcccgggtaaggcctgcattactaaagtcaaaacgggctttggtactggcggctggcaattagctgctgtccggtggtgtgctaaggccgctcgcaaaccaatcatcgcagacggtggtgtccggaccaatggtgacatcgccaagtcgattcggttcggcgctacgatggtcatgattggctcaatgttggccggacatcaagaatcacccggcaacattttaaaaatcgatggtaagacttataaacaatactacggttccgccagtgaaactcaaaaaggcgaacataaaaacgttgagggtaaacaaatgctggttccttaccggggccgcttagttgacaccttaaacgagatgcaagaagacttacaatcatccatctcatatgccggcggccgggatttaaaggccattactaagtgcgactatgtggtagttaaaaattcgatttacaacggggactaattaagactcactaatacctaaaaagcttgtcagccatttctggtctgacaaacttttttagtatccaattctaatttttacactcactttaccctgacagcggctatgaaagcggttataataaagctaaatcactaatcgaggtaatcagactatggaacacaatcgggtcttacgactagaacacggtattaacttccgcgaactggggggttatgagaacaccgctggtcagacaatcaagtggcaaaagctgctgcgttgcggtggcatgtcactactcactaaccgcgatctcacctacttggataactacggactccgttatgatatcgatttgcgccaagccaatgaagctgagatgtctccagaccgttatcccaagaatactaagtatattaatacgtctgtctatccgttcactgacaatcgtcgctttgatcgccgtttaaaacggctcatcaagcgaatggtcgtcgatgattccttcaacgcacaaacatacgcgcaaatgattacagatagtcatgccgtgaaagtctggcaaaatttatttgcgagcctcctcgccaacgaccagcccgaccaatcggtactctttcactgtgctgctggtaaagaccgaacgggggtcgcgggtgcgctcattatgacggccctagacgtcccccgtgaaacgattatgcaggactacctgctcactaacgccatcttcatggccgcagacagtatggataccgctacgatcattaccaaggccaatgctggtgacctagctagccaattcaacgttgccatggctgttgaagccgacaatatgaagatggtctttcgggttttcgacgacctctacggcaatggtattggttatttacgagaagtgcttgggttatccgtagcggatattaataatttgcgccaattgtacttgaacgactaagaaacactaaaaaaactgattttgaaagtcaataactttccaaaatcagtttttttgcatcatctattcaattgtttaattataaaattggtgataacaaccgtgaaaatgtctgcttgaacttcaaccagaatgattggtttttaaagtcttgaacggtaatcaaactactgattttttgatcttctaagaaaatccgttccaattcttgtgctaaatcagcatcgtataaaaaggcgttcacttcgaagttcaacttaaaactccgaaaatccaagttagcggaaccaaccgaagccacctgaccatcaatcacgatggtcttggcatgaataaaaccattattataataatagatttttacaccagcatctgccagctcccgggcatagtactgagttgcccggtaaacaaaggcatgatcaggtttgtccggcaccataatgcggacgtcaacccctgacatcgcagcgattttaatcgcatctaatacggaatcgtccggaattaggtatggcgactgaatccataaacggtgttgagctgtcataatcattttaatataacccaatttaatctgttgtgcatcactgtccggaccactggagacgatctgtaatgaagtattccctttaacgcgaatgactgggaacatattaacgtctggcacgattcgatgttccgcatcggtggcgttccaatcacgaatgaaacgttcctgcaattcaaaaactcctgaaccgacgatccgcaaatgggtatcacgccagtaaccaaacttcttactacgaccaaggtactggtcaccaacgttaaaaccaccgacgtagccgacccggccatccgttaccacgatcttacggtgatcacggaagttgagacggaagtccaaaatcgctgaatgagcacccaagaacggtcgggcatgcccaccaagttcttctaaatgcttaaagaagctgcggaacgtgcccatcgacccccacggatcgtacaagacacgaacgtcgacgccttgggctgctttccgctctaaaaggtgtaataattcatttccaatctggtcattataaaatgtgtaatattcaatatgaatatgattcttagctgcttcaatatcttggaacatcgcatggaacttctcatgtccatccgtataaatcttgacccggtttttacggcttagtaacgcgccatcggaattcaagaataaactgaccatcccacgaaccgagctagtgaccgcatctgcgggcatcaattccgttcccagggcttcacgttgccgctgaatcatctgttcgagtctaatttgcgtctctttacgtaaccggaataaccggtttttcggtaacttacgaccgacaaaggcgtacgcgataaacccaataatcggcaaccaaatcaacacgagtagccaagcccaagtggccgcgatgtcccgattacgatcccggaacacggtaacgaacgccgcggccgcgtttaaaacgataattgtatagaaaattggctgaatatattgcaatggaggcacccacctaatttattaatgatggttttattttaccgcagatagtagtgagataataatcttttgcgaatataatttttgcatttaatcattaaatagctaataattatgcttaaggagggcgcgttcaatgcttgcaatgcttggaattcacggcctcggccccattcgcatgtttcacttaaccgaacacattgcgggtccgcgagcggccgttggtattttactaattattattttattagcggtcgtctaccgttactatcgacgacatcgttaataaatcaaatctttgaagcagctggtgaagtctcccagctgtttttttgtgggtcattatcttacggatcggtttattcaatcattgcagtatacctctgctaccaccggagaaactcataacaaatatttttgaccaagttaaatcctcaaataaaaaagttgcgttgattagacaatcaacacaactcgattcgaccaccccttctgaacatctgttgtatggcctgattgagttaacgcattacctaccccatttttcaatgtaggccgatagtaaactaaatcattggaaccacctggttaatggctttttatgaaatcgttagttcacacaaagacttgtcgcttaaagcttggacgtaattcgaacgtcccgttgcgctgagtttttgattggtatcgagatagatttcacccgtccaatgctttatttttttagtcggcggtctaacgattacgcgatagacgatggggcaatttttcagggtcatattttttgatgactgatgcaaaaactttttgtatttcttactttccgctaatgtttggctggttgcaaatgtgtattcataccaaataatgccgctaaaagggccggattcttccttgattattgtgtttctcgagacacgcacgtcataaggactgctttttaacattgttgttagtacagtcctcgcttgatttaactcaatacgatttttaacgtacccgtataaacagaagctactaataaggataattgcaaaaagcacgtaatgtgtaacggtctttgctttaagaaatgacgacatgactaatgcctcccaactttattatctggaaatagtctggcaatgctttatacattatgaatgcagacgtactagtatcaatacttttattaccaacaccaaaccaatcagcttgctatccccttttttgattcaagatctgccagtcattgcaatcactagcttcgataccagcaacaatcagcagacccagtagtccactaatttcaagtggcctttaatattggtcaggccttgatttgcgttctccttttgaatatagcaaacgccaaacccattgtcaccaactaatgaatatcattcgtatttgttaattttagaattgcaatcaagtttgtatttggaataataaaatttatgcaaatgtggtcaataaatgttgatattggaaggtcgagacgaatcacatcagtttcccgtaggccgttttacctgcaagaaaattaattatccaatttgattcatcaaaatactttaaggataatcataatcccattttattcatataatcgatatggcaaattacaagtttaatc

SEQ ID NO: 68 - DNA, 11017 bp, Lactobacillus plantarum
attaattttacaatctaccatgtcagctttttgatcagtgacccaacgaccggcaaccatcccaccgtggattcggtaatcaacggtgtggtcgttcttggcgtaccactcgtattcccagccgttatcataagtgtagataaagtgtgtgccgagaaagtcatcaagtattttaaaagtttttgtcattagaattaccttccttatgtctaatatgtcattttaatcatgtaatttattacatgttttaaacaacaaggttagtgtatactgttatcaaggaatcgtcaaggaggaatttccaatggcgcaaaaaaacaagttacaatttattattctagggttattaaaccagcaaccattaacgggctatgatctaactaaagcctttgatgacgagatcggtgaattctggcaagctcaacatagtcaaatttatccgcaattgaagcgactagaagaacaaggttacgtcacgcatgaaattacggtcagtggcgaaaaacttgaaaagaaactctaccatatcaccgcaactggtcggcagctgttacatgagtggatcagtgtcggtacaccagacttaaccgctacgaaagatgaatttattttaaaactatactttattcaaacggatcgtgatccacgcctactagcgatgttacaggaacagctcaccctgcacacagctaagttagcacacttacaacagcgattggcgaccgttttcccgcaagctaaagctgctaagcaacattatggtcactatttgatcttacaacatgcgatcggacgagaagactactatgtgaattggttgaagcagacgttgaaagccttaccggagtaatggggagagtgctgccgctctaactggtggctggaatcatagcgttaaaagctacccttaattatttagagcggcgtttgaaggaaatcagcttatgattatatgcgtgtgagaaatggtgccgtttgaattctgaaactggtataatggcagtggtcaatatcaattcacttcaatgaggagattaactatggaaaatcaaaaaatgcaagagccacttgtctatcggcgaattttactgaccgttgatgaggacgataatacctcttcagaacgtgcgtttcgatacgcaacgactttggcccacgactatgatgttccgttgggaatttgttcggtgctggaaagcgaagatatcaatatctttgattcattaacaccgtcgaagatccaagctaaacggaaacacgttgaagatgttgttgccgagtatgttcagcttgctgaacaacgaggcgttaatcaagtagagccgcttgtctatgaaggcggtgatgtggatgacgtcattttagagcaagttattccagaatttaaaccagatctattagtgaccggtgccgatactgaatttccacattctaagattgctggggcaattggtccgcgtttagcccgaaaagcacctatttcagttatcgttgttcggtaatcaagactcgggacagggattaagatccaagctgatgaaattttaacaaccgcaagctcatcatggctaatgaggagcttgcggttgtttttgactgctattgttcattaatgaacttaacaattgaatttttttattggctataaatactgctaaacatgagtttataagtgtactgtttggatgatattaaataatttttcaaattcttgttgcattatgagcaaggatggctataataaagtttgtaaaataattcacaaaggaattgaacggaggaagcacttcatgattaagacagaaaaaaatcaaacaagcaaagttactgacgaagttgatcaattagttcaacgttctaagaaagcattagctattttgaagtcatatacccaagcacaaatcgatgatttatgtgaaaaggttgcggttgccgcactggacaatcatatgaagttagccaagttggcggttgaggaaaccggtcggggtgttgttgaagataaggcgattaagaacatctacgccagcgaatatatctggaacagcatgcgccatgataagacagtcggcgtcattaaagaagacgatgaagagcaactaatggaaattgctgaaccagttggtatcgtagccggggttacacccgtaacgaatccaacttcaacaacggttttcaagacgttgatctcattaaaggggcgtaacacgatcgtctttggtttccatcctcaagctcagaaatgtagttctgcggctgctgatgtgatgcgggaagcgattaaagctgctggtggtccagctgatgctgttttatacatcgaacacccaagcattgaagcaaccgacgccttgatgcaccatacggatgttgcgacgatcttggctaccggtggtccaagtatggtgacagccgcttactcatcaggtaaaccagcactgggtgttggtcctggtaacggcccaacttatgttgaaaaaacagctgacattaagcaggcggttaacgacattgttttatcgaagacgtttgataatgggatgatttgtgcttctgaaaatagtgccattatcgacaaggaaatttatgctgaagttaaagctgaatttattcgtttgggttgctactacgttaaacctaaagatgtgcaagccttgagtgatgctgtcattgatcctaaccggcacacagttcgtggtccagttgctggtaaaacagcttatcaaatcgcacaaatggctggcttgaaagatgtcgctaaggactgccgggtcttgattgcggagattaatggtgtcggtatcaagtacccattatccggcgaaaaattatcaccagttctgaccgtttacaaagcggattcgcatgaagcggcgttcaaacgggctaatgaattacttcactatggtggcttaggccatactgctgggattcatacgaccgatgatgcattggtcaaagaatttggcttacaaatgccagcttgccggatcttagttaacacgccatcttcagttggtgggttaggtaacatctacaataacatggcgccttcattaactctgggcacgggatcatatggtggcaactcgatttctcataacgttacagatatggatctgattaatatcaaaactgtggcaaaacggcgtaataacatgcaatgggtcaaaatgcctcccaaagtctacttcgaacgcaattccgttcgctacttggaacacatggccgggattaagaaggttttcctagtttgtgatcctgggatggttgaatttggctatgctgatcgagtaacggcggtcttgaacaagcggactgatccggttgatatcgacatcttctcagaagttgaaccgaacccgtcgactgacacagtctacaaaggggttgcccggatgaaggcctttaagccagatacaatcattgcactcggtggtggttctgcaatggacgccgctaaggggatgtggctcttctatgaacacccagaagcttccttcttaggtgctaaacagaagttcctggatatccggaagcggacgtacaaagtaccagtatctgaaaaagtaacttatattgggattccaacgacttctgggactggttctgaagtaacgccatacgcggttattacggactccaagacgcacgtcaaatacccgattacggactacgcaatgcaaccagatattgcgatcgttgacccacaatttgttgaaacggtgccaaagcggacgacggcttggactggtctcgacgtaattacccacgcaaccgaagcatatgtttcaacgatggcttctgacttcacacgcggctggtcaattcaagctttgcaattagccttcaagtacttgaaagcttcttatgatggtgacaagatggctcgtgagaagatgcacaatgcctcaacgctagctgggatggcctttgccaatgccttcttgggtatcaaccactcgatcgcccataaattaggcggggaattcaacttaccacacggattggcaattgcgatcacgtatccgcaagtcgttcgttacaatgctgaaatcccaacgaagttagcaatgtggccgaagtacaaccataatactgccttagccgactatgccaacattgcccgggccttagggttaccaggcaagaccgacgaagaactcaaagaaagcttagttaaagcttacattgacttggctcactcaatggatgtgaccttatccttgaaagccaaccgggtcgaaaagaagcactttgacgccaccgtcgacgaattagccgaactggcctatgaagaccaatgcacgaccgctaacccacgcgaacctttaatcagtgaattaaaggcgattattgaacgtgaatgggacggccaaggtactgaaaaatagccctttgtgaattaagggagcccgcgctcatgatgagcgcgggctttttttgttcttttatgactacttgattgggcgattaagcgtaagtttacacaaaactaaaaatgtatatttatgttaaatattgtgtatttttttggtaaatcctgttgatggtatcctaaccgtttgttacggtaatggaattaaggaggacgctatattgtcattagatattgcaacattattagcttctatgaaccaggtgtctgaggccggtgatcggacaggcgctctcatgaccttggcgcttcctactgggagtggcaagacatttgcggtacggcaacatattagcaggcgaattgtttatactgatgagcgcttttgctttgtggctaatcagaataaaagcttacatgcggatcgtttttatgaatcgattaaacgtgaatggataacgcgtgaactgaaagttagtcagtcagattttatgatgttctatacgcgtaaggttgcagtattacggtcattaccgaccatggtcaatataataacgacacaaaaattacctaaaacgttagaacactaccgggacatccaagaggctttggagacattagcgcagcggtatgatgaatttaagcatatgggtgaagatgttaagtcacagtatttgccgaataaccatggattgaagcaagcgtatattaattatcaacgcacgattcgacaacagcttatcaaggaagtcggtattgcagaacctatcagtgaaagtgacaaagagactattaaacggcatgtccgtgacaaagagacgcccttgacagcctacattaatcgttatcttccaaccattgatttagctaaccgccaattgataattgtggttgctgataagtttattcgttcatatatatccttttggggcggctactcaattacagttagtagctctaccgtattgaatcaagcaactgttatttttgacgaaattgacgggttaaaaccgattttgctcaataaaataattgatgatgccctgaagattccaattgattttcagccgtttttttgccaggtttacgccggggttaatgatcaacagaagcgccgtccagcggatatcatgactgttttacgtaaggatcatcggttacgtaatctaaagagtagaaccaatgaattagcaacagcttacaaattgttaaaagactataaaacaaaggggagtccagcagcaactaattttatctttaatttaagtcaccttcagataacgagtagtagtgcgtggtggagtcgtgatgatccagacgggaaatatgtcgcattacaatcgactgagccggccaaaggcaatttaaatttctatggaatggtccgtgatgttaataaattcattaagtattttgtgatacaaattgcgcagtgggcaacaagctatcaagcacggatcaatgaacggcgtagtgaagtcgaagactattatcaatttgctgattctgtccggactatttgtgatactttgaggctttctaacgagacacaaaaaattgttttactggaaatcgaagctctgaaaaacatccggggaaatgttggcgacaacttgcagaacggccattatgggcgattattacaagaccatggcatgcaactcttttcgttgactgatagtgatgcgcatcttaatcgaacggagatcggagcggccttcatatacacgacgccagaacaatttttgctgaaattagctcgcagtaatcgtgttctgggactatctgcaactgccgacctagaaacagtcattagcaattttgatttcaaatatattcagcaacaactgggtgccgcgtttataaaaggaacggagttagttcctgcagccaccaaggaagatatggatgttagttcccggtgccgggagcaaggtgttcaagtcaacgtgataaatgttattcctgatcctgatcaattagatgatatccgggttatgcaaaaattgattttgaaatatcacccaaattttgaaatcaatgatgataatcacgctcaattagcattactcgaacaacttgtacagcagttaatgcagcagctgaagcaaaaagttagcgacaatgcgctttattgccaaaagcggtatctatcattatttggaagctttatctgttttctaagtcatcgaaatcgacgggtcgtatcagggctacaaagtgttctaccaaagttagatacagaagtagatacaattaaaatgtcagttcaggtaatcgagcaagtatttgaactacttgcaggccttctctgtccggacgaaaagcatttaccgcaacttcatatgattgccaaaaagctgcaaagtgaaccgattgaacaacaagtggccgcagctttaaaagtacgttctgaagaacaaacgcgtgtgtatttgctaagcgcatacaaaaccctgggggtaggggttaatctggtccgagcgaatactgaaccagatcaggcgcagattattaatattgcccctgaggacgctgatattcaggatccacgatataagcaaattgatattgatgggatctatcttggagcgataacgcacttgctcaccctgattcctgagtgcgccactaaagcgaatacgaagcagtggattcgtggttattatgagtatatggaactagctgatgcggatgaaatctcattaaatgatatcaaaacatatgcgcgtgaacggagtcgggggcgaccaatcaaacagtttcgaaacacggtaagttatgtcggcgcacaaacacagtgtatcctacaagcgatcggccgacttgatcgcacgtttaataaagttgctgaagtgactgttattataggggatggcgttttagattattataacgtgacatcgatggcgccttaccaattaggaccaattgcgcaagcgctgcaagactatcagcggcaaagtcactggcgagtggtgacaagtgaagttgtaaaaaaagaacgttggcgtaatcatactaaccagagtcaggaattctttaatcaagttaagcacgacttacaggtgaaagctgtggttgcacggcgataccagaaggcgcgtgaattttacttgcaacatccgacgctaatgaataatcagcggacagaccaacctgaatttgcttatcttgatatgcaagcgaatgcttatcatgtgcaacgaaatggtgagatgtttgatttccccgaaaacaataatggccgagaaagtatctctgcagctgcggcagggctgccaatcctattagcttatccggggatgttggcgcattttaaacagaatcaatgggcaattgaatgggaatcaaagaattatatcttgaatccggtacaatttgacaactattgcggcattttgggtgaggttagcgcgcagtttgtaattaaggatcagtggcaatatcgaactagtctactggggaatcagctgaatgaactgtttgactttcaactcgataaacgggtgctagttgatgttaaaaactggcgctatcctcataatagtgagaacgatgatgaacaagattgggtgttgaaaaaactggcacgagtatgcaagatgactggtagagatgattggaaagtgttgattgtcaatctgatagaacccgatagtgacctcacctttactagtcatttattaaaaggacaacgagtgatggagcttcctgctttactcaatcgccaaggccaatttgtgttaaccgaaactgaaaagcagaaggtggcgacatttattcatgaatactgaagagaaactagccaaaaccaactacattgattttgagtttaatgatccgggtattaatcaacaatttagatttgcgataattacaacacaaattccaaaaaagttaggtagttggtttaagaaagcacaagcactcgcaattaagaagcttacagtaatgatcaatggcaacgtcagacaaacgcggtatctgatgatgattagtcgcacggctaaaatcatggctacggaccctgatattcagcaaaagtttgttaattttgaacagttagggcagtatggtatcaccgatgacgatttattacttatgttaatgaaatgtcattttcaaggtaagctggacgaaaaccgagactggtgtaactttaacgcaacggatagactcttcttaatcatgcctaatcacacaaaagaaaagccacagcaacgggtggccttagaggttatgattgatcaacatgtcctaaaattaataagtcgaatatttacggagattgaggatgatacggtcaatgttggctatgcagtgagcgaaggttgtatgaaatggcaataccggaaccgacagcaaatttttagacttaaaagtgtcgataaccaaaaaaatctcattaactttttctcaattcaggaaagtgattatgaacaagacaaggtcagtacgttgcataaattgttaagtctgacgcaattgcagtattggatgtgtttcaaatcggggccgattgcacacagttgcctaactgaaatggctgtcgataaaaagaacgttacgcctctgaagcgggcacgaattattgaccaacttatccataaaacagtgacgctaatgattgatcctgaatcagcagcacaacgggagttcgcagaatcatttggcagactatggcagcgcacgccagaattagcaacctgtcagattaaaattataactgacagtgcgatgactaccgggctcaatatccaaattctagatgatagtcaggattcgcggtaccaaaagaatacgccacatcaggtgatccaacatttaatctataaaaactttgttaacgagaaggtggcaggtaacgccttatatttaggaaacaaagtacatttgttagaagacgcaaaaatacggacgttactcagtcagctattgattaaacaggatattttgagtggaaaaatcacgtttccaaatcgtgatgagatggctgctgccgccaaattccgatattatatgatggctgacaaggcatattatcgtttggaaatcgacgatgccggaaatttaacatctcagaaggctactaagggacagcggggactgtcggcagagtttgaaagagtgattcacgaattcgatgaggaaaatggacgggaaacgcttaaattcaccaaaatattagcatatgaggataaattatataagcttggagaaacagcactacgaattattccgaatgcagaacaaattaatgcaatgatgagaaaagctaggtcacatcactcaattcaccgctgggcactattaaaagtagctaatgaattagatgattgtaatcgagagttgaagcaagcattaatcacgaagattgaacggatcaataccgagacaataactattgggagctttcaaaagatactaaaaacggcaccgacacttagttggcgtccaaagttaatggctacctttaatcaacgctttttcgataatgcgcatgtgtggttacacttgcctgtcaagcaacagatttatgatgattggtggaatggtatttacggaattgggttgttgatgttaggatcggactactattactatgtcggccggaatcaaatcatcaagcaagatttaactcgcgccactagtttgaaacaagttgttgcccttgatagtatgcaaccaaaggcagatattcaaagaattatgccgttactatcaacattgatggatagtggatatgttcgtgacggccagtatacggttgtcccttttccctttaaatatataagagaaattatggagttagaaacgcacgggactcaggtgacgaaacgttgagattgtgacactttttagcctggtaagcgctgccagtctgatgaatgtgacgatacgagcttattaaatgttggataatgtgggacagggcaacttaattgaaaatagggtatatttgatttgtgaatctagtttggaacgaagtagaattaagtcgttgttgaatggttgtttcaaagacggattaggcttttagcagtcagatatgaccgtattataaagcaacttttttgaaagataggtagggcctggatggctgaaggccggttaaaagagaccgcccattttcttggtatgcaaaggagaaaaataatgacgacagaattaacggatttacagaagtctattcaacaagcgaccgcagcattgaatggtgatcattcacaagttatcgtccacgaggctgaagttgatgaaagggttaacgattatcaggataatgctcagaaaacgacacacggcaaataaatttgttttggagcgtattaaggtatttatatgggtacgccttaaatattgaacagttcatgtatctgctgtgattttcggtcgattccgaacgcgctagtttttgcaagctgggcttaactttggtatatgggatacgctatacggtttgtaatagatgtgtctatgctggtaacaaggggaaattacgttaaaaatattatgcgtccaagaagcaactggtatggctgcttcttggacgcagttttaatctggacgcttttgatgctggacgtgagtggcttagaatctttgaatcgttatggatatggtagattgtaaaat

SEQ ID NO: 69 - DNA, 10725 bp, Lactobacillus plantarum
cttgatttgacaattcgggtatcaaaaggcttatgcaaaatgcataattttctgactgcgttggcgcgacgactgaattcgactgggtaagactttactcagtcgaattttgatttagaggtcaggaaagtggttgaaaataatcctgaaaactgttgatgtgttttcaggattatttgaggagacgattgtatttatggtacaatgctagtcgttgacgtttgataatataaatatatctaattaaatataagaaaggaatattttgtcgaaatggatttaaagcaaagcgatggttggcgatacttagctgggtggagcttcattctattaatggtggcgagtgccacattgcaacatgatgcggaaatcattttacccgaaatcggtgctctgacagccgggacgtgggtttatcgtaagacggcgtggactcggcaacccttaaagttattcttagtaccatctggaactgcaattattggcttcttagtcaatcaactaccttggtcgtacgccctcaaagtgcttgtcggtctattactgatgctattattattgaaggggttaaaatcgaatttggcgccagcctttgctactggcttactgccaattatcattaatgcaacgcactggacctttatcgtagccatctttttctggactatttgcctgatgattggggcttggattcaacgaccgcgatcaatctcacgggtaaccgaagcttctgctagtcgctggcaaatgctcggctttatcagcctagtttttgtctgggtgggtattgtttggctagcgggacagtcccagatggccgcaatcccacccgtgatcgtcgttttctttgaagcggctcaacagtctgaatatacggtaacgaccgcacttaagcagtggcttgcattgtcggctgctgctagtattggggtcggcattcacctattgattgcttcgtggctattaacgacggtcattgccttaccacttgtgtatttgtggttacgggcgcttaacttacaattgccagcagcgtatgcctttccactattagccttagtgttaccagccaatatgtttaacaaactaccgacatccgccggtttagcggccgctttcttcctaggatcgttactcatctaccatcagatcttgggttgggtacgcatggcggtgactgaaagctagttgtcagtcattcctgaaaaatggtcaaaaaaataccaactatttcgaaataatcgagatagttggtattttggcatttaattaagctttattgattcggttatccgcatacatgtatttccgggtcattggtaaggttcgtgatgaagcacctttagttacgaggtactgcatgacgtcaatgttaccagactggaaggaagcggcacaggcttgtaggtagagatcccacatgcgagtgaagcgcacgcccatcttttcttcgatggcagcgcgcttagcgttaaagtttttatcccagatttcagtcgtccgttggtaatggcgacggagggtttcaacgtcagcgacttgtaagccggcgtcaacaatgtgttgtaagttttcggtcatcccaggaacgtagccacctgggaaaatgtacttatctaaccaaccgttagtggcgccaccttgttgccgggtgatgccgtgcaataaggcaacgccgtcagctttaagatagtggttaacgcgttcaaagtacattgctaagttgtccttaccgacgtgttcgaacatcccaacactggtaatgtagtcgaaagtttcgtcgccaagttcacggtaatcttgtaaccggacttcagcaacatcactgaggccttcatccttgatgcgttgagcaactaggttatattgttcttgtgataacgtgaccccgacgacttttaagccgtattctttagcggcagtcaacatcaacgtaccccaaccgcaaccaatgtctagtaaggtcttgccaggttgtgggttgagcttttgaatgatgtgatgaaccttatgaatctgggcttcttctaatgtatcagtgtcatgtttgaagtaagcacaagaataggtcatggttggatcaagccacatcttgtagaagtcgttacccacatcgtaatggctttggatgtcttgttgactcttcttttcagagtgagattgtttaggcatgaacttcttgaacttagaattgttgaagaaactttctgccgattcgtaggccgattcaattaatttttgaatactgccatcaatttcaattttgccatccatataagcttcaccaagggcaattgaagcgttcttggtgatttcacgcattggaatggcttctttaaaagtcaccgtgacttctggtgtgccttcaccataagtttcactacttccatcccagtagttgactgtgacgggcatattgaatgagtggcttagaagggtgtggtaaaaggttttttctagcattgcaataaggatcctttcttcgtaaaatacactaattattatacgcttatgaaaacagttttgtaagcacaacgaatcgcgacctgattcgtaaacatgttataataaattaattacaaaatcagttgatgggggtgtcgtgatgaaaagatggatgtggatcgtgtttgcagtaattatcgctgtgggggttggtagttattcatatacgcggtaccgtctgcaggaagactcatacacggctgaaatgcgaactggtgagcgggcactgcaagcgcggaattatacgttagcggagacgagttttacacatgcgaccagaacgaaagctagtagtactgaggcgcaacggtatttaacccagacccagacttatgtggctggtcaagaagcattggctgcgcggaaatttgacatggctaaacgtgactttatgacggttaagacgaccaagcacggtgcagttacgttaattaatcaggcccaagaacaacttgccttaataaaaaaagtgcaacaaaaacgcaagacttatcaacaacagtatcagaaagctgctgagctgaataaagcgaatgagtttacggattctaacgttgtaattgctaagttattgcaggataaggcgtttaagcaacgttactatcaggatattcggaaaaatgtgttggatttacagaaacaaaataatgcgtcactcaagacattgaccggttcagcgccggtgatcccgagtgcggcacaagcggttacggggatgaccggaagtcagcaacaaacgcaacgcacgccaaccactaaacagcaggcggctgcttcatcatcaacttcctcagctaaccattcgatgggctcgtcagctgcagctaacaacagttatggtgacagtcaagtgcagacgactcgtgctgagttgaccgcgcaagggctcgacggcagtagttatagtgatgcccaaattcgtgctattctgcaacgagcagcggcgcaacacctctcactggcgcaagctgcccaaacgatgaattatagctctgatcagattcaggcaacgcgtgcggagctagcgcaagctggatttaatgctagccagtatacggatgcccaaatcgaggccattttacaacaagccagtttacaacatatgtctctggcgcaagcagcgaggtcgttgcagtaatataaacaatttaataacagtatggaagtccacttaacaatcatcgataaaacacctacttttaggtgtcaatcggtgatttttttataaaaactgttatagaatgtaggagtaaggacggaaagttttcgttcttgatattttggttctacgggggcggtcattttatatcggtattgacctttttttaacgttcatatgtcaaaatgggtataaaattgactattttgtgtactatttttgtttgatgctatagaatattaacagattagggggttaaggtgcccgttgatgattgaattaatggcagaccaaattaacatgatttggtaaagtagttcgattgtcaatggtgggcatcgaaattcagtatgattattaataaacatgtaatgcgcagtacgaatgaaaagcaagttctgcagcaggttattaacgaaggaccgattagccggagccagatttcacggaacttgagtttgaataaagtgacggtttcagatatttataatcagctactgcggacccagttcatcaaggaaattggctgtggtgtcagcacgaaaaacggcggtcgtaaaccagtgatggctgagctgaacgtgaactatggttttgtggccagcattgacatgacagctgacgcagtcaaacttatgtattcacggttgaatggtaaaattttgcactttcaaagctttaagacgagcgatatgacgttgacggatgtcattgatttgattgaagatcaattacggaacgttgatgactatggtacgattcatggtctgatgggggtcgccattgcgctggatgggattatttatgagaataaaatcctcaagacaccgatcaagggactaacacactttgatctagcaaagtatttacgtgataagctacggattccggttgttctggaaaagaaagctaacttaacggccgtttttgaacgtgatttccatgacaacgagattttcgataacgtggtttcggtagtcgttcgcgatcagattcatgcgggcatcgtggctgattcgcgactatattctggtcatgaaggcgaagcaggtgaagtggggactgctttgttagaagatcggcacgttgaggaccacttggcatcagttaacgattatgcttctgaaaaagccttgtgggctcggttgaaggccatcaagcatgttgaacgattagatttaacgacggtcaagcatgactacatcaatcatgatccggaagtgacaaaggtcttcgatgactttgtttactatctatctaaagtgattgcgaatgtttccacggcgttcgcgccggatgtggttgtgttgaacacgaccgttctagaaatcttgccacaactattgactaatgttcgggagagcacggccaagctaacttcgccaagccggcaagttccaatcattgcaaccaagaacgtacaatcggcggccttgttgggtggcgcctcagttattattcaccaagcactaggattagagagcttaaagatgcagttctcataagttattaagtgtttatttaaacgaacgtgtgaagtttatcgtgcgattagtgataaacttgacacgttttttgttgattcacaacggccttttaatttttattgctgagactttccgttagaataggagtaagggatagtagaggggtggattttgtggaattttggtcacagttaatacgaaatgtgcgctggcggcgcgcctgcgtattggcgttgattgtgttaacgctatacttggcatcaagtatgatgagtattattttattaacgtttatttttacgttcttagtgacgcggttagttcgggcagttcggcggtgggtgaagattccaccgacgatcattgtcctagtggtctacgcactagtcattcttggaatttactttgctgtatcgatttatttaccgcagttgatcaaacaaacttttttgacgtttgaatcagtctatcggttttatcagaacccatcacatgatactaaccaagtgttgacgtgggtgacatcgtattttcaagaatcggatatactcaaacaattgaagggcggcatttcagttgtgttccagtatattactaatattggtaatatgggactaaccttcttcttatcatttattttaagtttcttctttacgattgaggatcatcagatgcgggtcttcacgaagcgctttttgactagtacgtttggctggttctttcaagacgtccatttctttgccaaaaagtttgtgaatagctttggcgttgttttggaagcacagtttttgattgcgattgtcaatacggtgattacggtgaccttcatggcaatcttgaagatgcctcaactgattagcttgggattaatgatctttattttaagtctgattccagtcgctggggtgatcatttcagtcgtaccgctgagcttgattgcctattcggttggtgggttgcgctacgtggtctatatgctcttaatgattttggttgtgcacgccctagaagcctatgtcttgaatcccaagtttatgtcgagtcgcacggagctgcccattttttatacgtttgtcgtattgctagtgagtgagcgtctgtttggtgtctggggattgatcgtcggtgtaccgatttttaactttattttggacatcatcggcgtgaaaccggttcaccggccgcgacctaacattaatctgaaaaaaacgattactttccacccggattctgaaaataagcgctgatattgttttgatttttcgctttttcagtgtaaaatagggtgagtaaataacttaagaaagaggtcattaactgctatggcaaaattagtattgattcgtcacggtcaaagtgaatggaacttatctaaccaatttactggttgggttgacgttgatttaagcgaaaagggtgttgaagaagctaaggctgctggtcaaaaagttaaagaagcaggcttagaattcgattacgcctttacttcagttttgactcgtgccatcaagactttgcactatgtgcttgaagaatccgaccaactctggattccagaaaccaagacttggcgtttaaacgaacgtcattatggtgcattacaaggattgaacaagaaggaaaccgctgaaaaatacggtgacgaccaagttcatatctggcgtcgttcttatgatgttttacctccattattgagtgccgatgatgaaggttcagccgttaacgatcgtcgttacgctgacttagaccctaacatcgtccctggtggcgaaaacttgaaggttaccttggaacgcgttatgcctttctgggaagaccaaatcgcacctaagttattagacggtaagaatgtaatcattgctgcccacggtaactcattacgtgccttaagcaagtacatcgaacaaatcagtgatgatgatatcatggaccttgaaatggctactggtgaaccagttgtctatgactttgatgaaaagttaaaggttcttggcaaggaaaagttaggcaaataatttaatagttatttactagtttttttggagcactccgctgtctcaggggagtgcttttttgggcgctgaggtccgataacgtctgatgatgttggcatttggtgacaaatggacgctaaacggacgctgtttatgatcatgaaaactaagctttaggttttatgactgctttcaaagaaggacttttacgatgtatgatgaagctgaattattggaagctaaacgccaaattgattccaccgtgcataagattcagggagttatcaagacctttgaagctaaggaacggccggagcgctataagtcccagctaactttggcaaagcgacgcttgaaggcgttcggaattgccacgcagttaattgaggatgaattgggccgactaaagcagtagaccaatcagaatattttgatgaattaaattataatcaaacttggtgaaagattgcttgaaggctttgggattcttcgctaatgactgatgataagttaaattaatgaattaggggtagtggacgctaaatggacactatctagaaaatagaaattaaaaagcagaaaataatttactgccttgagtaatttaaaagggatcccccaattcccccttagctcccataagagaggccaattgacattttgttaattgtatcaatggctggaactttatatcagacatgaatagtattcagataaataatgcataaggatcaggtgtaaaaaatgagtgaagcaactaatgaagtaacgcaacgcgagatggtgcggattattaaccagtttcgcaaacaaggttttaagggcacttacgttagttttcagcacgtagtagacgaaggagcatcatattttgtagtgatgagtgatgaaaataatagtaatcaaggtctgtttaaaattgatttattaagtggtgatattgtctttcaatatatgttggatgagaatcacgctgttagtaatgattagtattagtattaacgcccatcatcttagttaaatggctagatgatgggcgttattttttgagttaatcggctcttttaatacgttatattgaacaattttctgataattataattacatcataggagactaaacatcttatcgggttagagtgtttaattgggcaaaaaattcgagttgaatttgtgatctaccatcaaaacttatttcattttaagaatgtgattgttgtttcaaatgcgaaatttcctttagacccgcattcatcaacacaaataccacgatccaagctagcccaatcaataaaattaacttgagataattactgcccaatatggtaatgttccagtcccacgcagcgtgcatcaatactgctaagacgaaaaatacaagaaagcgtgtatctaacaactgactaaacttaaacggatggtcacgtttcacaatcataattgctccgccagtgatggctgcccataccaaatgaccaccaacggccgaccagccacgcaagattgccactgcaactagttgagcatttgccctataaatgtatccagccgtttcaaatgcagcaaagccagaaccaactgccgcgccaatcagaatgccatctaacacatggtgcacatctaattggctgataaaataagatataattaagactttcccaagctcttcaactattccaattgataaagaatccttgagtgtcaaaaccccaaaaatctgactagtcgagctaaaagtgacaaattggtataaaaacaatgtaacgaccattgaaaaaattccgccaataaagaacaccttaaccacttcaaaaagactaatatctttaaaagcattagattcaaagaaaaatactaggcctgaaaacgggactgcaaaggctcccaccaggatcaatccgggaatcgcattgctgttactgaaaccatctaccatatatagcaacaccacaaatgcgagtaaaaatcctaacagaattcgcgaaaataaccatggctttgcccattcatctgaaacatccgacaaagcaggtgtagtcgtcttagtccctgcaataaaaatagaattggcctcatctttagtgtggtgtttgaagacttctgagaataaagctacaatgttaaccttaacggcgccctcttcacctgtataatgattcaacttagccgttgcattattgtaaatttctttaaattgattgttactatctgatactgattgtgcatggctagtttcaaccagagcattaccgcaacttggacaaaaattagctttctcccgcaccgaattgccacaatgtggacaatatttcataacgttttcctcactactccaatgtagattgataaaatagcaagcctaactaattcatggtgccaatttaatcagtttaatcaccatttttagaaaggtccacagctaaaaaacgcaacacgatatttgtggatgatttctgcatcattttgaacaccgtagttcgtatacttaccaattttattatacactgttgtagtgccactagataggcatttgaataacttggttcggattgaatctacaatctatcaagtaattaattggttatttactgatttttcagagtactccgctatcttataggggtgctctttggacgttaggattaaacgtataatttatcctgtcttgagtaaaataaaaggtatcctccaatacctcatcagaagttgttagttggtattatgttaattgtattaatgaataaagttttaatagtgaacatgaacagtattcagataaaaggtgtataaggattgggttgaaatattagtgaattaattaatgaagtaacgcaacgtgaatggtgtggattacgggttagtttagaaggcaaggttctaaaggcacttacgttagttttcagcacatattgcatgaaagaacgtcatatttatcgtgatgagaatgatagtaatcaaggcctgtccaaaattgatttatgaagaccatcctagttggtcgcagtagctgatgatgggttctttttattggcctatgcttttatgcaagaagagtcaatagtgatttttttagttaagtgactagatttgtggaaccaacgtgagtagacctggagatatcgtgataaaattaattatcaagagattcactccaatctatggggctcacttcaccattttaagggaagctgatccttttttgtccgagcagctttcggatcaattttacaatctaccatttgtctaactctaagtgccaaaaaatggcggttaaaagagtattatggaactgtaatagcgagcaatcgagacaatggttgcttgtttttaacaaaattagaccattaaaaaaatgagggtgtgcttaaatcaaacttgtaatttcttaaatataaagtggcaactggaatacgcatagatagtatctagaatagcccccttatgaagatttcttaatttgataacacggagaatgaatctaatagaatatttggaagaaaaatatgaagcaagtttttaaattcaggagaaaattgcgtttgtattatgaggagaattatatatttatggtagattgtaa

SEQ ID NO: 70 - DNA, 5159 bp, Lactobacillus plantarum
gcaattggcagaaatgcctggaggtcggtgtaggacgaactaactaaacaagtttacgctgagtcgaactttttcccagcggtccatagctggctgtttttgaatttaagaaccggcacgttttaatcacaaattatgcaagccgtccaagcggcttgtgtttaacgcaaaaaacagcgatgtcaaaatcaacttttgacatcgctgttttagaagttattcatcataactgatggcacccagccggcagctatttccccggttgataatcttcatcaatgatcaagacaggtttgatggtcttgccgctacctgaatcagcattagcttgattaatatcctcaaacttatagaacttttcggtcttttcaaatgggaacatgccatgttgatagaaatcgattaaccgtggaatatcaacgccagggatggcatcacccatgttaacaccaatgactttcttatcatcaacacacaaatcgttccatgagctaatggtgatatttttggccgtaacggcaatcaaagcagcagtcccaccttgagcaagtgcgtggattgcagaaaccataactggttctaccccagtcgtatcaacggcaaagtcgaccccgtaaccatgcatcaacttcttgattgcttcaactggatcttcttccttactgttaatggcatgagtagcacctaattctttggcgagttctagccgtgaatcaacaatgtcgaccgcaatcacttcggtacagccggaaatcttaccagccatcattgccgctaaaccaaccgcaccagtcccaaagactgcaattgtttgtcctgggcgcggctgtaaactgttcaaaacagtgccacttccggtgacgtagccgcagcctaaaggtcccaagcgacgtaaatctagttcttttggtactttaaccgcattacgttggtcaactaccgtatgagtcgtgaaggaagattggtcgaacatatcactgatatggtgcccgttttcttggaaatggtcggaaccatcgggacgagtcccactcaagttatagtcggcataattccgacatttagttggcatgcctttcagacagttatcacatgttccgtcagcgtaaaatgatagaataacatggtcgcccacttcaaaattagttacttctgaaccgaccttttcgacgattccagaaccttcgtgtcctaaaattactggataacctaacgacgcatcaccccgccgaattgcttcatcagaatggcaaattccagtcgcaaccattttgatttgtaaatcagttgctttcatttcagctaattcaatatcatctttaatgacaaatggatcgtttactttatcaaccactgctgctttaattttcatgttcaaaccctcgtttcaaatagtatgtaaaccgcttacaattaatattgttacacaatacacaatttgattcaagcgcttacaaaagcatctaacaccacacttatctccgttaaatgggcattcttctaattttacactaacgatatgatacttaattagtgtaaatctaatactctttttttactgattgtgaggaatttatagccagttttcttccttaaattgtcgactcaaaaagcgggtgtctaacgccagctcaacaacgtgaactggcgttagacacccgcatattttgtaccattaacacacatttctgcttgtttaacaagcccgatttcatccgacgctatctgctcatcgtctacgcaggttgggcgttcgaactgatcttagctttatttagcaataccgaactcgtgactacggacaatgaactaaaggccattgctaatccggccaattcggggctaagcgtcagcccaatggcaaagaagaggcccgccgcgactggaatcccgagcacgttgtacacgaaagcccagaacagattaagtttgatacggttaaacgtcttcttactcaatgccaacgcccggtcaacatcacgcagatcgttcttaacgagcacgatgccaccagcatcgattgcaatatcagttccggaacccatggcaatcccaacatccgccgtcgtcaacgcgggggcgtcattaataccatcgccgacaaaggccaccttgccagccttctggaacgcgtgaacgtgctcagccttatcacctggcagcacatcagcaatcacttcatcaataccgacttgatccgccacagcttgtgcgacccgttcgttatcgccggttaacatgaccgtcttcaagccacgtgctttcaaactcgcaatggctacctcagacgtcgatttggcgacgtcttgaatggcaatcaatccaatgatttcgtgatttaagcccacgtacacgaccgttttcgccgcgtcctgaagctcagtggcttggcgttgtaattcagcactaatcggctcatcagttaataatttatgattaccgaccaccgctaattggccctcaacttgagcagtcacacctttaccctcgatggcttggaagttcgtggcggttggtgcttgaataccacgggccgtgccgcgttttaatattgccgcagctaaaggatgttccgaagccgcctctaagctagtggcaacgcgcagtacttgggcttcgtcgccgataacatcggtcacttgtgggtgaccaaccgtaatcgttcccgtcttatcaaagatcaccgttttaacgtcattgacagcttccaagacctcaccatttttaatcaggatccccatcttggcaccacggccggtaccgaccattagtgcggtcggcgtagctaaacctagcgcacacgggcaggcaatcacgaccacagcgaccgcaaaaatcaaggcattcgcgagactagcattcaagaaaacataccaggtcaagaaggtaacgatagcaataattagcacaatcggcacaaagatatcagaaactttatcggtcagcttttgaatcggtgcgtgactgttttgtgcttttttaacgagctcaacgatttgagccagcattgtctggtcaccgaccttgctagctttgaactgaaaggtcccattaccattaatcgttgaaccaatgacggcgtccgccaccgttttttgaaccggcatactttctcccgtcaccattgactcatcaaccgttgagcggccagttgtaattacaccatcaacgggaattttttcgcctggcttgacccgaataatgtcgccgaccactacttgatccaacggcacttttacaaattcttgattgcgtaacacttccgcttccttggcttgtaagcccactagctttgcgaccgcgctggacgcgttgtgccgcattcgttcttcaaagacttggccgagcaaaacgaaagtggtcacaagtgcggcactttcaaagaagactgcttgccccgttgccattgcgtataagctgtaaaaataagccgtcgcggtgccaatcgccaccaaagtatccatattggcatggtgcttagtaaaggacgcccacgaactttgcaagaacggccgagccgaaacagccataatgatggtcgtcagaatcaactgcgtccaatcaccacccgggagcatccagccaaagggcatcaaaatcatattagccagtagtggcagggaaaatattaatgaaatccaaaaccgtttcgtcgtgctcatcacgcaatcaccaccttgccactcaccatgtccatcccacaactaaagtgaaattcaccggctcgatcagttggtaccgtcaccgtttgcggttggtcaaggggtaactcagtcgtaaagtgcaagtcggttgaatgtacttgctctaagcacccctgcgtactcgtgcgcgtaaacgttaattgggccggtacaccttgttgtaacgttacttctgctgggtcataatggccgtctactgtaatcttgatttgttgtcgtgcgctcatttgattttcctcccactatttaatgattaatttcccatgaaacatgtccatcccacaggcccattgatattcgccagacttactcgtatcaatcgtaattgcttcaacttgattttgtggcaattcctgattgataccgaaatcactgaacaccacgtgatccagacaaccagatgcatctttgcgcgtaaaattaagtaccgccggaaccccttttttcaacacgatttgctctggcgaatagccacccttaacctccacatcaacctgctgtaaatcatcaaccgcactcgcggtgaccgttgtcgtagcatgcttcccgaagaaccaccacagaataaacccaattgctaacccaccaattaataagactaatactttaatcatcattttattcgtccctttctcattatcgtttacacttgtaatctatatgtgtatattaatcccttcgtttacaattgtcaacgataaatgttatttttaggcataacccttaattttttaaacgccccacccagttgctactatcatatgtctgacatttagtgtcactacaaaaagtgccgcgtacgttcctttgctcagttattagtcaccatttcgaccggtcaactgaccgcatcaaaagtaccaacgacgatatcataaaaggcaatcactaccgtttaataagaaacgtcagtgattgcctatattaatcattcaaaactagctgtccctcaaaggaacgttaaccccgtcaatcccggttcctaaagatccgcaactcacaacgggtatcatatcacaactgttaatcgcgggacttaatcttcagccaacctaaaattgaactcaatgctaatccaatcatccccaagagtgataattgcgtattctgctcgtccgtctggggaagggtcgtcatccgatgatgcttagtggtacgttttgataccgccggtgcactaacccaaccaatacctgaaacggacgcagctgttttctgctgattcgtctgcacaacgctttgatctgactctgcttgtgatggctgtgacgtccgtgattgttcagcctgattacgactcaaattggcttgatcacttaatccatctggttgctcagaatcagctggctgactcggtttttgcagttcccctggtttttcggattgacccggttcttccggttgacttggttgctcagggtgccccggctcttctggttgacttggttgctcagg

SEQ ID NO: 71 - DNA, 10735 bp, Lactobacillus plantarum
tgccccggctcttctggttgacttggttgctcaggttgacccggttcttccggtttgattgccgatttcttgtaagtaaccactacaacctgatcggcagttgtgacactcacctgctgagctgccacttctgttaatgtggtcgtggcacccgctacaattggtgaaataacgcccgccatttccgttaccgagactggtacccattcttggtatgtcacttcgcccgtcactaaatcaatcatcgcattgcgttgaaattggacggtttgtaggaccgaggctgcggctgtcgtgccatcctcataaacatagtgaatgattctagtaacggtgtgcgttaaatcggtgtcgccaccctcatctggaaacaagatattcggattgtcaggatcaactggctgtcctggtcgagcaggattgcctggtgttaccgtaataatacgatggtcataagtcacgattgtcgtcatcaggtccggatcagtaatcgcgaccgtttgagccgctacagtccttatgtccggatcagtatagccttggacgactagcgttggtgacgttaccgcggcaaattgaccactgccaactaaaatccacgcataatcagcttgactcgtatcaactaatccatcaccgtttaaatcatagcctaaacatttgccagtctttttttcaataattgctgttcgttggtaaataaccaattgctggacggtcgtggcaatcgattgatgggtctgtcaatcaatatagctgataacgcgccgtttattttgatacaccgtaacggcctgagttgctagtcggtaataaacattgatcgtaacatctttatcatcgaccccagcaaccatctgctccggcactacttttaggtccggcgctgcgtagccctcatggctcagatctggcgacttaaccgcgccaaaccacggccctgaaccaacaatcaaccatgcttcatctgccaattgtgtctcaatctgtccgtccccgttggtatcgtagccaagtatcgttccgtcatgagcaaccacagctaataattgatacttaaccgtttgaacaacagcatgtagtgacgcgatgggttgcagtgttccaccatcgatatagttaatcgtccgggtaaccgttcgctgcgtcgttgcaatatgcgtttgttgctgatacttgacaattacatttgtattcatcgttctatcaccaccattaatgatcactgtttgccccgcaactaccggaatatcaggagcttgataaccctgcgcagataagtctggtgagacaacctgtacccaatcttgatccgttggcggtactaacagccatgcaattgtcccatcactagtatcaacaattccgtcgccgtttgtatcatagccgagcaattcatgagttttagcataaaaaatggcaaatcgcacgacccgtacattttgtataactgggccagcaagcaccgccccagttcgctcatcttggtaattgattgtccgcgttatcgctgaatattccggtatccggctgataggtattatgggctcatgcgatggttggacgttcaaccaagtcgttgcagtctgatcgccaaattggtaagtaattagatagcgatgctggcccgcaatatgtgtatcaactgcattcaaccctgataaacgtgtcccagccgcatctgtaatcgtgatcttcagttgcccggttgctagtagatggcgaaaaccagctaaagtatcaatgctcgtaccatccgacttaatcactgcaattaagtaatccaacgggtcatcagtaaccacttgaccaaaaccataattatgctcgttttggctcgtaatcgtctctcgaatagcactgtcaacatcgccatatccatattgtaaaacggccgctgaatcaacattttgattagttgtaaagacagcatgtggtgccacgattttaccagttatcatcgtggtattctgaatacgcatggcatgattgaagttccagactagattcggtgtactactagaaaaaccgccaccaatggttaacgctggtgctgccgtgacgacgttataaataaccacatcatcattattaaaaccagtggtccgaataccactgtgccagtcattcaaatcaatattcacggcataataatggtgtccttgataagagcccaaatcagcagttccagactcaccaatcagcatcttactcaacgtgccaccattagttgccgataaaatggtccctgcagtaactagttgatcataaaagtcactaatattgatctgagcttgactaaattcttgcgcattgattaacgaagaatcaaccgtaacgctcggtaaacctttgattgcaccatttcctgttggccgaggcttcgtaaaatccatatcctgattagctacgggacggtccaccaatccattggtagttgtaaacgtgattgtattgtttgtcactgacaaaccaccgtttatgatggtctcccattcatcatcctggccagaacgaattgtcgcccccgtattgataacgtgcagaccaccactaatcgtagccacattaccatcaaacgaactattcacaatcgtaattcctgtaagtgcaataattcgatacgtggacaaccaatcttggatcaaagcaatcaaagccgcttgcccatgctgtttgacatactgatcaagatagttcttatcggctaagttctttgctgttgtcaaaaacgacgaagcggtgactgtccgttgcttgctcggctgctttgttgcaactggtatgtttattgacttagtgacatttgttttattcaatgcccttttctcaaccctgctgctcatttgatcagttgccgctacagctcggcttgaatttgagttcacaggggtagctgtcgtcacggtactcactgatgactgtgaatgaacagtccccgataaatctgaatcgatcgtcttaccttgaccgcctgagtgttgcgcctcagataaactttcagaatgggccccactgtcagcacctagtgcgctagctgaactggccatatcaatcgcatgatgagtgccagttgagttggctgctggcgcctgatcagaacttgttgcggctgacgcctgattagtactggcacccgcagaagctgctgttgagtcacttgcctgttgatcaacagctgttttatcttgctgtgttgaccgctgttgggcttcactagtcgttggactgaccgcctcaacagtgccagtcgtagcagattgctccgaactagtcctgtcagctgacttgctggactgggcggtcacactgtggcggtcacgagttaccgcagtttttgaaatccgtgctacttctgttaattggtcttgactatccgtttctaactgcaccgaatgactcgacatggtaaccgtctcagcttcacttgcttgagccactgtcggcacaattctccaacctaaaattaaaacactagaaaacaaccaaaccttgggattggttacgcgccatttgccccgtgtatatcgcatagtaatttgcctctgttaattttagtcaaatatcgacatattttgaattttgagacatagtatacctgcttttatgcgagtaaaacgggggtttgtatttacgcgaaaaaggttatctttaaaaatacaagtactaatcagttcgtgtattaagttgtcgaaattctaagggcgtttgaccggtctccttcttgaatcgttttgaaaaatcggcggcatcgtagaaacagagttcagcagcaatggctcgaatggttaaatccgttgccaacaacatatgctcagcttcctgaattttcttggcattgatgtaatcacgaatcgacatatgcatctcttgactaaacgaccgccgcactgactcaggattgcaccgcgcattgacgtgggccaatacctttttcaccgataattgatcatgcaggtgagcattggtatagtacatcacatcgagcgttgactctaaatgtgcgttataagctaatgcgttcggtttggcaattgcggcaaaatcacgaataatctgcacaactagtggctggtaacgttccgtcgtcacgggtaatttaactaaccaacggtgataatcattacgtagcttaacaaattcataaatctcagcatgattttggattccctcaaaagctaagacatcaaccagcgcactgagttgcagctgtttttcctcactcgataatttatttaataaatcgcgcgaacgggtcagatttttcttagcaaattgaatgccttcttcaatctttccggcccggtaaaatcgaataaaatctcgttctaagtaacctaataagatcagccccttggtggttgggtgctgatcattataatcacgcatttgatgtaaatattgtacaaattgtagttctgtccccataatctgtaactcctttacgttattggtcaaaatttgttaacccaaaaataatgctcattttaacagatgtctagcagtaatactatttacatttgccatctgacaatttacaatgctaactaatcccgctgtacactaatgattctaacaaatattttttatttaacaatcaatacacaaaagcggttatccctcgtaatctgggataaccgctttaaagcaatcatttttatgttaaccaattcacataaagtgaaaaaagtatggtcttaattatctaaaagcttatcgttaaattctccgaccagcgctcacattgccattcatgagttatagcaatgatctaaaaaattgttttaaatcttcgcgagttgccggtgataactgtgggtaagcgcaattctcaattgcgccttgtaacgaatacaataattgaatacaagcgtgggggttggccttttttatggcagtaaaagcgactttgctacccgttgactttagctgttcgggtgtcgtaatcgcaacggcttgcaattgtttggctaatgttggcccaatattaggtaatgttgttagtaatgccaccaaattcagatcctttcgattcataatcatagtttaatgtttgataatgagctctgcaataaagttgccctcttcaatacaataattaacaactaattgatctgtagttaattgttcaatactactcaatccataacccaaatgtcctggtttagttgtaaatcgacttttcttgataactgataaatctaccgcttcatgcgttgggatttgatttgtaatcgaaaataccgttgtgtgagcatcccgatttttaacagttagcgccacttgatgattcgctcgggcagcagcatccgtcgcattatccagcaaattacccaaaatccgcactacttttatctgtggaatatccgctaacgtgactttctctaagattgtcaccactaaatgaacgttctgaccgttggctgcctcatattttgcataaatcagaccactgaccgtcggcatatccaagcgactcaaatcactcagtcccgactgacgattaagggttaccctggcaggcattacttccgttgtaaaataacgctttaagccggccatatcattgttctgaataaatgccgacatgctcaaaagaatattctcataatcatgtttaaacaaatgtaaatcacggttatggtggcttaataattcgttgtaatttgagacttgtagcaatagctgcgcatcattcaagtgactgtttttattactaattaaatacgacccgataatgccaaacgtcacgatagccgcaattgccatatacgtttgcgcattgactgaccattccatcgcaaaaacatacgcaataatgtaaatagcaaaaaacaaaataactaataagtaatcgctaatattaacacgcgcccgttgcaagaaatcggcggccgacacttgtactaaccagcgatgcgctaacatccctaaaataataatgaccggcagcatcataatcgacgctaaaaagagattaatatccgctgtcgaatgtagacctatcgcttgccgtaataacattggcgatgcagattgggctacggccttggcaatgacacccatgattgcccctactaatcgcttaagcgcattcaaaaaggttgccaccggtaacattaaaatccactgggtgtacaacaaccgagaactcataaaggtggtcacacaaacaatcgggatgatccaaaaataagccagggggacttggggccataagtttgaagccacttcccccaggctcatcgtaatgataaccagacttagccaaatgatggcaatccgccaagtgacatattctctaaaaccaatcattaaaaacaacatttcataaccgccagaaatcaacgacagcgctaaaagtactgctgacacgccaaccacctcatcatattaatacatttgttagttcactttactatatcagaaatacggcttcattaaaccctttactctatattgtaaacataaatttgcattaaactataataaagcccttacaatcttattattaattattcataaaaaaagacattgcaaatcgacatacttttgcaatatcttttaaccacttatattaatttttaaggtgtatcctgtaaggtccaattaatcgtcccactgtaactgtcaatttgcacactaggttggacatccaataaaataccctgactgctcgaccaaccacttgcagcattagtgctcgtcgtacccgcgattttcttgccagaactgactgttaccgaagtattcgtcagcacctgtttgttccccgcgttcagataaatcaggttgccactcatggtccgcgtactggatttcatggcagttgctgtcgcccgcaagtaccactgtgaaccggtcttccgtgtgtcattaacagtgatgttccaagcatttgtcggctgatatagtgtttctttaaacggaatcgtcagggtgccaaacgtcaaacttgctggtaatgtgcccaaactcaacgttccatcccgcatcgtcacagtaattgccttagcatccgacttcagcccagaactgcctttcccataaatattgatcgtggtgctgctaccaacggctaaactactcaacttgctcgctaaactagtctcgtcggccgcgtaagtaattgtgtcagtcgcactatccggatttgtcgcaacgatgccagcttgcttaactaaccaggcgacgaccgcgctatcacttgtcagtgaatctaagtcaccaggatatagatcgactgccgtctttgaactagtaatatttagttttttgagggtcaccgctgcggtcgccgtccccttatcaccggtaatctcatcgacctcagtgacggtgacgttacttaaagtaccgagtgcagtcccaagattcagcgtgtacgttccatcgcttccgaccgtcgtcgtcacaccattaacattactactgatcgtattgccgggtgtcccggttcctttgatcgtcgtatcagtcgaataaagtgtccccgtaattttaggagataatgtctgcgcgttgaaacgccccagctgataggtaccttcctcaccattcactgtgattcggaagccaatatagattggcaactcacttttaatattttgaaaattgaccgataacgtctgcgtctgttttgaagaactaatcataatcgaattgccactgccaagactagtaggtgtagccgtaactaatgtcgccccggtgtagctcccacttgccggaccagccataatatcaaaataagcttttgacatcgagttactagattttaaggtaatcgaacctgtcatcgtcattgtaatttgggtcgtctgcctcgtaattcgaccattatccgcatagttagcggacacattgcctaatgctggatacgcttgcaaaccgttatcaacattactaccaaccgaattaccacccggtacggcctgaaaagcagcattagctttcacgtccgtcatcttgctcgtcaaagtcgcggcgttaccctctaagggcagcaaattcagcaagccgagtataccgaatacaagaattagtaaccattttactcgtctgttacgcattccgttcacccccatcttgccgttttaatattcggtacaacgcgcctgctaaaacactagctaacaactccatcccaccaaggatactgccaatgacaagccgctcactcgtttggggcaattgttgaccattgcgtgattgcccacgcaaccagccatcgataattagttgtcggcggattggcttgcgctctgactgatttctctgaccctgggtacccgggtcagctggtctaataacgtacgggtgaccaccatcaggaatcacacgggcgggaataatccggtcagcactatacttagtctcataaaaccccacactgatctcagtgcgaccgtgtgttgccgcccgcactggtattgcccagctcagcacgagcattacccctaatattaatcgccaccatttattcggcatggtccttcccccatttcactgaccgaactaagcacgccgccgctttttgatccagaaaaagattaatagaccgattaatccaataattaacatgcctaacgctccgaatagaataaaccagccaacgctcattcccgaattatcaacggaagcctgattatacttatctgccgcggccgtactgatgacaaaatctttatcaaacacccatcgatgatcggtatttttagcaactagccggacatgatacgaaccagcctgcaaacgattggtccctgtcaaaattggtactttataaactgagttaggtgctaattgcacattcttctgtgtaaagttcttgatgaccttgccactattcttactcgttaacctagccgtaatcgttagtttggggacgatcaccgcagtaacgttgcgtaattgtggaaacacccctcgccgataattctgcatgcccgccgtaatcgtatcgagcttcaattgtggttgtggcactataccagcagtatatttcagtccaatcacatacgaatactgattggcaatattcatggaacccttaacacttccggtgactttattggcgacccgtttaaaataccaaccgcctaaaatcacaccgttcaccgcttgcttaggcatcgtaaccgtcgccgttaccactttcgacccgtttgcgggtaccgtgatggtcgttggtccctgtattttggtgatttggtccattcgatacttcaaagaaggatcataacttttagttggtgtcacgtactcgataatgccattgccgttcgtataagccgtatgaatcgccgtttgaaccttgatgtcagcgttggtgacgttataaatcgtcgtctgaatctgttgctgtcggccacgcgtcatttttaaatcaaaataggaattatgttgatcaatctgattattcggaatcttcgcggccacgctaaacccgatgtcattgctttgcgtggttttactgctactgctacttgcgctactggctgccaatccactaacgctgctaacttgcagacctaaaattaacgtccccacaatgaccatgattcgcttcaataattgcatcttctcgcccccattactcacatatgtacttggggcgccgttcgcccagatgacgcttaatttgttggtaaatcactcaatgtccaattcaggttagcgctataggcctgcgccttaaccgtattagccttaatattcagtgtcaacgcctttggatctaagcgactaacagttaccccggaaccaccgcccttatcggcatttaagacggcacttgatcccaccgtaccatttaaagcaacttcggaagccgtggcaaccgcaccattggcctccgagccgctgttgaccacgtcaccttttggtaaactgagcgttgcgccctttgcagccgtaccatccgttcctgttaaattggagccggtaaccgttaatttccagccggcattggttccccgaacatcagaaacttctacaaccatcttatcctgccatagcaaagtatatgaactagttgggtcaaccttatattgttgatcatttaaaacgtccagctcatgcgtcccgtatcctaacgatttagacacaaaaatcagcgacaggtcgccacctgctgccgccccgttgtcaccatcgccatcagtacttggcacatcaggatttgatggatcaactggcgtcaccgtggacgtactcttcgtaaattccgctttgatatccgtattcccactacgattttctgcagcattggcaacaatcggtgtactacccgctaataataaagttcctgccattaataagtgtcctaacattggcttcatggtataaatccccctttttcatttaccagcgcttgtttagctttcatcaactaagaacggtggtcattatcaacaatgattgctctcataacaattcataaattactggcactaaatcacttgtgacctcccccaataaccttgtacgattgattaattaatttaaatgccgactcctttgaccacattttcattatattggttggtcagtaacagcgctaataatgtataacgttaactatatttacaaacccggattgttcgtgtaaccgttatcaagcgtgggttgcttgagataattaggcgaacttcctttaaagccgttcaccaacaatcgatggctatccgaataaataaattcatatcaacaatctagggactgtctgaaaact

SEQ ID NO: 72 - DNA, 19511 bp, Lactobacillus plantarum
caaatttgtccaaaaattcggattaaatttgcaatctaccatatgggtaaattttgattaagtatagacatttaatgtattaagttaataataaggggggcagccatgagtcgtaaagagccaatttatcaaaccattttaagcgccttgattctggaattgaacacgaaccattttcgaaagaatgatccgttttatagcgagagtgagctacggaagaagtatcaagtcagttccacgacagtcgtgcgggtactgaatatgttagccgatcagggttatatttatcgtattcagggtaagggcagctttgtttccaaatttaatcgggggactgcggtacgaattacggatacccatacatacgatgttgatgaggaacaggttgcaatcttagtggccaatcagacgacgccactaccaacacgggctaagtttacggctgaatcgacaacctggtatttagagcgattacgcgaaattagacacgcaccatttgaattttcgcagtcgtggtatttggcgacgctgattcctgccacagcaatgaagaagttacgggccgtacattcgatttatgcactaattaggaaacatgcgcagcttgatttatcacgccagccctttgagcaagaatatgcggcgacctgcgttcctaatcaacgaattgcggattatttgcacgtgagtctggatacgatggtgattaagatcgaacggtgggtatttcaaggggaagaaacgctggaatataccgttagttacatgttgcctaactattttgggctggcgctaactagtgattccaagtcggtagatcctaaccgaattcgatgatcgatgcataaagagaggagtggcacacaatgtcaattcatagcaataacttttattccaacgtgttacgacagtcagtgcaagtccaagttatcttgccggaaccagtgaacgcggtcggacaaattttaccagactacagtagtggtgaacagcaacttccaactgtgtggctgttgcatggcttaggtggggacgcaacgtcgtggttacggcgaacggaaatcgaactactggcaacgcaataccgagtagcggtcgtcatgccggaaacggggcggggattttatacgaatatggttcatggtccacgctattgggattacttgacccacgagttaccaacacgaatgcgttatatcttcccgttgtcggcacgaccggaagacaattatttgttggggaactccatgggtggctatggggcattacgttatgcctttacctatccgcagcggtttgcggctgtcgcggcactatcaccggtgacggatctcaaaaggtttcacgtggaacaatcggcaattatgccagaccttgagctggctttctcaccagcacagatgcaagggacgccagcggatttgtcttacttggtacagcaaccgacaaactgggggacgttacgtgttctaatggcgacgggtgatcaagatatgttacggtcaatggatgaagccttcaagccagagttggcggctgtgtttaaagaccagtttgaatggcagttacaaccgggtcaccatgattggcggctctggaatcatcaattaccatttgcgatgaactggttaattaagggaggttggcacaatgtttaatattaaggatgagcacggtcactataatttgtggcggcagacgggattagcgttattaccgctactattggcaattatcgcatatccactgctacctaatcgtgtttacgtgccaactgctgtcacgagtctgacgccgtgggggatcaagagtaatatctttatttatcccgtcttttgcctgattctgtggttctttatctggctatttatcttcttcaaccggttatatgaaaaaaatctcaaggtaacccgccaaaaatatcggccaatggagaactactatgtgtggagcagctgggtgttggatattctggcgactttgatggtggtggttcagatcttggtaagtgttagtcggtgagtggtcgaaaaaattgaaatatattaagtaaactacaattgataagcgcttacatctggagtaaaatattatgttaatagatgagcaaaacactttgttactcaattcaaattttacaagggcaaagattaactcatatgacatcaacagaacgtattaaaacaacgatatgtttgtatcttaattaccttgttcatggtatggctattgtgattctcgcccaaaatatgactgtgttaagtcaacaatggcatgtcaatgatgctggtgtttcacttgttatttcatcattaggtattggacgattactagtgctttatttagccgggaccttctcagatcgacttggtcgaaaattatttgttcagattggtatcttaacatatacactgttttttattggcattgtcatttctcctaacattgccgttgcctatttcttcggtattctagccggaatggctaattcatttttagattcgggaacatatccagcactcatggaactttatcctcaaaggcaagcaacggcgaatatcatgattaaagcgtttgcttcgattggtgaattattattacctattatcgtggctggactagatcattttcaactatggtatggttgggcatttttattgtgtgtgtttttaatggtagttaactttagctttttacgtcagcgaacttttccaagactaacaactaatcgagtaacaatgcctaataaaaagcagaacactctgcaaaagcatataccactaacgccaaagaaaattatccttggatgtgttctgacggtttttggatatatctcaatggcaactttttatttagtgagccaatggttgacaaagtatggcagtgacgtgattcatttgaatttagtacacgctcgcatgttagtcagcgtctatagcgttggttctattttaggcgtgattgtaactgctttactagttgagcggattattaagccggtttggtttatgctgtttgatacggtggtatcgttgttagcactggtagctttaacgctaatcccaacgtggtgggtagctttaatcagttcgtttgtgattggatgctcagctgcaggcggtgttatgcaattaggattaaccgttatgagtaatacgtttccccgcgctaagggccgtattacaggaatttattatactgcgagtggattagcttcatttacgattccggtatttaccgcttggatttcacagattggtatttatgaaattatgtggtttgacgtattaattgctggaattggtgttctttgcagtgttgtagttcttaccctatcgcgagaaaagaagacaattgttgcttagtaaaaaatctctcaggtctataacacgcattatcactagtctggcgataatgcatgttgcaaacccgagagtttttttgtcctaaattaaacgttcctgttgtgtgtaatgttgccaacagtaactgcgactgaattcttcaaatcgactaactgaaggtgtaacaaaatgattacgtttgctgatgaggtatatttggtgacgtagtggctgatcggctaagtgcttcaacgttatgctggtctggtctaaaagcggtaagtatggcatcaaagcaacgccaaaattatagctcacaaagccagccatggtatgatcctcctcgacttcgtaaacgatttttggtttcacatgcgcctgccttagaattcgatcaatcaaaggacgtaaaccactattatgtgagaaaaatatcatgggatatggttccaagtctttaacgaataattcttcttgtttggctaacgcgtggtggctagggacagccgccacaatttcttgttgaaccaatggaataaaatcaaacaaggtattagtgggttgctcgccaaggcgttcgacacttgaggctaacactaaatcaaacttttcatcagcaagttcttggagtaattcagttgagtttccttgaccgagttcaaatgtaattgcatgatttttatcatctgtatggaacttagtgattagttcggggactagctgctgtccaagtgtataagtaaaccccaatttaacatgtcctttgtcaggatccattaattgctgaacgagttcattgccttgtgataaatcgcttaaacttgccgtaatatattttaaatacacggaaccaatcggtgttaaacgaatattacgaccatctggttcaaataaagggacccccaattcactttctaactttttaatggcatagctcaatgaaggttgtgagataccaaggttttcagccgcttttgccatatgttgtgtccgtgctaattctttaaaaaattctaagtgtcttagattcaatctacatgatacccctttcattcataaaagaatttaatcgatttagcaactgttctatatttattatattaaagcattttgttaagatgacaagtgaattgagtaacaaatattaaaaatataaatttataggagtggattaacatgactgaacgcattgatggacacacattattaattggattgatggcatacccgattcggcattcaatgtcaccaacgatgcacaataatgcatttgctaaattaggactgaactatgcatatttagcattcgaaatcgataacaaaaagctaccttcagcaattgaatcgattcggacgttagatatgcggggttctaatgtttcaatgcctaataagcagaaggttttgccactgctagacaaattagacccagctgctgagatgtgtggtgcggtcaacactattgttaatgatgatggaattttaaccggttacacgactgatggtattggttttatgaagtctctggacgatgaaggaattaatattcgtggtcataagatgacgttagcaggtgccggtggtgctggaactgcaattgctgttcaagcagctttggacggagttagtgaaatgtcaatctttaacttacatgatgcagagtgggaaaatgctaaacataacgttgatttgatcaacgagcggacttcctgccatgctactttacacgaattagaagatcgtgatgattttaagaaggaaattcaagattcatatatttatactgacgctaccggtgttggtatgaagccgttagaagacaagactttagtcgatgatccaagttggttacgtaaggacctgattgtgttcgacaccgtatacgcaccacggacaactaagttaatgaaggttgcccaagaagctggcgttgaacatgtctttaatggtttgggtatgatgctcgaacaaggtgctgctgcctttaagctctggactggtgaagatatgccagtggattatattcgccatattttatttgatgaagacgctgcagcacaaaaatagacgggggttgccatgaaaaataaatatatgccgacagccattagcttatatttaaactattttattcatgggattggggttattattttagcccaaaacatggaagctttggctcaacactggcagacgactacaggtggtgttgccgtggtaatttcatcacttggaattggtcgtttgattgttttgttagtttctggatttctatcagataagtttggccgtaaaccattcgtggttcttggtgttgttacgtacttgctcttctttgctggtattctattaagcccttcaattacggtggcttatgtttttgggatacttgctgggatagcgaactcattccttgattctgggacttatccggcattaatggaaatgtttccagattcaaaaggaactgcgaacgttattatcaaggccttcatttctgttggtcaatttggattgccgttattcgttagtttcttagttgctggtaattattggtacggttggtcgtttatcttctgtattgttgtattagttgttaacttactattcatgttggctgctgggaagttcccagttgctaatcaggatgctaaagttgctgtgaaagaagaaggtaagacagttcaatctgaatcaaagggtagcttatggtttgatggaacgctatttatcttatatggttatgtatctcaggcaaccttctacttagttagtcaatggttgagtcagtatggtgcaaaggttgccggcatgggcgatgcaagttcacgagcactgatcagttattatagtgttgggtcaatcgtttgtgtactggtgacggctgcgctagctaaacgtgctgtaaaagaaattcaattcttaggcatctataccttactttcatttctctcgttactactgatgtatctggtaccaacatctttgatgtgttcaatcatgtcatttgttgttggattctcagctgctggtggggttatgcaattaggattgacagtcatgtccaccttcttcccacaaggaaaggggacgattaccggtgctttttatacagcggggtcgattgcgtcctttacgataccgttagttacaggtatgatgtcaactaatcttgcaaacattttcttgtttgacgttattattgcgttgattggatttgtattggctgtactcattacagttcgctattaccacttgtttggcaagaacagtcaaaaggaggtcacgattgatcatgacaccaatcgttaaattacgtgatattgaattaggaacgggacggcctaagattgccgttccaattacgggaaaaactattgcggatattttagctgcagttgaaccaataaaggctgcacagccagatgtcgttgaatggcgaattgattttttcaaggatgtaactaatccagaacagttgaaatcggccggtcagcaacttcgtcaggctttaggtgatattgccttattaactactttccgaactaaagttgaaggcggcgaattagcaatatcggatactgagtattttaaactgtgtgagacggtcttagatggtgggttcacggatgccttagatgttgaacgttaccatgacgaacaagctgttaagcaaattgttgcagcagctcatgagcatcaagtagttgtgatcatgagtaatcatgattttgataaaacgccggcggttgctgagatcgttaagcgccttactagtatggtcgattatggtgctgacgttgctaagatggctgtgatgccacaatcggtggaggatgtcttaacattactgacagcgactaatattgcacgccaaacactaccacagccagtaatcacaatgtcgatgggtgacttaggaaaagtgtcacggcttgctggtgaagtgttcggctcttgtttatcatttgcaacggtcggggcggcttcggcacctgggcaaattgcacttgaaaatttacggccggaattggaagatctgaagttaaattaaagcataactgaaagaaatcgtgaggtcagagtgatgattgggacacaaaaaaagtatgtttcacaatttacgatgatgggaaccgtcatctcgctgacattatttgagccgaatcagttagcggtcgaagcggtctatgattacttgcagcggatggatggtgtcttttctgtcaatcgtgccgattcagaattagctgcgatcaatcaatatgccggtattcatccagttttggttagcactgaatgctttcaactagtgtcggatgctattaagtacacaaagcaatatgcggatagttttaatgtgctaattggaccgttggttaaactttggaagattggttttggtgggcatcaagtaccagcggccaagggaattagccaacgattagccttattagatacgcacgaagttatcctagatgaagcccaatcgagtatctacttgcgtcaatctggcatgcaattagatcttggtgcgattgccaaggggtattttgccgatcaggtcgttaagcagttacagcaggctggcattaccagcgctattgttaatcttggtggtaacgttaagctattaggggccaatccgctaaccgataatcggcgttggcaagttggaattcaagcacccgaagcgccacgtggctatccagcgctacaggttgaaacgcctgctagaacggtagtgacgtcaggtatcttcgaacgatattttaaaattggcaatcaccgctaccaccatatccttgatccgcgaactggttatccggttgaaaatcaagttgatcaggtgtcgattataactgaacggtcagaattagctgaagtgttatcaacggtggcctactttgaagggccaaaccgtggttgtcaactaatcgaacagttgccacatacggaagcaatttttattgatcatgaacaacaggtaacagttaccagtggcttaacgccgcgacgcaaaggagtgtttactattgagtaaaaaacaaattaccggccaagcaatgggccacaacggtattatcaactatgaagttgacgtgcaagataataagattgaggatttgaaaatattaaagcattctgaaacgtcggggatctttaaccaagtcattgataaattgaaacaaaatatcattacggaacaatcattcaatgttgacacaattagtggtgcaacggtgatgacccaagcgttacttaagtcggcagataaggctgtaaccgatgctggtgttgatgtgcagccagttcctaagaaaaaagcccccaagacgcaaaacttgcggaccgacgtgctcattattggtggcggagaagcgggcttagtcgctggctgtcgagcgttgacaatgggtcagaaggttatcttagttgaaaagaacggctatcttggtggtgcgacgattctgaatggttctaacgttgttggtaccgggtctgatgttgctgcacaaatttttgataataatcatgatacgccagaaatgttggcacaagatgttgctcgtgaaagcttggagacgaactatccagctttgaccgacctaatggtgcataacattggtccagccattgattttattagtaagtttgcagatttacattatcaaaaagcacagacgcaaacgccagaacattcgattaaccgtcagattgaactaccttcagcaagtagctatgaattcattcaaaaagtttcgaaggcgtttgctgctgcgggtggtcaaattatgttggatactcgagtcgagaagcttatgttggacaacgataaaaagttacgcggtgtgattgctgtccaaaaggaccaaacagtcaacatcaaggcacgttcagttgtgcttgctgcaggtggtcatggcgctaaccaaaagatgcgtggtactgaaagcgaaggcattgattattatggcccaatgacttccactggggatgcctatcaatttaatggtgatttggatttgcaaacgcacgatttaggttggtacaagctgtatccacatggtgttgaagtggaaccaggcgttgctaaattgaccacgtacgcgtcgaaacaagcaactgatatgggtgcaatttacgttaactctaagggtgatcgaatcgttaacgaatcaaatgtttatacgacttttcggaatgccatccttaaacaagcggataaagttgcttacctagtaatggatgaacggacttggaagaaagtttacgacctactgatcctgcatgatttcacaccagaagaaattaagagcttctttgagaataagggtaaacggccagtatttgttaagggttctttggaaagtgctgctgagcaggccggaattgtggttgatgaattagtccaaacggtcaaaaattatcaaggctatgttcaagatggtcacgatcatgatttcggtcgtgatccgaagtacttgcaccaatttgaaggtgaaacattctacatcattgaacaacgtgatcgctttgcgacgactttaggtggctatagtgttgatgctgataacttgcaattggtaacgactaaaaatgcaccggtagctaattactttggtgcgggggaaatcatcggcggcgctaacggacatgattcaatgccaagtatgatgaatacttgggggatttcgtcgggttacgttgccggcgccgcggctagcgaaaacgctcagcggcaggcaaccgcgggcgatgacgaagccaatattgtggccattgtggggactaacgcttcaaaatcatataaccgtaagttgttgtatgccatgaaagaattatttgaaacgcaagttaattttgaaatttgtgaaattaaagatttaccgctattcaatgaagatgatatggatcgggaaccggcaagtgtaaaagcgttagccgctaagattgaagccgctgatggtgtcgtctttggcgtgccagaatatgatcattcgattccagctgccttgaagagtgccattgaatggctgtcctgtgcagaacatccattcaaagacaaaccagtgatgattgttgggacttcgttaggtattcaaggtacggtacgtgctcagatgaacttacgacagattttggactcacccggtgtggatgccaaagttatgcctggtaacgagttcatgttacctcaagccggcaataagtttgatgagaacgatcatctgaatgatgacggtagtgaacacttcttgaagcagtgctttgggcactttttagaggggcttgaattagcatctaagaagacagtgacgaattaactactgtctagactaaaagaacgtacacaactcgtgtacgttcttttagtctagattttagttgttaaatcttttgttccacatcgtcgattgtgacaaccagggtcgcgcgaatccaatcaaacttagtatgcatttgatcgaaataagcgccactagtttcaaacttgccggtaccatgaatgtggaaaccacagccagtaccagttgtgccgggaaccttgtaactaccgacagcaattgtaatgtggttgtcggtagcaaaatcggcctcaattgagtgcatgccagccgatgggatcaatagggtatgatcatcgataagtcgcatataatgactccaggtgttgacgacgtgtgctggtgcggcgttgaccgtaacgatggttgcgggggtcgtgtctttgataacttcaataaatttagggtccataataagtactcctttacgtttatattctaataatatattgtaattgatatatataaattatcaagtgagagcgttcgatgtctcaataatcttagcggaggtagcatggtaaaacaggcgttgctttttactaatgaaagcggtaactttagctaggaacgaataacgagagggtgtttaatatgtatcaagcaagccagaagcgctatgaccatatgatttataatcgagtaggcaatagtggtttgaagctgtcagcaatcgggctaggtctttggaataattttggaagcgttgatccgatcgctaatcaaaaggcaatcattcatcaagcttttgatttgggaattacctactacgacttagccaataactatggcccggagtccggcagtgcagaaactaattttggtcgtattatggctaccgatatgcggccataccgtgacgaaatggtcattgctagtaaagcgggctatgtgatgtggccgggaccatacggcaattgggggtcacgaaaaagtattattgccagtgctgatcagagtctgcagcgaactggtttagactactttgatattttttatagtcaccgtcctgatcctgaaacaccaatggaggagacggccgctgcgcttgatcagctagtacggcagggtaagacattgtatgtaggcatttcaaattataatggcaagcagacggctgctatgaccaagatatttgaatcattaggaaccccatacattattcaccaaccacgctataatatgtttaatcgacaggtggaacaggacttgttccccgttctacaagcaactcataaggcggcggttggctttagctcactatcacaggggttattgacggacaagtatctgcacggaatcacgacagattcacgggccaataagcaaacaattccatttttgagtccagtccaggtagaacagacactagctacggtaaagcgcttaaatgaagtcgcgcaacaacgggagcaaagcttagctcaaatggctttggcttggaacctacgtcagccagccttagcaagtgtcttgattggtgctagccggccagagcaggtggttaataacgttgctgcattggaaaagttgaaatttagtgaatcagaattagcaacgattgaacagattcttaccgaacaaccggcaattgattggaatgctggtcgatcatagcgtttgcacaattcgctatagtcaatgttatagagccgcaaaagaaagggccatatccgaggatatggccctttctgtacctaatagttaagttaataataacataattttgcagatttgcacgcacagggggtctttactaaataaattagtgtttaaattcgccaattttcacaattaatgataaagttttacatgatagttatcacgattatgcgttgaagttcggcgcaatacttgaaaattaaaataatttgcaaataaatcatgcgatagcgactttagatggtagtaagaattagtttgaatttaagggggccaattcatggcggcgacgctaaaagatattgcaaataaagttggcgtatcattggcaacggtatcgcgcgtgttaaacaaagatcagtcattgtctgttagtgatacaacgcgccaacgaattctagatgcagcagaagcattacagtattcaaaaaataaacggcatactgtcacgacggcgcgtaagcgacttgctattgttcaatggtattcggaatctaaggaacaagatgatttgtattatatgtcagtccggatggggattgaacgtcgtggacaggataatcagtttgaagtgactcggatcttccaaaataatttacaagaattgggaccagacgtagatgcagtgattgcagttggaaagttcagcgagccacaagtcaaggacttggcatcagtaactgacaacttagtattcgtagatgatgatcagtttgatgctggttttgatagtgtcattactgattttcggttggccacagaaaaagttgtcgattatttttggcaacgcaactttcatcatattggctttattcacggtcaagaaatgacaaccgaccatcagttagcggtagttgatcgacgcatgctaggttttcgggccgcgatggaacgacggcatgcgtttgatcctaagttcgtttttaagggcgattatactagtgaatctgggtttaaaatgatgcaaaaagccattcgtaagttgggagatcagctaccaggagccttctttgtggcaaatgatccgatggcggcaggagcgcttaaagcgttgcaagctagtggcatacaggtgccagaacgagtgaagctatttagctttaacaatacttcgctggcgacattcgtttatcccgaattaagcgcagttaacgtagatactgagttaatgggggcgaccgcagttaatttggtcatcagtcgactagcagggcgaacaacgacacaacgggttgagctgggtactaatctggttgagcgagcaagttccaagtagtgaagggcgatctgggatagaaaccagatcgttcttttagtattttaactaaaagttttactcaacttcaagaaattctggtatacttctaaatgaaagcggtttaaataacacggaggtgcatgattttggaaactaaaaaaacggtgtttgaccaactagatggtcaagatgtaatgcgttatacgctggtcaatgaccatcaaactcgtatctcggtccttagttatggtgggacgtggcaagaattcgtcgtcaatgaagacggcgttgagcatcccttgatttggggccttgataacatgactgactatcaacgagtgggatactgcctatgtcaatcaattggtcgggttgctggccggattggcggcgctaagttcaaaatcgatgatcaatcctatcaagttgatatgaacgaacaaacccattcgctacacggcgggaatcatggttttaacacgctgaactttgaaggtgcttttagccaaaccaatgatagtgtcagtgtgactttgaagaagcatatcaacgccagtgatgataattacccgggaaatatggatgtcgctatcaagtttacattagataatcaggatcaagtatccattgcatttaccggtgatactgatgcagcaaccctctttaatccaactaatcacgtttattggaacacaactgatgatcggaccagtttggcccaacaaaaattacagattacgagtgcagctcacttggaatttgatgatgaaaaagtcccaactggtaagaaattagcagttaaaggcacagcgtatgactttaaccaggcacaaccagttgaaaaggcattagcccagctgaagactgagaatggtggcattgaatttgacgatgcgtatgaagtcgccccaagtgcggcagaaccaattgctatcgttggggatactgatgataagcgccaagtaaaaatttattcagatcgaaatagtcttattatcttcacggctaatccgtttgatgctgataaggaagacgcgcatcaatataatgcgttagcgacggaagcccagacacttcctgatgcaatcaatcatcctgattttggtgatattgtgttacgtccaggagcaccagtgacgcatacgattcggtaccaatatgaacggttaaattaatactagttgaggtgtcaggcgagttctgcctggcgccttttttgtaaacgtatgagtaaacaatgtttaatttagttaacaaagtcccgagcatctgattaataccgtgattagtaaaacgatgatcattggtaagataatgagtactatactgcttaagcccttggaaagcgggcaatcagtgtcgataggcgcattagcaggtcctaatcaaaagcggtatagataaaacttttgaacaaattttactaaaaatcattgacattacttctgaaaacggttacatttaaatttgtaaattattcaaggaagatgtgaggcgagattatggatgcagagacaaagcagagtaaaggtcgtaaaataacatcgcgacttgcttattcgtttggggcgtttgggcacgatgccttctatgccactttatcaacttattttattatgtttgtgacctcccacttgttcgataagagtagtggggctcaaggaacacaaatgattgcttggatcaccatgattattgcaggtttgcggttcgtggaactagcaattgatcctttgatcgggaatgccattgataatactaattctcggtggggccactttaaaccatggattgtcattggtgggattataggttccgtcgttttagcacttttattcacgagtttaggcggattaaatacctcaaaccccattctatatttaattatttttgcaattttatacattacaatggatattttctattcgtttaaagacgttggtttttggtcaatgattccagcaatctcatttgactcagcagaacgtgaaaagacggcgacatacgcccgggttggctctaacattggtgccaacatcgttggggttatcgttatgccaatcgtcttaatgttttctgttaagtctaacagtggtcaaggtgacaaccgtggttggatggcatttgggatcattattgccgcaatcgctttgatttctgccttagttgttgcacttggaaccaaagagaatgattctgaattgcgtaagaacactgaaaagactagcttcaaggaagtcttcaaagtgttagcccgtaacgatcaattgatgtggttatcattgatgtatgggatctacacggcagggattgccattacgaactcactagaactttactacttcacctatattttgggtgacgcctcgaagtttacactattaggttcactaaatgcgattattgggatttttgccgtattggccttcccaccattagcaaagaagtttagtcgtcgtaaagtgttcttcttagcagttgttattatgatgatttcactgatcatgtttgcctttgctggtcagtcattaccaatgatcttaacagcggccgtattattctacattccacaaccattaattttcttagttgttttgatggttttgagtgattctgttgaatatgggcagttgaagtttggtcatcgtgacgaatctttaaccttatccgttcggcctttacttgataaattaggcggtgcgatttctaacggtgtcgttggtttaactgctgtttgggctgggatgacagctggtgccactgctggtgatgtgactagccatggcgctgccatcttcaagttaatgatgttcggtgtacctgctgctatgattttgattgggacattcatcttcttcaagaaggttaagttggatgaaaagatgcatgcacaaatcgttgatgaacttgaaaaaacatggtcaactcacttggaaaccgatgaaactcctgctgaagttgaagcagaagccgatgccaagacgacggtttatcaagatcctgttgccggggaactgctcagtttgaaagatgttgctgacgaatccttcgcaaacggtagtatgggtaaaggtttcgccattaaaccaacggatggtcgcgttgtcgcaccatttgatggtgaagttgttgcaaccttcccgactcgccatgcaatcggattacgttctgataccggtattttaacgctaattcatattgggattggtaccgttaagatgcgtgggactggatttgttcagtacgttgagaagggcgaccatgtcacacaagggcaagaattaattgaattctggcaaccagcaattgaaaaggctggcttggatgataccgttatggtcgttattacaaactataaagatatgcccgaatttacgtatcttaaagattcaggaaccaccgtacaagatgatgaagatgtcttacaattatcgaatgtcggcttaccggatcaagcatagtttctttacgaggagagctattaatgacgcgagccattaatagctctttttttgaactgaaatagaaaaagctaatagcgaagggaagattttactatggcagtaacgttgcagcaaactttaattgacattgatgaagaacaacttgtctttcacctgcataacgatcaaatatcgtatattctaggtgtggagacaggcaacgtgttggcccacttgtactttggcccacgggttcggggttatcatggcgagcgtcagtatccccggattgatcgggggttctcaggaaatttaccgaatacgactgatcgaagctattccaaggatgatttgccacaggaatacggtggcaataataccggtgattatcggcaacccgccgcgattattcgcgcggccaatggtgctcgaacagttgattttcgttatcaagactgccggatggaagccggtaagccggaacttaagggcttgccacaaacttatgtcgaagatgaggatgaagcccaaactttgattgtgacgttgcgagatgccacattaggcgtgacactcgaattagcctacacgatttatcgtgatcggccagttatcacgcgtagcgcccggttgattaatcacagtgagcaagctgtcgacttagaaaaagtggcttcgatgcagatggacctgccaacccaaccattagatgccatttcgttacctggaagctatgcgcgtgagcgccagcttagtcgtgaacggctccatcgaggtgtaactcagtttgaaagtcgccggggtgctagttctcatcatatgaatccttttgtggcgctagctgatccgaatactaatgaatttcaaggcaatgtccttggtgcattgctaatttattcaggtaaccaccagattagtttagaacgggacccaattggtcagacgcgcttgactatgggaatcaatgaatataatttcgactggcgattggcggccggtgctagtttccaaacgcctgaggttgcaatggtatactcgacgacggggcttaatggtatgtcgcaaacctaccatgatttattgcgtgatcgcgtggcacgcagtcgttacaagcacgatctccggccgatcttgatcaacaattgggaagctacttactttgactttgatgcggacaagattcaatcaatcttggatgctgcagcaccattgggtatcgaaatgtttgtgctggatgacggttggttcggtcatcgaaatgatgataatagttcgctaggtgactggtttgttaatcggaacaagttaccagagggcttagcggatattagtaaacggacccatgataaagggatgcggttcggactttggttcgagccagaaaatatttcagccgattccgaactttatcgggcccatcctgactgggtgttaggcgtaccagatcgtggccgaacgttatcgcggaacgaatacgtgcttgatttcagccaaccggatgttgtcgacaatatttttgaacaaatgaccgcagttcttgataaggtgcccattgattatatcaagtgggatatgaaccgcaatttaacggaagtctattcgccacatagcgattcagctcatgaaggtgagactagccaccgctttatcttaggtgtatatgacttgatggagcgtttaacgaaacactatccacagattttatttgaaggctgctctggcggtggtggccgcttcgatgctggtttaatgtattatatgccacagagttggccatctgataataatgacccgattgaacggctcaaaattcaatatgggacttcactcgtttatccaatttctgcaattaccgcccatgttgggacgagcccggatgaattgttaggacggtcgacgtcgatgaagatgcgtggtgctgtggcaatgagtggtaccttgggctatgaactggacgcggcccaactaagtgatgcggacaagcaggccgttaaaagacaggttgccttctataagcagcaccgtgagttagttcaatacgggaccttttatcgattagagagcccgtttgaatctaatacggtggcgtggatgtttgttagtccggatcagaaagaagctttgctgttcaccttcgttattttaggtgcagttcaaccagaaccgcatattacgaagttagcgggattagaccctcagcagacctacgttgagaccgacacaaacaaaatgtacggtggcgatgaattgatgcaactaggactctacacgactcccgttcaaactagtgactttacggcgcgggtacattacttcaaggctaaggactaagctcagccattaaacatattaaaacttgatcatcgttaatctaaaagaacgctctggcaaataacttgccggagcgttcttttgaaatcaaattaatttttaaaaatgaatgttaaagctgaag

SEQ ID NO: 73 - DNA, 10619 bp, Lactobacillus plantarum
tttcaaagatctaattccgtgtgttaatcgcttaacacaacttaattatcataacatcttaatcaatatcttgtcaacaactttttttaagaagtaacttgattaatttgtcatagttgccgttgcgacaacagaaactatcttaccaattactgaagaaattgtcaacaactaatttcaataattatttggtggtgagatgcatctgccgtagcagcaacgtttactaatataccaattgaagtaaaaagtgtcaacactttttctgaatttctttttattaatagtcaaaccagctttctttctctatactatttaattaaaggagcgactaaattatgctagcttggctaccattctttttgatttcattaatgtttattgttctactatacgcttgtgcgcgatcagcgcgcacaaatatccagcgttttaagcaactcagtttaattgcctttctctgggtcttaactgctttttgctatacacctaccagttacaattttggtacccaactcgttattcaatatattcaatggggacccgttaagctgaacgtgattcctttccaacaacttgacattgaattttggctcaacgttctcctcactgttccattgggcggtttactggcatggaattttcccgacttgccttggcgtcgttttatttggttgggatttcttacggggctaacactcgagctgggacaattcatccttgactggttggttaacctcaaacgttgggttgatatcgatgatgtcatcacaaattgggctggtgtcattatcggtgccgctggttataaaattgcacgtcatgttcccggacttcgctggttgcaaaaataacgtgtatatagaagcaaaaagcaaaatagcgtttgtttagcacccacaagtgccaaacacttcagcggtctagctgtcatgaaatcgtaattaaataagcgtcgcagccttaagtggctgcgacgcttatttaatttaactactaactattaatgaagctgccatcatcaggattcaaaaaacagatcgaatactcgcttacgatcttggttccagacctgattgtcactagttggataaactcgatttgttaacacaaccagcccaatttgacgatccaaatcaaaagcaactgccgggccagtaaaaccagtatggaaatattgatgtcgtcccgcacgtcgttcccaacctaacgtccggccattttcgtcatactcgcctaaccagtcaaagacattttcatccagcacccgtttgccttgatattcaccaaagtttaacatcatttcaataaatacggataaatccgtcagcgttgagaacaagcctgcgtgaccactctcaccattcaacaaaaaggctttataatcatgcacctgtccttgaatctgaccccgccgcggatcaaactccgtcggcacaaaccgaatcttcggacgatttaagttataacccgtattggtcatcgctagtggatagcaaacgtggtcttgaatactccgagccaatgagccgtcaaccgcacgaataatccatcccaataaaataaatcccaggtctgaatagacatacgttgtccctggtgccgtgacgagtggcgcatcataaaccgctttgatcagatcttcacgttgcatcttatccaggttatcaatatctgccggtagcccactattatgaagtaacaagtttttaatcgttatttcaggatgagtgaacccaggtaaaaaccgggcaaccgagtccgttaaatgaatcgtgtggtccgataacaactgaaaaatcctcgtcgtggtccctacaaccttagttaccgatgctaggtcataaatcatcgcaggatctaagcccacggcaaactcgtcgcggccctgcttaccatgatagtattgattgatacctttaggggtgatcaagctaaacgacgccccataaatgtcgccagcttcaatacaactgtcaatatattgttcaattttttcgagcatccgcattacgcccacctttcactacattcactagtttctgcttatcttctttatgataacgaacttcctcataaaatcaacggcaaacgcttttaacaccctccacacctcgttgcactttttattaattaactagttaaacacttgttacattatggacaatattccacttatatatcaaaacaagtcttgtttttagccgttttctaaatataattaagtgaattaccaatgcctatctagctatgtaagtactgttatatcaacgttaatagtcaacttttcaataatagattgcaaaaaaataacccaaacgtgaaataaatcacctgaaagcggttacaaatccaacaaaaaatgttatgattcaaatatagaattttatcaatcatttgattggattcaaattatggaggcgagaaaatgattacatcagaaaagacaacaaaaccagcagcttggaaaggtttcaaaggcgggcactggcaggaagaaatcaacattcgtgattttattcaaaataacttcacacagtacaatggcgacgaaagcttcctggccggaccaacagccgctactaagaccttgaatgacaaagtcttagaattaaagaaacaagaacgtgccgctggtggtgtgttggatgctgatactaaagtcgttgcaacgattacttcacacggccctggttatattcaaaaagatctcgaaaagattgttggtctccagactgacaagcctttgaagcgggccttcatgccatttggtggtattcgaatggctgatgacgctttgaaatcatacggttatacccctgatgaagaaaacgacaagattttcactgaatatcgcaagactcataaccaaggcgtcttcgatgtttatactcctgacatgcggaaagcacgtcactacaagatcatcaccggactaccagatgcatacgcacgtggccgtctcattcctgatcttccacgggtcgctgtttatgggatcgatcgtttaatggaagacaaagctaatgactttgcccacattggtgatggtgaattgactgatgatgttattcgcctccgtgaagaagttcaagatcaataccgtgctttagcagatatgaagaagatggctgccagttatggctacgatattagcaagcctgcaactaatgctcaagaagctattcaatggatgtacttcgcttacttagctgctatcaagacccaaaacggcgctgcaatgtccgttggccggattgatacaacgatggacatcttcatccaacgtgacttggacaatggtgttctggacgaaagccaagctcaagaattaattgatcaattcgtcatgaaactacggatggttcggttcatccgtactgaagaatacaattctctcttctctggtgacccaatctgggcaaccttatcaatgtgtggtttaggcgtcgacggtcaacaccatgtgactaagaccgctttccggatcttaaagactttggacaacatgggcgccgcaccagaaccaaacatcacgatcttatggtcagaccgcttaccagaagacttcaaacgttacgcaactgaagtttcaatcgacagttcaaccattcagtatgaaaatgatgacttgatgcgggtacaatggggtaccgattattatggtattgcttgctgtgtttccgcacaaccaattgctgatgggatccagtacttcggtgcccgggcaaacttagccaaagcgattctttatgccatcaatggtggccgcgacgaaattgctggagatcaagttggccctgcttacgaaccaattacttcagaatacatcgattacgacgaattcatgaagaaattagacaagcaaatggactggttagctgacacttacgttaactcactgaacgcaattcattatatgcatgataagtactactatgaagctgcccaattagctttgaagaatactgatcttgatcggacctttgcaactgggatttctggcttatcacatgccgcggattcaatctcagctatcaagtatggtcacgttaaagtaattcgtgacgaacgtggtatcgccgttgacttcaaagccgacaatgactacccacgttatgggaacaatgacgatcgcgctgatgacattgctaaatggttagtcaaagaattatacagcaagatgaacacgcatcacctctatcggaatgccaaactttcaacttctgttttgacgattacctccaacgttgtttatggtaagaacactggtaccacaccaaatggccgtcaaaaaggcgaaccattctcaccaggtgctaaccctgcatacggtgctgaaaagagtggtgcattagcttcacttctttcaactgccaaattaccataccgttacgcaactgacgggatttccaacacgttcggcgttacccctaacacgttaggccatgacctcgaatcacggaaagacacgttagtaaacatgttagacggttacatgaagaacgatgggatgcacttgaacatcaacgtcttcaataaagacactttgattgatgctcagaaacaccctgaagaatacccaacattaacggttcgggtttctggctactgtgtctacttcgcagatttaaccaaggaacaacaagatgacgttatttcacggacattcttcgaatcaatgtaacatttaatctttaatagttaagaaggcgaaaggctcatggaaaacaaacaagtttcaacaacgcaagcggcggcaaaggagcctttgataggctacgttcactccatcgaaacgtttggctccgttgacggaccaggtatccgttacgtggcattccttcaaggatgccacatgcgttgccaatactgtcacaaccctgatacttggaaactcaacgttggcgatcaaatgacggccgacgagattctcgaagacacggctaaataccgggctttctggggcaagacgggtggcatcacagtcagtggtggtgaatcactggtacaaatcgacttcatcttagacttattcgaaaaagccaaggcgatgaatatcagtacttgtctggatacctctggacagccttttacccgagaacaacctttctttgacaagttcgaacgtctaatgaaggtcacggacatttcgttggtcgacattaagcacatcgattctgccaaacacaagcagttgacccagtatgggaacgaaaatatcttggatatgattcagtacatggcccaacaccacgatgatatgtggattcgtcacgtcctggttccccaacggactgattacgatgaagacttgaagaaactcggcgattacattgctaagattccaaacgacgtcgttcaaaaagtcgaagtattgccgtaccatactttgggcgttaaaaaatatcatgaaatgaagatcaagtaccggcttgaaggaatcgagtctccaacccaagatcgggtggcaaatgccgaaaagctactgcacactgctgattacaacgggtacaagacatggatgccattgccaaaactttaaatcggcatttctagcatgactaaaacaccagcgatacaatcgtctacggatggttgtgtcactggtgtttttttgctggctcgacgcatgcacgtattgctggctggaattagtacagtggcacgcaaaaaaggcgccgcgagcaaaccagcaacgtctttccttaatcatgccctatccaatgaccgtcagcccttggactggctgcgaacaggccggccactaactatgaatgcctagttccattcgagcttcgcgggacatcatactttcgttccaagcaggttcccacacaatctcaatctcgatattgttaacttctggtaatttgatcagttcatcgtgaatgtccttagccaaccattcggtcaaaggacagcccgcaatggtcaacgtcatggtaatttcagcggttccttccgccgtcaattgtgcatcatagatcaaccctaagttaactagatcaattcctaattcagggtcaatgacatgtcctagcgcctcgaaggcccggtttttaaacgttgttgtcatcgtatctcgtccttccataccagcttgaattcactgattaatcacgccaacgtttcgcggtataagtgccaccacacttgatacacgtcatcgttatataaagcgctttcttgtctacttctattgtaccgtatgtcagcccatattcaatcaattattagcgctaattagccgacttttcaaacgatcggtcaatcagcaaattatgcgactatttctcgaaaaaatttactataatccccgatatagcagcgttttgagtcactattgatttttattgcgaattcgcggttgtttttgttgtaagcgtttgcggtttatgctattatactaagtgaggaaaggaattaatcctcgattagcaaagcttctcaaaagagtttggctgtcgctgtaatgttagacagctagtatcacagtttgggtcgttatcgaaaccgttttaagcgccgtgaagcgttatcggtctagcgagtgtcgtgagatttacgttggatgactgaacgttgacccttagataaacgataaccgcaaagaattaattggcattagaatgacgaacagattttaactaagttttagttggaaacaggtgtctccgatgaccagttgttagttccacattaccagctccatttgtagactcaggtattacaaagtttaaacggaggtgcatgtctgttacgaagacattcccaagttttaaacgcgagtttgactttcgttaaaacccgtctaacgagtcgcaatcaagtaacaaccttactttagatcgactatagcagatagttacaataaatacgggttagtccgttagaagttggacacgcgtaaaattgaatagcatgaaggtgtatcatattaacactgaacaatttttcattgctaatcaggattattcctcataagtagaactcaagcagagaagccttgggttctatttttttgctctaaaatcagatttaccaacagtcggcaccagacgtaaccgtttacatactcttacgaaaaccgtatactgaatttaaatcaagttgcacattgaggaggactttagttttgaaaacgattaatttaggtcacagcaatattcaagcttccagcgtggcgcttggcatcatgcgcatggacgccttggatgtcgctcaagccaccaaggttatcgataccgctgctgatttaggcatcaattacgttgattcagctgatatctacggtggtggtcaatcatcgaccatcttcggtcaagcactcaagcaggctcacgtatcgcgtgatcagctctatattcagtcaaaaggcggcattgttcctggcaagcgttacgacttttccaaacagcacatactggcagccgtggatggcgagcttcaacgcttaggtgttgattatctcgacaccttcctcctccatcgaccggacgccctgatggaacccaaagaagttgctgccgcttttgacaagttgcaaactagcggcaaggtgcgccactttggcgtctctaacttcaatcccatgcaagttgacatgcttcaagcggcactaaaccaacggctcatcatcaaccaactccaatttggtatcatgcataccggtgcgatcgactttggcttgcacacgaacatgcaggacgaacgtagtcttaaccacgacggcgagatgatcgaatactcacggctccataagatgacgattcaagcttggtcgccttatcaatacggtaacttcgcgggtatcttcttagacaatccgaagtttccagaacttaataatgccatgcaagcactcgccgatgagaaacaggtcactaaatcagctattgcgaccgcatggattctccggcacccagcccacttccaagtcatccttggtacgatgaatccggaacatctagctcaaaatgctgctggagcagacgttacgctttctcggcaagaatggtatgacatttactttgcagctggcaacgatttaccttaatcacgatcgacctaacagaattgacgattagtttttacaatcaaaacgacgaccccaaatcaggattgattttcaggtcgtcgttttttagacgtttcactaacatttttgatgtactcaccacatctacgcgtatacttaatcttatcaagactcaggaggcgagcgaatgacatccacttgcacgatctgtgaacgaatcaaactaattcaggcacatcagaatccttatttcgtttacgaactcacaacgggctacgtggtccttgctgatagccagtactttgaaggctacacgctctttttagccaaacatcacgttaccgaattacatcatttaccggcacacgagaagttacgataccttgaggagatgagtatcgtccaggaagcttgtgcgcaggcctttcatgcagacaaaatgaacattgaactactcgggaatggtgacgcgcatgttcattggcacttatttcctcgccataacggtgatacgcccaaccccggtcccgtctggtggacaccgctggaaacaatttatggtgatgatgtcagtctagatattccccgtttaagccggttgaagcgcacgctcagcgtagcaattgaagccacgcttaatgctcgggaagcagaattgcaggctttagaggcactcacaaggcctgctagccacagaattgacagcaattagaccaaatcaggacccagacccgcttagatcttggtggctacaccccaattcttaatcgcaatccgtcaccgtatttcaaattgccaaaatccacctatttatccggccgactatcatacgctcgcttagatttatagccagctcgaaaaaccgtcttcataacttcaatgtgccgttccttagttgcttgtgccttagttccaaaaataaagcgggcccattcgcgctgataaccaggtgtcaaagccacaaagaacgtttgcaattcagcatcaaccgctaacaattcggttaccgccggaatatttttttcaaatgaactgaggggtgctgtactcataatcaaacctccgattagttttacttaaatttactgtaagaaagggaaaatccctaattttcaggcttttatatttcgaattttcacaaaattgcgctatcattatagtataagtattattatttgactactataattaaccatactgctattcaccaaggggagccctgctatgccaaaatttgatatcaccctcatcagtcccgaacgcgctaaagcgatgttgactgaatacaaagaacaacgtaaaaactctgtcccacatctggcccatcctggccgctatatcttgccggattacaaactaactcgtcgccgggccgcattcaaaattgttaaacatacctttttaacgccccactacaagtcttacgttgccatggactctgacaacggccacacactctggtttcataatttcggttccctaaccgaagctttattctggttagaaaccggccttaaaatcagcgataccgactcccattctaactacaaggaatggatggctaagcacactacggaaatcgaaaccttcaaagacttgctgcgcgagcagaagcataaacaagggcccaagactaagaaaaaagccaagtagcccgttttgacacctagattcagataagcagcagtacgctcattagcgtgctgctgcttttatttacgatcaactgtgccattcattactgactaggccaacctaaaagtggctatccaaaaacgactgcagcttgcgtgcaatcacgcgatgaccggcattgttcggatgcaaagtatccaccgaataaatggccgcttgagcgggaatcgcaaacgtcattcccgcatcacgatacaagctcaaatgtgggacgccatagtccgcagtcatctgggcaatcgctgcttcataatctgactgacgatacccgagaccattagtcaccgcactaaaactgcccccaaaatcagagccaatatgaattgctgaaataaataacttcggcacggtcggccaattcgtctgtaatcccgtcagtaacatcattaacgcgccataaaatgtcgtcatatcgcaatcaccgtattgccctaacggctgatcccgaccatagtcattgacgcccccaaagacagcaataaaatcagcatcttcaggaatagcttgatagcgcgccgccatcgcatcgtagcgactcccaatcgttgaaccagagattcccaaattatcgctccgctcgacatcccaatcagccgccaaaatatcatgataatgcaccgtcgccaacccattattcgccgtaatcgaatctcccaaccacgccggccgcttaaaactaacgtgcccattactaatcgccatagccaatcctccctttactatcatcgctaccattctaatccatcccacctgaattatggtagaaagatgcctttatttaaagtcaacagccaccagcttaggcccgctggaaacagttccggttagcgtaaacctgcttagttcgttcgtcctacgctgccctccaggcatttctgccaat

SEQ ID NO: 74 - DNA, 9902 bp, Lactobacillus plantarum
gattaaatttgcaatctaccaaaatggcaaaaataccatcactgaacgcctgaaatcgatctgttttcaaaatcagcacctcccacagcgttttaggataccataactcacaagtaattactgtaattaacttttcaaactgacgaccaaaccgcttctctaacacctgatatggtaagattaagtcaaaataaagtaattgatgtgggggcgtcaagacgaatgcgaaaattattaaaaccaaagtggttgttcttatttttctggggaatcgtggtgtttgcaagtattctgattttaccgaacattaccaggtttgtgaatgaacaaaccgcaatgccacaagatgcaacaacgagtcctaaatatcaacaacaatggggtcacgggttaaccaacagccagtccttaacgttagtcttcaacaattcaaatggtaaattatccaaacagcaacgccaacaaatctccacgaccctagccaaacttaatcgccgagccgatgattatggcattaaccagcttcgaacgccaaccggtatgactaatgaccggcacttattacgttccaatgatggttccaccgaattagcccttgtcgccgttcagacatcccgggctgacctatctgtgattgcaaatcaacttaataatgcgattgcaatcgccgacctcaatacgagtgtcaccagtacggacttgatctaccaacaacacgtgcaacaacaacgtcgcaacttgctgattagcatgcttgtcggtagtctgctcagtttaatcattctcggcctcatcttccgctcactgttagtgccattactgaacttactgtgtcaagtggtcactctgatcacaacgattagctttatcactaacgcgcgtttagcttggcattggccactgacggctaatgcgctgagccttgctggtctaatcagtttaatactgactagtctattgacatggcactttatgtacgcgtattggcaatcgagcgcaccaaccgcaccgaccactgtcagtctcaaaattctgacacttcaatatcgacagtgggcacttgtttttatcccattaatactcataaccatcactttacactggactgccttcatctcattagccgctgcttgggccattactgtagcgcttggaatcaccttactggcggtaccgccgctcaattacgcctttaccgcttggctcggtgataatttattttggccaggaacaacggcttggccgacccgtccacgcaatctatggggccaattgagcaagttcggctactggcagccagcgcttgggagcttggccgtcgcactgttactactccccggcctcattcttgctaacggccagtttgccgatgacaacttacgaccctggcgccaaaatcagcttagtaatgctgaattaggtcagcaattagtccaagctcacttcggtaccggtgccacggcgccaatcacaattacactacgagcaccgcagaatttaacgcagcagcaatcattacaaacaatcgatcacctgacgactaaactgcgggccgtaccaaatgtggctcaagtcatctcagtgacccagcccaccggccaaccactaagtaatttctacgttaaccagcaacttgcgactatcaacattgatttggctggtaaactgacgagtatggcgaaactcaagagccaactcacgactgaccaacaaagtctggaacaagcagcgactagtcgccataccaagtcggtcgaccagttgtccgaccgcatcaatgatttggctgaactgaatgatcaagtgcaacggcaattacaggctattgacacgacgctaacgacatcagctgaggctgaacccgatttaaccaaagtcaatcagcaggtcaccaagttagatcacctgactgaccgcatgacaaccgcactaaatcacgtggtaacggcccaaactacggtcgcaaccgaagctggacacgttgatcagcgtgttcaccacgtcaaccaatcattgaagcagaccgttcaacccttaaccaccttactcgcttcactgaaaaatacgaagacctatctacatgatttagccgctagtcaagttggccggagtttttacctgcctgctaacgcggctactaatcaggcctatcaaaacagtctttttactaatattagtagtgatttaagcatgacacagctaacggtcactttgaaatcagcgccggctagtgcggctagtcgcaggaccctgcaacgacttcaggcagtcacccacgacagcctactcgccacgcccttagcgcacgccaaaatcctaacaaccggggtaacacagcaacagcactatcagcataccctgattgcgacccacgcactgagatggctcacactcggattaatcatcggcatagttgttttatggttcggcctgcgttcattgaccttcagtctgttaatgaccgcgtgcctaactggcgtgacgttaactagttggggttggactcagttaatattaacacgctggttgcaaaccgggccgctcagtagcagtgtcttgcttggtagcttgatgttgttgacactgcactggctaatgattaccaccgcaaccagttaccgtcaaagttggttacgacacttggaacccactcaactgcagcaacacttttatactagtggacgatttgtttgcccggtaacaatgattgaattgacctacttactgccactgcttttgacgaccgcaccaaccttaaaggggcttgcactcatgagtctcattgggattacgataagtaacctcatcgttccattgggattttcagggtggacacgttgggctaatgagccaccagctatagccacgctttggcagcactttcgcccatcatctaccaaccgctagcaattgattagcctaatctttgagtaaaaaaaattgcttttccagacgtcaaatctggaaaagcaacttttttacaatactaaattgaatcgtagcaaactgccagtcgtttatacttaatgattgtgtgagcaccggtaatctgatagtcaccgctgactaactcaatatcgtcatactagcaacgacaaagactaataaggtcatcgccatccgccattcactgtgccaaagattttgcgtgtgccaccacacagctaacaatctccacatcagctaactagaccatattgcttaatcgtaactcacacgatgattcaaatttattgattgaaattctgaactgaccccgtaaacaatgttagctctacacataaccaaaacaatgccccagaaaccataaaatttctggggcatcatcaatccctacatgatactttaataaatcaattcatgcgtcttcaagcacgacggcgataaccgattcccaccgcggcaattaacaagcccaaaagcccggcaaaaatcacccaaatcggcgactgcttctctctggtttgcggcaaagttccgtggttatagccagctgatgtgctttggtcactaccagttggcgttccaaagccgttcataccagttgtcacaccattatccacagtgccaccagcaccattgacacccgtgcttggttgcttgatcagtcctggtaatgccggttgacctaatccagattgtcccggtttaggtgcagcgggttggcttggaccgggtacagctggtcgttccggttgtggcgcggttggccccgtggttccagggttacctggctcagtcgttcctggttcgcctggtttgcctggtttacttggttcagttgttcctggttcacccggtttacttggttcagttgttcctggctcacccggtttacttggttcagttgttcctggttcacctggttggcctggttcagttgttcctggttcacccggttggcttggttcagtcgtccctggttcagtgactggttcatcagttgctgctaccgttaccaccgccgtttgatccggcttgattgtaaatggtaacggtgccgcattaagctgatagccactaggcgctttagtctcaacaaattgataatcgccagcggtcaaaccaaatacagtaagttgacctgtggtatccgtcgttaatcccgtcttgagcactttgccagtggcatcttgcaattcataaacggccccggctaatgccgccttggtcgtggcatcagtcttggttaacgtgacatcaccagttgtcggcacaactggttgcttgacatcatcctgactcacctgaaaagcaacttctggctcaataccgccgagagtaaattttactggagtggtattcaattcatacccaagcggggccttggtttcaacgaactgataatcaccggcacgtagatttttgacaatcaattgtccctgcgaatcagtcgtcaacccagtttggattaccttgcccgtactatcttgcaattcataaaccgctccagccaacacggccttggttgccgcatcatgcttcgttaattcgatggtataggtcatccctgctgttccattgccaccataggtaatatcggccgtcgcatcaacgcctagtccgtccagtgcagccgtattatgccatttagctgtgtcagccggattaaaattctcaaccttagtgttataagtaatcacaaacggcgaatgaatgttgttaaacgtaaaagtaatcacgttaccattagttgcaacagtcggtgttaacggttgctgtggcacttggataccattgataatttgcacggcctgtgccgcaaccgaatctggaatgaatgtctgattgggccctagcgtatctgtaaccacaaccgtcgagttattgcccggtgtcacggtaatgtgccaccccaataccgttggcgcaccatcacttcccgacgaaacaaccaagccacttttagcaatttcggctgatccttccgtcgccgtcgcattgcccttcgcattcatgctcagtgtgccagcccgactattgagtgtacccaacgcatccgtaaacgtgatcgtcccagtactggcacctttcgtatacgtaaacgtgcccaaggtttgcccagcagaatctgttaacggcatcacaacatcatgatcgatactgacgtacgttggaatctcaacggttgctgtatcaccggccttaatcacttcagaatctggaatactccaatgatacgttaattggtagccagccttatcattcaacgtacttgtgtcagtaacgggcttgccattcgcatcaagtacgatggcattgccagccgttaaacccgtaacactgatttctttagcatgtgcagtactccccagcataaatagcgctaatattaccgtcaacatgcttagcatatacccaactagctttcttcgcatacgctcctcccccattcaaaaaaagctttgtctttgtcattctcacaacccaacacaccctcacagtcgcgtatgattgtcagggtcggccaccagttagtgattcacgctaatcagctccatatgtacaatactgcaaccaactagtttactacgaatcaaaacttttatttgcgaactatccgaactaatcgtttagcaaaaaaggcctctagaactatgcctagaagtctaccggaaattccatttacattgtctcgctaaaaacagccacaaagctaagccttaagttgaaggcccctttattctggaatatgactcgaatcaacaacctaaccaactgaaagttacgccaatatgcttacgataatgccaatatcatcgtctgatgtcgcaaacccgcctccataaacgggcgcccttgtggctgataccctaattgtgtataaaacccttgtgcagtgacttgagcgcctagtaccaactgtcgccaaccacggctcagcccatccgctgcaatacgttgaagcaattgccgtgcatagccctgccctcgcgccgctttcaacgtagcaactcgttgaacatgccccgtccattggtcgctaggtgtcactcgcgctgtggctaccgcctgcttttgatcatcatacaagacgtagtgccacgtcgctggagtgaccatatcaatttccaaagtttcatcgatatgttgttcctgcacaaagactgcccgccggattgcaatggcatccgcataaactgatgaatcaacctggttactcatttttatctgcatcacgttatcacccgttcttctgaaatactttgagaatacgcgtttcaccggttatcgtcaaactaactcgaaacgaaattaacgcattcttaaaattgttagcgattacgagttccgatgttatgttaaaatgatttgatgactggttatcgagtcatatccaaatttgttaaaaatgaggtctttatcgatgtttaccaaatttcgccaatacgttaacacgcgaattggatttttttggctactagtcttcttattctgggccaaaacgatctatgcgtacttaaccgaattttcactaggcgttgccgatccactccaggcattcctgatgctcgtgaacccgattgcaacgacggtctttctgtttagtctggcgttctacattcgtaaaaccggtgtatattactatattttgctattcattgatgcactcgacaccattttactgtatgccaacgttatctaccatcgtgaattcacggatttcatgactgttagtacgattaccggcgtgtccaaggtcagtcagggacttaccggctcatcgttagccctagcgagttggggcgatgttctttactgggcggatattattgtcattctggccttggtcattcttcatcggattaagcaagacacacgaccaattaagaaacacacggcctttgcgtacacctctgccgcgattgcaggtttcggtcttaacttgaccttagcagaatccaaccgaccacaactactaaccagaacgtttgaccgcacttatatcgtcaaatatcttggtatagatgcttttacagtctatgatggtatcaaggatgaacagaccaatcatcaacgcgccagcgcaaagaaatcagaattagataccgttaaagattatactgaatcacactatgccgcgccaaacgctaagatgtacggtctggcgaagggtcgcaacgtcattgtgattcatttagaaagttttcaacaatttctgattgatcagaaagtcaacggtaaggaagttacgccgttcttaaataaactgtatcatagcaactcaacttacagttttaagaactttttccaccaagttggtcaagggaaaacttctgatgccgaaaatatgcttgaaactagtacttacgggctctcaactggctcattattctcccaattaggctcagataatacgttccaggccgctcccgcgattctaaaccaacgggccaattattcctccgccgtcttccacggtaacgtggccagtttctggaatcgaaataacacgtataagaatatggggtaccaatatttctttgatgccagttatttcgatacgactggtgataaatcaactggatatggtctaaaggataagctgttatttaagaattcagttcagtatcttgaacggctacaacaaccgttctacgtcaaatacatcacggtaacgaaccacttcccattcacacttgataaggaagacacgacgtttaagacaacggatactagtgattccgccattaacggttacttccagaccgcccactacctcgatcaatccgtcaaagaattctatacctacttgcaaaaggctggtttattaaagaattcgatgatcgtactctatggtgaccactacggcttatccaacagtgaaaactcgaccttggcacctattcttggtaaatctgcggacgattggacttcctttgatagcgcccagcttcaacgtgtgccattcatgatcaatattccaggaatcaagagtggtaaagtcgaatcgacttatggcggtgaaattgacgtcctaccaacgattctgcacttactagggatttcaagcaaacgttatattcagtttgggaccgacctcttctctaaacaacacgatagtaccgttgcgtttagaaatcgcgatttcgtcacgtctaaatacaccgtccttagcggcaaaatttatgacaacgcaactggcgaaacgattgatgatgatgaggcagttcagaagactgttgataaagatcagaagaaagtcgacaaagaattaagcctctctgattcacttaacaataaaaatttgttacgtttctacacccctaagggcttcaagaaagtcgacgcttctaattacaattacgccgatggccttgaaaaagaaattcagattcaaaataaattagctggcaagtcaaccagtctctactcgaagaatggtaataagtcaacagactcgttgtatacgaccgacgcaccggaagcttcgcataagaagactgattctactcgtatcaagattaccaaccctgatgatacggatagtaccacgactagctctagcagttccaaatagcaacaagcattccatttacaatgcaaggcgcgacggcaatttatttgccatcgcgcctttttatgatctcctttaaatatgacgctgccctcacccatctggcatcgttttcatgataaaatactgattacggcttgtctcatgcttgcgcattaacgatgattacacgtgccatctcttaagttcagtggccgttcatcagccattcgcacggattaccgaaacgtgctcggtagccccattatgcttagttgaaagtggtttcctagagtgactaatctaagcaattatttagataaaaataactaacacaatgcgtgttacaataaaattaataatgacttgattcgtcaatgccggatcaagggaggaggcaccacgcatgggcgcttggcgtttttggtgggatagtacccgccgtttttataagaactggggcagttacgttgccctgatatttagtaccaatttggtcattagttacctagcaattcctttttttaattgggtgctagaaatgttactcaagtggcaacgggtcagttatgtctcgtacacgaatatcggtagtattattattcaccaaccactggccgcactcggtatggtggcgatcttattagccattattattttagtttattggcaatttgcctttctgctactgggtattatgaatatctttcgtggtcgaccacaaactgtgtgcgcggtcttgcggtcaacggtcactagtctgactggcacctcacccagcactttcttattctttatcggctattttattgtgattttgccatttggaagtttcatctttacaacaccattactcaacaaggccaaaattccagccttcattgtcagctatctcatggaaaacccgtggatgacgctcggcttggggtgcttctacttgctggctggttaccttggaattcgcctaattagcctattaccgctaatgattgtcgatcggcttccatggaaaacggccgttactcgtagttggcaacaaacgcgccaccatctttggcgctacttgtggaccatgattgtgaccttatttatgatttttctgatcgttacgaccatttatacgttgatttacgtcgcccagcttcaattcgataaaacaagttttgccatggccgctgccactgttaatctctttatcatggaagcaatcaccgaaattattatttgttataccacggccatcttcatgatgttaattattgtttgctatcgtcaagactttacactcctccgccaacaaccgcaatactttaacgaggcaccacggttgcgcaaattgacccgggcgagtgttgcaattggcttgctgttagcaacaagtttgctagggtccgtctgaaaacta

SEQ ID NO: 75 - DNA, 10781 bp, Lactobacillus plantarum
acaagatattttacgctctccattattgtgggagaaacttaactctttaattaatattggcttcaaataggtataaatgatataaatggcactaaaattaaagaccgggaccagaataccccagatgattcttttgtcttttaagatagctaactgtttgaatatattatgtgttccattttgtgttaaattatgaggtagcaaatagaaaactacgatagtaataaagactgaggcaaaaaaaattgtccaaaaagttaatcgccagttaaggttatcacttatccaagtacctaaaggtacgccaaaaactgaagcgatactgaagcctgagaacacccaagatattagccaagctctttttctctgaggagcaattgcagctgcaaaggtaacagcagtcgacatcagaggcccagatgatagggctgttataattctactcataagtagtacattaaaattactagctatagctgtcaataagtttccaaatgaaaaaaacagcataaaaaagagcataactttatgcaaagcgatactaccaatagataagttaattattggtgttgcagctgcataaacgattgcaaatatggttacgagtgccccaatgtctgcgatagaaactctaaaatctgtcgataaattatttataattcctattataataaattgactcaaacccattgtgaacgttagaaatgttaataatatgcattgaaggttgattttctttttcatatgaccaccttattaagagatacactaaaaaagttatataaaaagccaattgtttgattaacatcaaatgaaaaatgttatcaaaaagttggctttttcctaccgtttatgtgcaattaaatcatgtaactgtttaaaatcaggaataagatcataagcgtgagttttagcttccatgaccgcgtttatttgttgtttaatcctttcggtatcttcctcatcggtataactaacccagttgatatgctctaaccaatcaatataggcatgctttccttttccataactatttccaaataacaagcaaggtgttcctgttaaaacggaaaataccattgcatgccagcgatctgtaataattatttcctggtgcgagaatagttctagttctgaatcaaataatgcctcccgagtaacaggtgttatcttttgtggttcgtctagaactgtatcaactctttttacagggcgttcatttcctaaaatatcttttatattgtcaatcgtactttttttaacaactttttctgaatcatgccgtaaaacgaataaagccccatttcgattgaacttccagttgacagatttcatatataaaaccatatcaggtgtaaaaatgactttattgttgaaagtagtctgcattctatggtaactctgtgcatctcgagctactagaactaaattggggtttttttggtaagcctcttgacttaacttttgttcataaagtccagcttcattgtcttcaaaatgaatagactgtgggaatgagatggttaggttatcagtaaaagttgaaaatacttttcggcgtgctcgctcatgattaagataaagatttcccatgtttccgccaccagtaaaggcaacaatgtcttgtttagttatacattgcttaaccactggaatagccgcatcatcatcttcctccactatttcaatatattggtactctggaaactcagcttcaatatattttcgttcggctaatgagattgcctggtcaccaagattggtgtagctaggaacaccaaacataaaaaatttgggctgattatttttaggcaattcgtgtacaacgttattaggattgatataaaagttagccatattattttcctcattttaattttatttgctggaactttcctgataggattttttcattttctcttgattaataacagtcaaggaaagaattaaactgcacccatttgttatggcaaatacaaaaaagacagtggctgttcctaaagcattaattagcaatgggtaaactaagctaattgaaaaattagtgatccatgtggttgctgtagcaattgacataaatctagctttgacactattagggaacatttctgccataatcaaccaagtaacagggctaacaataccttgatggttcgctagaaataggacaagcattgctagaaccaaagtatttgtaactacctgtggcagcatgtttgcgtgcataataacccctaacaacgctaagaagataatattacccgttaacccaatttttaacattttcagatggttgtgattggcaatcattctggttccaaagatactagcgatgacagatgttaagccgattaatatattcgcatacaaagaaccacgttctcccataccaaccttttctaacaagatagtgccataatacataactgtattaacacccgatacttgttgaatcaaggcaataacgattccaatcaagagtaagtagactaatcgtttattcgaaaagatttggttccaagcgagctttgtctctgttttgatattctttttacgcccatcaatgatcctgttagcagtttgttttttgaatcctagtcgatgagctaaattacgtgctctttttaaatgccctctttgtactaaccagttaggacttccagcaatattgaatgaattaatccataagataatagaggggacacatgccattaaaatcataacgcgccaaattggatcccagtcaccccatagactgcctaaaagggcattcataataaacgctactagttgtcctaaaacgataaaaattgcattcttattgacgttgctagcacgaacctctcttggggatatttctgcaagatacattggagaaagacttgaggcagcaccaacagctagtcccaggataaacctaaatgtggtcataaagatataattgagtgataatgcgcaacatacagttgccagtgtaaagataactgcaacccaacgaagtgtaacctttctgccatatttatcagcatattttccacataggaatgcaccaagacaagcccctaagactaaagagcttgacacgattccctgacgggaaggagttagatttaattggctagtcttgctcataaaagccaaagctccattgataacaccagtatcatacccaaataggaatcctcccaaagatatgacgtaaacactgtagtttaataatccatattttctgccacttctattttgcatggccaatttgtccacttctttcagcttgttaataattagagtggctttacatgaaattaaagtaaaacatttataaaaaagccaattactacagtaactgaccagctaataacaaccatggattcatttaaaagattgttaaaaagtttaaaatataggggaaaattatcttgtgctacgacttaaaaagaaagaaactactgcaacaacaattactgctccaataattgaaggaataattgccattccggctaattgagggccccaagatccgagtatagcttctccaatagaggaaccaactaatccggcaacaatattagcaatccaccccattgattttcctttgctagtaattgctccagcaatagcaccaatgatggcaccaataattaaaacccataaccaatgcataaaacatcatcctctcttatttttcgaaggatgttttttagatttgttatagttttgaatttctttaaaaatggctaataaaagttgagatatagaaatgataattgatatttttgaccaaagtctaaatcttttcatataaaatcctccattatctaaattgcatctttctaaatctaattataggcaattgaatatttgcatacaagttattcgattgtgccattctttttaaaataggaatttttgatttgcctttttctcaattacaggcgttaaagaataattgatttagttattgcacttacaaacaatttagtctacggacttaaaaaggagttttgatgatgaaaacaaatttgcaattttttgctgatcctaacccagaacctaagccaaacgattccaacccgaatcctgatggtaaaaatccaaagccagctggcaagacctacacacaggatgatattggaaagatgatggcctctaaggctaaagaagtagaaagcaatctgcgggatgattttgaaaagggagcttaagcaaaaggaacaagaatggcttgaaaagggtgaaaaacgagccagcatgaatgctagtgagaaggcccaagccgatttagaagagcaacgacaagccttaaaagaacagcaagaccgtcttcaagaaaaattagatgaagctgatcgtaaggatgctttagctgcaactaaaactgttctaactgacaagcacattacagctgaatttgcggagtttattagtgatgttaaagaagatgttcgtaacaataacttagataagtttacaaacttatttaaccaagcagttcaggaagctgttgaaaagaaagttacgggtaatcaatcaccacagaatggcggtcaacaatttaacgcttctatgacacgcgaagattttgcgcagatgagccttgaagagcagactaacctttatcgtcaaaacccagatttgtacaacaaacttaaataggaggtgtaggtaatgaccgtaattaacggaaaccctacgaattttagtaatttaattgaaccaacagtctttctagactggatctatcgtcaaaatactcaaactaatcgatttgttcaatctggtgtgctaaaaaacgatccagtattaggtggccgattgcttcaaccaggacgatcagttgagatccctgcaatgaatgatttaagcggtgatgcagatgaatggaatgatactaacgatattcaaactaatggtgttgattctgctatggaatacggcattaagatgtatcaaagcaagtcattcggtaatactgactggggagatttaatttctggtgcaagtacccaacagcagattgctaatcgctttggcaactggtggactcgccaagatacaaagattcttttagatactgttaaagccacttttaacaatactgatatcgcgactgccaagattaaacgccgcaactaataaaacaacaaaaaagatctcccacacgaggagatctccaaaagatagaaactatccttcaacaccatttgacaaacttccagaatatcacggctatcttaaaactgtcaaaaacgaagatttcaaattaactttttcaggtatcatttatcaataaattctaggtgaatcctgagttttagaccaaaaagcccttcagcaccaacaaatcactatgcaatatatctattagtgccgaaaggcttttgttaaaagacacttcaaatagtgattgggattttttcctttgaattcggtggcctacttgttttgcttagaaaaattggcgcaaaatatcttttagtggtggtagttcaggtatttttttctcttctttaagatattggctgccaaatttcatgtatcctttagcttcctgaccgacaatcttgcccggcaaaggtgcatcatcactgacataagcattgatcagtaccggcatattctggacccgataggctctgttcaatgcgttcttaaattcttcggaagtgttagcagtaatgccaacaccgccagccgcatcggcaaatttggcgtaatccatatcctgtaagtcgatttgataatttaattggccggcggcctgttgttcgtattcaataaaggccagctttgaattattgagtacgatattaattaatggtaacttgtatttaactgccgtaatgaaatcctgcatgaccattgcaaacgcaccatcaccattaaccgagataaccggtcgatcgggataatttatttttgctgcaatcgctcccggtaatgcacatcccattgtccctaagtaagaggacaagataaatttttgtgttggtgatacgtttaagaaacgggcgctccaagaggtggctgttccaacatcaattgaataaattgtattaagcggtgccgtttcattaatatcgttaaataatgcttcgggtgcaactggcttggaatcgagttcacgtttgccggtcatccaacgattccagttagcaacactttcctgacaggcctttaagaaaccatcatcaggatggaggatcgttgtttcagaagaattaagttgctttataacgtctttgatatcggctaccaatccaacatcagccggataacgttttccgattgctgacgcactggtattgatttggatgcttttggccgcccctggtttgggcaagtacgcggtatagggataatttgtgccgaacattagaagcagatcggtattttgcatggcttcataagccggctttgtccccaacttaccaacatttcccagcgaattaggatgattgtcgccaatgatcccctttgcgggcaacgttgaaataaacggaatatggttttgctctaagaaggccgcaatctggctgccgactttttttgcccccaagccaaccaatgcaagcggttttttggaatcacgaattagtttagcggctgtattaaggcgattgtcatctatttgtggtgatgtcaattggaaagaagaagcggaactgatatagtggtcgctgaccctttgttccggaaggttatccggaatggttaaaactgcgactccatgtttctcataagccgttcgaatggcttcatcaacgatttcagctaaattgtcagtggcagaaattagtttattatagaccgcaacgtccgcaaatagttgtggtgtattcacttcttggaagtattcctcgtttaaaaactgggtatcaacctgaccaagtaaagccagtactggcacgtgatccattttggcatcataaaggccatttaacatatgaattgcgcctggcccaccgattgaaagacagacaccaagcttaccggttaacttagcctcggccgctgctgccaaggaagcaacttcttcgtgacggacttggacaaatccgatctgatcctgttgtttgcgtaaagcatcgacagttgtatcgatggaatcccccggtagtccataaacgtgttttacatgccaatcaattaagacgtcgactaattgttcagaagctttttgagccatattgcgtcatcctttccataaacgatgttaagaaagcttactttcattgtagacaatttaaatggaattgcaaaaactagaattattaattttacaatctaccaatttatcaaataatagattcactagacgacaaagacaggcctttaaaagatagcgataatagatatattttaagtcaagatgttgttaatgctatacatcaatattatgccaacaatacaaataaggataaacaagacaaaaacacgtcaagcaacgatcaattagttaatatacttagacgccaacttgacgaaaaggatcaacagataaacaaatttcaaaaattattagaccaacaacagtaattgaacttatccagtcagaaattacttgaaaatcaaaagtctgaacaaaatatcaaaagcaacaccacacaaagccgtgagaacgattctaaggacgatagcaatgattcagatacaaatatataagcaagcaaaacgaaaagccctctaatgagacgagagagaacttttggaaacggttgtttagataggttgtgaatattttttgagtagtatgggtggcttttttgagtaagttaagtgacagcattgattgttatatgattgtgtatgtcctaaatggacacaagcaacgctcctaagcaaagctcctaagcaaagcctgtatgtactgatttcaaaaaagccctctattccgcataatagaggacttttttgtgtgcattctgcttcatttaaacggacaagtatacgtctaaaaggtgaacgtgttgtctgagagcgcgtgattatttactttttagtttatagtcaagcttatcctttgtttccatcatcgataccaattcatcgtaagtatcacgtgtttggggagttagtgattcaagataactttcaatcatcaaagcaaccatttcactagctgaacgcttatcagctgttgctttagacaaagccaaaacggcgtttctggtatgattatcaactcgcatgtttacatcgaaggtaggaattttttccacactatcttcgccaaaacctgcttgctttctagaaattgatgatacatttacgtttaccttcttatcaggactttttacctgatcatcattaccgtgtttcaaaagtccccccatattattctgcctccaatctagatattaattcagtagcaacagccgtatatgtgctgtgagtagctttatcccaaacagaacgactgctttcagtgattccagtaaggtcgtatctctttactctttccatagcagtaatgacattttcaaatatgttgtcttccccaaattcttctacggcctgtttaagaacggcattgtcaataattgattgcccttttgtaagaactggaagaatacccgctacatctacttttgctccaaattcgtcaattaaatttgtttgtaaatagcttaagaaactttttgctcccagcaatgctctttgctgagtttgtagcataacaatgatccaatcgcagcacataaaaacgttatcgtttgttaaactcattgtagggcttacatcaagaaacacgaagtcgaatttgctagatatatttgacaaagagtttttaagatagctgactttagctttttcatcaatgtcttgtttatcaacccaccgactgaataagttcatatcagcagcagctggtattaagtcaagaccgttcttaatgttaatgatgccgtcatttaagtcttttccgttaattagtaatgcgaaaagagatggatcaattgtgatgttggaattttcgtgactttttgtttttatcattaaatcagttaggtttgcttgagggtcacaatctaccataagcactttatatcccatatttgataattcccaactgattaaggctgtagtagatgttttaccagtaccacccttttcattggcgcaactaattatcattttttaaaattcctccattcgtacacggtacacggtgtactgtgttatgtgtacagtgtaccgtactcagtacacaatgtacaggaaaaaatccttaaccattgaatgcggaatgacggcttttttatgagattatttaagtgtacagtacacagtacccaatacacggtgtacagtgtacaagatactgtgtactgtgtacggtttactgtacacaagaaaaattgactaaagatttgataactgatataatgataaccgtagtcaaaatagaacataaaaaacacccaccgactgtaatcggtgagcgccacataaaagtcatctaagttactgactattatatcatggccggtgcgatttttaaagccctaggggacaagctggggtctaaatccaaggggacacgtttgccagtgcgacttcaataagtctggctataccacaacaaggtcatctgtacggctgggtggtgaatggtgagcgcgaccattaacggcgcgggtggtaaaacgaagcttcggcttggtgccactgattagttggcgatcgaacaaaaataaatacgtattgccaacgcctactagggcgttttttagtaggttaaaccgaaaacgtaagtttataatgagtggtggtagcaataccgcaattgtacagacaagcgacgggcgttaacgaccgacgaactaaggggaaacttttagtagtagaattgtactctggttcagttattccaaatagctgattccagggaacaattctgcgctcaaaacgtcactccctctaaactgaatggaaaaccgtaacccgtcaagtcaaattccaaagaaaaaaagaaagttggtggaattgttggaatgtaaggattacattgttccattgaatccagatgtgatcgttaagaagacaatctatcggagttctgcaagaattacaaatcagcagagagatcaagtaaaaagagttttgcgtaagcaagggtatcaggggagaattagtagtattcgatatactcgggtaaattacaagtattcttttaaagtatccgtgaagtatcaggggagtgttggtaagtttttggttaatacaaagaatgagacagttgaatttaagggaatggtctaggagtaatcccagtgaatttcacaaactcattttccccaattaaggccaatctgcaacctataccacttcttttttgggcaagttcacaaagataaaataacggaatgtggaagtgccagggcgtgatgaggttacttgggataagccgccttgtgtgaagtagaaattggtatactaaaaaaggctcccggtttaacactggaggccttttttctaggttacatattttgaggatgaatgtttttatctttgtagcttttacttgggtgctgtaacatgatgaatactgcttagtttttggtgtcgtactatttgctgtttggtggaataagcaagcggctagagaatacgtggccaaacaccccgaagaagaaaagccggccgacaacgacaacagtgggttgtactactaatcctaaaaggctacaaaatcctttctaagcagttttaaggcttgccgacctccctttatacttaagttagatttaaatgtcttagaacgtgtttggatactt

SEQ ID NO: 76 - DNA, 9526 bp, Lactobacillus plantarum
taaatttgcaatctaccatatacttatatggctattaacatttttgagattcggttaggaaaattcggcgttctaggctacaataatgcaagagttaattttacggaggagaagcccatgaaaaataaggcagtcacaatcaaagatgttgcgcgccttgcagaacgctcaattgcgaccgtgtcacaaattttaaacgggcatggtgataagtttagtgcggcgacggttgctaaggtggaagcggcccgggatgaattaaattatgagcccgattactttgctcagcggatgattaagaagaccagcaaaacaattggggtccttgtgcctgatatccggaatcccttttttggtgagctacttcgaggcattgaaaatgtcttgtatcagcaaaatttcatcacgatgttgtgtaatgctgatctggatgaagacaaagaacgcgtctatttggatgaactcagccgccggggtgtggatggctttattatcgcaagttcggccgtttccaataatgcgattaatgatattctacggcaaaagggtcacccatttatcgtcttagaccaaaagcgcgccgaagggttcagtgattctgtgttgactgatgactatgatggggggcggcaagctgctcaacacttaaaagatttgggacaccggcaagtcgccgttcttattccagcaaaaccgtcagccaatgtccaaaagcggcttagtggtttttatagtgtgtatccgcggacagcggtacatgtcatcgcgacgccgctttctaaagtgggtggtcgccaagttgttccggaaattttggcgactggggttacggggatctttgcagtcaatgacgaaatcgcattcggtgtatacttaggcatggctgaacatgataagcggataccggatgattacagtgtcattggctatgacgatgtcgaaatgtgccaatatgtcgcgccacagcttacaaccatcgcacaaccgatttttgagttggggcaaacgacagccaaccagttactcgaccgtattgctaatccgcagcagccatgggaagaacaccacttaccagttaaattaattgaaagaaattcgacggcacatttgaattaattattcagatgtgttatattttttacgagttattaaaacgttttcataaaacgttttaataaaaactaaattcagattaatttaactatttggagggaccattatgaatacggtaaccgttattgggagtatcaacttagaccggacgattcgggttgaaaacatgccaaagcctggcgaaacgattcacactaaggaaatcttttcagccggtggtggtaagggcgcgaaccaggccgtcgcagcgcaacgttctggtgctaatacccactttattggtgcggttggtgacgatgctgctggtaaaaccatgcttgatttattgacgcaggaaaagatcaacttggcagggatcacaaagatgactaatcaatcgacaggtcaagcttacgtcacggttgatgatgccggtgaaaaccaaattatgattcatggtggtgccaacatggcctttacgccagcagacgttgaagcccaccgtgatatcattgaaactagtgattttgtggttgcacaatttgaaagcgctgtcgatagtacggtcgaagcctttaaaattgcacaggccgctggcgtaagaacaatcttgaatcccgctccagccatagaaaaagtccccgctgaacttttagcagttactgacatgattgtaccaaatgagacggaaacggaaactttgactgggattgcaatcaccgatgaagccagcatgttaaaggcgtccgctgcattacacgccctcggtatttcagctgttatcattacgattggtagtaagggtgcgttttatgatatcgatgggcgacatggtatcgtaccagcttttaaagtcgaagccgtggatacgacttcagccggagatacgtttattggcgcgatgagtagtgtgttaaataaagattttagtaatcttgaagatgcgattcgctatggtaaccgggcgtcatcgattgccgtacaacgtttcggtgcgcaaccatcaattccttataaaaatgaaattacagccgcggagggtaaataattatgaaaaaaacaaaagttattaattcagatttgccacgagttattgcaacgatgggccatttcgataagttgagtattggtgatgctggcatgccagtaccaagttcaaccgaaaaaatcgatttagccgttgataatggtattcctagttttatgcaagtcttgaataacgtcttggaagagcttgaagtacaacgaatctatttggcagaagaaattaaagttcaaaatcctaagatgttgacggccatcaagaagcgcttaccagacaccccaattaccttcattccacatgaagaaatgaagaaggacttggctgactgcaaggcctttgttcggactggtgaaatgacaccttattcaaatattctattggaaagtggcgttactttttaaagtagttggtgattaatggagggattggaatgaatactaccgctttactaattggcttagggccgttacttggttggggactttaccccacgattgcgtcgaaaattggtggtcggcctgttaatcagatcttgggttcaactattggaacgttaatctttgcgctgatttatgcatgggtgcaagggattgcttttccaagcggcatgaatctctggttttcaattctatcagggatcggttgggcaagtgcccaaatcgtgacatttaaagtgtttacgatggttggttcttcacgagcaatgccaattacgacggccttccagctgttgggcgcatcactgtggggcgtcttcgccttaggtgactggcctggggcaatggacaaggtcttgggtggcctagccttagttggaattatcattggtgcctggctaacagtgtggtctgaacataaggatgcaggtaacgcccggaccttacgccaagctgttatctggttagcagttggtgaaatcgggtactgggcttattcggctgcgccccaagcaaccaatattggtggggaggaagccttcgttccccaagcaattgggatggttattgtttcgatcgtatatgccctgttcttagcatcacgaggtgaaaagttagccctcgttgaaggggtgtcatacacgcacatcatctcaggtttcttcttcgcgtttgcggcgttgacttacttaatctctgcgcaaccaaatatgaacggattagcaaccggctttattctttcacaaacctccgttgtattggcaacgttaaccggtatttggttcttaggccaaaagaagactaccaaagaaatgtgggtcacgattggtggactgatactaattattgcggcagcagctgttacggtgacgatttaaaacaaattaatatggctacaagactatttaatagagtcgctttgaaggagttatacgcttctttaaagcgactctatttttacggttattgattacaatggtcgattacaaaatttgctttatgatatggcgataatgaaaataattcggcataatatttatagtttatatcagacatctaaatgtttgatgaatcattagtccattaatttaaaaagccaatgaaaaaagagtgcattaataatgtatgcgctttcgtatatatttatctgtgaagaaaagaaatgattaaggagcgattttgatgaataattcatggattaatatttcgggtaaggtatacgttgttactgggggctcatccggtattggtaaagcaattgtaactgaattattgaataacggggcgattgtttataatgctgacctcaatcaaggtgatcagcaaaatgataatttacactttgttgaaaccaatgtcacagatgcggaagcggttaatcggctggtcttaaaggttgttgatgaacaaggaaaaattgacgggcttgtaaataatgctggtatcaatttgccacgtttattggctgacgccaaggatcctcacggtaagtatgaatttgcagaatcggattttgtgaaaatgtttgccgtgaacgtgaaaagcgtcttccttgtatcgcaggcagttacccatcaattcgagaagcaacagtacggtgttattgttaatatgtcctcagaagctggacttgaaggttcacaaggacagagtgtttattcagcaactaagggagcgattaatgggttcactcgttcgtgggctaaagaattaggtgaacataatattcgggttgttggtgtcgcgccaggtattatggaagctactgggctaagaacacgctcttatgaagaggcgttagcttatacccggcataaaactgttgatgacattcgggcaggctataagagtacgtcaaccacacctcttggtcggagtggcaaactatcagaagttgcggatgcagttaactatttactatcagaacgtgccagttacattaccggggttacgattaacgttgcgggaggcaagagtcgtggttaacctttaaattttagttgggggcatggtgaggcaatggataggcaaagttttgaaatattaaacttttttattaataatgatgcattgacactaagagaattacaatcccatttttctgtttcgagagtcacaattaccaagaatattcgtgcaatcaatgattatttggtgggtattgcaaaaatcaacgttaatcaagccaagttttacctagttatcaataattattctgccatggctaagctacaaactaatttcttgaaaaaggatttagatttcaatgatccctcaaagcgacaagcaacgattttaaaagaattgttacagcaattcacggattacgttattctggatgatttggcagaatcattggctgtgagtcgtggcactatcaataaggatttaaaagcgctcaaacaacagcttgattattaccaagtcagaattgagacaaaaactaatcgtgggattcatttagcggttgaacatgattatatgtatgcagtaattacacgaactttagtcgggaaatactacgaactggaagcaacctgggataaagcgacagatgtcaaattgcttaatcttgttaaaaaacttgatcataataatgatactgtgaccatgattaaaagaaatattgcggttgttaattggttacgtaaatataacattcaaatcaatgatcgtattaataactatcatccacttcttagtgatgtaacgatggcgtccttgcggaatctagttactgagataattggtagctcgttaagcactagcgaatgggaatttatttcatacccattaaacatcagaaagctaccgaaggatgataatcagttagttcaagtgggattggtcgaagttgaggatttaatgcagtcggtttttccaatccttaagcaaaaattagatgtgaatttggactttaaacggttgttgatggagttgcgatatcatttattatttctcattaatcgggctatttttgatgtcaagtcagaaggatttatctcggtagacatgttaagtaagtatccagtttcaacggagttagcgcaattaacattatcaaccattgccactaaattgaatattcggattcgttcccaggaggttggttatttaacagtctattttcagatggagcttgaagaatacatggcagcgccaattattcatcgggttgcactagttgagcccattaatactagtatgaaaaagtttatttccgagaaattgaaagaaatgttagatgatgatttgcagattgatgtttttaactcaattagtgaatgggagcagagtccagaaaaatatttactgattttttctaacagttttttaacagataatgaattaattaaccacgcgcctattattcggttgaattctatttttaatcaaggaacgttacgtgaacgtcttcaaatttcgttggttgatgaagctgttaatcagggacagtgtcgatttgatgtcacgcagtttgaggaacaggagacctacgtcactggagtgaaaaaattaattaatcaagagatacaacatggttaactgacaccagattttatgcaagcttggcttaatagagagcaacaatcgagtagtatttttggtgatggggttgcattgccacacgttattgataaatctggactaaatcgaatccttgtaacagtaggagtgtttgaaaaaccggtagtattcgataatcaaaaggtaaacgtggtttttttggtcgcaattccgtataaactagatgcaacattaagcaaaatattagcacaagtatacgatctaattcgcagtatcacagctaacagcaatatttataataacttgaaaaattatgatgaaaatcaaggattaaatcagttgatggaggcgatttaatgttaatttattttggcgtgatcctagtcagtgcgtttctattacaaggtttccttggactaagacaaattaagaatttttctaaaacctttcatcaattacgagtgttagcgccagtagcaattggcaaaaatcctaaaaaattacggtcggggacactaattctattagcgataaaggatgacggcacgatcttagaggctcaaatgatgaagggggttacgatttttgcaaagtttagggaattgcatcaactgcggcagaaaaatattgcggaaattgctgcttcataccagcaattaaaacaattcgataagctaacgcgagtttgtctattggatgcctataagaactatttaaattacaaagcaaatcagctaacgccacaagatttcgatggtagtgtcaaaatttggagcctaccaatgattgaaaagctgaaatctatttattataaaggcttagcaagtttgcgaaaaaaacaagtgaacgtaaaggagcattaatactatgaaagtagtcacagatttggcctcgggctttatggggctgtttcagagcggtggtaagacattaattggatggatgacatcaattattcctgttgtgctattgctgttagtcttgatgaacgcgattattgcttttgttggtgacaagaagatggccaagttggccagagcttcgtcaaagaatcctgtaacccgttatttaattttaccgtttgtttcggcatttatgctcggtaatcctatggcgcactcaatgggacggttcttgccagaatactataaacctagttggtatgcatcgattgctcaattttgccacactagtaatggggtattcccacatatcaatccttccgagtatttcatttggttagggattgcgcaaggggttcagaagttaggattgaatacaatggatttggcgattcgatatctattagtcggcctagtaatgaactttatcggtggttggattactgactttacaacagcctatgtctgcaaacaacaagggattaccttgtccaagaaagttgaatttaacggctaattgagagagtgaggaacgagatcatggcaaaggaatatcatagtatcaaagttgttaaaggctctggtggctggggtggcccgctaattattacaccaactatcacgaagcataaatttgtttatgtcactggaggtaataaaccagcaattgttgataagattgctaagttgacaggaatggaagctgttgatggctttaagacgtcaattcctgatgaagaaacagcattagcggttgtagactgtggtgggacattaaggtgtggaatttatcccaagaagggtatcaaaacaattaacgtattaccgactggtaagagcggtcccttagcgcaatttatgaatgaagctaattatgtttccaatgtagatgttgatcagattatgttggtaacatctgaggaggcgcaattttctgatagtcaaaatgaaagcgctaaccaatttgaggatgtagatgacgatacgaaattcgataatacaaagacactaacagcacaaacaaaaaatcctgggatcttaactaagattgggattggtgctgggcgagttgtttcgacgtttaatcaggccgcaaaagatgctgttcaaacagttattaatactattattccatttatggcatttgtggcattaattattgggattattaatggctctggaattggtaaggtttttgccagtgtcatggagccgttagcaggcaatgtctggggcttgatggttttaggatttatttgctcattaccattcttatctccattgcttgggccaggcgcagttatcggtcaagttatcgggaccttgattggcgttgaaatcgggaaaggtaatattccaccacagtatgcattaccagcattattcgcgattaacacgcaaaatggttgtgactttattccagttggcttaggactagctgaggctgattctaagacggttgaagttggggtgccatcagtgttatatagtcggtttatcaacggcgttccgcgggtctttattgcttggattgcaagttttggattatattcaaaataaatttttagaaggtttgaggtgtattgtatgatgacaaaagagagaattatcttttcaacaaaggtcttagaaataggtgcggaatctgctgattttaaatcgattggcatggcagtattatttggtgatgaagctccagacgcattacggccttcttgctttattatcgaagttgtcccaataagtgagcaaatcacagcaggaatgaaacttgaagtcgacaatcaagtctatcaaattacagcagttggtggtgaagtccagactaaccttggaagattaggccatacggctattagttttacgggtgcaaaggaggctaaattgcctgggacgttatatgttgagcagggcgattatcctgattttaaagttggtagcgtggtacggattatagctgaataattaacttggcagatgttattttgctctgtgtcgagttgagttaaggtcatgttttgaaagcggtagttagttttcgaagaatggctagcttctaaacatgcagacattgttggaagtatgcccctgtaaaacatacactaattactaaaattgtttaaaaaatgaatgtatgagatactaactgtcaacagcgatggtggttcatcaaggcaagcagactagcgctgttgttgatctacaatgcgtttgaatcgtgattaagtggtaaaaagcatgagtttatgaccacttgaatgtaagcgtttgctatggtaatattcgtttattaaattgtgcgtaattaaattgtgcatgaaatgggggctttattatggttatgaaacaaacaaaacaaactaacatactagcaggtgcagcagttattaaagttttagaagcttggggagtagatcatttgtatggtattcctggaggttcaattaattcaattatggacgcattatcagcagaaagggatcgaatccattatattcaagtacggtagattgcaaatttaa

SEQ ID NO: 77 - DNA, 9208 bp, Lactobacillus plantarum
ttgaggttagttgtgataaggattaatttgtaccacaaaaggcctactcaattgttagttgagcaggccttttgtgggtattttgattagagctattaaccctatgctaattataaggcttagctttcaaatggaacatactattatccaaattatgatttgttaaggtggtgttgtcatagttactgaattgaatcaattgggcagaaacaagaaaaatttaactaagaccatggacaccattcaaaattaagggaacgtcatcctaaatctattgccaatggcgggaattgttgatttttatttatgccaactcgtgaccacatcttatcattggatggtatgaatgatgttgacagaaaaactagcattagaggcctccttattatatatagtaaaggatactaaacgaaatagattaaatatagtatataaaatcattttctaaagaaaatatggcctttgatccaactgggcatgattttcttcatgcccaaagagtggctaagctagctcaaaaaaaatatatagaagattaaaaaaaaaatgaaactgatattggtctgtatgttgtgaaagcagctagctatttgcatgacaccatagactaaaaagtcactgcagatagaatagactgagaggagtacgaattatacttagccatgagaatattacaactccggctagagaagacattttagatattatccaacatatgtcatatgctgacaacattgaacaccattatcagctttctaacgaaggtaaatgcgttcaggacgctgatagacttgatgcactaggtgcaatcggcatagcacgtgcatttgcttacggcgggcacgctggacaggaaatatatgattccaaaatatcagtgaagaaaatcaaaacacacgatgattatcgccatcacaaaagtacaaccatcaatcacttttatgaaaagctgctgaaattagcaagttcaatgaataccagaacgggaaagcaagaagccagtcgtcgaacaaagtatatgcgtgatttcttatctgaattccaaatggaaacaggtgtaaaagatgaaacataatgggcatctattagataaatcgtatttcgaaaaagtcgctgcactttttaataaaggacagtctgatcccctgctaggtgaggccatgtgaacatggaataatcttcaggaaggtttcacagtcaatgagcgtcttccagacactctcgttgatgttgctgtttggcacgtttttaatcgcgctcctcagctatatcgacaagcaccacaaataaaaaagccgccctgtgtaactttggtagaggtcacaggacgagctaaaatcgtttattaaatttctgccaccgcctttgaagcggcttgtctgagaagctccgttcacgcagggcttctttttcttccccgcattatagcatgcctttaattatccttcgactattttaaattaactttctaatagttctaggggacgcacgtttttttgtactaaaacaaaggtaaaaactagtagacataatcaaaatattttttgatcatgaaccgtacagtgtgctcttctcaattgataacaaggcctttggtgcaaactgtgagctgggtcctgggagcttgcttccattcattaaaagtcccgtttatcgtctcttagtgcagcttaaaataccaacggtgggcccattttagccacctcgcatgaatctttatattcaacacaatttgtagatcaatcagatcgtccactaatttgcatggataccatatatagtgctataatgatcgcctgaccactatatatagaaaaagggcgatgattagttacggaaaccataaatattctctacatcagtttgagcggcaacacgaaatattttattagcagactgacaacatactttgagaaagaacgtcatgttcgggttagttcaattaatgttaaagaacaccctgaattcaccactcttgaccagccgtttgttaccttcctaccagcctttcttaaaggtggtaatggggttaataacggttatactgaaatattaaccactattttgggagattacctcgcgtacgaaggcaattaccagcattgctacggtattatcggtagcggtaatcgtaattttaataagcagtttgcactcacggctaaacaatatgctaaacgcttcgattttccttacattaccgattttgagctacgtggcaccgcacacgacattcctcgcattgccgatgccattttaacctatcgcaatcaattttgttttcaaacaacgaaggagtaatccctaatggtaactagcaccccagaaatggaaaatacctatttttacttaaataacctcgtaaatatcccaagcaacggagaaattccgctacattatgatcaagaagccctaaaggcttatttcgaagagacagttaaaccgaagaccaagcaatttgattcgttaaatgccaagttaaattacttggttgacgaagattatatcgatccaagtatcctggaacaatactctcacaagtttgtgcagtccttgttcgaccaaatgagagaccatcactttcgttttcgcagctttctcggtgcctacaagttctacacacaatatgccatgaaaactaatgatggccagcaatttttggaagactttgtcgatcgcgtcgtcttcaatgccctctatctcgctaatggtgatgaacaacttgccaatgacattgccgatgaattgatttcacaacgttatcagcctgccacccccacgtttctcaacgcgggtaaaaaacggcgcggtgaaatggtatcatgttttttaatcgatgtggccgactccatgctctcaattggacgcggcgttaattctgcccttcaactatctcgaatcggtgggggcgtcggcgttaacctgtcaaacttgcgcgcctcaggtgatcctattaagcagatttccaacgcctcgtctggcgttgtaccagtgatgaagttacttgaagactcatttagctacagtaaccaactcgggcaacggaacggcgccggagtggtttatctcaacgtcttccatcctgacatcttacattttctggataccaaaaaggaaaatgcggacgaaaaaattcgggtgaagaccttgtccctcggtttgattgttcctgataagtattatgaattactcaagactaacgaaccaatgtatctttttagtccctatgatgtcgaacgtgaatatcgtacgccatttgcttacatcgatatcaccaaagaatataacaacatggccgctaaccccaatattaagaagtcagtttttaacgcgcggaaactagaacaaaagatttctcaactccaacaagaatctggttatccttacatcttgaacattgatacggccaaccaaactaaccctgtcgatggcaaaattattatgagtaacctttgtagtgagatcttacagcctcaagaaccgtcaaaacttgatgatgacctatcgtacaagacaactggcaccgatatttcatgtaatctcggatcaactaatatcatgaatatgattgactcgccggacttcggtcactcagttgaggttgctgttcgtgcgctcaccctcgtaactgacacaaccgacgttaaggaagtaccgactgttaaacatggtaacgaactttaccacacgattggattaggggctatgggtctgcatactgcccttgcacgccaccaaattgagtatggctcaccagaggcccttgaatttactgatgcctacttcctagctttaaactactattcactcgttacgagcaatcgaattgcccgtgaacgccacgaaaccttcgctaaatttgaccaatcaaagtacgctgatggcagttacttcgatcaatacttgaacgcagactttaaatttaagagtaccaaagttgcaaaaatcttcaaaaatattaaattaccatctgttacagattggaaggcactcaagcaagctgtgattactggcggcctttatcatcgtaatagactcgctgtggcaccgaacgggtcaatttcgtacgtcaatgaaacaagtgcatcacttcatccaatcacacaattagtagaacaacgtcaggaaaataaggtaggctcaatcttctatccagcaccttacctgtctaacgaaactttgccttactacacacccgcatatgatattgatcaacgaaaaattattgacacctatgccgtagctcaaaagcacattgatcaaggcatgagtctgacactatttatgcgttcagttttgaaacctgacctttacgagtggaaggataataacaatttaaagatgacaacccgagaccttaaccgattacggaattacgcctggacaaaaggcattaagtcactttattacattcgaacgtttacagaagacgatgaaattaaaacggcaaatgaatgtgaatcatgcatgatctaggaaattcacttggggtcttaccgtccgtttaacacaccggcatacgttattgggtcacaagacccatatacccatgaatcctaattaaggagacgaacaaataacgatggactacttatactacaaagcaattaactgggatgatattaaagataatttcgataaatacatgtgggaacgactcaccactaacttttggttggacattcggattcccatcacgaatgatcaaacggcttggcaacagctatcagatactcaacaacaggccattactcgtatgttggcaggtacatcaatgttagccgtctaccaatcagaagttggcacccctgctattcgccacgatcggcgaactcaacaagaagaatccgtattaaacaccattacctttatgaaatcagtccatgccaaaagctgtacgaccattttccgggctctgattccgggtaacggcggtgaaagttttacttgggcagatgacaatgccaatctgcaagctgaaattgaccaactagcccaaatgagcactagcgatatggccttacagaaaaaagccctttttattctgactgaaactgggctctcgtttggtaaatactggacaatacttcaaacacaggctctcgtcaatacttaccaaatattggctaatattctccgcggtagcgccctttttagtgcttatattggttacaaatttcgcctcagatttgaagaactcactgtaagtgatcaaaccgaactgcagtattggattaatacacagtttgatcaactcatgcaaactgaaaaagacttcttagaagctaaccttgacgatgccaccgaagccatcaatctggcctcctatggtgccaatcatgcattaatgtcacttggctttaacgctgtctacgaagttcaaccgtcttcactagtggcgcaactcaaagaactgatgattgaccaaaatcaatttttgcaacaggtaacggctgcaaacaatgaatcggacactgaaaaaatgaccgatgacgactacgacttttaaggagtgttcaactaatgagctataaaacaattaattgggacatcatcgaagacgaacttgacgaatatgtatgggataaagcaacggcacaatactggctggatacgcgagtacctgtttctaatgatttacgggactggcggacactctctggcaccgaaaaatcggttatcaatcgggttgtgggtggattagccttgctggacacactccaatctgaagaaggagtcgatgtgatgcggccagacgttcggacacgaaaagaagcagcagtcctcaatgactttttgatgatggagtcaattcatgccaaaagctacggcactattttgacatctttgaacgatcaagccactgttgacgaagtattcaaatggatgaacaataatcccagaatgcaatacaaagccaaacggatcaatgatatttatcaaacgggaaacaaccttgaaaagaaagttgcaagcgtctttcttgaaggaattttgtactacaccaacttttttaccccactttggtaccgtggtaacaataagctggcaaatctttctgaagtcatcaaactggtgatccgcgatgaatctgttcatggtacttacctcggctacaaatttcaattgggatataacgagctatcggcgactgaacaaaaaacattcaaaaagtggatggatgagttgctcgacgatctccttgagaacgagtttgcgttcaccgaagaagtttacgcgccgattgggttagcggaagatgttaaacaattcgttcactacaacgccaacaaggcgctccaaaatatgggctttgaatcccgcttccccaatgctgagattaaagatatcaacccaatcgtaatgaacggaatttcaaccgaaacggccaatcatgatttcttctcacaagttggtgctggctatctaatgggtaatgctgaagctatgagtagcggcgactatgacttctaacataggcttctaggcataattaaaatttaaaaaaggctaatatctacaggaaatattaaagtaaagcccctgagttgtactagtccctgtcaagttgtcatttgaaataatataagttttgctttgcttaaacggcctcattccagtattcagctggggtgaggtcgtttcttgctggtgaacaatctagttgattaaaatagttgatgccttcttcgaccaaggccactaattctttataggtaactggtttagcgtgtcgatcaatccagcgcaatttgaactcgttccaccaacgttccattggtgcgttatcatacggcattcctggtcgtgacatactacgggtgacttcatgttgcgccaaaaagttattgaatgttcctgatgtgcatgccgaacctcggtcagtatgcactacagggtggacgtcacccgcaaaattaaaggcccgttgaaaaacctgaacttttgccttcgaagtttcagtttcacttaatttatgggcaattagatggcgaccgtaaagatccagcgcgccgctcaaacgcactttatactgaccgttaacaccataggtcaattccgttgaatcagctaaccaaacctggtttggttggttaacgctaaaacgctgatttaaaacattatcttgtaagtattgctcctgttgtttgattcgtgaatgctttttctgacgaacctggcaacgaatgcctagcttgctcataatccgcttaacttgctttaacgtcacctgttcggtgacggccgggtcttttctgagattagataatattttggtactaccaataccttgatgatgctggttataccaatattgaacccgtccagttaagaagttatctcgaatcccccaatccgttacgttacgatgtaccctaatgtctccttcctgagctgtggtataatagatcaaacgtgtgagacattagagtgtgacacagtaacttttaaatcttaatcagatcaactagttgagtagttgcccagaaactgacgtcagaattaatatgataagaaggcaaatatatgaaaattggttatgctagggtgtcgtctgaaaatcagaatttagctcggcagattgaagctctaaaaaagtctggtgtagagaaaatatttcaggaaaaagtttccggaaaatcagttcaaaatcgccctgaattgcaaaaaatgttagagttcattcgtgaaaaagatattgtcactgttttggatttagatcgacttggtagaaatgctcaggacattactgacaccattaacttgattcaacaaaaggaagccacactagatgttttaagtttaccgagtttcactgatatacaagatgttaacttacgtggtttattaaccaatttggtttttgaaatatacaaatatacagctgaagaagagcgcaacaaaattcatgctaggcagaatcagggaatccaattagctaaggagcgcggggagtataaaggaagaaggcggcaatatagtccacatggatcaaaacgctacctatataaaagggtagttcaaatgctcagggatggaacgaatattgcacaaattgcaaggagtactggcgtacaacgacgacaaatttatcgtattaaagaatatgctttaaaaattggagacttaggcactcccaaaagggaagtgaatagctagggactacaggacaagttagtgttttttagggaccatcggtcaaataataaagcacttacattgataaaacattttggagatgaactatgttttttaaagattggacaaaatacaatagtttcgaattaattatgattacgttgggatgtagcatttatgcgttcagtctagatttagtctctattccaagtggcttggcagacggcggtctgagcggaataactctgattattcgtcatttctttcatattaacttgggaattagtactttatttctgaatattccattgatactaattgggttgcgctacttaggcaagcgcatgatggcttacactatttatggcaccatttgtttatcactatttctaataatatggtcacagcagcctctgatccaaccactaccattgagaaatgatttattattgtcatcactggttgcaggggtattatcagggttgggaattggtctggtttttcgttataacggaactactggtggtagtgatattattgctcgggttggccagagaagttttggattttcttcgggaaaaggaattttgattattgactacgtagtattagggctatcactatcatacttagatctgtatcacatcgcgtactcgctaattgttagtttcgtattatctaaagtaattgatatggtccaagaagggcccaatcgtgctaaggtattattcattgtatcagataaaagccaaaagatttcccaattaattgatgtttctttaaatagaggattgacatatttgcaagctgaaggtggttatcagcatgatcaaaagcaagtgatttatttggtggttcaaccgcgggaaattccacaattgaagcaattaattaaagcgattgatgaacgggcatttgtgacggtactggatgcccatgaagtgattggagagggctttagttatcaacgcaaaagataccatgttaattggcagcacagtaaagaataaaaattaatagacgttttaatatgaaaaaacggctataatctactagggactgtctgaaa

SEQ ID NO: 78 - DNA, 13704 bp, Lactobacillus plantarum
  misc_feature (9318)..(9318): n is a, c, g, or t
acgctgttcggacaaaaaagatcagcttcctttaaagggtctaaaatttttggtgttgaagagttcttcaacgccggaagttttaggcctttttagataacaaaaaacacctactccctccagtgttatgctttaagcgaccaaaccaaaagataaacgaggtaggaatagatgtctcaattagatagtacacgcaaattgcttggaattacagatacaaatattaatattcaagacgttcgcgaagacttccacggcaagggggctggtcgcaagaaatacctagtgatccgcgccgaactcacgtacacgctcacacactgcccacagtgcagtttccctgatcttcacaagaacggacacaagctcacccacatccacgttgagggcccgtcagatcaacctgtagttcttgaactaaacaaacaacggtggcgctgtttgaattgtcatacaacttgcacggcgacgacacccgttgtcaaagcgaaccattcaattggaaacaaactggcaatagacgccttaaaacttgccagtaagtcgctcacagtaaaaaccattgcgctacttctgggaatctccacgaactccgttcaaagggcacttgacgacaatatccatcctcacgccagtcgtaagctcccagagaatctgtgctttgatgagttccgttcgactaagtcggcgatgtctttcatttgtatagacgccgatacccacaaggccgtcaaagtacttgggggacggctcaataaggacatcaaggagttcttcatcaatcaatataatgtcgcgcaacgcgcggctgttaagcgtgtggtcatggacatgaatgtcgcctatcagctcatcgttcacgagcttttccccaacgctgagattatcatcgaccgcttccacatcgtgcaaatgatcggacgcgcaatggatcagattcgcgtcacaacgctcaaacaattagatgggaagtctcgcgaatacaaggtgttgaagtcgctttggcggctattccatttggctcatcccgacgccaagaagtctcgctatttgttcggcctcaatgaatactcgacccaacagaatgccatcgatcttggtactgcggtatcgccaatattcaaaactgcctatgagacttaccttgccatccacgaagccttgatggatggtcatcctcgtgtcctcaagagattaatcaccgaatatcagccaacaggttcggtcatggacactgccatcgccaccttgcgcaagaatctcccatggatcatcaacgccgctaagtcgccatactccaacggccctattgaaggcgtcaaccgtaagatcaaagaactcaaacggacctgttatggattcgccaaccaagcaaatatgttcgtccgggtctaccagctcatcgcttaagctttctaaaacaactctcaactccaaaacctttaccgcaacaccatcgccattgaatccagcctagtcccttgaacaattaaataacaaaaaagcctcccttagtcggggagaccttcaaagaataaaaactatccttcaacaccatttgacaaatttccgatgttttgaggcatcaacaagcttggttacatggctctttatctatatggtcaggctttgaaatgttccaaatctaagaatttccaaaaatcgactgtttggacaccgagcgccttggcgacaaaaggaattttaggttcactgggtgtcgctttcccgtttggtccggtattccgttcatcggtcacgatggcatagtcttcttgtttggcgcacgcaattaaccatggatctgcttttgtataatcaaaagtccactgaccgtatcctgccgcagtccagcgggcaggaaaatttcccatgattagcacagtggggcaaaatcaaataacggtttcaccagacattgcctaaaatgagtgctctaactcctaattcactcttcttgaagcaatgggaatatcctcgagcaagcttaattcttctacattaacaaaattcggtaaatatctagaattttgccgaccataattgaagatgtgtatttttttaaaaacaaatctcgactcttctcacccatcaattgtaaatcctcggaatcattcattaagtttgcaatccgatctgcaattttctgatctgaatcactcaatctaaatagtattccattgccgtctactaattctgcatgcccggttactttactaagcgccaccggtagaccagatcgcattgcttcaatcacagcaaatggtagtccctcatagagcgaagttgacataaacagactagctttctcaagaaacgcttgaaccccatcttggggtccaacgaaatctacaaacgataattttgaacactcgtcctgaagcttgggaagaagttcacctcctccaatgtataaaaatttaattgacggaatgattgcatgaactgaattcgcaatggcaatgaatctttcgggattcttctgtttgtcaaccctccctaccataacaatcaaattattatccttaaaactaaggtttggaataatgtcaggtaaaccgtttgggacgattcttatcttgtcctgccgtaccaaacggtaattttccgaaaattcagcctcttcactcgatacgtgaatcacagtgtcaaatcctcgcaacatccaccgctctatgtattgaacgacacggaacttgacacgtcccattggcttctcagaaaaaaaagcgtgaggtgtatagacatatttacgttgatgagttcgatcaaatagcaattgatatgtgcgaaccaccaatcctgagaatgtactatgtgcatgcacgattaagtaattgtgtaaacggatttgggcatggagttcaaataccgtcctgaacaaatttggtccctttgtacgatcaaaatacttagattgaatcatatgtgcttgaatcccactaagttttccaagaggccccacaaaaagatcagctctcatagaacacgaaggtgaaatcgcgttgatcaaggttttgacatgtgtatagactcctccgtcgagtctttccacgacttcaagtactttctttgtcgacatatctgccctcctaaatttaatacagaaaatccacgtccgaaatcaggatatcctaaaaagctttctgatgaatggaacgaaattattgccgaatatcttcgttaaaagcctaaggatgcgatctctcagcaattcgcctttagttcgccacgttccagaaaaccagtgaattgcatatgtgtttttcgttatgacaggttcatcagagtaatagtataagggcgagaaatactctgacgggaatacagttaaaccattgaattgttctggataaagtctatataattgatagatatactctgagtttggggtcatgtctaattttccatttgtttcttcgaaagatctcgactcgtactgtgcaagtatgaagctcagccaaccttgattcggttcactacctatgactgcggtacaaaacgcagtatctgattcaaagctcatcatggctttattctccaataaagtatctagcgacctgagtatttcaacatctgtatcaagatatataccgccatacgtgttcaatatactcaatctgaaataatcagtcacaaacgcccatctttcatgagataacgctgatctgacatactgaggtacatccgtaaaatttagatttgtttcattccactctatgatttcataatctgaaagtattcgacgccatccttccaccatggcagatgcagtcggatccatttctcggccacctagccatatgtaatggattttctttggaatcatcttgtattcacctcttgagcttatatatttttgatgcgtcttttcaactttttaagaaattttagggctatcattatcatataagcactcttagaactaggatcatgtctaaagtatgcatcttctaaaatgtttcttccatgaagtctactgtctgatgctagacaataaatgatattgatttgttgctgtatgctcgacagatgtttaaagtacgagtccttgttttccttagataattcgaacatgagcagcctttgatactgacgtgaaagtaagcggagttgatcacgattttcgcaaagtttgattaattccaacatcgtttcctgtagggcaacatattcagttgttgatggaattttgttcacactactgccgcttctttgacgataatgataggttggaaccatctgaaaggaagcacaaatttcattgcgtgccagtatatttgcaatctctcgcacgtcctccataaagttaaatgtattatgcagcttgcattcggcgaagagttcagatctaaacatcttgttccagagaaatccttttaattctccagatattaataatgatcgaagtgttttatcaggaataatatcatcggaagtgtaccctgaaggaagtttaacagcaactgctttgcgacgaaaatcctcgaaatacgctgtgacgaccatttgtacattgcgggtgaaaagttcctgcattcgataaagatggtcactttcaagaaaatcgtctccatcaacgaaagtcaacaactctccgtgaacaaacgacaatgccctccgtctagctgctgattgcccagactgctgctgatgataataaaaaaaacgattatcgagggcagaaaattcactcgcaatttgatgcgtatcatcagtagaaccatcgtcgacgattatacactcaaaatcctggaactcttgatttttgatagattggagacattgttgtaaatatttgccatcgttatgtgttgggattattatcgaaattttactcataaagccgtttttcctcctgaatttctctcactaaggtaaaaaatgactgggaaaaagataatttgatgacgcagacatgaccctaaatctggctcaaataacgcttgtactaagatgtatgaaagcaagaaaagtaaataaattgagcattctgttcttccatcaagcagctgcttaaatggctcttttagcaaaaacagaatcaaatataaccacgcataatacatgatttgagataaggcagataaatgaacgggaagaatcattataattgcagtatagccaatattagcaagttcataaaataaatttgtgttcttaaaaagactttgaatcatagattggctatttccagtatcaatccggacggcattgatactatccctaatatctagaatagaggatccatgtagtaaccggtagaaaacgagaataacaattagctcaagcactagaacaaaggtgattctgaaaacattgacaaattttgaatgtgttttcggaaagaatcttagtgaaaaagtcataataataattaaaaaccaatatgctcgaaagaacgctgcataaattaaagcacataataaaaatgtccaaaatcggactttttcatctttaatcagaataaatgcaggaaatattacaatcaagaatgcaatctggtccttcgccatctgagagagataagcggcgtaaaaaaccccccacatagacaaaaatagaaaatttgttttattacgaatccaagaagctttttttaaaaacaaactgagcatcgtaatgacaaagacgagcgctgcaacaagtgactcgataatgggactggtcgttgcagtcataccaaaaagcttatatactttggcaacgttcgtatatgaagagtccgcgatatagccattaagaatcgctcgaatcatctgattatcaaagaaatatttttcagggaaaatacttcttgagaagaatattaagaacagggttccagtaattagagctacaaacagaacctcactgataagtgcatcgtgctgtgtatcgatcttatttttagaaataacatgcattctagtatttcttaaacttctgttttccatatcgccaaaacaacttccttaaatatttttcgatacaaatcgtttgattctaattagtggctgttgaactaggctatgccataagatagcctccgaggatactcccgaaaaatgcacgagaaatgtgcgaaatcggttaaattctgtgaagttattgtaacacaataacgagctaattactttgtatccttgatattgttaatttttaaacaggcactaattaagaattaatcctattttcaacattgaactttttcactcccataattgacctaagttcggtggcgcaaatgatccaaatacggcgctatatagctaaacaaaattcgtggacgaaataatagcaaaacaataaagtagacgatcataccaagcaaaacctctactatcaatgcagtcatgcttgttttacaactgaactgccatccttttataaaaacaaacatgattaatgcactcaaacaatatttccatgattcgctgaatagctcaccaagggacagttgatttttaatagcgtaaatctgatagattgttactaccgattcggaaagaatcgttcctatcatggcacccatagtcccaaaccaaaggatcaatggcacattaacaatgatattaaccagtgcacccaagataactgaaacggtgtatggtttaacttgatcagttggtaacaagtattgcacaccaatggcacttgcaatcgaaattggaatcacgacaatggcttcaactgccatcaacggagctacaggcatgaacttgatactgaagaagtaataagtgaacggtgtcgaaacggcagctattccaaaagcaagaggaaatgctataactaaggtagattgtaaaattaatccgaacagcgttcggattaattttacaatctactattagcggaacgggtaagtaaagtcgcggctaagcccggggcacaagctatgatggacttattaaatagcgttacaccggaacgggtaaagaccctcacacctgatcgtggaactgagcttgccaattatcaagacgtcattaacactttagaaataccggtgttttttccagatccacacgcaccacaacaacgtggaaccaatgaaaacactaacggtttaattcgcgaatatttccccaaaggaactgatttgaacggtttaaatgaccagaagattatcgcacttgtcacagatttaaataaccgtccacgcaaggtattgggatggaaaagtccaagtgaagttttcttcggcaaaaggttgcgcttgatttgacaattcgtcacaacaaaaggacatatcgtcctgtgctacaatcaagtcgaccaaaacaaattgaagttgagcgtcaaatataccccaataccattcactcaccgttattttcaataaggcaggttcctaaacccatacttctatttatgaataataatcttcagcttattaattatttctgcctttaaaaatattaataaagcaacataagtaattatgcccacagtaatttctaacaggataaatatccaagatgtcggtgttaaccaactaatttcaaagacaattagaaacatcactaatcctgaaactaaatacttagataaacctgaaaaaagtgtatgcaaattaagctgtttatgaattgtaaaaagttgatacacagttacagacatttcagaaagtacagttgcaatcgatgcaccaacaacacctagatatataattagtggaatatttaacattaaattaactactgctccaatgatcaccgaaactgtatatgacttattttgattagttggtaaaagatattgagtacctattgcgttgctccaagctattaaaataattgcgattgactcgatcattaacacaggaataacatcactaaattgagatgtaaaaaaaagcggtacgaatttaggcgtaatagctataagcccaaacatcataggaatcgaaattgccgacacaaaagaaaaacttgcatacatgtattccttagttttaccatactctctatgtgcaaaggcatttgcaacacgtggcaacatgacagtacctgttgcagtagcaatagccaaaaccagtttaactattttatcagactgatcaaaaaagccagagctcctgacagaatccaatgaacctaacattgttttattcaaaacccaataaatttggacagcaacttgtggaataaacataactaaagattgctttaaatgctttattggccttaattcacgatagttaacctttacgagatacctgtgtaaacttggaaaaaaagttaaattaccaattaatgtagataaaactgttatcaatatatatatattcaaatcattgtaagatttgacaaataggaaaatactgaatagggcaagtaacttaactataaaatttcttaatacagttactttaaaattttcaattcccataaaaaaccaagagatatcaaatgcagctgcaactatagcaatggattgagacaaatagtattcatgatattgaccattaatggttaaaaaagcaacgaacaaaaaatacgctaaacatattgttaataatcttaaaataaatatttcataaaaaactttagacattttaacctggttatccctaacaaaggcaatctggcgattcccatacaaaccgactcctacactaccaaataaaacaaaatactgaacaatagaattggtatatgagttaatgccaatacctgaaggacccaaaattcttgacaaataaggtgtagtaagtaatggcacaatcattataaagacctgatatattgcattataaagataattttttgcaatttgcattaatagccctcccgaaaaatattaaacaaaaactatataacaggaaggattaaaaatttggctctcctatccacctaagttctaataaaagtatctagatggtaaactcttaccactcttaatcaaacagaataacttttaataagttttcatctgccttcacttaatatctgtccagatagctaactagacaaatcaaagactccctttaaccgaatgacttcacattcattgaaacaagataatcaaattcagtgattaatgaactcattaaagatataaaaaatctgtaattaacataaatggatgtaagctgattcctgagacaacttttaagagagggtataatgaataaatcgtctctcaaaaggaaggaatttttacatgccaactcgttacgacaaagaattcaaacaaaacattatcaacctatataagcaaggcgaatcagctgcccaactggcctgagaatatggcattggctattcaacagttcataagtggatccagggccaggccaaaactcaatccggtaaatcgccagacgaaatnaaatagagactctgatttagtataattaaggaagtaaattggaggatcaaataatgacgaagcacagttatgacaaggaatttaaggaacaggccgttcagtattacttagataacaaggatcacatgaccatgaatgaaataagtaagaatctaggtattggggctagtacattacataaatggattaagctgtttactgagactggggagtttggccgtggctctggtaatttttctagcgataaggacaaggagattgcacgactaaagcgtcaacttcgtgacgctgaaggagcgatcgaagtgttaagaaaatcaatcgggattctgagcaagtaactaccgaaaaggtataccaagaaatggacgttcagcacgctttggaatcccacccttccatcaatggtatgtgtgattatgttggaatctcaagaagtggttactatcaacgagaaaagcgtcataatcaccaatcaccgcgaaagcttcggaagaagtttattcaaggtgaaattaaagcaatttggctcaaaaacctttgtatttacggtgccggcaaaatcacccaagaacttcgctcaaaaggatataagatcgctgaacgaactgttggtaagtatatgcgtgaacttggcattcacgccgtttacctaaccccttggacgactaccactcgcaattctaagtttgataaacagctaataaatattttagacgagcagttcaatccattgcgaccaaacgccgtttggtgcattgacaccacttatattccagttcatgacggattcgtttatttaaccagtattatggacttgtactcccgacggatcattggttgggacttatctgaaaccttggaggtatcgaatgtcatcccacttattgaaaagactaagcacagtcgccatattagcaagccattaatcatgcacagtgatcgtggtagtcagtttacgtctgaagcttacaatcaagttacagctaacatgacattaagctattcaaagaaagcttatccttgggataatgcctgcattaagtcgtttcatgccttgattaagcgtgaatggataaatcggtttaaaatccattcatactccgaagctaaacgactagtttttcagtacattgaaacgttttacaacacagttagaattcacagtcactgtggattcaaatcaccaaagcaacttgaagatgagtatcaaactcaaattcaaaatttagtcgtggcataggacaaaaaagtctctatttaaattgtctattttattgacaggggaccagtttatcggtacattgatcaaggtcgcttagacattaagaacatcgacctgccagccaaggtccgacgacatgtaaagtccaatcgtcacaaccactcgcggaaaaacaagcgtctggctggcacttcaattgatgaacgaccagacactatcaataaccgtgaacgctttggtgattgggagggtgacctagttaaaggcaagcgtcaggctagtgaaccagcactgatgaccctgaccgaacggcgaacccgctatgagatcatcgtcaagattcccaattaccacgcagacacctgcttaaaagagcttcaagctaccattgatcagcatcctggctactttaagaccatcacttttgataacggttctgagttcaaactgttggaccagattcaagggcctcagatctactttgcgcactcttactcaccttgggaacgtggcagtaacgagaaccagaacggtttgattcgagagtacatccctaagggtctatcgctacatggtttctctgatgatgacatcgcaaaggttcaagaggcgctgaatcaaaaacatcgcatgacactcggctacgctaacgccgccgagcttattgaggccgcgctagcaagctagctcacggcctggctccatggtgttgcgcttgagttgacattccgggttaaataataattaaaattgggagtagtaatttggccatgaaattaataaccgtgattatacctgtttataatgtgaaatcttatctttcaaaatgtattgagagcgttaaaaaacaatcgtataagaatttggaaattattttagttgatgatggatccgatgacggatcattttcaatttgtaaagaattttctaagaaagacagtcgaattaaactttaccgtactgaaaacttaggcctttcacatgcaagaaatgtaggattagatcatgctagtggagaatatattgttttcgttgatagcgatgattatatttatgaagatatggtcaaaaccatgataagtaaatctgaaaatgctgacctagttatttgtaattatgaaaaaataagtgatagtaatgagaaggttcctcaagacgctaaactactcaaagatgatatttggaattttaaacaattttgggaacgctattattttgatggcttaaatgttttttgttgtgtagcgtggaataaattgtataaaagaaaactattcgagggtttaaggtatccggttggcaagatccatgaagatgagtatattatcaatgatattattagacggtgtgatcaaataaaggttattaatgattcattgtattattatgttcagagaaaaggtagtatcatgcatagatcgtataagggatattttgaaggagctgaagcattttttaataggtgcgaacttttcgaaaagtttggcttaacaaaagttttgaaggagaatcttaattgtatcccatcagaattgataatgggattagatgaaacaaaatgtcaaaaaaatgctaaactaaggtactcttttttaagaaaaaaatatgtttttttcttaaaaaaatacctaaagaaagaattctctattaaattatatctaaaaaaatatatgttaatgatgcctactttttatagtctgtatgcaaaatataagcttagaaaattaggataacaatgttaaaggggtaacgttagaagtgaagctgaagaaagaattccataataagattttaagaagaatatactatcatacagtaattgataaaaaaatattaccaaaacgatatagtaaaagaagaatatatctatttggagtacctgaatatctgaattatggtgatatagcaatatttgtttctgacccaaattgcaagaacaaattagccacacgataaatcctattaaatcagtattttcattaatattcatattttatggacttaacttaaccggcggaagcagcggagaaaagctctttgggtgtttgatagccagtttgccggcgcggtaaattgtttagctttgactcaactgcttggatatcatgaggacccaaaatatccatggatagacccttgggtacatcgcggcggatcattcgattatgcgcttcgttagtcccacgctcagaggaacgatatggatgggcataataaaggtcagcgacaccggtaagtacagcgccaacttccgagaactcagcgccattatcggcagtaactgatttcatgattgatccgtattcttgacagatcttggccagctcatagttgactgaatcggcatcacgaccatcgatcaaacgtagaatttggcagcgggattgacgctcgatcagcgttaaaatcacactctcttgaccgttgcgcttgcccaccacggtgtccaattcgaaatggccgaactcttggcgctggtcgatactcttaggccgttcatcaatactccgtccggccagacgcttgtgcttgatcgagtgatgatgtttggcacggtggcgcgttttttcgagtagatcaagattgcggacttcaagtaactgggcatcaatatagtggtatagcgtcttggtcgagaccatctcctcaggttgatataagccttcaagtttggcccgtcctactgctgcatcaggcgaccaaccatcttgacgcaaatgagtcgtaaaatagtcgataaaatcagcgacaccgacgagtttcaaaggtcgatgacagtgggctcgattagcttcgtacttagcttgtgctgtttctggtgagtatacagcgtaatattggcgttgaccattcactttttttacttggtcgatctcgccgcggcacaattcattattgattgtttgatgacaaacattaagcgctctggcaattgcacgattggaatagccttggctgtgcagcgtagcaattctgcctcgttcaaacgaagttaggtgctgacctttttttctgactgtggtattctgttcttgcatcaagacaataacctctttcattgtttgtgtaggaacatcaatgataacagagatttgtcttggtgttttttattttatcaattagctaaaagtatttggctaacttgattataaaacgcgcga

SEQ ID NO: 79 - DNA, 8860 bp, Lactobacillus plantarum
ccggaggtcggaataggacactcaccggctgacgaacagtaagccaactaaatggcacgttttaatcatagttaatgctagttgttttcgatggttaccagtgtccaaatatgctgatttaagcgtcaagtggactgggattgccttgttgatgacccccgctgaaaatggcgttaggtcgactaataacgcgtctgctggtgtgatttgcggtgcagtcgtgattgagactgggtcacagtccaataacgatgtaacggcatcagacaacagttctattgtaatatactaacgcgtaatttgaatgaataagacccataatgatggaacagataaaagaccgactaacaagcaatcgcaccgcttgttagtcggtcttagtgttcattgattaaagctttttaccagattttgacccgcttatctggtgccaaatacatggcatcatcgggttgaatgtcgaaggttgtgtagaaatcatctaagttcttagattgtacgtttgctcggagcttagctggagcgtggacgtcgattgaaagtaagagttgcatgtattcagtcgtggccttcatacgccaaaccatggcccagttagtgaagaacgcactcaaatcaacgtcatcttcgcccttagcagcttcttccgcgcaacttaagcctcccgcatcggcgatgttttcggatacggtcaacgtcccgttaactttcgcaccagcaaagtccaagccatcgaattcactgatcatggacttggcaagttccttgaagtgggcagaatcttcctcggtccaccaattatgcaagttaccgaattcatcaaatagggcaccattgttgtcaaaagcgtgcgagatttcatgagcaataactgcaccaataccaccatagttagcgctagaagattgttctaagctgtagaaaggtgcttgtaggatagcagctggaaagacaataatgttcataaatgggtggtagtaagcattgacggtgtccgcactcatttcccaacgggtccgatcagtggctttgccccactttgagaacatgtcttggcgtgccaaacggttaaagtggaggacattgctcaatacgttgccaccttgttcgggcgtgtgcgtcttgaatttcgtgtaaatcgtttctagtttatcagggtaaccgacttgaatgccgagtttatcaagcttggtcacggctttagcacgcgtatctgcactgagccaagtgttcgcttgcaatcggcgtttgtagacggcaatcatcttttcgaccatctgatgaacgtccgctttggccgcttcaccaaaatacttgtggccgtaatagagtccaacgacttgatcaaaagttccggtagctagatagtaggcactcttagcctggttccgcggttctttttgaccagacaatgcccgtgaataagtcgtggctaatacccgcatttcatcactgaggtaaccactgtaccgttgaacgagtttagctttcatccagttcttcatcagaccgaagttatcaggattgactacttcgttaaagtgatcgaagaaggcgggttctggcaagatgacgaggtcgggattaccatcgatgacggagtaggtgatggcggctaagtctaaataacgactagtgttaacaaaatcgttgaatttgcgaggattatacatcttactgtaatcagccgactcttcagcggatttgatccatggaacgatcaaacgatcgaattgcagcgtgtcatcaacgattttttgtgcttcgtccttttcgtaaccagttttttgcaacagttcggtcatcattttagcgtaaattgctagtaacttagggccggcctggttgccttcgtcgtagtatgtcttgtcgggcaagatagtcccaggtgcttgggcaaataaggcgttgaccttggtatttttcatatcagcgtcgacatccaagctgaatggtaatgggaggccgtcgtagatccaatcgggcatccgttgttgtaagtcagcaaagtcgcttaaactatcaatttgcttgagacacggcagaattggttccgcaccattggcattgcgttggtcgaaatctttagctaagcggtaaaacttaatgaattcggttagctgaggatcgtcgggggtaattgttcccgccgccattgcatcaaagtcatgcattaacgttttttcaatggcatcaactaagtccataaagcccccggttgaagaatggtcatccggaatgacggcggttttgagccactcgccgttgacggcatcgtagagatcttgttttactgctgcttgattaatggttgccattaaatccactccctaataaattttctaatactaagttaattataccttagattattctcagtggtatcatctggtaccgactcagtaaaaaatgatactaatcatcttaatagtcccgaatcagtagcggatgggttgtgaatgttaatgtaaagggcgagattacttctgaattatcggcatgcaggagctgttagtgcctgtaaatcaccttatgaggcagtgtgatggttgacgtaaaattccccggatgactaacggtgatttcgctagtcatccggggaattagggataatttaattagtagtcattattcagttaataatagctggtcggcatcgttaatttcgatgaccttgccaggcttttgcgtaattaggccttgacgctcgaataaggcgagcttacggctgatgctttcaggggtggtgccgaggaacgtcgccaggtcctttttctttaatggtagtttaaacgtgtcggttttgagcgctgccgctgtttcagtgatatagttcgctaaacgggcttcgacggattcagtggccgtgctggttgtttgacgttccagttgactgagacgtttgccaaagacgtttaagacgttgatgctgatactgggatatttttgcatcaagtcttgaaagtctgaacggcgaatactgcaaacatccgtcggtactaaggcttcaccgaatgaggttcgccgttgattttcaaataaggcagcttcgccatcgatatcaccagtttgtaataggtatagtaactgctcgcgaccattggcagctagctgatagactttaacctgcccattggcaacaatcatcagtgaatccagtggatcgtcagcaccaaataaagtgctgccggctggatagtggtggtgacgaacgatcgattcgatagtgtctaattgttcactaccgagttcgctaaaaattgggactaactgcacacattcatgttctgccataaggcccacctcctgaataaattcaccctaactataacagattttgcttggtagatagggtttgacgttttaaatttcctactgttttaataactatattgtagcgtaaaacttttttgaatttcttgacggccgtcaagttctggtcaatcaaatccggttatgatagaaccatcaaatgaacgacacggaggtaattgattatgaaaattattatgcaattaggaacgttgacttgcccatcatgcatgaccaagatcgaaaaggccgttgctaaccatgacggcgttgagaatgttaaggtgctattcaatgccagcaaggtcaaggctaactttgatcctgaagtgacgaatgccgatgatttggcacaagttgttaccggacttggttacgaagttgaaaacgtcaaggttaagtaggaggaataaacgatgagtgaactaacgatcgacgaacaatacgcagcggaattaaaacagagtgacattgatcaccatgtcccaacagcgggcgcaatgacgaatcacattttatctaacttaatggttgcttacgttaagttgacccaagtgaagtggtacgttaaaggaccacaatcattggcattgcggacagcatatcaacgtttgttagatcagaatgtccgtcagtttgctgaattaggcgaattactcctagatgaaaaccagaagccatcttccacaacggctgaattaaccaagtattccatgttggaagaaaatggggctttcaagtatcaatctgttgatgaactcgtggccgcaacaatcaaggattttgatacggaaaacctattcgttgaccgggctatcaagcttgctgaaaaagaaaaccggccggcactggcagcttggttagttgcttatcgtggcagtaacaatcgcaatattcgggaattacaagcttatcttggtaacgatgctcgaactggtttggatgaagaagatgaggatgacgacgattaggtcgttgtcgctgaagaattaaacgctctggatagcgattgtgtgggcaaactatccagggcgtttttgctattacaacgggcctgcgctatactaacgacaattaaattatatgggagggacccgagatggcgattagcgacattgtgatgtggacatttgtctttattattgcgactgggttcgtaacggtgatttcaacggcggtactgttgaagcgagcaaaacgagcgcccaaggatgccgagcagtcccacagtgatgacgacgatgactggaaaaaagatgattggaaccatgatgactggaaaaagggagattggaaagattgactcgataagttgcctgacagatacggtgcttaactgagtcaactggcactaaaaagacggtataaccaactgagattggcgacaccgtcttttttggcgttatttggtttttagcagtagatccaaggagtgttcaagattctgaacatcagccgtggtcatcgcatctacacaattattaatattacgggcgatgacgagtttcatggccttgtcgatacttgatttcactgctgaaagctgaaccaagacatcttcgcaaggacgattttcgtccatcatacgcaaaacgccgtccagttgaccagccgagcgttttagccgggtcttgatctgcttgctagtgacatattcttcagtagttgccatgattcatgatgcccccttcgtaattaagcaagtgcttttttgagttcggcttcaaaatcaggcttaggacgtgctccgaccatgtgactgacgacttggccatctttcttaatcaggaaggttggaattccttgaacttggaattgactggccgtagcttggtcatggtcaatattcaatgaaacgaagttgacctggtccttgtaagctgggtcttcagaaagggacttaagaattgggtccatcatgcgacatggtgggcaccagtctgcgcgaaaatcaataacggcgataccagtatctgtttctttggcaaaatcttggtcatgtatttctttaatcattttagttgactcctttagtaagtatttgtcactaaacaatatacccccataggtatacacgagcaagtattctgcttctggccgtggagggatttaaaaaggactgatgtattgggtaattagataataacgatttgttgtggaagctagcgtcacctgagaatcttctagttgtgatcgcgagcattaacgttgaagatctcatgttgacgcgagcgtgttatactagcgcttcataattatacaacccagggtatctggtagaattatgttgaattattagaaaccgcttatttaagcgaaataaagcgtttacataaacagttttatctggtatcttcaaattatcatagatgctcggtaccttacgaggaggatttacagatgacaggttcatgggaagcacgctacgccgctgaattttttggcacgctgatcctagtactactaggtaatggcgctgtcgctaacgcattcctgaagaacacgactggtaacgatgatccaggactcgccaatggaggatggctcctggttgcatcgggatatggactgggggtcatgctcccagccatgatgtttggctcgatttctggtaaccatttaaaccccgcgattacgattgggcaagccgtgattggaatctttccctgggcgcacgttgcgccttacttaatctggcaatttctaggagcaattgcaggccaatgcttgattttggcactgtactggccccattatcggcaaacgactgataatgaggcagtcttagggacgtttgcaactagtgatcatgcgaacagtcagttaaacggttttgttacggaaatggttggaaccgcggtcctgatttttggcgccatggggctatatcgcgggatgtttttccatcaaaatatcgatatcgccaatattggcgttggacttttgattgctgccatggttatttcgttaggaggtccaaccggtccggccctaaatccggcccgtgacttgggaccacggctagtacacgcgttattaccagtaccgaacaagggtagttctcactgggaatatagttgggttcccgtggttgccccaattgttggtgccgttattggaatttggatttataagatcttttttggtttataatcgcaattaattaaccgagcgtatttatgaaattattattggtctatcatttttgattgcaatatgataaaacggtccgccgactagctggggaagactagtcggcggaccgttattggttgctaggcctgtaaccaagttggggagacttgattaagctgtggctgcttgaatggttttagttggttggtgtttgtcgaacttggtttggaaattgattaaccgcatagcgttgaagataacgactaagatactagcttcatggacaaacatcccactggccatgtagatataaccgaagattagcccaatcagtaggaaggccacggtggcaatggcgatgaagatgttttcacgagtgttcaagacagtcttcttggcgagaccgtgggcgtgtactaatgcggggaagcttgattgcatcaagacgacatcggatgtgtcgatggcaacgtcagtcccactacccattgcgattccgatatcggcgttagcgattgaaggactgtcgttgatgccatctccaataaaggcgaccgtgttaccggctgcttttagtttcttaacgtattcgactttttcttctggtaagaggttggcgtgaacttcatctaggttcaattcgttggcaacggcttgagcggtgagttcattgtccccagttaacataacgagtttcttgattccttgggcttttaatgcggcgagggaatccttcacgcctggacgaatcgtatcggcaatcccgaagatgagttgaacttgtccgtcgactgccatgataacggttgattgaccaccagcttgtaaaccattgagatctttgagttgggtaggatttagtttgatattatgagccgtcaacattttttgattaccaatgacaacttcttgttgaccgacttgtgcacagattccttgacccttaacggtttcagtgtcatctaggacgggagagacccccgctgactgctggtcggcataactgacgattgcttggcctaacggatggtcggaaacgccctcaatagcggcagcgagagctagttgattatccgcgttgtttgtgtaagtgtgcatggttgtaacggcagtgttaccttccgttaaagtaccggtcttatcgaagaccagggtatcgactttggcaaaagtatcgacgacttcaccacccttgatcaggatgccgcgcttggcaccattcccgattccggcaacgtttgacactggggcgccgataactaaggcacctgggcaaccgagaaccagtaccgtgattgctaagcggaagtcacgggagaaggcgaagactaagactgctaaaacgaggacggcaggcgtataatattgagcaaagcggtcgatgaacttttcagctttggacttggtatcttgagcttcttcaaccaattcaataattttggcaaaagtcgtgtcgtcgccaacctgagtcgctttgatcttcagatagccattttcaaccattgttcctgaataaaccgaatcatcgagttgcttgttgatttggcgtgcttcacccgtaattgaggcttcgttaaggtaaccgttaccttcaacgacgatcccgtcaacgggaacctggctcccggttttaactaggacaacgtcaccttcgtccacatcatcaacgtcgacttcttcggtgccatcatcagtaactaaagttgcggtagttggtgacatgtcagtcaagcctttgattgcggtccgcgtcttctgcaaggtcttgctttcgagataggagccaaacaagaagaggaaagtaacgattgcggattcgttgaattcaccaataatgaatgccccaatcactgcgatactaactaacagttcaatactgaaaactttgttccgaagtgcgctccaagcacgaaccgcaatcggaatgacggcaataattgaagcaactgctaaaatgacttggtaaccgagcgtaaattgtaagagatatttactgagcatcccaaggacaatcagaatccccgtaactaatgtaatttgattcgtatgtttagtgagaaataattggaatttcataatttgcaactccttatttgatttgatgaccctagtatagtgagttcagcttgatggcaacttgataggcgtcaagttttgcaaaataacagtattaattctggattgctggcagtgattatgattaaaacatgccattttttaaattcaaaagcagccagcttagacccactggaaacagttcgggttagcgtaaacctgcttagttcgttcgtcctacgccgacctccaggcatttctgccaattgccggaacgtggtgggcacagattcgagccgaaaaaacacgtcttaaatactggcctttcactaaccaagcaaaggacgcttgctaagtg

SEQ ID NO: 80 - DNA, 8267 bp, Lactobacillus plantarum
aaatttgcaatctaccatatttactttgtacaataaaatatttttttgtgttttaaaattcgcatataagtttaatcactcttaaacttgatattaattctgcaatatcaagcaagctcctaaccaaaccttgaacgcgctattaggttaaaaggcaaccaaagttcatatgagtaagacgagtatttgtccgctcgtcttatttatacaaatcacccaatcaatgtgactactatacaaacagtaagcgctcactttttccaaaaataattactaataagtcttattttaagtacaagcacggattatatctgatagcgcaaacaaccagcttgacacctattaccatcgagacttcatagcacctatcgtcttgatcatttccgaatcacgatcagtggtcattaatgattataaaaataaccctgttagcaccaaaagacgccaacagggttgtttttgtaattatctttaattgtaactgacactcaattaagcttcagcccgcttcaaatcagtatcagcatacattgtctttttagtttgcttgctagcatcttcattaacaaacttgtccataaactcttcaaccaagttcaaagtctgatattgtttagctaaactgaagctttgacgccattcccggttgcgttgaatcaattcagtaaagacttcatgttcaatccgagcgccttctggtgttaactttaaaactttgttacgacggtcatggtcttcagcttcttgatataagtaatctttccgtaataagcgaccaattaagcgtgagattgctgaacgcgtcacaccgtgactttcggcaatatccatcagacggatcttaccttttgcttcagcaatatcatataaaatgtaaaattcatccaaagtaatcccatgttccgttgcaggttcagcaaacatatctgataagtttttaaagccatgtaaatacatatggctaaagcgattaaaaaattccatatcttcattcattattcaagtctccctttcactagtcgaattatcattaaattcccaatcataattcgccccatacttttttcataaattagtaagcgtcgtttatcatttccccgctttaaagtgtactagtatattttacgaaatacaagtaatttagattactttaatattaaatttttatttcagtgctcaagtcaagggtcgcgtgtttatgcagatacgtgatgaattgctgataataatagtcagtattatacttggctgtgctcaaataaatttgatcaattttctcagtattctcacctaataacaagtaaaacgcttggtcgatattttctgcaatcatgccaacactagctcttagaattttacgcttgaaaaaaacagccataccaccagataacgcgaagttcaacgcgtatctaatcatagcagcttcaccttctacgccgatagcttctagccagtctagtgtcactagcaccatctcagtcgtcagttccggactctcgaagatgtcctgaataaagtgttccatggtcggattttcatctaacatccgcaaaacaaagctcatttgaatcattgttcgctgatacgaagacagcatggtcagcttttcattactatagataaaagcactaagcgtcaactcatttaacatcgtacttaataaaacgattttcttcgggaaatagtgttgtagcaacgacttactgatatcacaggcaatggcaatgtccttcatctgaacgttcgcatacccctgctcggcaaacaagcgaaacgctgtattaacaatctccattcgccgttgcgtgttccttcttcgtggcaagaaaggtgcctccctatcactgattttcaatcattctcttttaataaactatactaatatagctttgaacgcaagtgataatttaattggaaagttaattaataacagcctcaactatcaaaatgatcattacttatcaataaaatccgcgagtacttccaactacaagttagttaacaaccactgcggcttaacgtcttaatcgtctaaacgcactagcagctattcatcagccaaaaaagaaaacgctttcttatgtgaaagtttgtgctaaaattaacttatcaacttgcagggaggctacaatatgagcactaaaaattcttatcaattagccgatatcggtcgccataatccgatcttttcacagatccgttctaccgtcgaaacggccttttacggtaataatatgcaccacgttgatgatatcgctgccgcttaccaccgcgctactaaggaccccggaaccgttattacggacctcccaatctatcgcgcaacggatttaggcttaccagctgatgcaaaaatgttgattgccaatacgggtaaggttgttggccgaaccgcacaagcgcgccggattctaggcaacccgggcgttagcgaagccgatatggccggtcgcctacgccaagcactatttgctagtgctcacaaggacttcatcacgacggacgttctggtcggtttagacgaagacttcatcgtgcgggcccacctcgcgattccggacggctttgccaataatctactttcttacatgcttaacttccagcccatcaccactgcttatcaagaaatgttcgatcggtccgttgcctatccagaaggcgatatttacatttacgctgaccctacttaccatgatccagattatccagacggcctggctatttttgatccgcaacataatacggctgccattctaggaatgccatactttggtgagttgaagaaatcgactttgaccttagcttggtcgatcgcccatcgtcacggcttcgttgcttgtcacggtggcttgaaggccttccacttcaagaacaagcaagaccaagtcttcgccatgttcgggttatcaggttccggtaagtcaacactaacccacgctaaacacggctataaatacgatatcaccgttctccacgacgacgcctttgtcatcaatcgcaaggatggtagttccgtggccctcgagccttcttactttgacaaaaccaatgactatccgatgacgtccgatgagaccaagtattttatgacgatccaaaacgtcggcgtcaccttagacgatcagggtcgcaaggtccttgtcactgaagacctacgcaacggtaacggccggacgatcaagtcacggtacgcttcgactaaccgggttgataaggaagccgctcccatcaatgcaatcttctggattatgaaagatgatagcttaccacccgtgattaaagtagatgatcccgtattagcagcgacattcggcgccactttagcgaccaaacggagctcggccgaaaatattattggtaatgtcgaccgtaacgccctagtgatcgaaccatttgcaaacccatttagggtctatccactatcagaagattaccatgatttcaaggcactcttcgaagaacgccatttagattgttacctattgaatactggcttctttggcgataagaagattcctaaggaaattaccttgggtgcgctggaagccattgtcaatgatacgaccaagtgggagtcattcgcaggcttggagcacatgcaaaacctaaagttagctgatttcccagttgattatgccaatgcagactaccgtaacttggtcgccactcgtttaggaattcgggctaacttcattgatcaatatcaacacaacaatcatgaccagcttccccatgagattactgatattctagtccacctacaagatcaattaaaacaaccaattacaaaataggatggtattcgttccccgcttcagaccaattaaggttataataaaagtagcaggtatatggcactgaacttttacgaattctaaaaatcggggtgaggagcatggaactaccattaagtcaattatcagaaaagctcatcagttttgaacgcgagcaccatcttacagataacgaccttgcgtttggcagtcaattatcagttgaacggattcacaacattaaatctggtgaagcaacgccaactcaggaagaactgcaactgttgaagaaattcatgaatagcaaagccaaagcttaactgctagttcagcgataaagcctaattggggcaaagatcctcactaaaaactggtcgtccattcgaccagtttttttgttacctaccatccggattgcgttttaatttaccctgttatcacctcgtgctatactcggcacaacttataaagataagggtgaccaacatggcaatgttatacggtaaacacaatcatgaagctgaagaatacttggaaccagtctttggtgcgccttctgaacaacatgatcttcctaagtatcggttaccaaagcattcattatcccctcgagaagccgatcgcttagttcgtgatgaactattagatgaaggcaattcacgactgaacctggcaactttttgtcagacctatatggaacccgaagccgttgaattgatgaaggatacgctggctaagaatgccatcgataaatctgagtacccccgcacggccgagattgaaaatcggtgtgtgaacattattgccaatctgtggcacgcgcctgatgacgaacactttacgggtacctctacgattggctcctctgaagcttgtatgttaggcggtttagcaatgaaatttgcctggcgtaaacgcgctcaagcggcaggcttagatttgaatgcccatcgacctaaccttgttatttcggctggctatcaagcttgctgggaaaagttttgtgtctactgggacgttgacatgcacatggtcccaatggatgagcaacacatggcccttgacgttgaccacgtcttaaactacgtggacgaatacacaattggtatcgtcggtatcatgggcatcacttataccggtcaatatgacgacctagccgcactcgataaggtcgttactcactacaatcgtcagcattccaaattaccagtctacattcacgttgacgcagcgtcaggtggcttctataccccatttattgagccgcaactcatctggaacttccggttggctaacgtcgtttcgatcaacgcctccgggcacaagtacggtttagtttatcccggggtcggctgggtcgtttggcgtgatcgtcagtttttaccgccagaattagtcttcaaagttagttatttaggtggagagttgccgacaatggtgatcaacttctcacatagcgcagcccagctcattggacaatactataatttcattcgcttcggtatggacggttaccgcgagattcaaacaaagactcacgatgttgcccgctacctggcagccgctctggataaagttggtgagtttaagatgatcaataacggacaccaactccctctgatttgttaccaactagccccgcgcgaagatcgcgaatggaccctttatgatttatcggatcgcctattaatgaacggttggcaagtaccaacgtatcctttacctgctaacctggaacaacaagtcatccaacgaatcgtcgttcgggctgactttggcatgaatatggcccacgatttcatggatgacctgaccaaggctgtccatgacttaaaccaagcccacattgtctatcatcatgacgcggcacctaagaaatacggattcacacactaaatcatcacgttattttgaataaagtagccaaactccagaaaacaattaatatcgctcacgcatacaaaaatagcatcatcctaattctgacgaactaagatgatgctatttgtccatttaaggaacgttaattacatgtggatagcaaagcttggtgtatagtaagcagtgctcttaattgaaacagattcgccgtaagttggtgatgcgatgtattggccaccgcctaagtaaatcccaacgtggtaaggtgctgaatcagaaccccagaagaccaagtcgccagcttgtgcttggctgaatgatacgtgagtaccaatcgttgcttgggcataagtagtccgaccaattgaacgaccaaccttagcaaaggcagcttgcgtgaatgcagagcaatccatttgttcgtaaggtgtgccaatgaaagtcttgccagcagcaattactgaactgtatgatgcagttgaactagttgttgctgaagcacggtaggctgttgcagtagcagtcgttgttgatgaactgttcgttgttgtgttacttgcagttgagctagcttgtgaactcgttgaagtagcagctgattgcgtgctagtagacgatgctactgaagttgagctttgtgatgcttgtgaagctgaactttggctagcagagctttgtgaagttgctgaactagttacagcacttgaactagcttgtgaaactactgaactcgttgaagcacttgaagttacactgcttgcactagcagttgaagtactactcgattgcgcagctactgagctacttgatactgcttggctcgtactacttgcactagtagttgatgagctggttgcagcagcactagtagttgaactagcagcttgtgaactcgttgaagttgcagcactagtcgacttggcactgcttgcactagcagcggtcttcttagccgtaaccttttcaccggtcttaacaccaggaatattgatggtcttaccagcaataatcatattaggattgcttaaaccattagcttcagcaatcttgtcaacagaaacattgtacttttgtgcgtatgcccaaacagtgtcccctgctttgattgtcattgaatcggcattggcaactgcttgactagtaactaacataccagctaaagcagcagttcctaacatcacttgtttaatatttactttcactttaataatgatcactccaaaaagaatgtcacgtatgtacttcaagccaacgtctatactactcaatttgtgttacataccaataccagcaaaataacaatatgttacgaaagttacaaaaccgtaacaataattagccatcgtaacatttccgcgctgaaaccctatcataccggcatcgttttattactaaaatttgagaccatttagcaactttgacgaaaaaaagttatttttattttaaaaagccgaatttccagtgacaattcctggaaattcggttaaatttcaatttaattacgaccaaacgttcggttaatttggactatttagatattcgttggcgatgatgcgttcgcggtaatcctaatagccatcgaatatcattacccgtaaagttcaacttcaagaattcgccactttgtccctgttgatacatggtcggtaatacctggtcttgcaacttgatcacttgctgtgcgatctcttcgtcaaataaatattgccgtgtcgcagcagcaatttcaccaacagtaaaaatctgagcagcgttagcaaatatctgctctttgcccagcgccaactgggcttgtttaaactgggcgtaggactgatccaagacttggcctgcttgagtttccaatgcggttactgtggtcatgatgcgcacctcctaaatttatccctattgtaaccgccatcgctgactttgaccacgctaaaccatgctttttaaataaaatttgctatactaaaatgacaaaggggaaattaacttgacgaatacagacgatcgttattatcaaccaaccgacatcaaagatgcgcttcaaacaattcaaaaattatttaatacttatactgatgccccattaacacccgaattaatggcctaccatcagaaattagttaaccagttagctactaatttattaccactagcacaacaacaacacgacaaattacgtatcacccaaattaattcaatgatggccgtcatgcaagattggctaaaattaaggctgaatgggcaagttttcggcggcaaaatgcaacacttcaagtttgtcagcaaccaaaaagcacagtacaaacgacgagtgcataaaattcgtggtaatcaaaatcatcgtgctagccgccattgataacgaaactagacttgcacgactagcattttgcggtatactaaaagttgtattgggcccttagctcagttgggagagcgcctgcttcgcatgcaggaggtcgtcggttcaaatccggtagggtccatattaatagacgtcgaaaattaaggtgtgttgcaatcgaaattgattacaacacaccttattttttggaccatcatttacttgtgtttatcaaagtaacggtctgttgttttaacgaatggtagattgtaaaatta

SEQ ID NO: 81 - DNA, 8111 bp, Lactobacillus plantarum
gtagttttaagacggaccctaattaaaataaaatatttaatatttgcgaacaaaggactagtattataaatctaaagttgatatactagcaaagtttgcttgtctggcaaagcaccaagaaaacgattacaagtacgtcatcttaattaatgaaaggagtgcgaaaatgaacgatttaacaaagggaaaaccgctaaaattaattttttggtttacgattccgttactaatcggtaacatttttcagcaattttatagtttatcggacacgttgatcgttggtcagacgttaggggttaaatccctagcggcggttggatcaactgggagtgttcagtttttgatcattggctttgcgcaggggttaaccgctggcttatccatattaacagcccaacattttggggcacgtgattttaaagcagtgcggcgcagttttgcgattagtatcgtagttagtctaattgttgggatcattttgacgattctgtcgttgatcttcgttgaccatatcttgttgttaatgcaaacgccaacggatatcattgcggatgcgcggacattcttacaaattatgcttggcgggatgctggcaccaattgcgttcaacctgttgtcaaacatcattcgcgcactcggtgatagtcgcacgcctttatggtttttgattatcagcgcgttaattaatattggcttggaattgttattcattttggttttcaaatggggcattgccggggcgagctgggcaaccattttagcacaaaccattgcaacgctcatgtgtgtggtttacatcatcgtcaaagtacccatcttgcacattggacggcgccacttcaagttagtttggtcggaagtgaaggctcacctgaatgttgggttacccatggcttttcagatgtcgatcattgcgattggaacgattgtgttacaagcggcactgaatagtcttggcactaattcagtggcggcgacgactgccgctcagaaaatcgaccaagtcgcgactcagccattaatgtcttttggggtcaccatggcgactttcgcggctcagaattatggtgctcatcagtatgaacggattatcacgggagtcaaacagaccatgtggctgtcggggagctttagtgtggctgccggtttgattgaaattatttggggtaaacagcttgtgggattcttcgtcggtcatcaggacatggcggtattgaacttatcccagacgtattttaacgtcatcgggagcacgtatatcctattatcaatgttatttattatgcgtaataccttgcaagggcttggacgcagcgcaattccaactttggcaggcgcggcggaactctttatgcgggtgtttgcagcgctgatcttagttcggatcttcgattacgccggtgcttgtagttcggaaccgttagcttggttagggtcgtgtgccgtgcttttgcctgcttatattaaatcagtccacgatttacgacaacaggcccgcatgacaaacacggtcgcagaaggggccgaaccaatattaaacgattctgaaaaattgtaattaaggcttgcaaccaagtggattatttgataatatttgttatcaattttattttaaagtcactcatataatctcccggacacctgtggacggggcatgaattgaaaaacgttaaggagtttacaaatggccgtagaattaaaaattggcgattacgtcgctggtaagaagtttgcttcgttggaacatgatttcaagggtgaaattgaaaaagtgtatgaaaattcagtcttgatcttaattaaggaatttcaaaaagctgacgaaccaattgttaacgagtataaccaccgcgcagttgttcgtaaggatgatgctaagctcattaaagcggctccaaagccgaaagtcgtcccagaaaaagaagactaaaaatttataaataaccatgacaacagaaaaaatgtatgctatactaatttctgttgtcaaatgcgggtgtagtttagtggtaaaattcaagcttcccaagcttgcgtcgcgggtccgattcccgtcacccgctttgctattaatcatttcggttagtagtcattgtattctcaagctccttgagcgcatggtccgttggtctagttggtttaggacgcctgcctgtcacgcaggagatcacgagttcgagtctcgtacggaccgtcaatagatgatgataatcaagaacgttagtcagcaatgacccgttcttttttattgagtaaaaatcaagatgactaaatagttgaccggatgggtgatcaacagtaatcgttaaggagcgcaaatgcaatttataacaacatctttcgatgagttaactgttcggcagttacaacagatttacaagttacgagtggcggtttttgtcgtcgaacaggcctgtccgtatcaagaagtcgacgatacggacttgatggcttggcatttacgagggctgaattcaacggaacagctgctagtatatgcgcgattaatgcgtgaagccaaccagcaggcccgtatcggccgggtgatcaccaatccggcggtgcgggggcacggctacggtcagcagttgctccaacaggcgattgtgcagattcaagcgttgtggccttccacgacgcaaatcaatattcaggcccagcattacttagatcgcttctaccgtggatttggttttcaaccagtctctggcgtttatttagaagatgggattccgcatcagaatatgattttaacgttgaactagtcaaaacggctgaattctgttatactaacgcatggtaaaaatatatacgtctaatgagaaagaatagtacgatgaacgtttagaccagcgagttcgggatgatgggagccgaatctaaacattattggaagcgcgcttttgaagacgacaattcgataataagtggatgtcatatcaattagagtggtaccgcgggcacgtctcgtctcttacatgtttttaaatatgtgagggactttttttgtcccgtaagacaatcaaggaggacaatatggattataaacaactcgtcgcagcggccttagcgccagcactaccagatttaacgcaggaagtgattctagataagatcgaacaaccaaagacgtctaagcagggggacttggcctttccgaccttcaccttagccaaaacgttacacaaggcacctcaaatgattgccatcgacatcgtcgaaaaagtcgatggcagtgactttgaaaaagttgttgcaatgggcccgtacgttaacttcttcttcaagaaagatgcgtttgcagccgatattttaaatcaagtgttgtcgaatggtggccattttggtgatgctaagctcggtgaagcgggtcaagttcccatcgatatgtcatcgccaaacattgccaaaccaatctcaatggggcatttgcggtcaacagtgattgggaattctttggcaaatattttaagtaagttggattaccaacccgttaagatcaaccacttaggtgactggggcacgcagttcggtaagttgatcacggcctacaaaatgtggggaagcgaagctgaggtcaaggctgatccaatcaataacttattaaaatactatgtacgtttccataaagaagacgtcgatcatcctgaaatggatgacgaggcgcgtgaatggttcaaaaaattggaaaatggtgatgaagaagccacccatctgtggtcatggttccgctcagaatcattgaaagcgttcaagaagatttaccaacgcttggatatcgactttgattccttcaagggtgaggccttctacaatgataagatgcaagaagttgtcgacatcttggaagacaagcacctcttgcaagaaagtcaaggcgccgaagtggtggacttaagcaaatatgacttgaatccggcattgattaaaaaatcagatggcgcgaccttgtacatcacgcgggacttggccgctgcgatctaccggaaacggacttatgatttcgtgcagtccctctacgtcgttgggaatgaacagaccaaccactttaagcaattaaaggctgtgttgaccgagatgggctttgactgggctgaccagatccaccacattccatttggtttgattacttctggtggtaagaagttgtcaactcggagtggccgggtcatcctgcttgataaggtcttggacgatgcggttgcgttagctcatgaacaaatcgaagccaagaatccggacttgcctaacaaggatgaagttgcgaatgcggttgggattggcgctgtggtcttccatgatttgaagaacgaacggatgaacagctttgactttaacttggaagaagttgttcgtttcgagggtgagactgggccatacgtgcagtacgcccatgcacgcgctgaaagtatcttacgtaaagctggtagcccagaaattgcggcaaccgagcaaacgttaagcgacccagccgcttgggataccttgaagttattgagtgaattcccagcgactgtagtacgtgccagcacggaatacgaaccatccgttattgctaagtatgcgatccacttagccaaggcatacaacaagtattatgctaacaccaaaatcttagttgaagatgatgaattaaacgctcgtctggctttggtcaagagtgtcagcatcgtcctgaaggaagcccttcgcttacttggcgttaaggctcccgatgaaatgtaattagaattaattaacaactgttcaaatttgaacgccacgcatactaaaccggccgttaaagccgggcgagaatgcgtggcgtttttttgttgcggccgtagaggcacggaactcgatatacaaccgatggcgaacgcaagttgtgaaccaatcgcagaaatcgcaagtaggtagcggaggcccactattgtaactggaaccagacttatcgtgtgaagtggattatcagtcgacggatcaaggctttaccgccccggccgagtaaaataagcccgattaacggccaagatagtaacaataggcacccatgaatgacaaaggaaacgctgatcgacatcatatcgtcacgatattcattctgagagagcaacatatcacggctactgacgggattgacggcgttatgataaatttgagtgattgtttgatgttgaccggtcgcatcattcaaggcacgtgaagcgactgaaatcatttgaaaagggttatgggtaagtcgtggcaataggcacattaggagtggatggccgaagaagtatgcagaagtcagatagaggttggttaacgtccaatgtaggtgaaaacggccgctgggatctgcggtgacggcataaaaagcaatcacgaaaaaaatcgcgcaacgaatatagtcggaaccgattaagctgaaagcctttttcatggttatccctccgtttgaggcttggctgtgttttcttcagataaatgctcaaactgggttgcgggcgtcatgatgcttacaaatgaccgcccatccgagttagtgaaaccaagcatgatttatgtctgattataagtcggtgtgatgatcgaaacaaacattaaaatcttaataaggcaacttccaatactaaaattttaatgacctgtttagtcgtccggggtggtattctgaaaactaattcaaaatgccatattgggggcttggtgatgagctacttagaactaacgaatatttgtaagaactatcaggttggcaaacaaacattcaacgtcttgaaggacattaacttgcagtttgaactcggtgagtttgtggcgattgtcggtgaatcaggtggtggtaagacaaccttgatgaatattattgggggactagaccatgatttcacgggaaccgtcagtatcgctggacaaccacttgattatcattatgagcgccagctggatcggtaccggcgcgaagtcattggctatatctcacagacctacaatctaatcggtcatttgaccgtgcttgagaatgtcatgctagccttagatatgactaaattaagccatggtgaccgattgcgacgggcacacgagctcctagcaaacgttggcttgacggcacaaataaaaaaatacccgcaacaattatcaggtggtcaaaaacaacgggtggcaatcgctcgagcattagccggtgatcctaaaattttgattgcggatgagccgactggtgcgctggatgcagacaataccgccgatgtcatggccatgcttcaaaaaatcgcacgggaagggcgcttggtgatttgtgtgacccattcacagcgcgtggcgggtgcggcgacccggattgccgagttggtgaatggacgaattaagtcacaaccagtgaccacccaaaatgtcggcaccacgcaaacagttgcgtcactacctgcgcggccactttcgtattgggtatcagtcatgatggccttcaagcatatgcggcatacgtggatctggaatacgctaattgtcgttggcacagcgattggattattcgccgtcatgcttttcaatggtctggggaccggcataaaagggtatattaaccacgaaatgaatgcgttggtggacccacaatcaattatggtcatgcaccaagcggataacgcgaaggatcgtgatgaacaggctgcggccgtctatgatccagctgtagccggcggtatcgcagcccggatgccggtgttcaccgactcacaactcacagcgttgcgtgaccttaagcacgtgaccaacgtggaacccgggatttcagctacaaacgcaacgattgcgattggacaacaaaagtatgccgcacctgaactgacgacctggacgagtagtgatccgacccggcagttgaaagcaggccacgtggcgggtgacaatcaaatcgtattagataagtcttcaatcgcgcagaaatggtcggcaacgcgttggcgtcagttagtgggtcgggctgtgactgtgagttatcaaaccttcaatcaaaaagggcaacccgtgaccgtggcgcgcgtgttgacggttgccggaatagtagatagtacctctgaggtcggtttgaatgcagttaactacaccacgatgcagtcgatgcgttcagcggcacgtgtctcaacacaaccaacgtttgtgagcgttagaattaagagtcgggtgcaaaatcaggtcgtggtaaatgaaattaaccacttatcaattaatggcaagcacccatttgccgcgactagtattgcggccactttggattcgttcaatacttacgttaatattgccactaaagtgttggcggcgattgcggggatttcattaatcgtttccgcattaatgattattgtaacgatgttcatgtcggtcagtgctcggatgcgagaaattggtattctgcggtcgctgggggagcgccggcgtgatattcgccggctatttactagtgaagcgctgatgttaggcattatcagtgccacgttagcgactgggctgtcctatttagctgaacgagggctcaatcatggtctggctaagctaactggcgggtatgcgctagttcagattcagctcggcaacgtaattgcaattattatcgcctggcttgcggctattttaccagcaaggcgggctgcgcgggctaatccgatcaaagccttggccgctgaataacaagtgattggataattgtcgtgatggaaaagttatgttaaccagtcaacttgtttgaaggagtggttaaaaactgtgcgagatgtcgcaaaatagtcgttttattcaggggtgggggtcattaattcattagggctggtattaacgacagcagccagttctaatattggctcgcccagggtacgcagaaacttctgattgagaaaagtaaattagctcggctaggttctgcgttactagtcgagctaattttgattaatatcttctggtcttaggtaactggggatggttatttggcagttagcgtgtacttgagacgtcgatgatggttctttacaaaccggtgctagttagttaattgacataactaaacattattagtaaaaactaatttttgagaagataagtagcaatggcaaaattcaattgtatccgtttggtagattgtaaaatta

SEQ ID NO: 82 - DNA, 7848 bp, Lactobacillus plantarum
aatttgcaatctaccttttaaataaaaatttttgcgtttctatactggtatgtgttatcgagaggtcggattctttatgaaaaaattaaaatcatttgaggtgctttctgatgaggaggctaaattgataattggcggcggacattgctatacggcggggtgtattcggcgtagagataagcctcggaattcagatagcttttttccgggattagcacatggtatttgtcaaggagttggtatttgcggatgaaaccccttttttataaaaaaccatcgttttatgtgtttattttattttcactgttcttaggtatttcattggtatatcggagagattggtggattacaatccctcttgtactagtagttttaatacaaggatatagaacaattagataatcataaatataagtggaagtttgccaaatggtgttgaaggatagaaactatccttcaacaccatttgacaaacttccaaaaaaacagcctcagttgaagcactgtgactaaaaaccaaaaacttgtcactctttctactacagtaaaggatactttaggctatcttccaaattgtacagcagaacaaattccattggttgccaagaaaactgtccctcgcagtagtgctccaaaggttttttggaatcattttgtgaatttcgttaatgaaaaactctaaaattttactgacagaaaacttgtcagaaaattaactcacaaaaaaagccgtcaatttactgacagcttttttatcatcctttagattttacaattgcaagtaaaattgcacctgttacgaacagaacaatcccaattccaacataaaccaattcttttttggttttcttttcaccaaggaagagaattcctccaatagttgaaatgataacacctaattgtgagaatgaaaaggcaattgcgtcaccagcagcgcttgcagccataagcataaagatattacctacagcaaacattactccatcaatcatattttgataaacatatttttccattttaattttgaaacgacccatcacaagtgctccaaagatcattccaactgacattggcaaggtaattgtcagtgtatcaaaatgaacattgaaccaaagtactgctaagttattaaaaagaataacatagctaacatatcccaaagttgagtaagttaaagcagtcaatcctttagtataattacgtccttctttaacaactgcattttctgggtcacgtttagctgagaaatagaacccaactaccaaaacagccatcgcaataaatccgagaataaattgaatttgttttgtccattcgtggaaagcaaaaaccccaagcaatccaccaattactaattgacttcctgatgaaagtggactcgctactgaaacacccatgtatttcattgatttaaactgaccaaattgtccaattgcccaaagcaatccaccaataaatccaattaagaaaatttgccatgtcaacgttggcatgcggaataagaaaacaataagtgcaaaaacaaaagcgcccaaagtcattccaagtgtttgttgattagcatcaccaccaaatttattagctaccaatccgatagaaccccaagcaaaaattggaacaagcgcgaaaagaattccttgcatgtttatattcatctctttaaaataattttttacacaaaaaattaagcaatatctctattttactattttttcaagaaaaaacaagagataaaagaatacacaataaccataattgtggctctacgtcaactggtgttgaagaataaatttatcatttgaggcggttctccatttggggagccgtctttgtcatgttatgccgtgatttggtagattcgtttgaagaagttcagctgattcttgaagccaaaacaggatcgtttgagtgacttgatgaggcggttaatcccttcgatcggaccgttggaataagggctggtgacagcggcgagaacagcgactttgtgtcgcttaagcgtcgcgatggttctgttgcaaagttttccaaaaaatctattttagtgtaaaattgagaaaaaagacagagaggacagagtaatgaatcattttaaaggcaaacaattcaaaaaagacgtcattattgtcgctgttggttactacctgcgttacaatctaagctatcgtgaagttcaggaattgttatatgatcgtggaataaatgtttgtcatactacgatttaccgttggtgcaagagtacagcaaagtcctctattatctttggaagaagaaaaatagacaatccttctattcatggaaaatggacgaaacctatatcaaaattaagggacgttggcattatctttatcgtgcaattgatgcggacggcttaaccttagatatctggttacgaaagaaacgggatacgcaagcagcctatgctttcttaaaacgactccataaacagtttggtgagccgaaagcaattgtgaccgataaagcaccttctcttggctccgcctttagaaagttacagagtgtgggtttatatactaagacagagcaccgaactgtgaagtatcttaacaatttaatagaacaagaccatcgacctattaaacgacgaaataaattttatcaaagtctccgtacagcctcttccacgattaagggcatggataccattcgaggaatatataaaaagaaccgaagaaatggaacgctcttcggcttttcggtgtctactgaaatcaaggtattaatgggaataacagcctaaaatatttggagttcagagagggcacgtttgattttcaaacttcgcaacagaaccgctgttataaaaatttttagtggaatttttataacagctctttatatattttgaaattaaaagggtggaactatgttccactctttcgattgcataagtcccgattgctaaatgtaactaaaaaattattaattgcatagttcggaaaaaaattctaattcaaattatttatcaaagaataccattagttcctgatataaatcatatcttttgataaataatttgtcttattcaccagtcccttccagagggccctcctgcttaattgcatcggctttagtggtttcgttagttcctttttggtgcttaactggtgaataaatagagaagaccttcatggtctgttttccagcgttgatcacgttatgccaagtgttatcgggaacaattacagcctctccgggatgaatttcctgatcaactgttaaatgatctttatcttttcccattttaacgtggccaataccggctactaagtaaataaattgatcattaccatgatgaatttccataccaatatcaccacctccggctggaatagccattaatgtgatttgaaaatgatccccggtccacaaagtagttcgataattttcattttccaaggcagccaattttaaatcaggtgcaaaaggtgctggaccgtagtctcctaaatctgcgtttttttctaacataatgaacacttcccttctaggtagaattgtaacataattttttattatttgatatcattttaagagcactaatgttatcagttaatttaccaatctgagttctagtgactaatagccaataggattgtctaaaaagtgaagttgttcaattaattaatttcggggcttggttaaagtatgggtatccactcagtttccataacttctacgtgcaatcgtccagttaactgctggccggtattaggaactaattcactggcataaacggctaaattgcgcacggcctgaccagtccaattttggcggaataaaagactctacaattttaagtaccgatgttaaatccatcagtacttaaaattgtagagtcatttagcttctaaggatgttacggtaatcggaaaagtgaattcatctgtgcctggtcaatatcaaattacgtataagtacggtccagacaatgtttcaaagacaattacagtcacggttaaaggtggtagcacttccggcggtggtagtacgaatgataataacagctcaaccaatgggtcaaataacaactcaaatggtaatataaattcaggttcagataataattcaaatcaaacgaccaatcctggcgagaccactgataccaatggtagtactagtgtgacaccagaaatcggtaacggtcaggtagccgtcaaaggtgaatcggtttatgctacgaagaaaattggattatataagaaggctgattttaagcgtaataatcgagttaagttgtattcaaaggctaagcggattaaccgtcctcagttcattgtcaagggataccagcgggacaatgcaggtaaactgagatatcgcgttcaacaatataatccgtatacccgtaaatatgtaaagggaaccaaaggatatatcacagcgagcgctaaatatgtcattcctgtttattaccgctcaactcctaagagcaacaagataacagttatcaatcgtaaggggcttaattcttatcggaagacttttttaacgcaaaaggtcacccattataagaagggtgctttattaaaggtcaaaaaagtgattaaatataaattggcgacccgttatcagttgactaacggccactatatcacagccaacaagaagtttgtcattcagaaataggctgttagaaagtcaagttttgacaggccaattaccattttgggaatggcgatcagtgtaaaaaatataccaagcgttttgaggagcaactatcaccttgaaaatgcccggtatattttttattgggttgctaaatgatttttgaatgaacggctggctagaaaatatggtttcggatgtaattgaatattaaatagaattacaagtcctgaaaattaacgcatattaaatatttaattgcatattataacgtttgtccattagtgttagttcctcgtattttgacgatatcagttcgaactttttactttgagagaataattttgtaaaatccccaaatgacctattgccatttttgaacttttaatctatccttgatttgcagcaaattaacaagacggtaccggatcaggcaatgaccggtataatcaaaggaagggactgtcaagttatgaacttgttgacgattttagttttctgcgtgttaagtattttgattggattagccatcgagggctacacttattgggagctgggtcacagcgccagatcaaggccaagttgaatcgataaccatattcatccataataaataataaaatgaaatgatgaatgattgaaagaagcgtcacgattaaccggataaacgttaatcgtgacgtttctttataaatatgagtaatgtcgatccgaaacatggcctggtttcttagccgggataagtatccgtttcgtcatcaaagtcatgctaaggttatcgattaaccctgccacttttttctaaaatagttgaattttccaaaacatcatcgggaatatcaaaaatcgttgcttcaataacatagtgttgaatatgttgatgcgcaatatgctaaggcctggttgaaataggtgaaaagttgactaatgttgccagtcagagtggtggcgtagtgaatttcgcttggctctaagcctaccttttcagccaagttgacgatttcttgaatttcattcatatagtcatcgtcaccaaaggcgtagaaagcatatttgcactggactgggaagtctggtagatcagtaatcgttaatggttttatggattcattagcaaaatgatcggcatccttatcaccgcgacagcctttagaaaaggtgagttcaaaagccgtctcggtgttttctttatgagccaattggcaaagagtttggacaacattgatcacattttcctgacgaccacgatacgttgtcccaacgctggtggtttttgaccaaaccggcaatccagctttattgagtgtttgaatagcctgctcaacggtgtggctggcatctgaactcattgagaaaatgtctaaattgcagccggtaatatctacggagccgtcaatgttacaacttgtatcaattttcattacttctaacgatgattaattatccctgcgtcgatactaatcgaatcaggttcaatgggtataatctcagcacatggcaccccaaaatttttgttgtctaaaatgataagacgttaatcaatattagtcaaacccatttaatattaatcaaggaattaagactttgagtgggatgaaagcgatgtgatatcatctaacaattttctgaaaaagttttgaaaaaatactgatgtcagaagatataacgtgtataataccaattaagggaaaccaaaaagatttatttagacatcccaaataaatgctatgcaggaggctttcgatcgatgaagacaattgatgatattcgcaaattagctaaagatgaagaggttgaatacataagaatgaccttttctgacctgaacggtgctttgaaaaatgttgaaattccgatcagtttattagatgaagcacttgaaaataaaatcaaaattgacggatcttcaatcactggatttctaccgattcaaaattcagatatgtacctgcaccctgacttaaatacatggactatttatccctggatcaccacgggtgggaagacggccgcactgatttgtgatgtctacaatcgtgacggtaccccatttgctggtgatcctcgtttcgttttaaaacgactaaatcaatcattgaccgatattgattgtggccatctaaatgttggtgccgaaatggagtacttcctatttaaagcagatgaatctggcaaaccaactgacactttgaatgatcaggcttcttattttgatgtttatccagatgataatggtgaggcttgtcgccgagaaacggttaatacattgaaacaaatgggcttccagattgaagccgatcatcatgaggtcgcaccgggtcagtgcgaaattgattttcgatttgatgacgcggtctttacggctgatcgaattcaattgttgaaattagccaccaaggcgattgccgttaagtatggcctgcgggcaacctttatgccgaaaccaaaagctgggatgaatggttcggggatgcatttgaatacgtctttgtttaaggatggcaagaacctgtttgatgattccaagggtagccacggtctttcttcactggccctgaattatttagccggtattttagctcatgctcaagcctttaccgcgattaccaatccaaccattaatagtttcaagcgattagtcccgggatttgaagcgccaacctatgttgcttgggccgtggataaccggacagcattggttcgagtccctgatggtcgtggtccggcaacgcgtttcgaattacgaagtggcgatccctctgctaatccatacttggcaatttcggctttgctagcttctggattagatgggattcaacgtcaattaacgcccaataagaatgttgaagacagcatttataacatgacgccagaacaacggaccgatgccaaaattgttgaattgccaagctcattgccggctgcactggctaatttgaaaaatgatgatattttagctaaatctttgggaagtgttgtgccaaagtatctggaaattaagcaggatgagttgaccaactatcagatgagtgtcactgattgggaaaagaagacttattttaatgtttaatgctgggattaggcaggcatgaatcctcggtgtttaattaaacgtgagtttgcgatattgttaaaatgcgtaaataaataatgaaagttcgtttaaaataaagtattgtggtagattgcaaatttaatccgaatttttggacaaatttg

SEQ ID NO: 83 - DNA, 7319 bp, Lactobacillus plantarum
gcaattggcacccagccccggaggtcggcataggacgcgcaccggctgacggaaaataatgcagttaaacagtttgttttaaccataattcatgtcaacacgcacaatagatgtcaaagtaagacactggttagattaagtggtgtttgatgctgaagagttgacgattgcgttccagatgacggtgaatgtgatcgatgaggacgtcgtgcgaccaatcggtagttgtgttaagtggcggaacgggaaaacgttcatcgatatcgattgtcggtggcgtgatggcacagttggcgactagggcgatggcgaggctcgtaggtgtgtgctggtacatgaggtcatttcgaatcgcaaacctgatgtgctgctggttggctagtttaacgtagcgattcaggatgtcttcatctagcaagccatgtaggagtagctggtaatcaggatgggccgccatttcactttttagttcggttgagtagtcacgcatgagtgcttgggtgaaagtaatgcccacatcgattcgttcgtgaaacgtgccaaggttacggtgttgttcatccggatgtagtacgggggccccgaatattgcggattgtaagtgtttatccatttggtcttcagaattagccatgccagtcaggtcctttcacaattaaccataaaatttaactgcttttactactatcgtaataaagaaagcgctttaatcaacataaaattttctaaagctgatcagaagttaaaactttggatgccactaggcttgaaacggatgacagataatctaaggacgcaacggatttgccggggccaatttaatgctgttttgaaaacaaggactcagtgcttcataaaataacgaaggtgcccagaattaggaaagttgacttcatcggcaaataacgaatattcaaggccattttgggaaaagccagcctcggccagataatctcaattataatctaagtaacggtcagggctaattcaacaaattgataataaggttactaatatatcaataaactgattaaagcagtgtgttacttaatgattaaccaggctaaccttaatccttgtcagcattgacttacggctgattatacaagccttttttttaagattgtaaaggtgtattattgattcgtccatggtatgatactacatagtatgttagtaaagtagtcaatcaaattaaaagagaaacggatggtaacaaatgccaagacatttacggaaacggcgccggtcctggacgctgatcataattgccatggtgcttttgggggtcattggatttacaagcacacaagtttctgactggattgatgcatcgtttacaactaaacaaacggatgcagctaagtctagttcccaaacgaagcccaagtcggtcaatcaggtcaagttggacgtcccgctagtgaatcaaatgacaacaccacgtttatacaatggttgtgaagtcacatcgttaacgatgttgatgaattacgcgcatatcaatgtcactaaaaatgaattagcggcaaagattacgagtgtgccactcacttatagtgacggcgaacatgggaatccagagtatgggtttgttggggatattactggtaacgatcctgggttaggtgtctatcataagccaatctataaattggcgaaaactgagactagtcaggtgaaggacttaacgggggcaaactttgatactgtgattgaacagttagaacaaggacggcccgtttggacaattacgacggcttcgtttgcaccggtcagcacgatgcaaacttggcagacaccacagggctccgttaaagtgacttatgatatgcacagcgtggtcattgttggctttaaccggactaaaaagttgatttatattaacaatccgtacggagaaaaacagcaggcagtcagctggaagaattttgaggctgcttataatcagatgggcaagcaagccattgttctgacgttaccacattagttagttaacaacatgctattgtgaaccaattagtttaagcaactaatcttggtcaagatgagccaaaatcttgatgaggattagttgctttttttgtggcggtattttcgaatgaaacggttgtaatatcccgtggtatgggtagttcgggcaccggaaagcgggtgagaaactgctaacaatatcatgattgtaaccaaactgtaattcaaatatcagcctttccagagttgttcataatattaaccataaaggggcgacgctttgttaacaagctgtaactgaattgaaatcgaattgacgccccagcccattaaaaatggcctattattggtagtataagaatgttaaagttatgggtatgtcataaactgtccttgacagtttagttgttggtgattgtgggaatcaccaacaacttatgatgataatttttttaattgcggagcacagtatggggagagggaccgcatgatggggattaaaaggctcagttggttagttggaacggcggtggtcgccacacttggcatgcaaattacggttcaagcacagggacacgcggtggtcgatatttccgagtggcaaggacagctcagcccaagtcaggtgcaggcgatgaagtcgcaagtgctatttgtgatcaatcgtcgtcagtatggtttaaattatgttgaccgggacgcagcgaataatacggcattatatgttcgttatgggattccatttggtgagtatgatttttcgcaatttacggatgccgctagcgcgcgccgtgaagcccaagcgttttatgcgcgctccaataaagctgcgcgtttttatgctttggattttgaagttaatacggtacgtttaggatcaactaatgcggcagttgcggcttggtatcgtgaaatgcgcgcattgactaacaaaaaactgatcttctattcgtatgcttcgttcgcactgacgtatgccaaccaagcgcggcaacggtttgatgcccagtggattggtgcgctaacgcccaacccaccaatcatttcggcggcgttatggcagtataccaatcgctatcatttagctgggctagcggcaccggttgataatagttgggtcattactagtgttcatcccgtttcgtggtggttggggacgacccgtggcgcacccggtgttgcgattaaagctcaaccaagactgaaagttgtgcacgatcgccatttgactatgccggcccacaatcaacagcatggacgggtgggccaagcagttgtcgccattaagaggccagcagttcagccagctgtgaagactcggccggtgcagcagaaagtggtaagcaataagtcgcgttcgcagaccgtggcgcgcgtcaaacggcggtcattgcaaacgatcagtgttaacagccatcatggcaaaataactcagcatcgcgccattcgacgccgagcgactcagcccaaagtgataaaacttaaagcgacgcgacgtacaggaacacagtttaaactgaatacgtccaaagcaactaaacttcggcggcccggtaagagtattcgaacaaaaccggtgactcgttcaaaagggcgaacgcggcagcgacttacgcgacgtcaaccgtcactgaggcagcgagtaacgaaaaacaggcaatcccgccgccgcgcactacgagtaacggtgcagcggcgagggtcgacgattcgtcgtgcaccacgttggcaacgaacacaaatacgtcccgtacataacacttctcgggacaagcgaggacttagctgattgcatggctgtcgctcagttctcattatcatggtagaaaaggtaattatggttaagtaaaatcggtcatttgttgtagaaattaggaggatatttttcatgaactttaagcgcaaaattcaattaggaatcgccactgcaactgggatgttggtggtcggaattgttgccgtaccttcagtaacgaatgtattacacgcggcttcagacagtgttagtttggttagtcagacggcagcgcctacgaccgtcaaggcaaccaatcaaacagtcaaggccatcagtgcaagtgggaccaagggaaactaccgggtgaagtacgccaaagctgggactagttcgacgactgcgacgtatcaacagacgaactacaatacgaaaagtgatgccagcagccaagtcgattacttagcgaatacgcagggtcagcgtacgacacttaattcaggtacagcggcaacggttcaagggacgatgggcaaagtgtatgttcattggaacacgggtagttggtcagtgacaacgattgccaatacacaggacgttgctggtaatccaaccaagtttgctaatcaggtcaataatcagattcaaaagcaagatttgacgagtaaaaatgtcacgagtggtgccgttaccgtgtacgataccccacaaaacggacaggcaaactcagttcaatggcaaaatggcaaacaggttgctaaggttcaaggccagcaagccaataccgttatcaaaattgcggcggatgctaaaaattaagtttttacctgggagctcaataaatgagtgccagtagtctggttatatcactgtgtcgacgtcaaccgcattcacaagccagacactatggttagattagtgggtttaatgcgatgttttgaccgaaaataggattgacttttggcagtggagtgcttatgatgttaggtaataattaaaaagtagtgatcgttaattagtagtcgttgacccaacagtctagcgactcggtgggtggtgcgaaccgagctgtggtcaaagatgaattacataacgtgaactgccattggccggatgatatccgttactaatcaatgagcgatcacatttggtgataacttgggtggtaacgcggaaaactcgtccctgttttgatgacaggggcgagtttttttgtccagcgacaataacgaggaggactaacatgaacattatcgatgatttaaaatggcgtggtgccattaaccaacaaacggatgaggccgggttaaaggaacttaccgaaaaccaatcagtctcactatactgtgggattgatccaaccggggatagtatgcatattgggcatttgattcctttcatgattctcaaacgattccaattggctggtcatcatccctacgttgtagttggtggtgggacgggtgctatcggtgatccatctggtaagaactcagaacgtaagttacagaccatggatcaagtgaagcataatcaggatggcttaagtgctcagatgtacaagttgtttggtcatgacgaaaacttttcgattgtgaataactacgattggttatcaaaaatttcattactagatttcttacgcgattatggtaagttgttcagtgtgaacacgatgctgaacaaggaagttgttgcaagccggttggaagtgggcatttcatacactgaattcacataccaaatcttacaatcagttgacttcttacacttgtaccgtgctgaacacgtgcaactccagattggtggggctgatcagtggggcaatatcaccgcggggaccgatttgatccaccgcttagaaggcaatgacgctaaggcttacggattaacaattccattattgttgaaggcggatgggactaagtttggtaagactgctggtggggccgtatggttaaaccctgaacggacatcaccgtatgaattctatcaattctggatcaaccaggatgatcgagacgtcgtcaaatacctcaagtacttcacgttcttaagtcatgaagaaatcgatcgattggccgaaacggtgaagactgcacctgaaaaacgggaagcacaacggcgcttagctgaagaagtcacggaatttgttcatggcaagcaggcggtagttgaagctgaaaatattactaaggcgttgtttactggtgatgttcaaagtttaacggcggacgaaattgaacaaggtttcaagggtgtgccatcagcagacgtctcagctgaaaagcaaaacattgtcttgtggctggttgatgctacgaaattcgaaccttctcggcgtcaagcacgtgaagatattaaaaacggtgcgattcgaatcaatggtgaaaaggtgacggatgtcgaggccgagattgatccgtccgcaacctttaatggtaaatttgtcattgtacgtcgtggtaagaaacgttacttcttggcacatgttaagtaagttaatttagcaggtggactggacccgttgtggcccagtctttttattattattacaagtaagaactggtgtaaaatttatttaggtcacattaataatgtgtgatcattgccagatgaaaatcaattgaggagatgaaagttttggtgggggttaaatttaatacacggacgattgcaatcctggggatgttgatcgcacttaatgttgttatttctatctttttccatatcccaatcccgatgacacacggttatattaacttatgtgatgcgggaatctttattgcagcactgatttttggctggcgtggtggggtcattgttggcggtgctagcggactattactagatttattgctagggtatccacagtatatgtttttctcactactcgttcatggtttagagggcggaatagcaggatatcttggtgctagcaaatcacatggtcgacagattgcagcgataattactgcggtagtggtgatggtggtcggatactttttgtcagattcgctgttgtatacgatggcaactggattggttggtgtaccgactaatttagttcaagctgtggttggtggtatcttggcattcccaattgttgcgggaattcgaccaatcgttaaacgtcatttgaatttttaaaattagatgtgctggcttaagataagcgttcgtcgtgcttttacgggcgcttttttgctgtctaaagggaatccttaattggaaaacatagtgccatctcacaatgatgttaatcgatgacatataatgtagtaattgtgtaattgacgacagttttgtgccgttcttttcataaaagtgaaaaaacattggattaattgttgacagtttcataactggctggtatattagtaaacgttgctgctacggcagatgcatctcaccaccaaataattattgaaattagttgttgacaacttcttcagtaattggtaagataatttctgttgtcgcaacggcaaccacgacaaattaatcaagttacttcttaaaaaaagttgttgacaagatattgattaagatgttatgatgattaagttgtgttaagcgattaacgcatggaattagatctttgaaaact

SEQ ID NO: 84 - DNA, 6872 bp, Lactobacillus plantarum
ttttcagacagtccctagtaacattttagcgtgtcacaacgaaccacttaattctgtaaactacctacttttaacgtgatacagctgaacaagaatagccccactagcttccgacccgaagtcgctgataacccagcgcggcaaagtagaagatacactcgattgcagcgatgaagaaactgactggtaaattcgtgacgtaactcaagtacagccccagccaaaccccaatcaacgcgaaaccaatcgctagaaaaatcatcttgctaaccgtatggacaaagtatcgcgctgccgctgctggtaacgtgagtaagataaagatcagtaatgaccccacaatttgggcagccacgctgacgctcatcgcaacgagtaccaagaagaccactgagatgccggtcgtccataagccgctcacccgggcgccaatcgcatcgaaggaatcaaatttgagtggccggtacaagcccaacatcacgagtaggacgatggccgataagattgcgacccggatgacatccgcactggcaatcccaatcacactcccaaacaggatgctcgtcgcataactcgaagtttgattagataacgacaggaatagaatccctaagccgataaacagagcggaaattgcagaaatcgaggcttcgcgtcgtgattgtttcacactcatctgccccacgatgaccgaactaatcacggtaaaaatcagcatcccactcaacgcggtccagcccataaaaatcccgaaggctgcaccggcaaacccaatttcagacagtgtgtgtgtcagaaatgagaggttccgggcaatcacgaaaacgccaatcgtcccacaaataattgcaataaaggttcctgctaagtaggcatttcgcataaatactaagctaaacattgacattagtggcctcctttaattgctctaccgacatatcagcgatattgccaaattgctggtggccgggctttaaggccagataatgtttggcgtattgcttcgctaatggcaagtcgtgcgtcacaaagaagacggtaatgttgctagtttggtttaagttctgaacgaggtccaacaattcatacttcatttcattgtccaaactagccgtcgattcgtctaaaattaatagctgcggttgttgcacaattgcttgtgctaagtaagcccgctgcttttcaccaccagaagccatcccaagcggtcgctgacggagtttcttcaaattggtcacggctaatgctgtcgctacctgacgatgttcagctcgagacagccacggctgccacccttttaggttcagcccgacaaagtcctcaatcgttaacggatactcctggtctaagttgcgaaattggggcacgtagccaattttaatggcttttttattcggataatacttaatttgaccggctgttggcttcagcatgccaagcaaggcgcgaattaaagtggttttccccaccccattctcaccaatcacggtcaaaaagtcaccttgttcaatgttaaaattcaaatctttaaacacctggttgtttggaaagccaattccaaggtgttggacggcaattaacggttccgtcataacactaccccaactttctaaattaaagtaaatcgtaatgattactattttagtttacctgaatgcggtgatttgtcaatacctgagttcaaaatgccgtaatcattaccagctgcggcaatcatcggggcctaatcaaataacaccttgaccactagttgaatgcgcttatcactaagacgagattgcaaaaaaaagaccgtttttaccattaagccggtaaaacacggtcaattcatgtttatcattactttaatttaaggtgcttaagccaaccccgcctgctcatgcaagaattcatccaacacttcttgatagcgatccgggtgcgttcggatggcttcaacgtgaccagcatcggggtcgatatacaggcccttttgttgtggtaactggtcgtacaaggtatgtgcattgcggacaggcaccgtctgatccttggaaccatgaatcatcaagatcggtaacccaccatcaatcacccgttgcagaatccggccatccttaaacccatagcccgcgcgaacgtgtgctaagcgattcgccaccggcataatcggataggctggcaagtggaacttatgagtcagtctgaacttcgcttcatcataaagatccgcataaccgctatcctccacaatagctttaacattctccggtaacggctcaccactagtcgccatgaccgtggcggcccccatcgaaattcccatcaatacgatgtcaatatccagacctaattgactaagcgccatcgtaatccaacgttcataatctagtcggtctagccaaccataaccaatcgtatggccttgactatcaccaaatgaccgggcatcaggcattaaaacgtcataccccaagctcataaagatgcgcgcatacggaatcatttgttcgcgcgaatgtcctagaccatgcgccaaaatcgccaagcggccaattgttttcggattagggatatatgttgccactaagttcagcccatcaaaggactggatcatccactgctgtttaggctgcttgaaataccaaaaattctcaatttcagtgttttctgcccgcgaacgttcgcggccctgctgcttctgtgcgtcactcacgtgcatcgcgacttgatacgccgctaagccaccaagtaacgttcccgcataagttgcagcaccaatgacgcccgccaatttcaatccaaattttgtcgactgcttcatccgaacacctccgttactccttatttaatcataaacgcgcataaattgcttacaaaaagagattgcgttgtccgaataaccgatgatgcgttgaaggcaacgaccatcttcgtgtgtcaacctgcaagcaaagccgcggctactcgcattccggtgccaattgcactgctacaccatctctggctggacacaggtcgtgatgacaaatggctcagcgctaccgtttaagcgtagcagtaaattagagactcggctcacctaaccccgtaccaataaaaaaagcccaccatcacggcggactactacggtctaatgttcatttaaattaactggccgcacaaggtatacttcccgacaaaaacccttcaaggaattatacacgcgttgcgcccgcgattgtttgcgacacacaccgaacacagttggtccggtgccgctcatctgggccgcatccgccccaaacgttaacaattgccgcttgatctgtaaaatctcggggtagcgttttgccgtgattggctctaaaacgttgcccatattcgcaaaaatctccgcgaaatcctgctgttgaataccagccaacaaggcctcaatattgggatgctggtcgatgcgctcgtaattgacctgccgcaaaatatttggcgttgacacactgactttcggcttcgcgagaataatccacatcggcggcaacttaggcagtggggtaaccacatcgccttttcccgtcacgtgggccgtctgactgtagacacagtatggcacatccgaatctacttgcaatcccaaacgtgctaacgtggctaagtccaagtggagattccacatccggttcaagccccgtaaaacagcggcggcatcagatgagccgcctcctagaccagccgctaccggaatggcctttcttattttgatacggacaccccgatcaacatgacaataccgttttaaaacactcaccgcttgaaaagctaagttacggcgatcattcggcaaaaagccactatcggtgaccacttcgattcggttcgtatgcaatgattctaacatgacatagtcggccagatcgaccgacgtcatcaccatgtcccactctttatccccatttggatgttcaaataaggtatccagtcctaaattgattttggccggtgctttttcaacgatctgcacgcgtctcaccctcttccatgaccgcgattacccggggtcgctgacttactttgatacaattatactaatatcaaggcaaaataaaaagaccttgcttgggggtcttaatattgagaattcacgagacgcgaattaagcttcagttgtttcatcatcaaaagcgatttgaacgttctttgtcagaacatcagtataactgtaggagacccgttcaaatgcgttttcttgttgatctaaatccacaacgaacaccgaacgataagtttctttcaagataccgtggcgttcagttgttttcttacggccagcctgggcaacgaccttcatgcgttggccgatccgtgagtcaagtttatctttaattgcagctagtgaaattggcattgagaatcctcctcatgaaagacactatactagcttttcacaaaaaagtcaatattatatcacaaggttttctaatgtgcaaccattttataagcatagataacttaaagtaagtcagcctgatgtaacgcatccgtcaatgtaataaattcatcgaccgtcaaccgttcggcacgaatcttgggatcaatcgtcgcgatatcaagagcctgttgaatggccgtcttcgtctcaggttgtttaccaaataggctttgcaaattattccacagatttttccgacggtgcgcaaagcccgctttaacgaccttgaaaaaagctgcttcgtcaaatggcacgtgtgtccgcggtggcaatgccgtcaatttcacgattgcagaatcgacattcggtgacggcacgaaaaccgtccggggaacgaccatcgccatctcagcagccatccggtactgcacagcaatcgttaacgcaccatacgccttcgtacccggttcagctgccaaacggtcggcaacttccttttgcatcatcacaacaatattttcaaaagcaacgtcccccgccaaaatgttcatcagaataggcgttgtaatataatacggtaaattggcgacgagcttcaacggccgctcgttatctaaatgttcactgatcatcgcggctaagtcggccttcaaaatatcttggttaacgaccgttacattgtcataatcagctagtgtctcatccaaaattggcagtaaccgatcatcgatttcaaaggccaggacgtggtgcgcatcccgtgccaaatactcagtcaaggcgccgatcccagggccaatttcaatcacgtcatcattggttccaatgtcagcagtggcaacaatgttgtgtaacacgttctgatcagttaaaaaattctgtcctaaactcttcttaacttgtaacccgtacgtatgcataattgcccgtgtgcgggcgggattcgcaatatctaaatctctactcatcatttctcctctgtggttagttggtcaacagccgcccaaaaatcagctggctgaatttgaaatagttgtaaccgtttgggcagctgtttaccgttgacgtatccgatacctaaacgttcacccaactgttcgcgtcgttgacgcgccgtgggacccgctagtaagcccgccgcaatcaaatcatggtgactgatcaactgttggggctcgtcgatttgctccgtatatagatgggcgagtgcagtttggatcgccgctgggctcgcgtgttcaacgcccaggctccccccagccttagttggtacaccagctttgcggggcaaaaaggcgtgcttgacacccggaacagccgccgaaatcgtcttccgaatacgttcaccggaaaagtctgggtcggtgaacacgatcacgccgcgactggcctgcaacgttttgatctgggctaaggtggcttcggaaatcgccgagccattcgtttcaagtgtatctgcatcgacagctagggcgagacgcttcgtgtcatctttcccttcaaccacaattacttctttaatctttttcaatcttaaaaaattcctctgcattttgataagtttgggccgctataatttccggcgtcgtttcacgtaacttggcaattgcttcaacaacgtaccgcgtgtaaccgggttcgttctgctttccccggtatggttccggcgttagataaggggcatccgtttcaaccagcatttgcgttagtggcgtttgcttgacggattcatggacttcacgcgcattcttaaatgatgcgacaccactataggaaatatgcatacctaagtccaagaaccgtttgagccactcagggtcaccattaaagctatgcatgacgccacccgtgttacgaatatcagctgctttcaagatcttataggtatcttcgaaagcatcacgattgtgcacggaaattggcaattgcatctctttagcaatggcgacttggcgggcaaagacttgccgctgaacgtcttgtggcgacgtatcccaatggtagtccagtccaatctcacctaacgcgacgactttcgggtgttggacttgttcaatcaacaacttttcagccgcctgatcatagtttttggcatcttccgggtgccaaccaacaatcgcgactaactgaggatacgtttccgccagtttaatcgcatcggcgttcagttgtgtattcgaaccaacgattgccatccgcgtaacatcaaggtcagccgcttgttgtaagtaacgtggcacttcctggatgaattcttcactatttaaatgggtatgagaatcaaaaatccgcatgtaataaccccttttcgacttttgttatcttagttgattttaccatgggacgcaagttttcggaaaagaagacgggccatccaacctatttcttgcaaactaataacgacatactagtcattagccataaaaagaggctgcactaggcaccctcttaactaactatattctaactagggtccgtcttaaaa

SEQ ID NO: 85 - DNA, 6587 bp, Lactobacillus plantarum
agcgtcaacgataataaaggaagttaaagctgaacgtccttggtaagttcgccgagcaatgacaatttttttaaaacttgttccaataaagaatcagccgtaggctcagctttagttgaccaaattttgtaatagttgtaagctgaccgccattctgggaaatcaccggggacttgacgccattggcaaccggttttcaagacatataggaccgcacagaagacctcgtagaggtcatattttcgaggcttagttcgcttacgaaaattttctaaagctggtcgaattaattcaaattgttgccgagtaatattgctgggataatttttcatagcttaaatagattgtaaaataaaaaagatataacttgtgccaggccgataagatacaaaaacacataggacattgagaagctagcatagaaaactatgtgttgcattttagggtctataactatcaaatcgcccctcgaaaacgttgaaagaataacccccaatatctataatgtagatattgggggttatttgtcattatatgccaaaaataacttcttctatttgtcatcaatactaaacaataatttgtacaaagtgattatttcttctagttcttcacgcgatacatgatcgacaatagtttcatcagtgacatgtcttgcccgtaaatctaaggctatggtttgatctaataatacttttccatatactgtttgactactagttagtcgatgatacattggaaaattacgcttggtactgctaattggagccacaatcgtcatgttacttgtctgacagactagatcattgcttagcgcaatcgctggtcgcttattcatctgttcatgaccacggcttggattaaagttaacataaaatatatcaccttggcttaccattgaagttcattaccttctgactttccccaatcaagctcgtgatcccttttcccgtcatcttgccaatccttaaatagttcgtgaatattggttgggttcttttttattggtgttaaaacaattgatccattttcaatggttattgtcatatcttggttatcatctaatttcagttgtttaataatttggctaggaattctagcagctttcgagtttccccactttgctaagcgtgtttgttctttaataagttccatattttcccctcctaaattattattacaagtcaagtatatcccgtgtagatacacaatgcaaatattcttactggaggtcatttacatgcaacaagttgtcttacccataaaagattcaaacgttcttaaagaggttcaagatacgttactcaataactttaaagctggccgacgtaactatacgatttttcaagttggtaaagctacgctactgcgagtgagtgacgttatgggtttaaaacagaccgatatttttaatctggacggttctattaaacaaaatgcgttcattcatgatcgaaaaactggtaagcctaataccttgtaccttaaaccagttcaaacagaactcttattgtatcgtcaatggctgcttgatcataaactagcatctgaatggctctttccttccattcaacacccagatcgccatatcactgaaaaacagttctacaaaattatgagtagggttggcgatctgttaggaattaattatctaggtacccatacgatgcgcaaaaccggggcttatcgtgtttacacgcaatcaaattacaatattggcctagtaatgcacttactaaatcactcaagtgaatcaatgactttagcttatttgggcttggatcaagcaagtacagaaaacatgttgaaccaaattgattttggataaattggtttgattttgttgtcgccaacggcgacttctaatacaggttttttgggggttatcacaacatataatttattctatgtataagtgcgcattgacctcgtttcactcggtctgctgataaccataaaatcaatttctgctgttgttgaattgaatgtatttttaattaaattatgcttacacttaactaatcttgttatgatttaaatttttgcagagattctttgtaaacttagcaacaaaattttacaatctaccttaaggccctcatttccctttgggtctaatgatttccaaatagaaaacaacgaacatagtgaggccttagcaaacacaatactagtcaatacccaatttacaatagtgattcgaaagttacgaacgtcagtgagttactctaggtaagtgctttagcacttactatatataatatgaacaaaggtaattcacaaactttacactcacataaacgctcatatatcaacgttatcaagccactaactagcgggataaatatttcacaaaagaatagtgcacaatctatatatatatctatatacataattgccaagcagtcacacgtcataacacattgtatagccctgttaaaatgacttctaagcgactttaagctgtatcgcgtataattataccaagactagctaaaacgtcttagaatgtattttaaagtagttatttaatgttagcatacaaaacaggctcgtcaaattaatgacgggcctgtttgtatgctggaattttcacactattatgaagtggatgtgtcattatgtcggagacacaagcttgattatagcactatgcaaacttggtgtaaaaacaaaaaaatgagcacccgggtaagtgctcaccaagaagttgtcacattgaaacgaaataccatgagtcccgactaataggacaactttattttagatcattctaattaaattgcaacttaaaaaaagcgactatctaaacagatagccgctccccaagtaatatagatagcacacattattataataacattaaaattgacatagtaaaaaggtctatccagttaagggaagacctttttattttgcggtatgttactgagagtagtgtgcaatgtcatgtcatacagcacaaacgtagtatagcattattaacgctagttgcaaccactagagtagttaaaaaagcctattcaattgagaatagaccttactgtaaacacgaaaaactaagttttgagtttattcctgaacacactttttaagtatagaacacacattaataacattaaaaatagtataataaaaaggtctatccaaactggaataggccttttatcgtgctcagtcattatcagactgttaaatgattgaagggttactaagtaacttgaccgagcacatatcgaagtacacatacttaacgatgactgagactagcaaaacttgttaggagtgtttgcaactaccagagttagttttcattatagcactattttatgctagttaacataacacatagtattcaaagctaaagtttgtgaagtgtgtaaatccttgttatatcaacgatagcaagctatatatttaccgatatcatacgataacgatactttgtgaaaatagagtaaatttgtaaatgctaatataccagtattttacacttgtgaaagtttattattctacgtatgtaagttactttgtgataatgacgtttcatatataattgtccgaaacatgtcggcttagaacccgcctaggctgagactatataatattaatagtgtgtctatcgttagtagttagttcttaacgtcttgtggtctacgtgactactagtatattaaataacaccttaagtctagcaccaacccgcacgcatagcggtgcttaaaccatcaagggtcaagcccttaggctctctcaaacagttatcctaatcgtgaataactgcgcttcttttgcagtataaagagagaactctttatcagacaatttaagctcaaccagcccttgcactaactattattagagttggttttagcagcaacccgaataatctgcgttaatagttagcctgtccgtatcatttcctagtcttccagccacgtctttagtcgcgttgatctcgacaaggtttagcatacctatgttgttaactgcaagcggggtcacgaacgacactcacgggaggttttactagctaagaacaggtttccagcctttagttgctttgatggttgctaaccattgaataacaaaaaaaacggttgctatcaggtttctgttaagattcccgataacaaccgtttactttaagtatcaatggttgaaaaacttagcctacatgttataatagtaccaagttagatagcttgtattggtagtacttgctatcgaaaatcttatcaggttgtgctgataagtcgtgaatcctaactctgctaagttgagggttctttttttgcgttcatttattaagttgagtacattataaccgtaatataagattaatacaacctttatcattttaacgtctcaaccagccgaataagccttttttaagcgttttagtttcttcccccttgtaatgatccccagtgggttctaaaacgtctgtatcgtcctttgaggcgtcctcgctggtcttttgtggggcatcgagtagcttttcattttgacggttagtggataagtttaattgctgttgctgatcaagtaacttgtgggcttcgcccaaagattgctgaagcttttcgatctgcttatccttttcaaccaattgcttttctagcaactccattgctgtatccgtgacgctatcgtgtgtaacataattactgtaacttacactctcgttacttacaaccctgttactacttaaaaaatgctgttttaaaagcttgtatccatcatcacttatcgtcagcttgcttactccgttactatgtaccttacttacatacttacttctaaatttatcgtccatttttcgcatgatagcttgccttgtaacaccaaactccattgtaagttgtttcatagtcttactcatgttacttacaccccctaattttactaatattaacatagttaatcatggtaaacactgaacgagggcttagaatgcgtctctcacgctccgtgcgtggggcatacgttcggaaaattctccaatagcctagcagttggccaatggattttgtaataaaaaatcgcatgtttgaatttttctaacagttttccaacatttttataacagacacattccggcattgtatatttaggcaaatccctatatataaggaatataacaatatatatatatttatatatactatatagtttgttagaaagtaagaaaaaagtccccagaaaaaaattatttttttcttaggaacctcgatatttttctaacattcttacaaccgttgcgggagtaagtaagaatcgtgttaggattaaattttattttctaactttctaacattttgttaagtgaatgcggtgcttttgtcggtaataatatagcactgctggcggtattttacaactctttcattggtaagccaaaaatataacaaaaaaagccactgtttccagtgacttaatacttgtgtgggacagtgactgttaaccatattggttagcagtttttttgtcgatatgaaaatattctttgggtgcgccattcggctttccttgcttccaatgactttttgcagaaccatacttagttggttcaggattaggactaatcgcaacaaatcgacgcccaactgaatccataaatatgattatccgacgatattcttcagttggtgtaatcaacgtacagttttcatgcttaatgccataaacatctgtaaagtccatatttcacattgctttcccgtatgtttcagtgccataaaataaaaaactgccttattacaaagcagtttcatcagtatcaaaataaattattgtggaacaacattcgttgcttgagggccacgatccccttgttcaacttcatagcttaccttttgaccttcatcaaggcttttaaacccatctgtttggattgatgagaaatgaacgaatacatctttattatccgaaccggtgataaatccaaagcccttatccgcgttaaaccatttcacagtaccactttgcatatacttatattcctcctagaaactaaatcaaagtaaccagccgaattaacatctaagaaaattatagatagcaagtttaatgatacttaaaacttccgaatatgttaaccgtgttcagtatatcacagagttcgaagatagtttaatttaaacacttcaagtgcccggttctttaagtagttaaacttgctgacactaaccgataattgattacaggcttcgttgcggttgaaacgtttctcaataatataatcatgtaggataaattgatattgcggatcatcaattgtattgagggcgtcttcgacttcttttaactggtaagataagtcaacatggtttaccaggcggctttcagtgccgtttaggctactatgactggatactccatcgaatgagggactagaaacttggttaaaagttgtcaagtcacgttttagtttggcatattgttttaataaattacaaatcttcttaacatcttgacgcattagaatcacactttctaatcccagatatatgtataaaaaagcggggctattacaccccgttccgactaatatcaacacaatgaatggtagattgcaaatttaa

(The sequence listing continues in the following parts.)

The invention claimed is:

1. A probiotic formulation comprising at least one food-grade substance and at least one probiotic bacterial strain comprising at least one polynucleotide that has at least 95% sequence identity to:
   a polynucleotide sequence selected from the group consisting of SEQ ID NOs: 177, 183, 188, 205, 207, 219, 244, and 248, and/or
   a polynucleotide encoding a polypeptide with a sequence selected from the group consisting of SEQ ID NOs: 261, 267, 272, 289, 291, 303, 328, and 332.

2. A probiotic formulation according to claim 1, comprising at least one further probiotic bacterial strain.

3. A probiotic formulation according to claim 1, wherein the concentration of probiotic bacterial strains ranges from about 10 to about 50 weight percent and/or about 1 E+6 to about 1 E+12 colony forming units/ml of formulation.

4. A probiotic formulation according to claim 1 that is formed as part of a tablet or that is contained within a capsule.

5. A food product, a formulation for food enrichment, a food supplement, a nutraceutical formulation or a pharmaceutical formulation comprising a probiotic formulation according to claim 1.

6. A container with a liquid volume between 0.5 and 50 ml comprising a probiotic formulation according to claim 1.

7. A container with a liquid volume between 0.5 and 1000 ml comprising a food product, a formulation for food enrichment, a food supplement, a nutraceutical formulation or a pharmaceutical formulation according to claim 5.

8. A probiotic formulation comprising at least one food-grade substance and a probiotic bacterial strain *Lactobacillus plantarum* TIFN 101with accession number CBS 138100.

* * * * *